US007396979B2

(12) United States Patent
Alexandrov et al.

(10) Patent No.: US 7,396,979 B2
(45) Date of Patent: Jul. 8, 2008

(54) NUCLEOTIDE SEQUENCES AND POLYPEPTIDES ENCODED THEREBY USEFUL FOR MODIFYING PLANT CHARACTERISTICS AND PHENOTYPES

(75) Inventors: Nickolai Alexandrov, Thousand Oaks, CA (US); Vyacheslav Brover, Simi Valley, CA (US); Peter Mascia, Thousand Oaks, CA (US); Ken Feldmann, Newbury Park, CA (US)

(73) Assignee: Ceres, Inc., Thousand Oaks, CA (US)

( * ) Notice: Subject to any disclaimer, the term of this patent is extended or adjusted under 35 U.S.C. 154(b) by 0 days.

(21) Appl. No.: 11/172,740

(22) Filed: Jun. 30, 2005

(65) Prior Publication Data

US 2006/0057724 A1 Mar. 16, 2006

Related U.S. Application Data

(60) Provisional application No. 60/583,621, filed on Jun. 30, 2004, provisional application No. 60/584,829, filed on Jun. 30, 2004, provisional application No. 60/584,800, filed on Jun. 30, 2004.

(51) Int. Cl.
*C12N 15/82* (2006.01)
*A01H 5/00* (2006.01)

(52) U.S. Cl. ............................ 800/290; 800/295; 435/6

(58) Field of Classification Search ....................... None
See application file for complete search history.

(56) References Cited

FOREIGN PATENT DOCUMENTS

| | | | |
|---|---|---|---|
| EP | 1033405 | | 9/2000 |
| EP | 1033405 A2 | * | 9/2000 |
| WO | WO03013227 | * | 2/2003 |

OTHER PUBLICATIONS

Keskin et al. (Protein Science, 13:1043-1055, 2004).*

Guo et al. (PNAS, 101:9205-9210, 2004).*

Thornton et al. (Nature structural Biology, structural genomics supplement, Nov. 2000).*

Database EMBL [Online]Jun. 14, 2002, "*Arabidopsis thaliana* clone 40252 mRNA, complete sequence," XP002385217, retrieved from EBI accession No. EM_PRO:AY087999, Database accession No. AY087999.

Database UniProt [Online]Oct. 1, 2002, "Hypothetical protein," XP002385218, retrieved from EBI accession No. UNIPROT:Q8LA65, Database accession No. Q8LA65.

Database Geneseq [Online]Oct. 18, 2000, "*Arabidopsis thaliana* DNA fragment SEQ ID No. 71025," XP002385219, retrieved from EBI accession No. GSN:AAC52337, Database accession No. AAC52337.

Database Geneseq [Online]Oct. 18, 2000, "*Arabidopsis thaliana* protein fragment SEQ ID No. 71026," XP00238220, retrieved from EBI accession No. GSN:AAG55399, Database accession No. AAG55399.

Sivamani et al., "Improved biomass productivity and water use efficiency under water deficit conditions in transgenic wheat constitutively expressing the barley HVA1 gene," Plant Science, Limerick, IE, vol. 155, No. 1, 2000, pp. 1-9, XP000983688.

Jeanneau, M et al., "Manipulating PEPC levels in plants," Journal of Experimental Botany, Oxford University Press, GB, Vol. 53, No. 376, Sep. 2002, pp. 1837-1845, XP008013190.

Dewaele, E et al., "Metabolic engineering of a complex biochemical pathway: the lysine and theronine biosynthesis as an example," Phytochemisty reviews 2002 Netherlands, vol. 1, No. 1, 2002, pp. 125-133, XP002385209.

Nam, H. G., "The molecular genetic analysis of leaf senescence," Current Opinion in Biotechnology 1997 United Kingdom, vol. 8, No. 2, 1997, pp. 200-207, XP002385210.

Murphy, D. J., "Engineering oil production in rapeseed and other oil crops," Trends in Biotechnology 1996 United Kingdom, vol. 14, No. 6, 1996, pp. 206-213, XP002385211.

Bock, R. et al., "Taming plastids for a green future," Trends in Biotechnology 2004 United Kingdom, vol. 22, No. 6, 2004, pp. 311-318, XP002385212.

Dai, M. et al., The rice Yabby1 gene is involved in the feedback of regulation of Gibberellin metabolism, Plant Physiology, 2007, vol. 144, pp. 121-133.

Sinha, N. et al., Overexpression of the maise hemeo box gene, Knotted-1, causes a switch from determinate to indeterminate cell fates, Genes & Development, (1993), vol. 7, pp. 787-795.

* cited by examiner

*Primary Examiner*—David H. Kruse
*Assistant Examiner*—Vinod Kumar
(74) *Attorney, Agent, or Firm*—Birch, Stewart, Kolasch & Birch, LLP

(57) ABSTRACT

Vectors, nucleic acid sequences and amino acid sequences that confer improved characteristic to plants, plant cells, plant material, seed of plants and regenerated plants comprising vectors, nucleic acid and amino acid sequences as compared to wild-type plants cultivated under identical conditions.

4 Claims, 578 Drawing Sheets

FIGURE 1

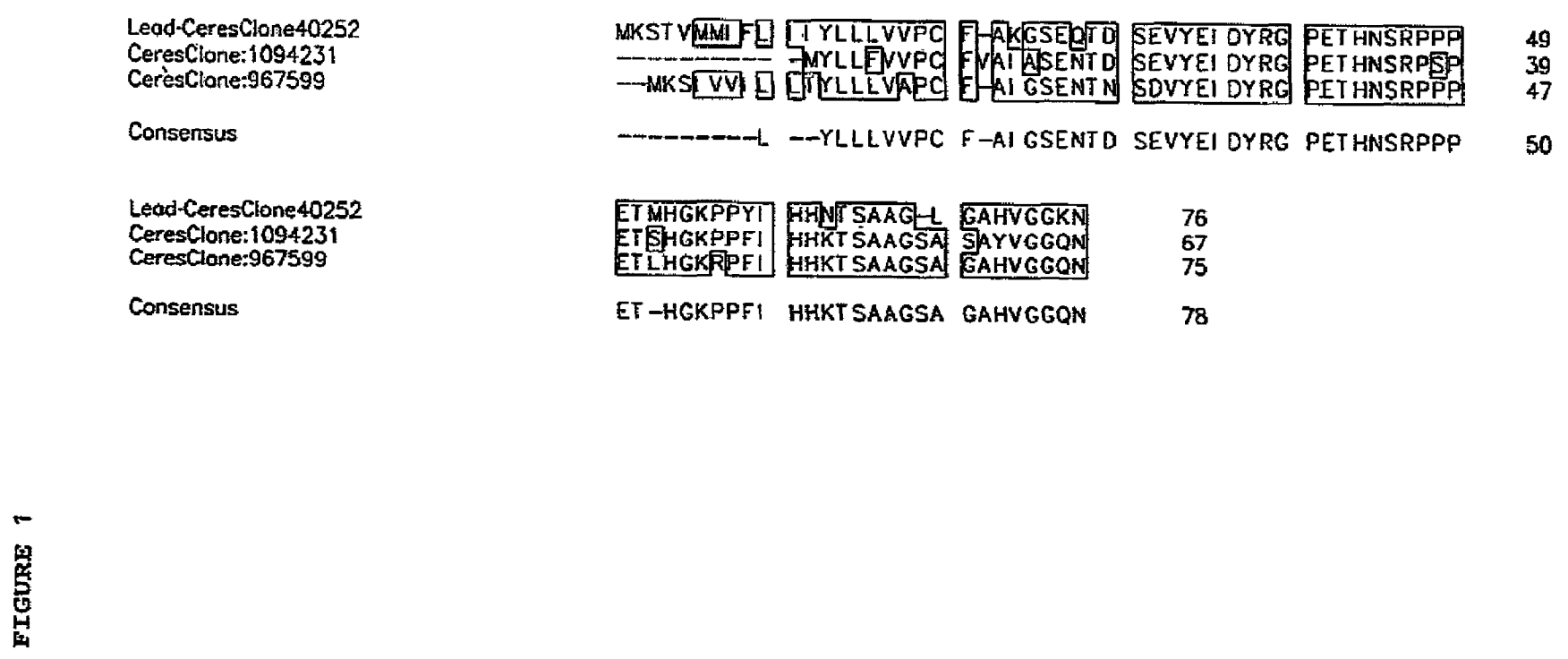

```
Lead-CeresClone40252   MKSTVMMIFL LIYLLLVVPC F-AKGSEQTD SEVYEIDYRG PETHNSRPPP   49
CeresClone:1094231     ---------- -MYLLFVVPC FVAIASENTD SEVYEIDYRG PETHNSRPSP   39
CeresClone:967599      --MKSIVVIL LIYLLLVAPC F-AIGSENTN SDVYEIDYRG PETHNSRPPP   47

Consensus              ---------L --YLLLVVPC F-AIGSENTD SEVYEIDYRG PETHNSRPPP   50

Lead-CeresClone40252   ETMHGKPPYI HHNTSAAG-L GAHVGGKN   76
CeresClone:1094231     ETSHGKPPFI HHKTSAAGSA SAYVGGQN   67
CeresClone:967599      ETLHGKRPFI HHKTSAAGSA GAHVGGQN   75

Consensus              ET-HGKPPFI HHKTSAAGSA GAHVGGQN   78
```

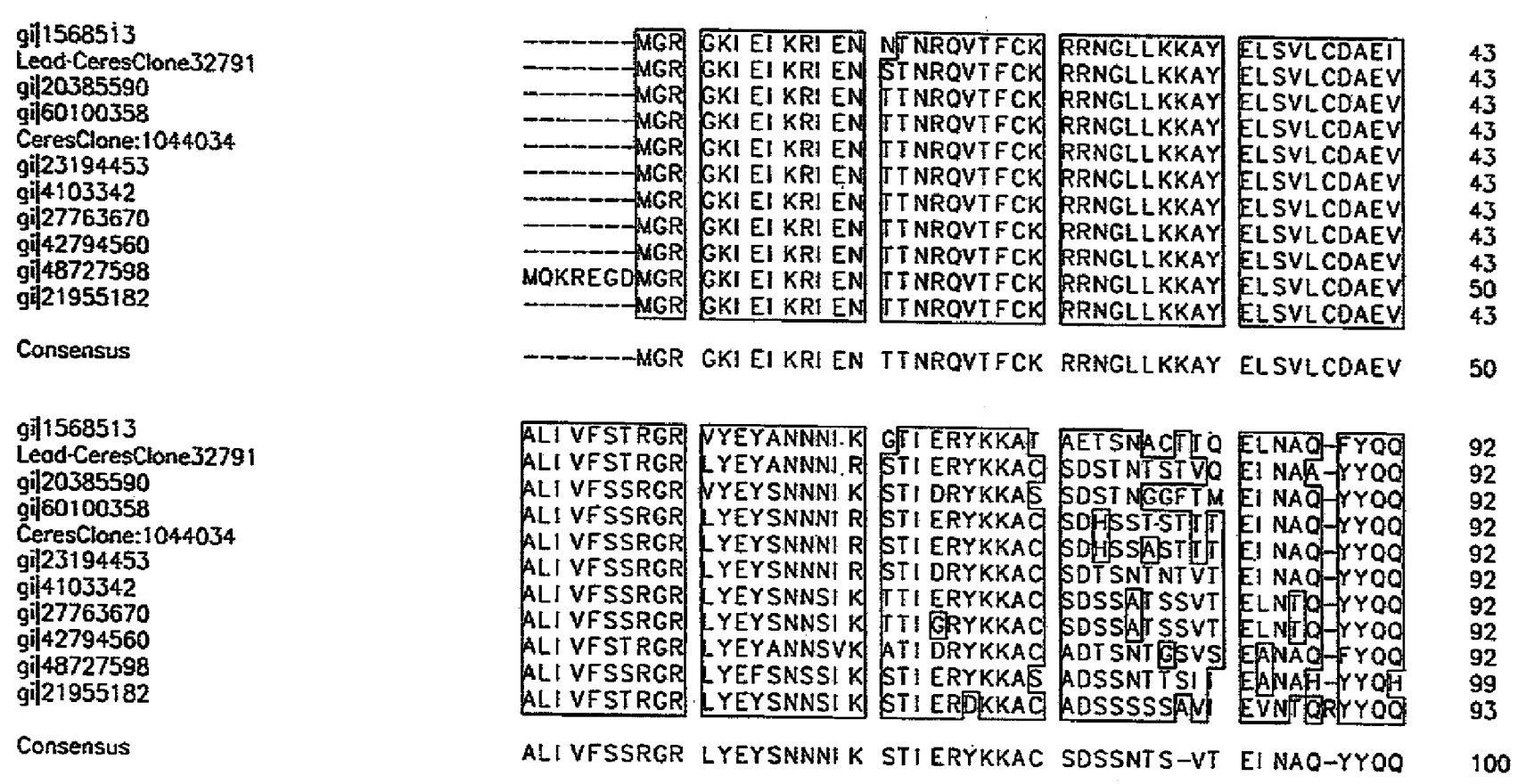

```
gi|1568513              -------MGR GKI EI KRI EN NTNRQVTFCK RRNGLLKKAY ELSVLCDAEI   43
Lead-CeresClone32791    -------MGR GKI EI KRI EN STNRQVTFCK RRNGLLKKAY ELSVLCDAEV   43
gi|20385590             -------MGR GKI EI KRI EN TTNRQVTFCK RRNGLLKKAY ELSVLCDAEV   43
gi|60100358             -------MGR GKI EI KRI EN TTNRQVTFCK RRNGLLKKAY ELSVLCDAEV   43
CeresClone:1044034      -------MGR GKI EI KRI EN TTNRQVTFCK RRNGLLKKAY ELSVLCDAEV   43
gi|23194453             -------MGR GKI EI KRI EN TTNRQVTFCK RRNGLLKKAY ELSVLCDAEV   43
gi|4103342              -------MGR GKI EI KRI EN TTNRQVTFCK RRNGLLKKAY ELSVLCDAEV   43
gi|27763670             -------MGR GKI EI KRI EN TTNRQVTFCK RRNGLLKKAY ELSVLCDAEV   43
gi|42794560             -------MGR GKI EI KRI EN TTNRQVTFCK RRNGLLKKAY ELSVLCDAEV   43
gi|48727598             MQKREGDMGR GKI EI KRI EN TTNRQVTFCK RRNGLLKKAY ELSVLCDAEV   50
gi|21955182             -------MGR GKI EI KRI EN TTNRQVTFCK RRNGLLKKAY ELSVLCDAEV   43

Consensus               -------MGR GKI EI KRI EN TTNRQVTFCK RRNGLLKKAY ELSVLCDAEV   50

gi|1568513              ALI VFSTRGR VYEYANNNI K GTI ERYKKAT AETSNACTTQ ELNAQ-FYQQ   92
Lead-CeresClone32791    ALI VFSTRGR LYEYANNNI R STI ERYKKAC SDSTNTSTVQ EI NAA-YYQQ   92
gi|20385590             ALI VFSSRGR VYEYSNNNI K STI DRYKKAS SDSTNGGFTM EI NAQ-YYQQ   92
gi|60100358             ALI VFSSRGR LYEYSNNNI R STI ERYKKAC SDHSST-STT EI NAQ-YYQQ   92
CeresClone:1044034      ALI VFSSRGR LYEYSNNNI R STI ERYKKAC SDHSSASTTT EI NAQ-YYQQ   92
gi|23194453             ALI VFSSRGR LYEYSNNNI R STI DRYKKAC SDTSNTNTVT EI NAQ-YYQQ   92
gi|4103342              ALI VFSSRGR LYEYSNNSI K TTI ERYKKAC SDSSATSSVT ELNTQ-YYQQ   92
gi|27763670             ALI VFSSRGR LYEYSNNSI K TTI GRYKKAC SDSSATSSVT ELNTQ-YYQQ   92
gi|42794560             ALI VFSTRGR LYEYANNSVK ATI DRYKKAC ADTSNTGSVS EANAQ-FYQQ   92
gi|48727598             ALI VFSSRGR LYEFSNSSI K STI ERYKKAS ADSSNTTSI  EANAH-YYQH   99
gi|21955182             ALI VFSTRGR LYEYSNNSI K STI ERDKKAC ADSSSSSAVI EVNTQRYYQQ   93

Consensus               ALI VFSSRGR LYEYSNNNI K STI ERYKKAC SDSSNTS-VT EI NAQ-YYQQ   100
```

| | | | | | | |
|---|---|---|---|---|---|---|
| gi\|1568513 | ESKKLRQQI Q | LLQNTN---- | RHLVGEGLSA | LNVRELKQLE | NRLERGI TRI | 138 |
| Lead-CeresClone32791 | ESAKLRQQI Q | TI QNSN---- | RNLMGDSLSS | LSVKELKQVE | NRLEKAI SRI | 138 |
| gi\|20385590 | ESAKLRQQI Q | MLQNSN---- | RHLMGDSLAS | LTVKELKQLE | NRLERGI TRI | 138 |
| gi\|60100358 | ESAKLRQQI Q | MLQNSN---- | RHLMGDALST | LTVKELKQLE | NRLERGI TRI | 138 |
| CeresClone:1044034 | ESAKLRQQI Q | MLQNSN---- | RHLMGDALST | LTVKELKQLE | NRLERGI TRI | 138 |
| gi\|23194453 | ESAKLRQQI Q | MLQNSN---- | RHLMGDSLSS | LTVKELKQVE | NRLERGI TRI | 138 |
| gi\|4103342 | ESAKLRQQI Q | MLQNSN---- | RHLMGDSLSA | LTVKELKQLE | NRLERGI TRI | 138 |
| gi\|27763670 | ESAKLRQQI Q | MLQNSNSNLV | RHLMGDSLSA | LTVKELKQLE | NRLERGI TRI | 142 |
| gi\|42794560 | ESSKLRQQI V | ILQNSN---- | RHLMGEALSA | MTVKELKQLE | GRLEKGI SRI | 138 |
| gi\|48727598 | EATKLRQQI Q | NLQQAN---- | RQLMGDSLSS | LTVKELKQLE | NRLERGLTRI | 145 |
| gi\|21955182 | EASKLRQQI Q | ILQNAN---- | RHLMGESLDP | LNVKELKQLE | TRLERGI TRV | 139 |
| Consensus | ESAKLRQQI Q | MLQNSN---- | RHLMGDSLS- | LTVKELKQLE | NRLERGI TRI | 150 |

| | | | | | | |
|---|---|---|---|---|---|---|
| gi\|1568513 | RSKKHEMI LA | EIENLQKREI | QLEQENTFLR | SKI AENERLQ | ELSMMPA-TG | 187 |
| Lead-CeresClone32791 | RSKKHELLLV | EI ENAQKREI | ELDNENI YLR | TKVAEVERYQ | QHHHQMV-SG | 187 |
| gi\|20385590 | RSKKHELLLA | EI EYLQKREI | ELENESVYLR | TKI AEVERLQ | Q--ANMV-ST | 185 |
| gi\|60100358 | RSKKHEMLLA | EI EYFQKREI | ELENENLCLR | TKI TDVERI Q | Q--VNMV-SG | 185 |
| CeresClone:1044034 | RSKKHEMLLA | EI EYFQKREI | ELENENLCLR | TKI TDVERI Q | Q--VNMV-SG | 185 |
| gi\|23194453 | RSKKHEMLLA | EI EFLQKREI | ELENESVCLR | TKI AEI ERLQ | Q--ANMV-TG | 185 |
| gi\|4103342 | RSKKHEMLLA | EI EYLQKREI | ELENENVCI R | TKI AEVERVQ | Q--ANMV-SG | 185 |
| gi\|27763670 | RSKKHEMLLA | EI EYLQKREI | ELENENVCI R | TKI AEVERLQ | Q--ANMV-SG | 189 |
| gi\|42794560 | RSKKNEMLFA | EI EYMQKREI | DMQNDNMYLR | AKI AENERAQ | Q-HMSMM-PT | 186 |
| gi\|48727598 | RSKKQEI MFA | EI EYMQKREV | ELQKENMYLR | AKI AENENAQ | Q--TSMV-PA | 192 |
| gi\|21955182 | RSKKHELLFA | ELEYMQKREV | ELQTDNMYLR | AKI GENERAH | Q--ASVVQAG | 187 |
| Consensus | RSKKHEMLLA | EI EYLQKREI | ELENENVYLR | TKI AEVERLQ | Q---NMV-SG | 200 |

```
gi|1568513              QEYNAF--QQ YF-ARNMLQL NMME--GGVP SYDPLPA-HD KKSLQLE---   228
Lead-CeresClone32791    SEI NAI--EA LA-SRNYFAH SI MIAGSGSG NGGSYSD-PD KKI LHLG---  230
gi|20385590             HEFNAI--QA LV-SRNFFQP NMI E--GGST G---YPL-HD KKVLHLG---    223
gi|60100358             QELNAI--QA LA-SRNFFNP PMI E--DGTS ----YPQOPD KKI LHLG---   223
CeresClone:1044034      PELNAI--QA LA-SRNFFNP NMLE--GGTV ----YPH-SD KKI LHLG---    222
gi|23194453             PELNAI--QA LA-SRNFFSP NVI E--HPSA ----YSHPSD KKI LHLG---   223
gi|4103342              QELNAI--QA LANSRNFFSP NI MEPAGPVS ----YSH-QD KKMLHLG---    225
gi|27763670             QELNAI--QA LA-SRNFFTP NMME--GGAV T---FSH-QD KKMLHLG---     227
gi|42794560             SEYEAMPPQQ FD-SRNFLQV NLLE--PNHH ----YSR-QE QTALQLG---     225
gi|48727598             QEFDAI--QT FD-SRNYFQM NMLE--GGAA ----YSH-AD QTALHLG---     229
gi|21955182             TEFDAL--PT FD-SRNYYQV HMLQ--AASH ----YSHHQD QTALHLGYET     228

Consensus               -ELNAI --QA LA-SRNFF-P NM-E--GGS- ----YSH--D KKI LHLG---   250

gi|1568513              ------    228
Lead-CeresClone32791    ------    230
gi|20385590             ------    223
gi|60100358             ------    223
CeresClone:1044034      ------    222
gi|23194453             ------    223
gi|4103342              ------    225
gi|27763670             ------    227
gi|42794560             ------    225
gi|48727598             ------    229
gi|21955182             KADPSA    234

Consensus               ------    256
```

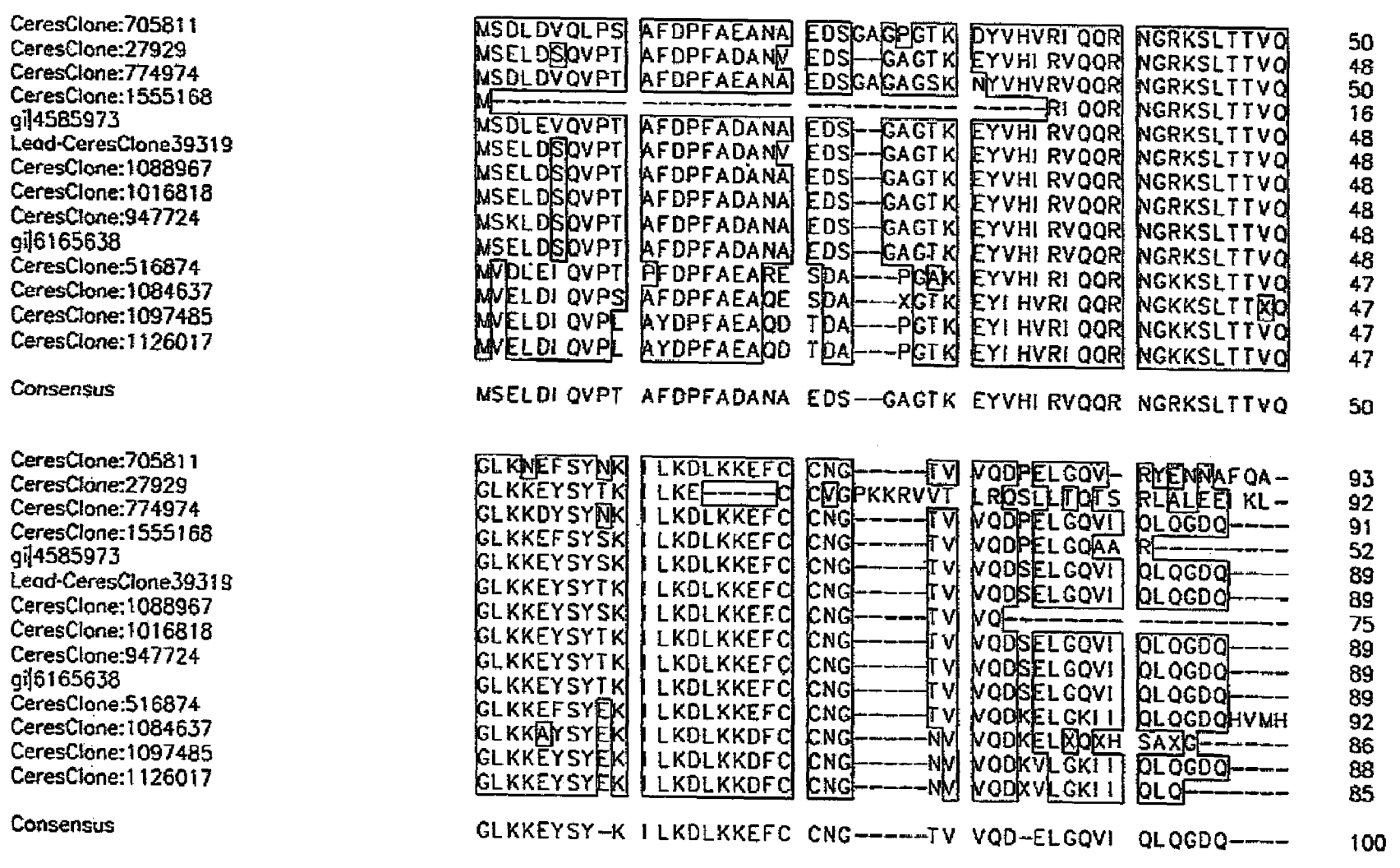

```
CeresClone:705811         MSDLDVQLPS AFDPFAEANA EDSGAGPGTK DYVHVRI QQR NGRKSLTTVQ   50
CeresClone:27929          MSELDSQVPT AFDPFADANV EDS--GAGTK EYVHI RVQQR NGRKSLTTVQ   48
CeresClone:774974         MSDLDVQVPT AFDPFAEANA EDSGAGAGSK NYVHVRVQQR NGRKSLTTVQ   50
CeresClone:1555168        M--------- ---------- ---------- -----RI QQR NGRKSLTTVQ   16
gi|4585973                MSDLEVQVPT AFDPFADANA EDS--GAGTK EYVHI RVQQR NGRKSLTTVQ   48
Lead-CeresClone39319      MSELDSQVPT AFDPFADANV EDS--GAGTK EYVHI RVQQR NGRKSLTTVQ   48
CeresClone:1088967        MSELDSQVPT AFDPFADANA EDS--GAGTK EYVHI RVQQR NGRKSLTTVQ   48
CeresClone:1016818        MSELDSQVPT AFDPFADANA EDS--GAGTK EYVHI RVQQR NGRKSLTTVQ   48
CeresClone:947724         MSKLDSQVPT AFDPFADANA EDS--GAGTK EYVHI RVQQR NGRKSLTTVQ   48
gi|6165638                MSELDSQVPT AFDPFADANA EDS--GAGTK EYVHI RVQQR NGRKSLTTVQ   48
CeresClone:516874         MVDLEI QVPT PFDPFAEARE SDA---PGAK EYVHI RI QQR NGKKSLTTVQ  47
CeresClone:1084637        MVELDI QVPS AFDPFAEAQE SDA---XGTK EYI HVRI QQR NGKKSLTTKQ  47
CeresClone:1097485        MVELDI QVPL AYDPFAEAQD TDA---PGTK EYI HVRI QQR NGKKSLTTVQ  47
CeresClone:1126017        MVELDI QVPL AYDPFAEAQD TDA---PGTK EYI HVRI QQR NGKKSLTTVQ  47

Consensus                 MSELDI QVPT AFDPFADANA EDS--GAGTK EYVHI RVQQR NGRKSLTTVQ  50

CeresClone:705811         GLKNEFSYNK I LKDLKKEFC CNG-----TV VQDPELGQV- RYENNAFQA-   93
CeresClone:27929          GLKKEYSYTK I LKE-----C CVGPKKRVVT LRQSLLTQTS RLALEE KL-   92
CeresClone:774974         GLKKDYSYNK I LKDLKKEFC CNG-----TV VQDPELGQVI QLQGDQ----   91
CeresClone:1555168        GLKKEFSYSK I LKDLKKEFC CNG-----TV VQDPELGQAA R---------   52
gi|4585973                GLKKEYSYSK I LKDLKKEFC CNG-----TV VQDSELGQVI QLQGDQ----   89
Lead-CeresClone39319      GLKKEYSYTK I LKDLKKEFC CNG-----TV VQDSELGQVI QLQGDQ----   89
CeresClone:1088967        GLKKEYSYSK I LKDLKKEFC CNG-----TV VQ-------- ----------   75
CeresClone:1016818        GLKKEYSYTK I LKDLKKEFC CNG-----TV VQDSELGQVI QLQGDQ----   89
CeresClone:947724         GLKKEYSYTK I LKDLKKEFC CNG-----TV VQDSELGQVI QLQGDQ----   89
gi|6165638                GLKKEYSYTK I LKDLKKEFC CNG-----TV VQDSELGQVI QLQGDQ----   89
CeresClone:516874         GLKKEFSYEK I LKDLKKEFC CNG-----TV VQDKELGKII QLQGDQHVMH   92
CeresClone:1084637        GLKKAYSYEK I LKDLKKDFC CNG-----NV VQDKELXQXH SAXG------   86
CeresClone:1097485        GLKKEYSYEK I LKDLKKDFC CNG-----NV VQDKVLGKII QLQGDQ----   88
CeresClone:1126017        GLKKEYSYEK I LKDLKKDFC CNG-----NV VQDXVLGKII QLQ-------   85

Consensus                 GLKKEYSY-K I LKDLKKEFC CNG-----TV VQD-ELGQVI QLQGDQ----  100
```

```
CeresClone:705811        ---------- ---------- ---------- --CKNGI CRL VDI LI CLSAA  111
CeresClone:27929         ---------- ---------- ---------- --KFI DI ASI  FGHCRFQI SL  110
CeresClone:774974        ---------- ---------- ---------- --RKNVATFL VQAGLAKKES  109
CeresClone:1555168       ---------- ---------- ---------- --YRSFSSRV I RGRTSRI SS  70
gi|4585973               ---------- ---------- ---------- --RKNVSTFL VQAGLVKKDN  107
Lead-CeresClone39319     ---------- ---------- ---------- --RKNVSTFL VQAGLVKKDN  107
CeresClone:1088967       ---------- ---------- ---------- ---------- ----------  75
CeresClone:1016818       ---------- ---------- ---------- --RKNVSTFL VQAGLVKKDN  107
CeresClone:947724        ---------- ---------- ---------- --RKNVS--- ----------  94
gi|6165638               ---------- ---------- ---------- --RKNVSTFL VQAGLVKKDD  107
CeresClone:516874        GATIJSAFEG TWHMVLVSPF PSAPPLLLTW LWKRQQQWRV EHGQLNAKPX  142
CeresClone:1084637       ---------- ---------- ---------- ---------- ----------  86
CeresClone:1097485       ---------- ---------- ---------- --RKKVSHFL VQTGIAKKDQ  106
CeresClone:1126017       ---------- ---------- ---------- ---------- ----------  85

Consensus                ---------- ---------- ---------- --RKNVS--L VQ-GL-KK--  150

CeresClone:705811        GHSAPR---- -   117
CeresClone:27929         EKMRFYNRVT K   121
CeresClone:774974        IKIHGF---- -   115
CeresClone:1555168       SRPAL----- -   75
gi|4585973               IKIHGF---- -   113
Lead-CeresClone39319     IKIHGF---- -   113
CeresClone:1088967       ---------- -   75
CeresClone:1016818       IKIHXF---- -   113
CeresClone:947724        ---------- -   94
gi|6165638               IQIHGF---- -   113
CeresClone:516874        VAVLDRGSIA E   153
CeresClone:1084637       ---------- -   86
CeresClone:1097485       IKIHGF---- -   112
CeresClone:1126017       ---------- -   85

Consensus                IKI--F---- -   161
```

```
CeresClone:554851        ---------- ---------- ---------- ---------- ----------   0
CeresClone:994766        ---------- ---------- ---------- ---------- ----------   0
CeresClone:246886        ---------- ---------- ---MAARPI S DSTAAFTI ET SVPFTSHLVD  27
CeresClone:297432        ---------- ---------- ---MAARPVS DSTAALTI ET SVPFTSHLVD  27
CeresClone:246807        ---------- ---------- ---MAARPVS DSTAALTI ET SVPFTSHLVD  27
CeresClone:293206        ---------- ---------- ---MAARPVS DSTAALTI ET SVPFTSHLVD  27
Lead-CeresClone41337     MALSRLSSRS NTFLKPAI TA LPSSI RRHVS TDSSPI TI ET AVPFTSHLCE  50
CeresClone:37506         ---------- ---------- ---------- ---------- ----------   0

Consensus                ---------- ---------- ---MAARPVS DSTAALTI ET SVPFTSHLVD  50

CeresClone:554851        ---------- ---MHYFKEM SMMRRMEI AL DNLYKAREI R GFCHLYDGQE  37
CeresClone:994766        ---------- ---------M SLMRRFEI AA DSLYKAKL1 R GFCHLYDGQE  31
CeresClone:246886        PPSRDVTTTP AELVTFFRDM SLMRRMEI AA DSLYKAKLI R GFCHLYDGQE  77
CeresClone:297432        PPSRDVTTTP AELVTFFRDM SLMRRMEI AA DSLYKAKLI R GFCHLYDGQE  77
CeresClone:246807        PPSRDVTTTP AELVTFFRDM SLMRRMEI AA DSLYKAKLI R GFCHLYDGQE  77
CeresClone:293206        PPSRDVTTTP AELVTFFRDM SLMRRMEI AA DSLYKAKLI R GFCHLYDGQE  77
Lead-CeresClone41337     SPSRSVETSS EEILAFFRDM ARMRRMEI AA DSLYKAKLI R GFCHLYDGQE 100
CeresClone:37506         ---------- ---------- --MRRMEI AA DSLYKAKLI R GFCHLYDGQE  28

Consensus                PPSRDVTTTP AELVTFFRDM SLMRRMEI AA DSLYKAKLI R GFCHLYDGQE 100

CeresClone:554851        SI AMGI EAAV TFEDCLI TAY RDHCQAYCRG DSVHQI IAEL MGKRTGSTNG  87
CeresClone:994766        AVAVGMEAAA TRADAI I TAY RDHCAYLARG GDPVAAFAEL MGRRDGCSRG  81
CeresClone:246886        AVAVGMEAAI TRSDSI I TAY RDHCTYLARG GDLVSAFSEL MGREAGCSRG 127
CeresClone:297432        AVAVGMEAAI TRSDSI I TAY RDHCTYLARG GDLVSAFSEL MGREGGCSRG 127
CeresClone:246807        AVAVGMEAAI TRSDSI I TAY RDHCTYLARG GDLVSAFSEL MGREGGCSRG 127
CeresClone:293206        AVAVGMEAAI TRSDSI I TAY RDHCTYLARG GDLVSAFSEL MGREGGCSRG 127
Lead-CeresClone41337     ALAVGMEAAI TKKDAI I TSY RDHCTFI GRG GKLVDAFSEL MGRKTGCSHG 150
CeresClone:37506         AVAI GMEAAI TKKDAI I TAY RDHCTFLGRG GSLHEVFSEL MGRQAGCSKG  78

Consensus                AVAVGMEAAI TRSDSI I TAY RDHCTYLARG GDLVSAFSEL MGRE-GCSRG 150
```

```
CeresClone:554851        KGGSMHFYRK KTNFYGGHGI VGAQCALGTG LGFALKYQKK PNVAI TMYGD  137
CeresClone:994766        KGGSMHFYKR DANFFGGHGI VGAQVPLGCG I AFAQRYRKE GTVTFDLYGD  131
CeresClone:246886        KGGSMHFYKK DANFYGGHGI VGAQVPLGCG LAFAQKYKKE DTATFALYGD  177
CeresClone:297432        KGGSMHFYKK DANFYGGHGI VGAQVPLGCG LAFAQKYKEE ETATFALYGD  177
CeresClone:246807        KGGSMHFYKK DANFYGGHGI VGAQVPLGCG LAFAQKYKKE ETATFALYGD  177
CeresClone:293206        KGGSMHFYKK DANFYGGHGI VGAQVPLGCG LAFAQKYKKE ETATFALYGD  177
Lead-CeresClone41337     KGGSMHFYKK DASFYGGHGI VGAQI PLGCG LAFAQKYNKD EAVTFALYGD  200
CeresClone:37506         KGGSMHFYKK ESSFYGGHGI VGAQVPLGCG I AFAQKYNKE EAVTFALYGD  128

Consensus                KGGSMHFYKK DANFYGGHGI VGAQVPLGCG LAFAQKYKKE ET-TFALYGD  200

CeresClone:554851        GAANQGQLFE AANMAALWKL PVLYVCENNH YAMGTSTARG AASTEYYKRL  187
CeresClone:994766        GAANQGQLFE ALNMAALWKL PVI LVCENNH YGMGTAEWRA SKSPAYYKRG  181
CeresClone:246886        GAANQGQLFE ALNI SALWKL PAI LVCENNH YGMGTAEWRA AKSPAYYKRG  227
CeresClone:297432        GAANQGQLFE ALNI SALWKL PAI LVCENNH YGMGTAEWRA AKSPAYYKRG  227
CeresClone:246807        CAANQGQLFE ALNI SALWKL PAI LVCENNH YGMGTAEWRA AKSPAYYKRG  227
CeresClone:293206        GAANQGQLFE ALNI SALWKL PAI LVCENNH YGMGTAEWRA AKSPAYYKRG  227
Lead-CeresClone41337     GAANQGQLFE ALNI SALWDL PAI LVCENNH YGMGTATWRS AKSPAYFKRG  250
CeresClone:37506         GAANQGQLFE ALNI SALWDL PAI LVCENNH YGMGTAEWRA AKSPSYYKRG  178

Consensus                GAANQGQLFE ALNI SALWKL PAI LVCENNH YGMGTAEWRA AKSPAYYKRG  250

CeresClone:554851        MPVPGIRFAA NNVFAVREVT KFAKEYSIKE GPICLEMQTY RYHGHSMSDP  237
CeresClone:994766        DYVPGLKVDG MDVLAVKQAC KFAKEHALEN GPI I LEMDTY RYHGHSMSDP  231
CeresClone:246886        DYVPGLKVDG MDVLAVKQAC KFAKDHAVAN GPI VLEMDTY RYHGHSMSDP  277
CeresClone:297432        DYVPGLKVDG MDVLAVKQAC KFAKDHAVAN GPI VLEMDTY RYHGHSMSDP  277
CeresClone:246807        DYVPGLKVDG MDVLAVKQAC KFAKDHAVAN GPI VLEMDTY RYHGHSMSDP  277
CeresClone:293206        DYVPGLKVDG MDVLAVKQAC KFAKDHAVAN GPI VLEMDTY RYHGHSMSDP  277
Lead-CeresClone41337     DYVPGLKVDG MDALAVKQAC KFAKEHALKN GPI I LEMDTY RYHGHSMSDP  300
CeresClone:37506         DYVPGLKVDG MDAFAVKQAC KFAKQHALEK GPI I LEMDTY RYHGHSMSDP  228

Consensus                DYVPGLKVDG MDVLAVKQAC KFAKDHAI -N GPI VLEMDTY RYHGHSMSDP  300
```

```
CeresClone:554851        GVTYRKKQEI DEYRKIKDCI TLVKQLIIDN KVATEEDLKE VERAIKKEVD  287
CeresClone:994766        GSTYRTRDEI AGIRQERDPI ERVRKLMLVH EFATAQELKD MEKEIRKQVD  281
CeresClone:246886        GSTYRTRDEI SGVRQERDPI ERVRKLLLTH DLANAAELKN MEKEIRKQVD  327
CeresClone:297432        GSTYRTRDEI SGVRQERDPI ERVRKLLLAH DLATAAELKD MEKEIRKQVD  327
CeresClone:246807        GSTYRTRDEI SGVRQERDPI ERVRKLLLAH DLATAAELKD MEKEIRKQVD  327
CeresClone:293206        GSTYRTRDEI SGVRQERDPI ERVRKLLLAH DLATAAELKD MEKEIRKQVD  327
Lead-CeresClone41337     GSTYRTRDEI SGVRQVRDPI ERVRKLLLTH DIATEKELKD MEKEIRKEVD  350
CeresClone:37506         GSTYRTRDEI SGVRQERDPI ERIKKLVLSH DLATEKELKD MEKEIRKEVD  278

Consensus                GSTYRTRDEI SGVRQERDPI ERVRKLLL-H DLATA-ELKD MEKEIRKQVD  350

CeresClone:554851        EIVEKVREDA YPDAKDLLKD VYIEDPKEPQ HIRGVEYDKS FAPRGLP  334
CeresClone:994766        AAIAKAKECP LPDPSELFTN VYVNDC---- GLESFGVDRK EVRTVLP  324
CeresClone:246886        DAIAKAKESS MPDTSELFTN VYKKGF---- GVESFGPDRK EMRASLP  370
CeresClone:297432        DAIAKAKESS MPDTSELFTN VYKKGF---- NVESFGPDRK ELRATLP  370
CeresClone:246807        DAIAKAKESS MPDTSELFTN VYKKGF---- NVESFGPDRK ELRATLP  370
CeresClone:293206        DAIAKAKESS MPDTSELFTN VYKKGF---- NVESFGPDRK ELRATLP  370
Lead-CeresClone41337     DAVAQAKESP IPDASELFTN MYVKDC---- GVESFGADRK ELKMTLP  393
CeresClone:37506         DAIAKAKDCP MPEPSELFTN VYVKGF---- GTESFGPDRK EVKASLP  321

Consensus                DAIAKAKESS MPDTSELFTN VY-KGF---- -VESFGPDRK ELRATLP  397
```

| | | | | | | |
|---|---|---|---|---|---|---|
| Lead-CeresClone314 | ---MAKPLGT | -TGEFFRRRD | EWRKHPMLSN | QMRHALPGLG | IGVAAFCVYL | 46 |
| CeresClone:13483 | ---MAKPLGT | -TGEF.FRRRD | EWRKHPMLSN | QMRHALPGLG | IGVGAFCVYL | 46 |
| gi\|21387015 | ---MAKPLGT | -TGEFFRRRD | EWRKHPMLSN | QMRHALPGI G | IGVGAFCVYL | 46 |
| CeresClone:481859 | ---MGSGSGK | HTGEFFRRRD | AWRKHPMLTN | QLRHATPGLG | I AVVAFGI YL | 47 |
| gi\|50909577 | --MAGKGLNA | -TGEFFRRRD | DWRRHPMVGN | QLRHATPGLG | I AI VAFGI YL | 47 |
| CeresClone:366717 | MASGGKGLNA | -TGEFFRRRD | EWRRHPMAGN | QLRHATPGLG | I AI VAFGI YL | 49 |
| CeresClone:696513 | MATGGKGLNA | -TGEFFRRRD | EWRRHPMVGN | QLRHATPGLG | I AI VAFGI YL | 49 |
| Consensus | ---MGKGLG- | -TGEFFRRRD | EWRKHPMLSN | QMRHATPGLG | I AVVAFGI YL | 50 |

| | | | | |
|---|---|---|---|---|
| Lead-CeresClone314 | VGEQI YNKAL | APSKSSHHHQ | EQTAPSH- | 73 |
| CeresClone:13483 | VGEQI YSKLM | APSSQS-SHQ | KQPAPSH- | 72 |
| gi\|21387015 | VGEQI YSKLM | APSSQS-SHQ | KQPAPSH- | 72 |
| CeresClone:481859 | VGEQVYNRLY | APDPHSI SHV | KAGDHH-- | 73 |
| gi\|50909577 | VGEAAYNRLY | RP-------- | -SGDHHHH | 66 |
| CeresClone:366717 | VGEAAYNRLY | RP-------- | -SGDNHH- | 67 |
| CeresClone:696513 | VGEAAYNRLY | RR-------- | -AGDNHH- | 67 |
| Consensus | VGEQVYNRLY | AP---S--H- | K-GD-HH- | 78 |

```
gi|55168209          -------MDG EGGGLAD--- LARAARAWHA PPPMEPSDDA CTVAAPAAET   40
gi|25992100          ----MAIMDE AANMVCVPLD YSRKRKSRSR RDRTKNVEET LAKWKEYNEK   46
Lead-CeresClone332   ---------- ---------- ---------- ----MEKSSS MKQW------   10
CeresClone:557009    ---------- ---------- ---------- --MDTCKKSP LKPW------   12
gi|27960757          -------MEG LQRSSST--- FRRKKRPRRS RDGPNSVSET IKQWKEVKQQ   40
gi|58700406          -------MER GEGRRGDCSV QVRKKRTRRK SDGPDSIAET IKWWKEQNQK   43
gi|25989383          MLFRFVSCNV QLCGIIELPH WVRKKRTRRK SDGPDSIAET IKWWKEQNQK   50
gi|42822041          ----MERVEV LGGGSSAG-- QVRKKRMRRK STGPDSIAET IKRWKEHNQK   44
gi|52145406          ---------- ---------- MTRKKKVRRR STGPDSVAET IKKWKEQNQK   30
gi|38099059          ---------- ---------- MSRKKKVRRR STGPDSVSET IKKWKEQNQK   30
gi|45385108          ---------- ---------- MSRKKKVRRR STGPDSVAET IKKWKEQNQK   30

Consensus            ---------- ---------- --RKKR-RRR S-GPDSVAET IKKWKE-NQK   50

gi|55168209          AASS----SG AGGGGGGGRT KKKAAGKGGP ENGKFRYRGV RQRSWGKWVA   86
gi|25992100          LDNEGKG-KP VRKVPAKGSK KGCMRGKGGP ENWRCKYRGV RQRTWGKWVA   95
Lead-CeresClone332   ---------- ---------K KGPARGKGGP QNALCQYRGV RQRTWGKWVA   41
CeresClone:557009    ---------- ---------K KGPTRGKGGP QNASCEYRGV RQRTWGKWVA   43
gi|27960757          LEHDPQGAKR ARKPPAKGSK KGCMQGKGGP ENTQCGFRGV RQRTWGKWVA   90
gi|58700406          LQEE----NS SRKAPAKGSK KGCMAGKGGP ENSNCAYRGV RQRTWGKWVA   89
gi|25989383          LQEE----NS SRKAPAKGSK KGCMAGKGGP ENSNCAYRGV RQRTWGKWVA   96
gi|42822041          IHED------ -RKAPAKGSK KGCMAGKGGP ENGNCAYRGV RQRTWGKWVA   87
gi|52145406          LQQE----NG SRKAPAKGSK KGCMAGKGGP ENSNCAYRGV RQRTWGKWVA   76
gi|38099059          LQEE----NG ARKAPAKGSK KGCMAGKGGP ENSNCKYRGV RQRTWGKWVA   76
gi|45385108          LQEE----NG SRKAPAKGSK KGCMAGKGGP ENSNCKYRGV RQRTWGKWVA   76

Consensus            L-EE----N- SRKAPAKGSK KGCMAGKGGP ENSNCKYRGV RQRTWGKWVA  100
```

```
gi|55168209             EI REPRKRSR KWLGTFATAE DAARAYDRAA LLLYGPRAHL NLTAPPPLPP 136
gi|25992100             EI REPKRGSR LWLGTFGTAI EAALAYDDAA RAMYGPCARL NLPNYACDSV 145
Lead-CeresClone332      EI REPKKRAR LWLGSFATAE EAAMAYDEAA LKLYGHDAYL NLPHLQRNTR 91
CeresClone:557009       EI REPKKRTR LWLGSFATAE EAAMAYDEAA RRLYGPDAYL NLPHLQPRST 93
gi|27960757             EI RESNRVSR LWLGTFPTAE VAAQAYDEAA KAMYGPLART NFPVQDAQAA 140
gi|58700406             EI REPNRGRR LWLGSFPTAL EAAHAYDEAA RAMYGPTARV NFADNSTDAN 139
gi|25989383             EI REPNRGRR LWLGSFPTAL EAAHAYDEAA RAMYGPTARV NFADNSTDAN 146
gi|42822041             EI REPNRGRR LWLGSFPTAL EAAHAYDEAA RAMYGPTARV NFSESSADAN 137
gi|52145406             EI REPNRGNR LWLGSFPTAV EAARAYDDAA RAMYGATARV NFPEHSPDAN 126
gi|38099059             EI REPNRGNR LWLGSFPTAV EAAHAYDEAA RAMYGATARV NFSERSLDAN 126
gi|45385108             EI REPNRGNR LWLGSFPTAV EAAHAYDEAA RAMYGATARV NFSERSPDAN 126

Consensus               EI REPNRG-R LWLGSFPTA- EAA-AYDEAA RAMYGPTARV NFS--S-DAN 150

gi|55168209             PPPSSAAAAA ASSSSAASST SAPPLRPLLP RPPHLHPAFH HQPFHHHLLQ 186
gi|25992100             SWATTSASAS A--------- -SDC--TVAS GFGEVCPVDG ALHEADT--- 180
Lead-CeresClone332      PSLSNSQRFK WVPSRKFISM FPSCGMLNVN AQPSVHIIQQ RLEELKKTGL 141
CeresClone:557009       STITSG-KFK WFPSKNFISM FPSCGLLNVN AQPSVHLIHQ RLQELKRNSV 142
gi|27960757             PTVVVQVATE GVVRGSS--- -ASCESTTTS NHSDVASSSH NKQLQIQ--- 183
gi|58700406             SGCTSA---- ---------- -PSL--MMSN GPATI--PSD EKDELES--- 167
gi|25989383             SGCTSA---- ---------- -PSL--MMSN GPATI--PSD EKDELES--- 174
gi|42822041             SGCTSA---- ---------- -LSL--LASN IPPAS----- ---------- 155
gi|52145406             SGCTMA---- ---------- -PSL--LLSN GATAVSHPSD GKDESES--- 156
gi|38099059             SGCTSA---- ---------- -PPV--LMSN GPTAVSHPAD GKDESES--- 156
gi|45385108             SGCTSA---- ---------- -PPV--LMSN GPTAVSYPSD EKDESES--- 156

Consensus               SGCTSA---- ---------- -PSL--LMSN GP--V---S- -K-E-ES--- 200
```

| | | | | | | |
|---|---|---|---|---|---|---|
| gi\|55168209 | PQPPPPPPPL | YY-----AATA | STSTVTTT-- | -TTAPPPQLA | ---------- | 219 |
| gi\|25992100 | -----PLSSV | KD-----EGTA | MDIVEPTS-- | -IDEDTLKSG | --------WD | 210 |
| Lead-CeresClone332 | LSQSYSSSSS | ST-----ESKT | NTSFLDEK-- | -TSKGETDNM | ------FEGG | 178 |
| CeresClone:557009 | VSQ--SSSSS | SN-----DPKA | EIQNVDSKNH | GEDENPPKDV | QTSSEEVLGD | 186 |
| gi\|27960757 | -----APEIS | SQSDLLESTQ | SVEYIQQQ-- | -SVPDAVSSI | ---------- | 215 |
| gi\|58700406 | -----PPFIV | AN-----GPA- | ---VLYQP-- | -DKKDVLERV | --------VP | 193 |
| gi\|25989383 | -----PPFIV | AN-----GPA- | ---VLYQP-- | -DKKDVLERV | --------VP | 200 |
| gi\|42822041 | ---------- | ---------- | -----QRS-- | -DDKDEVESV | --------ET | 169 |
| gi\|52145406 | -----PPSLV | SN-----APTA | ---ALHRS-- | -DAKDEFESS | --------GT | 183 |
| gi\|38099059 | ------PSLR | SD-----GPTA | ---TLRRS-- | -DAKDEPESA | --------GT | 182 |
| gi\|45385108 | -----PPSLM | SD-----APTA | ---TLHRS-- | -DAKGEPESA | --------GT | 183 |
| Consensus | -----PPS-V | SN-----PTA | ----L--S-- | -D-KD--ESV | ---------- | 250 |

| | | | | | | |
|---|---|---|---|---|---|---|
| gi\|55168209 | -AAAPAAVLV | AAAVSSTAET | QAVVATAPED | AASAAAAAAA | E--EEAAWCF | 266 |
| gi\|25992100 | CLDKLNMDEM | FDVDELLAML | DSTPVFTKD- | --YNSDGKHN | N--MVSDSQC | 255 |
| Lead-CeresClone332 | DQKKPEIDLT | EFLQQLGILK | DENEAEPSEV | AECHSPPPWN | E--QEETGSP | 226 |
| CeresClone:557009 | LQEKPQIDLH | EFLQQMGILK | EERQSERTD- | --SSGSSTVR | E--AVLTDDC | 231 |
| gi\|27960757 | AMSTSEEDVY | EPLEPISNLP | DGEAHCAIS- | -RCFGPRTWP | ETWTRRRRGC | 263 |
| gi\|58700406 | EVQDVKTEGS | NGLKRVCQER | KNMEVCESE- | ----GIVLHK | E--VNISYDY | 236 |
| gi\|25989383 | EVQDVKTEGS | NGLKRVCQER | KNMEVCESE- | ----GIVLHK | E--VNISYDY | 243 |
| gi\|42822041 | EVHEVKMEVN | DDMRSVHVER | KTLEVFQSE- | ----ESVLRK | E--GDVSYDY | 212 |
| gi\|52145406 | VAHKVKAEVS | NDLRSTHEEH | KALEVTQPK- | ----GKALHK | E--ANVSYDY | 226 |
| gi\|38099059 | VVHEVKTEVS | NDSTSVREER | KTVEVFQPK- | ----GKALHK | E--EKVSYDY | 225 |
| gi\|45385108 | LVHEVKTEVS | NDSRSLREER | KTVEVFQPE- | ----GKALHK | E--EKVSYDY | 226 |
| Consensus | -V--VK-EVS | --L--V--ER | K-MEV-Q-E- | ----G--LHK | E----VSYDY | 300 |

| | | | | | | |
|---|---|---|---|---|---|---|
| gi\|55168209 | HGGDE----- | ------EDYA | AALL------ | ---WS----E | PDPWF----- | 287 |
| gi\|25992100 | QEPNAVVDP- | ----MTVDYG | FDFLKPGRQE | DLNFS----S | DDLAFIDLDS | 296 |
| Lead-CeresClone332 | FRTENFSWD- | ----TLIEMP | RSETTTMQFD | SSNFGSYDFE | DDVSF----P | 267 |
| CeresClone:557009 | DHLGVFSDKS | VNWEALIEM- | HGLAGIQESE | VTQLEAYEPN | DDLTFST--- | 277 |
| gi\|27960757 | PAASSTPSSG | V---PAPALA | PQRAEAVPSP | RGGNGRRCRG | SDRAMVDVMR | 310 |
| gi\|58700406 | FNVHEVVEM- | ----IIVELS | ADQKTEVHEE | ---YQ----E | GDDGF----- | 269 |
| gi\|25989383 | FNVHEVVEM- | ----IIVELS | ADQKTEVHEE | ---YQ----E | GDDGF----- | 276 |
| gi\|42822041 | FHVEDVLEM- | ----IIVELN | AAKKIEVHEE | ---YQ----D | GDDGF----- | 245 |
| gi\|52145406 | FNVEEVLDM- | ----IIVELS | ADVKMEAHEE | ---YQ----E | GDDGF----- | 259 |
| gi\|38099059 | FNVEEVLDM- | ----IIVELS | ADRKMEVHEE | ---YQ----D | GDDGF----- | 258 |
| gi\|45385108 | FNVEEVLDM- | ----IIVELS | ADRKMEVHEE | ---YQ----D | GDDGF----- | 259 |
| Consensus | FNV-EVLDM- | ----IIVELS | AD-K-EVHEE | ---YQ----- | GDDGF----- | 350 |

| | | |
|---|---|---|
| gi\|55168209 | DLFLK----- | 292 |
| gi\|25992100 | ELVV------ | 300 |
| Lead-CeresClone332 | SIWDYYGSLD | 277 |
| CeresClone:557009 | SIWNF----- | 282 |
| gi\|27960757 | AVFILE---- | 316 |
| gi\|58700406 | SLFSY----- | 274 |
| gi\|25989383 | SLFSY----- | 281 |
| gi\|42822041 | SLFSY----- | 250 |
| gi\|52145406 | SLFSY----- | 264 |
| gi\|38099059 | SLFSY----- | 263 |
| gi\|45385108 | SLFSY----- | 264 |
| Consensus | SLFSY----- | 360 |

```
gi|40748265               MDAGVVAATI  PADGSLESKV  HTDVMLFNRW  SYDGVDINDM  SVEDYITATA   50
Lead-CeresClone1610       -----MATAA  DVDAEIQQAL  TNEVKLFNRW  TYDDVTVTDI  SLVDYIGVQA   45
gi|3043428                ----------  -----RSDPT  QIEVKLFNRW  SFDDVQLSDV  SLIDYIGVVP   35
CeresClone:533766         --------MA  DEAVVVPDPT  QIDVKLFNRW  SFDDIEITDI  SLADYIGVAT   42
CeresClone:792839         --------MA  EIEATVPDPS  QIDVKLFNRW  SFDDVEVTDM  SLADYIGVSP   42
gi|34893994               ----------  --MAVVEQPQ  QQVVKLFNCW  SFEDVQVNDI  SLADYLAVSS   38
CeresClone:1281072        ----------  --MAEVEQP-  QDAVKLFNRW  TFDDVQVNDI  SLNDYLAVTA   37
CeresClone:741488         ----------  --MAVVEPVP  GGDVKLFNRW  TFEDVQVTDI  SLNDYLAVTS   38

Consensus                 ----------  ---A-VE-P-  Q-DVKLFNRW  SFDDVQVTDI  SL-DYIGV--   50

gi|40748265               NKHPVYMPHT  AGRYQAKRFR  KAQCPIVERL  TNSLMMHGRN  NGKKLMAVRI  100
Lead-CeresClone1610       AKHATFVPHT  AGRYSVKRFR  KAQCPIVERL  TNSLMMHGRN  NGKKLMAVRI   95
gi|3043428                SKHATYVPHT  AGRYSVKRFR  KAQCPIVERL  TNSLMMHGRN  NGKKLMAVRI   85
CeresClone:533766         SKHATYVPHT  AGRYSVKRFR  KAQCPIVERL  TNSLMMHGRN  NGKKLLAVRI   92
CeresClone:792839         SKHATYVPHT  AGRYSVKRFR  KAQCPIVERL  TNSLMMHGRN  NGKKLMAVRI   92
gi|34893994               TKHATYLPHT  AGRYSAKRFR  KAQCPLVERL  TNSLMMHGRN  NGKKIMAVRI   88
CeresClone:1281072        AKHATFLPHS  AGRYSKKRFR  KAQCAIVERL  TNSLMMHGRN  NGKKVMAVRI   87
CeresClone:741488         MKHYTFLPHS  AGRYSAKRFR  KAQCPIIERL  TNSLMMHGRN  NGKKIMAVRI   88

Consensus                 SKHATYVPHT  AGRYSVKRFR  KAQCPIVERL  TNSLMMHGRN  NGKKLMAVRI  100

gi|40748265               IKHAMEIIHL  LTDQNPIQVI  VDAVINSGPR  EDATRIGSAG  VVRRQAVDIS  150
Lead-CeresClone1610       IKHAMEIIHL  LSDLNPIQVI  IDAIVNSGPR  EDATRIGSAG  VVRRQAVDIS  145
gi|3043428                IKHAMEIIHL  LTDQNPIQVI  VDAVVNSGPR  EDATRIGSAG  VVRRQAVDIS  135
CeresClone:533766         IKHAMEIIHL  LTDQNPIQVI  VDAVINSGPR  EDATRIGSAG  VVRRQAVDIS  142
CeresClone:792839         IKHAMEIIHL  LTDLNPIQVI  VDAVINSGPR  EDATRIGSAG  VVRRQAVDIS  142
gi|34893994               VKHAMEIIHL  LTDANPIQVI  VDAIINSGPR  EDATRIGSAG  AVRRQAVDIS  138
CeresClone:1281072        MKHTLEIIHL  LTDTNPIQVV  VDAIINSGPR  EDATRIGSAG  VVRRQAVDIS  137
CeresClone:741488         IKHTMEIIHL  LTDANPIQII  VDAIINSGPR  EDATRIGSAG  VVRRQAVDIS  138

Consensus                 IKHAMEIIHL  LTD-NPIQVI  VDA-INSGPR  EDATRIGSAG  VVRRQAVDIS  150
```

| | | | | | | |
|---|---|---|---|---|---|---|
| gi\|40748265 | PLRRVNQAI Y | LLTTGARESA | FRNI KTI AEC | LADELI NAAK | GSSNSYAI KK | 200 |
| Lead-CeresClone1610 | PLRRVNQAI F | LI TTGAREAA | FRNI KTI AEC | LADELI NAAK | GSSNSYAI KK | 195 |
| gi\|3043428 | PLRRVNQAI Y | LLTTGAREAA | FRNI KSI AEC | LADELI NAAK | GSSNSYAI KK | 185 |
| CeresClone:533766 | PLRRVNQAI Y | LLTTGAREAA | FRNI KTI AEC | LADELI NAAK | GSSNSYAI KK | 192 |
| CeresClone:792839 | PLRRVNQAI Y | LLTTGAREAA | FRNI KTI AEC | LADELI NAAK | GSSNSYAI KK | 192 |
| gi\|34893994 | PLRRVNQAI Y | LLTTGARESA | FRNI KTI AEC | LADELI NAAK | GSSNSYAI KK | 188 |
| CeresClone:1281072 | PLRRVNQAI Y | LLTTGARESA | FRNI KTI AEC | LADELI NAAK | GSSNSYAI KK | 187 |
| CeresClone:741488 | PLRRVNQAI Y | LLTTGARESA | FRNVKTI AEC | LADELI NAAK | GSSNSYAI KK | 188 |
| Consensus | PLRRVNQAI Y | LLTTGARE-A | FRNI KTI AEC | LADELI NAAK | GSSNSYAI KK | 200 |

| | | | |
|---|---|---|---|
| gi\|40748265 | KDEI ERVAKA | NR | 212 |
| Lead-CeresClone1610 | KDEI ERVAKA | NR | 207 |
| gi\|3043428 | KDEI ERVAKA | NR | 197 |
| CeresClone:533766 | KDEI ERVAKA | NR | 204 |
| CeresClone:792839 | KDEI ERVAKA | NR | 204 |
| gi\|34893994 | KDEI ERVAKA | NR | 200 |
| CeresClone:1281072 | KDEI ERVAKA | NR | 199 |
| CeresClone:741488 | KDEI ERVAKA | NR | 200 |
| Consensus | KDEI ERVAKA | NR | 212 |

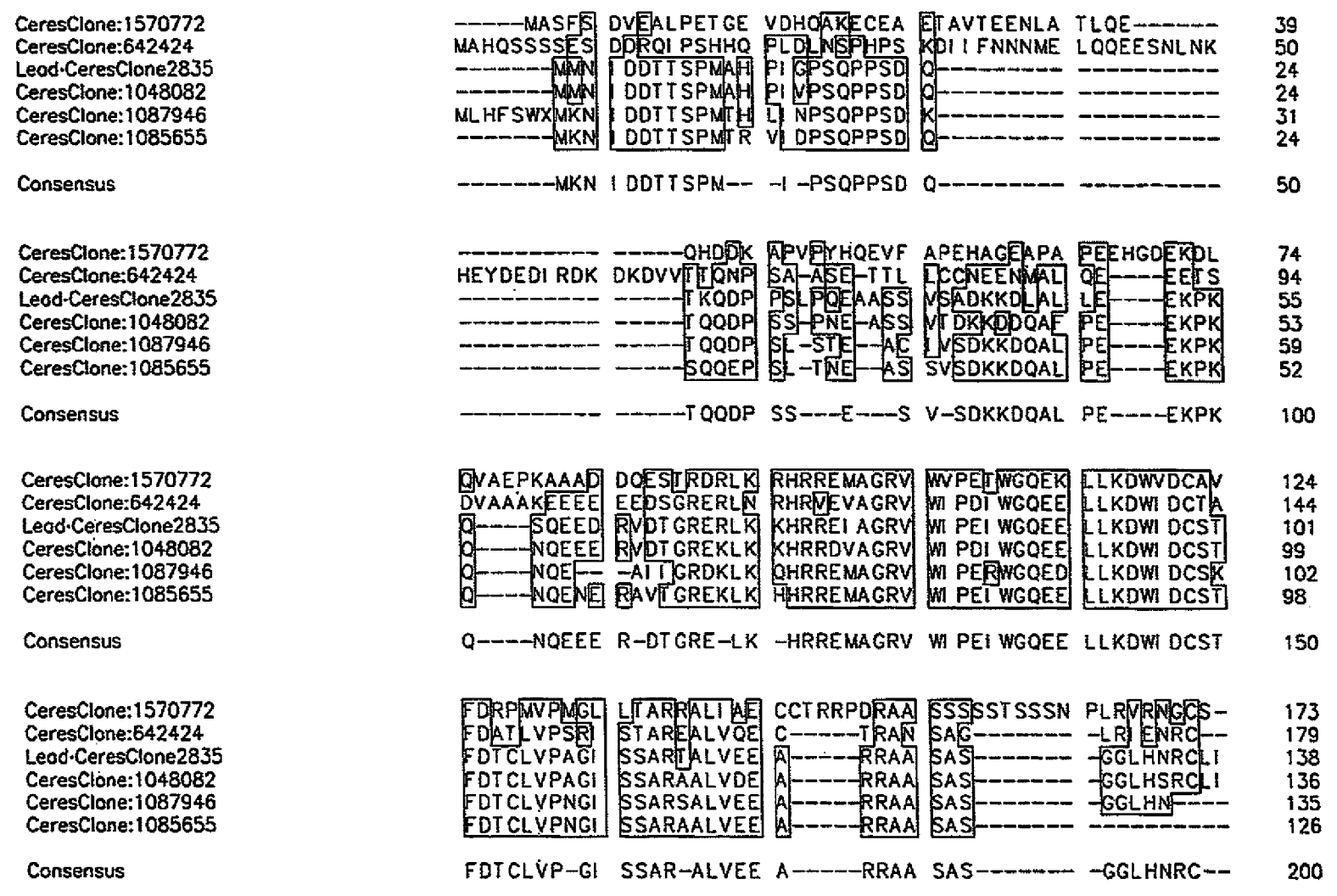

```
CeresClone:1570772       ------MASFS DVEALPETGE VDHQAKECEA ETAVTEENLA TLQE------   39
CeresClone:642424        MAHQSSSSES DDRQIPSHHQ PLDLNSPHPS KDIIFNNNME LQQEESNLNK   50
Lead-CeresClone2835      -------MMN IDDTTSPMAH PIGPSQPPSD Q--------- ----------   24
CeresClone:1048082       -------MMN IDDTTSPMAH PIVPSQPPSD Q--------- ----------   24
CeresClone:1087946       MLHFSWXMKN IDDTTSPMTH LINPSQPPSD K--------- ----------   31
CeresClone:1085655       -------MKN IDDTTSPMTR VIDPSQPPSD Q--------- ----------   24

Consensus                -------MKN IDDTTSPM-- -I-PSQPPSD Q--------- ----------   50

CeresClone:1570772       ---------- -----QHDDK APVPYHQEVF APEHAGEAPA PEEHGDEKDL   74
CeresClone:642424        HEYDEDIRDK DKDVVTTQNP SA-ASE-TTL LCCNEENMAL QE----EETS   94
Lead-CeresClone2835      ---------- -----TKQDP PSLPQEAASS VSADKKDLAL LE----EKPK   55
CeresClone:1048082       ---------- -----TQQDP SS-PNE-ASS VTDKKDDQAF PE----EKPK   53
CeresClone:1087946       ---------- -----TQQDP SL-STE--AC IVSDKKDQAL PE----EKPK   59
CeresClone:1085655       ---------- -----SQQEP SL-TNE--AS SVSDKKDQAL PE----EKPK   52

Consensus                ---------- -----TQQDP SS---E---S V-SDKKDQAL PE----EKPK   100

CeresClone:1570772       QVAEPKAAAD DQESTRDRLK RHRREMAGRV MVPETWGQEK LLKDWVDCAV   124
CeresClone:642424        DVAAAKEEEE EEDSGRERLN RHRVEVAGRV MIPDIWGQEE LLKDWIDCTA   144
Lead-CeresClone2835      Q----SQEED RVDTGRERLK KHRREIAGRV MIPEIWGQEE LLKDWIDCST   101
CeresClone:1048082       Q----NQEEE RVDTGREKLK KHRRDVAGRV MIPDIWGQEE LLKDWIDCST   99
CeresClone:1087946       Q----NQE-- -AIIGRDKLK QHRREMAGRV MIPERWGQED LLKDWIDCSK   102
CeresClone:1085655       Q----NQENE RAVTGREKLK HHRREMAGRV MIPEIWGQEE LLKDWIDCST   98

Consensus                Q----NQEEE R-DTGRE-LK -HRREMAGRV WIPEIWGQEE LLKDWIDCST   150

CeresClone:1570772       FDRPMVPMGL LTARRALIAE CCTRRPDRAA SSSSSTSSSN PLRVRNGCS-   173
CeresClone:642424        FDATLVPSRI STAREALVQE C-----TRAN SAG------- -LRIENRC--   179
Lead-CeresClone2835      FDTCLVPAGI SSARTALVEE A-----RRAA SAS------- -GGLHNRCLI   138
CeresClone:1048082       FDTCLVPAGI SSARAALVDE A-----RRAA SAS------- -GGLHSRCLI   136
CeresClone:1087946       FDTCLVPNGI SSARSALVEE A-----RRAA SAS------- -GGLHN----   135
CeresClone:1085655       FDTCLVPNGI SSARAALVEE A-----RRAA SAS------- ----------   126

Consensus                FDTCLVP-GI SSAR-ALVEE A-----RRAA SAS------- -GGLHNRC--   200
```

| | | |
|---|---|---|
| CeresClone:1570772 | -- | 173 |
| CeresClone:642424 | -- | 179 |
| Lead-CeresClone2835 | LR | 140 |
| CeresClone:1048082 | SR | 138 |
| CeresClone:1087946 | -- | 135 |
| CeresClone:1085655 | -- | 126 |
| Consensus | -- | 202 |

```
CeresClone:704321      ---------- ---------- ---------- ---------- ----------   0
CeresClone:224792      ---------- -----MDLYE KLEKVGEGTY GKVYRAREKA TGRIVALKKT  35
CeresClone:473347      MEMEKTGAGV VVLSAKEAFE KLEKVGEGTY GKVYRAREKA TGKIVALKKT  50
Lead-CeresClone1241    -----MDEGV IAVSAMDAFE KLEKVGEGTY GKVYRAREKA TGKIVALKKT  45
gi|15218072            ---MDNNGVK PAVSAMEAFE KLEKVGEGTY GKVYRAREKA TGMIVALKKT  47
CeresClone:108339      ---------- -----MEAFE KLEKVGEGTY GKVYRAREKA TGMIVALKKT  35
gi|21536682            ---------- -----MEAFE KLEKVGEGTY GKVYRAREKA TGMIVALKKT  35

Consensus              ---------- -----MEAFE KLEKVGEGTY GKVYRAREKA TG-IVALKKT  50

CeresClone:704321      ---MDDEGIP PTALREISLL RLLSSSLYVV RLLAVEQATK GGGAGGGGKP  47
CeresClone:224792      RLPEDDEGVP PTAMREVSLL RMLSQDPHVV RLLDLKQ--- --GVNKEGQT  80
CeresClone:473347      RLHEDQDGVP PTTLREVSIL RMLSRDPHVV RLMDVKQ--- --GQNKEGKT  95
Lead-CeresClone1241    RLHEDEEGVP STTLREISIL RMLARDPHVV RLMDVKQ--- --GLSKEGKT  90
gi|15218072            RLHEDEEGVP PTTLREISIL RMLARDPHIV RLMDVKQ--- --GINKEGKT  92
CeresClone:108339      RLHEDEEGVP PTTLREISIL RMLARDPHIV RLMDVKQ--- --GINKEGKT  80
gi|21536682            RLHEDEEGVP PTTLREISIL RMLARDPHIV RLMDVKQ--- --GINKEGKT  80

Consensus              RLHEDEEGVP PTTLREISIL RMLARDPHVV RLMDVKQ--- --GINKEGKT 100

CeresClone:704321      VLYLVFEFLD TDLKKFVDAY RRGPAPKPLP TQVVKSFLYQ LCKGIAHCHG  97
CeresClone:224792      ILYLVFEYMD TDLKKFIRGH RS--NNEKIP AATVKILMYQ LCKGVAFVHG 128
CeresClone:473347      VLYLVFEYMD TDLKKFIRSF DQ--PGQNIP PETIKSLMYQ LCKGIAFCHG 143
Lead-CeresClone1241    VLYLVFEYMD TDVKKFIRSF RS--TGKNIP TQTIKSLMYQ LCKGMAFCHG 138
gi|15218072            VLYLVFEYVD TDLKKFIRSF RQ--AGQNIP QNTVKCLMYQ LCKGMAFCHG 140
CeresClone:108339      VLYLVFEYVD TDLKKFIRSF RQ--AGQNIP QNTVKCLMYQ LCKGMAFCHG 128
gi|21536682            VLYLVFEYVD TDLKKFIRSF RQ--AGQNIP QNTVKCLMYQ LCKGMAFCHG 128

Consensus              VLYLVFEY-D TDLKKFIRSF RQ--AGQNIP --TVK-LMYQ LCKGMAFCHG 150

CeresClone:704321      HGVLHRDLKP QNLLVDKEKM ILKIADLGLS RAFTVPMKSY THEIVTLWYR 147
CeresClone:224792      RGVLHRDLKP HNLLMDRKTM ALKIADLGLS RAITVPVKKY THEILTLWYR 178
CeresClone:473347      HGILHRDLKP HNLLMDRKTM MLKIADLGLA RAFTVPIKKY THEILTLWYR 193
Lead-CeresClone1241    HGILHRDLKP HNLLMDPKTM RLKIADLGLA RAFTLPMKKY THEILTLWYR 188
gi|15218072            HGVLHRDLKP HNLLMDRKTM TLKIADLGLA RAFTLPMKKY THEILTLWYR 190
CeresClone:108339      HGVLHRDLKP HNLLMDRKTM TLKIADLGLA RAFTLPMKKY THEILTLWYR 178
gi|21536682            HGVLHRDLKP HNLLMDRKTM TLKIADLGLA RAFTLPMKKY THEILTLWYR 178

Consensus              HGVLHRDLKP HNLLMDRKTM -LKIADLGLA RAFTLPMKKY THEILTLWYR 200
```

| | | | | | | |
|---|---|---|---|---|---|---|
| CeresClone:704321 | APEVLLGATH | YSTSVDI WSI | GCI FAEMVRK | QALFPGDSEL | QQLLHI FKLL | 197 |
| CeresClone:224792 | APEI LLGATH | YSTPVDI WSV | GCI FAELVTN | QPLFPGDSEL | QQLLHI FKLL | 228 |
| CeresClone:473347 | APEVLLGATH | YSMAVDI WSV | GCI FAELVTR | RALFPGDSEL | QQLLHI FRLL | 243 |
| Lead-CeresClone1241 | APEVLLGATH | YSTAVDMWSV | GCI FAELVTN | QAI FQGDSEL | QQLLHI FKLF | 238 |
| gi\|15218072 | APEVLLGATH | YSTGVDMWSV | GCI FAELVTK | QAI FAGDSEL | QQLLRI FRLL | 240 |
| CeresClone:108339 | APEVLLGATH | YSTGVDMWSV | GCI FAELVTK | QAI FAGDSEL | QQLLRI FRLL | 228 |
| gi\|21536682 | APEVLLGATH | YSTGVDMWSV | GCI FAELVTK | QAI FAGDSEL | QQLLRI FRLL | 228 |
| Consensus | APEVLLGATH | YST-VDMWSV | GCI FAELVTK | QAI F-GDSEL | QQLLHI FRLL | 250 |

| | | | | | | |
|---|---|---|---|---|---|---|
| CeresClone:704321 | GTPTEEDWPG | VTALRDWHEF | PQWKAQRLTR | AVPTLEPEGI | DLLSKMLQFD | 247 |
| CeresClone:224792 | GTPNEQVWPG | VGKLPNWHEY | PQWKPTKLSA | LVPGLDADGY | DLLEKLLEYE | 278 |
| CeresClone:473347 | GTPNEEVWPG | VSKLKDWHEY | PQWNSQSLST | AVPGLEELGL | DLLSQMLEYE | 293 |
| Lead-CeresClone1241 | GTPNEEMWPG | VSTLKNWHEY | PQWKPSTLSS | AVPNLDEAGV | DLLSKMLQYE | 288 |
| gi\|15218072 | GTPNEEVWPG | VSKLKDWHEY | PQWKPLSLST | AVPNLDEAGL | DLLSKMLEYE | 290 |
| CeresClone:108339 | GTPNEEVWPG | VSKLKDWHEY | PQWKPLSLST | AVPNLDEAGL | DLLSKMLEYE | 278 |
| gi\|21536682 | GTPNEEVWPG | VSKLKDWHEY | PQWKPLSLST | AVPNLDEAGL | DLLSKMLEYE | 278 |
| Consensus | GTPNEEVWPG | VSKLKDWHEY | PQWKP-SLST | AVPNLDEAGL | DLLSKMLEYE | 300 |

| | | | | |
|---|---|---|---|---|
| CeresClone:704321 | PANRI SAKAA | LEHPYFNSL- | DKSQF | 271 |
| CeresClone:224792 | PAKRI PAKKA | LEHPYFKDVR | KGDAH | 303 |
| CeresClone:473347 | PSKRI SAKKA | MEHAYFDDL- | DKRNL | 317 |
| Lead-CeresClone1241 | PAKRI SAKMA | MEHPYFDDLP | EKSSL | 313 |
| gi\|15218072 | PAKRI SAKKA | MEHPYFDDLP | DKSSL | 315 |
| CeresClone:108339 | PAKRI SAKKA | MEHPYFDDLP | DKSSL | 303 |
| gi\|21536682 | PAKRI SAKKA | MEHPYFDDLP | DKSSL | 303 |
| Consensus | PAKRI SAKKA | MEHPYFDDLP | DKSSL | 325 |

```
Lead-CeresClone3036   -----MAEVEE IAHEEQNIEK R--EKKKGKH EKPKPWDDDP NIDRWTIEKF   44
CeresClone:278965     ---------- ---------- ---------- ---------- ----------   0
gi|56785318           ---MASEGDA SALVAAAEGR K--PRHKGKH DKPKPWDDDP NIDHWKIEEF   45
gi|31432429           MASEEGEEAN AASSAEEVGR KKPPRHKGKH DKPKPWDDDP NIDHWKIEKF   50

Consensus             ------E--- -A--A---GR K--PRHKGKH DKPKPWDDDP NIDHWKIEKF   50

Lead-CeresClone3036   DPAWNPTGMI ETSTFSTLFP QYR------- ---------- ----------   67
CeresClone:278965     --------ML EVSSFSTLFP QYR------- ---------- ----------   15
gi|56785318           DPSWNEGGML EVTSFSTLFP QYRGKSPHPT PPSALSWFLP RSAIDWFCLV   95
gi|31432429           DPSWNEGGML EVSSFSTLFP QYR------- ---------- ----------   73

Consensus             DPSWNEGGML EVSSFSTLFP QYR------- ---------- ----------   100

Lead-CeresClone3036   -EKYLQECWP RVESALKEYG VACKLNLVEG SMTVSTTRKT RDPYIIVKAR   116
CeresClone:278965     -EKYLQEAWP VVKGALKEYG ISCELNLVEG SMTVSTTRKT RDPFAIIKAR   64
gi|56785318           VKKYLQEAWP IVKGALKEFG VACELNLVEG SMTVSTTRKT KDPYIIIKAN   145
gi|31432429           -EKYLQEAWP IVKGALKEFG VACELNLVEG SMTVSTTRKT RDPYIIVKAK   122

Consensus             -EKYLQEAWP IVKGALKE-G VACELNLVEG SMTVSTTRKT RDPYII-KAR   150

Lead-CeresClone3036   DLIKLLSRSV PAPQAIKILE DEVQCDIIKI GNLVRNKERF VKRRQRLVGP   166
CeresClone:278965     ELIKLLSRSV PAPQAIKILD DEMNCDIIKI GGLVRNKERF VKRRERLLGP   114
gi|56785318           ELIKLLSRSV PAPQAIKILN DEMSCAIIKI GSIIRNKERF VKRRGRLLGP   195
gi|31432429           ELIKLLSRSV PAPQAIKILN DEMSCDIIKI GSIIRNKERF VKRRERLLGP   172

Consensus             ELIKLLSRSV PAPQAIKILN DEMSCDIIKI GS--RNKERF VKRRERLLGP   200

Lead-CeresClone3036   NSSTLKALEI LTNCYILVQG STVAAMGPF- -KGLKQLRRI VEDCVQNIMH   214
CeresClone:278965     NLSTLKAIEI LTGCYILVQG NTVAAMGNYR GRGLKQVRRI VEDCMKNVKH   164
gi|56785318           NLSTLKAIEI LTGCYILVQG NTAAAMGYW- -KGLKQVVRV VEDCIKNVKH   243
gi|31432429           NLSTLKAIEI LTGCYILVQG NTVAAMGSW- -KGLKQVRRV VEDCIKNIKH   220

Consensus             NLSTLKAIEI LTGCYILVQG NTVAAMG-W- -KGLKQVRR- VEDCIKN-KH   250
```

```
Lead-CeresClone3036   PVYHI KTLMM KKELEKDPAL ANESWDRFLP TFRKKNVKQK KPKSKEKKPY   264
CeresClone:278965     PVYHI KELLI KRELAKNPAL ANENWDRFLP KFKKKNVKQK KPQTKEKKPY   214
gi|56785318           PVYHI KELLI KRELVKNPAL AHESWDKFLP KFKKKNVKQK KPLTKEKKQY   293
gi|31432429           PVYHI KELLI KRELAKNPAL ANESWDRFLP KFKKKNVKQK KPI TKEKKPY  270

Consensus             PVYHI KELLI KRELAKNPAL ANESWDRFLP KFKKKNVKQK KP-TKEKKPY   300

Lead-CeresClone3036   TPFPPPQPPS KI DMQLESGE YFMRDKKKSE KKWQEKQEKQ SEKSTENKRK   314
CeresClone:278965     TPFPPPQQPS KI DLELENGE YFMSDKKKSA KKWQEKLDKQ SGRAEENKRK   264
gi|56785318           TPFPPPQQPS KI DLELESGE CFMSDKKKSA KEWQEKLEKQ SQKAEENKRK   343
gi|31432429           TPFPPPQQPS KI DLELESGE YFMSDKKKSA KKWQEKLEKQ SEKAEENKRK   320

Consensus             TPFPPPQQPS KI DLELESGE YFMSDKKKSA KKWQEKLEKQ SEKAEENKRK   350

Lead-CeresClone3036   RDASFLPPEE PMNNNSNANK SEDGKNDI TE LTNSLKSKTK ELKKQKKTHE   364
CeresClone:278965     REAAFVPPKE NTAGPSKSDK NASDNSEI AD I AKSLKRKAK EFRKN-EAQE  313
gi|56785318           REAAFVHPNE DI ATPYESAK SI I NNGEI AD MAKSLKKKAK ELRKN-EEQE 392
gi|31432429           REAAFVPPKE DTATPYESAK STSNNDEI AD MAKSLKKKAK EFRKS-EAQE   369

Consensus             REAAFVPPKE D-ATP-ES-K S-SNN-EI AD MAKSLKKKAK E-RKN-EAQE   400

Lead-CeresClone3036   RVNAEEYI AG PSSSADKSSK KSKKI RD--          391
CeresClone:278965     SVI AESYI AS NDELRQKKEK EI N------         336
gi|56785318           NVRLESYVAS NEGSRPKKKH KLSKYSQPE          421
gi|31432429           NVRLESYVAS NEGSRPKKKH KSSKSK---          395

Consensus             NVR-ESY-AS NEGSRPKKK- K-SK-----          429
```

| | | | | | | |
|---|---|---|---|---|---|---|
| gi\|81888 | MI YDVNSPLF | RSFLSQKGGS | -SDKRKTEEQ | KPKEHRPKAS | ENKPI MTE | 47 |
| CeresClone:810742 | MI YDVXSPLF | RSFLSQKGGS | -SDKRKTDEQ | KPKEQKPKAS | ENKPI MTE | 47 |
| CeresClone:553538 | MI YDVNSPLF | RSFLSQKGGS | -SDKRKTDEQ | KPKEQKPKAS | ENKPI MTE | 47 |
| CeresClone:857804 | MI YDVNSPLF | RSFLSQKGGS | -SDKRKSDEQ | KPKEQKPKAS | ENKPI MTE | 47 |
| CeresClone:678746 | MI YDVNSPLF | RSFLSQKGGA | SSDKRKMEEQ | KPKDQRFKAN | ENKPVMNE | 48 |
| CeresClone:753703 | MI YDVNSPLF | RSFLSQKGGA | SSDKRKMEEQ | KPKDQRFKAN | ENKPVMNE | 48 |
| CeresClone:927400 | MI YDVNSPLF | RSFLSQKGGA | SSDKRKMEEQ | KPKDQRFKAN | ENKPVMNE | 48 |
| CeresClone:1316352 | MI YDVNSPLF | RSFLSQKGGA | SSDKRKMEEQ | KPKDQRFKAN | ENKPVMNE | 48 |
| CeresClone:644900 | MI YDVNSPLF | RSFLSQKGGA | --DKRKMEEH | KPKEQRPKAN | ENKPVMNE | 46 |
| CeresClone:300291 | MI YDVNSPLF | RSFLSQKGGA | --DKRKMEEH | KPKEQRPKAN | ENKPVMNE | 46 |
| CeresClone:421214 | MI YDVNSPLF | RSFLSQKGGA | --DKRKMEEH | KPKEQRPKAN | ENKPVMNE | 46 |
| CeresClone:1070119 | MI YDVNSVLF | KSFLSSKFST | --DKRRGED- | KPREQKPKAS | DNKPVMNE | 45 |
| Lead-CeresClone3510 | MI YDVNSGLF | RSFLSQKGSS | -SDKRKMED- | KPREQKPKAS | DNKPVMNE | 46 |
| Consensus | MI YDVNSPLF | RSFLSQKGGA | -SDKRKMEEQ | KPKEQRPKAN | ENKPVMNE | 48 |

```
CeresClone:619936        MEFQSLSGFY LL--LSLTIL FLAPFHAQAK IKVTYCDKKA DYPVKVSGVE  48
Lead-CeresClone5597      MAISQAQPLL L---LLLSVF FLPAL-HATS FT--YCDKRL D-PVKVTGVK  43
CeresClone:970267        MAISHAQPLL L---LLFSLF LLPSL-RATS FH--NCDKRL D-PVKVTGVE  43
CeresClone:1610116       MAGFQSKLLV V---FLCSLH LIAPLTHAID VK--YCNKKN NYDVKVSGVD  45
CeresClone:618484        MATKQ-SLLA AAAVCLLLLL PLPAAYAVTD VE--YCNKGK NYPVKVSGVE  47
gi|50355738              MATDHRRFPV FLAAALLTLL LLPASAAATD VE--YCRQGR DYPVKVSGVE  48
CeresClone:504766        MAAKHLNLFA ----AALLLL LLPSGSSATA VE--YCKKGW DYPVKVSSVE  44

Consensus                MA----Q-L- L----LLTLL LLPA--AAT- VE--YCDK-- DYPVKVSGVE  50

CeresClone:619936        ISPDPVESGK PATFKISATS SKAIYGGEVV IGVSYVGVPV HTERIDLCHE  98
Lead-CeresClone5597      ISPDPVVSGA AATFKIFGST GEDISGGKVV IRVLYVGIPV HTETHDLCDE  93
CeresClone:970267        ISPDPVVSGK AATFKITGST DEDISGGEVV ISVSLYGVHI HTETHDLCDE  93
CeresClone:1610116       ITPYPIERGT ETTFTISAXX ETPISGGNLV IDVSYYMFGV YSETSDLCTK  95
CeresClone:618484        IVPDPVERGV PATFKISATT DKNITEGKLV IDVKYWIFNV YSETDDICTK  97
gi|50355738              IVPDPVVSGQ PATFKISAST DKSITKGKLV IDVKYFFFHV HSESHNLCEE  98
CeresClone:504766        VVPDPVVRGQ PATFKISAST DKNITKGKLF IDVAYFIFHV HSETHNLCDE  94

Consensus                ITPDPVVSG- PATFKISAST DK-I-GGKLV IDVSY--FHV HTETHDLCDE  100

CeresClone:619936        VSCPVANCNF LISHTQTLPS ITPPGPYSLK MTLKNDRDEV LTCIKFNFKI  148
Lead-CeresClone5597      TACPVAPGSF VLSHSQTLPS ITPPGTYTLK MTINDKNGGR LTCISFKFKI  143
CeresClone:970267        SSCPIAPGTF VLSHSQTLPS ITPPGTYTLK MTINDKNGGR LTCISFKFKI  143
CeresClone:1610116       TTCPVATGDF AISHXXSLPS VTPPGSYTLF MKLQDSNKNE LTCITFDFSI  145
CeresClone:618484        TQCPA-TSDF ELSHSQTLPS ITPPGSYTIQ MKMLGKHDEE LSCISFGFNI  146
gi|50355738              TSCPV-TGEF VLAHEQTLPS ITPPGSYTLT MRLLDDGNKE LTCISFGFSI  147
CeresClone:504766        TSCPV-TGEF VLASQQTLPS FTPPGSYTLT MKLLGDSNEE LTCISFGFSI  143

Consensus                TSCPVATG-F VLSHSQTLPS ITPPGSYTLK MKL-D-N-EE LTCISF-FSI  150

CeresClone:619936        VFGSFVSDM- --  157
Lead-CeresClone5597      TVGSAVFAS- --  152
CeresClone:970267        TLFSKVSAS- --  152
CeresClone:1610116       GWYSSEEAVA SS  157
CeresClone:618484        GFLAPVALS- --  155
gi|50355738              GFISPLALI- --  156
CeresClone:504766        GFVAPNPVI- --  152

Consensus                GF-S-V--I- --  162
```

```
CeresClone:246369          MVSDQEI ASC VESVLRGSAG GPGEV-SLTA VLQQAEATLG VDLSHKAGFI   49
CeresClone:563093          MVTEEEI SEA VQSLLRES-- NPSRFTTLNQ VVEELQAKLG HDLTHKTDFI   48
Lead-CeresClone12272       MVSDQDLAKG VETLLRQS-- DPSSLTSLSS IVQQLEAKLG LDLTEKTTFI   48
CeresClone:541471          MVTDQDI AKG VESLLRHS-- DPNSI TTVNG VVQQLEAKLG LDLSHKASFI   48
CeresClone:528932          MVTDQDI AKG VESLLRHS-- DPNSI TTVNG VVQQLEAKLG LDLSHKASFI   48
CeresClone:855912          MVTDQDI AKG VESLLRHS-- DPNSI TTVNG VVQQLEAKLG LDLSHKASFI   48

Consensus                  MVTDQDI AKG VESLLRHS-- DPNSI TT-NG VVQQLEAKLG LDLSHKASFI   50

CeresClone:246369          RDQMDLFFGP RLQPQPLTT- ----PQLAPP PPQAVVAPAD AVPQPQPQHQ   94
CeresClone:563093          TAQI NLLFGS R--------- ---------- QP-------- ----------   61
Lead-CeresClone12272       RDQI NLLLRA HQNPSASVAS ASSVQQSHPP PP-------- ----------   80
CeresClone:541471          RDQI DHLLRS Q--------- ----PQTFAP HP-------- ----------   67
CeresClone:528932          RDQI DHLLRS Q--------- ----PQTFAP HP-------- ----------   67
CeresClone:855912          RDQI DHLLRS Q--------- ----PQAFVP HP-------- ----------   67

Consensus                  RDQI D-LLRS Q--------- ----PQ-F-P HP-------- ----------  100

CeresClone:246369          VLPQAPPSAQ QMQPQQLAPL QPQLMFQTI H QLPAI SPVPV VSAPPAMAFY  144
CeresClone:563093          --PQNPHRQL QQPKDHFAP- PPNPNFHS-- ---------- --APVSVGFQ   94
Lead-CeresClone12272       --PSSHQQQN LHSGVNVPP- MAKGHFTLSH PSQFSVSSQS QQYPSHFALQ  127
CeresClone:541471          --PPLH---- ---KDYFAP- HTQLHFPTTH ---------- --FAPHFALH   95
CeresClone:528932          --PPLH---- ---KDYFAP- HTQLHFPTTH ---------- --FAPHFALH   95
CeresClone:855912          --PPLH---- ---KDYFAP- HPQPHFPTTH ---------- --FPSHFALH   95

Consensus                  --PP-H---- ---KDYFAP- HPQLHFPTTH ---------- --FPPHFALH  150

CeresClone:246369          PPP---PLAF RYTTGLACAA TGGTVSFQQP APGAGGT--- ---ASPTAAP  185
CeresClone:563093          -------LQNF SSSNAMVAAA TAADASRI EA PSAPVVV--- -------EGN  128
Lead-CeresClone12272       PPYHSYDLNF RQPYPVYMPP QQHQHQQQSP RQQQSSVMLS HGGNASLSVN  177
CeresClone:541471          D------EI NF LQ-HPHPPPP RKVETF---P PQNV------ -------APP  123
CeresClone:528932          D------EI NF LQ-HPHPPPP RKVETF---P PQNV------ -------APP  123
CeresClone:855912          D------EI NF QQ-HPRAPPP CKVETF---P PQNAHTV--- -------APP  126

Consensus                  D------EI NF RQ-HPV-PPP RKVETF---P PQN---V--- -------APP  200
```

```
CeresClone:246369          QVAGDNKESS SKRKRGGPGG LNKVCAI SPE LQI VGEIAM  SRTQI VKQLW   235
CeresClone:563093          QVPKESTQTK VKR-RGGPGG LIKI CGVSPE LQVI VGQPAL SRTEI VKQLW   177
Lead-CeresClone12272       QAPKESAPAG TKR-KGGPGG LNKVCRVSPE LEVVVGEPAL PRTEI VRQLW   226
CeresClone:541471          QVPKESVQTG SKR-RGGAGG LNKVCGVSPE LQAVVGEPAM PRTEI VRQLW   172
CeresClone:528932          QVPKESVQTG SKR-RGGAGG LNKVCGVSPE LQAVVGEPAM PRTEI VRQLW   172
CeresClone:855912          QV-------- ---------- ---------- ---------- ----------   128

Consensus                  QVPKES-QTG SKR-RGGPGG LNKVCGVSPE LQ-VVGEPAM PRTEI VRQLW   250

CeresClone:246369          AYI RQNNLQD PDDKRKI I CN DELRVVFETD TIDMFKMNKL LAKHITPLDP   285
CeresClone:563093          AYI RKNNLQD PSNKRKI I CN DELRVVFETD CTDMFKMNKL LSKHI I PLEP   227
Lead-CeresClone12272       AYI RKNNLQD PSNKRKI I CD DALRVVFETD CTDMFKMNKL LAKHI LPLDP   276
CeresClone:541471          AYI KKNNLQD PGNKRKI I CD DALRLVFETD CTDMFKMNQL LAKHI I PLGP   222
CeresClone:528932          AYI KKNNLQD PGNKRKI I CD DALRLVFETD CTDMFKMNQL LAKHI I PLGP   222
CeresClone:855912          ---------- ---------- ---------- ---------- ----------   128

Consensus                  AYI RKNNLQD P-NKRKI I CD DALRVVFETD CTDMFKMNKL LAKHI I PLDP   300

CeresClone:246369          KSQLHEVKRM KAPT-MSPQP GRPI D----Q PSIVI SDALA KFI GTDGT-F   329
CeresClone:563093          TKKP-VPKKQ KVDVESGTRS AEP-------T PSVI I SDALA NFFGLTGREM   270
Lead-CeresClone12272       SKDSGQAKKA KTEVETKTET TEPVSSTAI S STVTLSEPLG KFFGTGETEM   326
CeresClone:541471          TKES-QAKRV KVDTEI KTES AEPA------P STVAI SEALA KFLGTEGREM   266
CeresClone:528932          TKES-QAKRV KVDTEI KTES AEPA------P STVAI SEALA KFLGTEGREM   266
CeresClone:855912          ---------- ---------- ---------- ---------- ----------   128

Consensus                  TKES-QAKRV KVDTEI KTES AEP------- STV-I SEALA KFLGTEGREM   350

CeresClone:246369          PQDDALKYLW DYI KANQLED VINE-SI LCD SKLQELFGCE SI PMSGLSEM   378
CeresClone:563093          LQSEVLRRI W EYI KVNQLED PANPMAI VCD GKLQEI FGCE SI SALGI PEV   320
Lead-CeresClone12272       ADEEI RRVW EYI KLNNLED PVNPMAI QCD EKLRDLLGCE SI SAVGI NEM   376
CeresClone:541471          QQSEAI RLVW EYI KLHHLED PLNSMVI LCD AKLQELLGCE SI SALGI PEM   316
CeresClone:528932          QQSEAI RLVW EYI KLHHLED PLNSMVI LCD AKLQELLGCE SI SALGI PEM   316
CeresClone:855912          ---------- ---------- ---------- ---------- ----------   128

Consensus                  -QSEAI R-VW EYI KLNHLED PI N-MAI LCD AKLQELLGCE SI SALGI PEM   400
```

| | | | |
|---|---|---|---|
| CeresClone:246369 | LGHHFI KKT– | --- | 387 |
| CeresClone:563093 | LGRHHI FRSS | --- | 330 |
| Lead-CeresClone12272 | L–RRHMYKQS | --- | 385 |
| CeresClone:541471 | LARHHLFKQS | DTR | 329 |
| CeresClone:528932 | LARHHLFKQS | DTR | 329 |
| CeresClone:855912 | ---------- | --- | 128 |
| Consensus | L–RHH–FKQS | --- | 413 |

| | | | | | | |
|---|---|---|---|---|---|---|
| gi\|13430182 | MSKRGRGGSA | GNKFRMSLGL | PVAATVNCAD | NTGAKNLYII | SVKGI KGRLN | 50 |
| CeresClone:568627 | MSKRGRGGSA | GNKFRMSLGL | PVAATVNCAD | NTGAKNLYII | SVKGI KGRLN | 50 |
| CeresClone:1073644 | MSKRGRGGSA | GNKFRMSLGL | PVAATVNCAD | NTGAKNLYII | SVKGI KGRLN | 50 |
| CeresClone:1447299 | MSKRGRGGSA | GNKFRMSLGL | PVAATVNCAD | NTGAKNLYII | SVKGI KGRLN | 50 |
| CeresClone:1605872 | MSKRGRGGSA | GNKFRMSLGL | PVAATVNCAD | NTGAKNLYII | SVKGI KGRLN | 50 |
| Lead-CeresClone9897 | MSKRGRGGTS | GNKFRMSLGL | PVAATVNCAD | NTGAKNLYII | SVKGI KGRLN | 50 |
| CeresClone:1083013 | MSKRGRGGTS | GNKFRMSLGL | PVAATVNCAD | NTGAKNLYII | SVKGI KGRLN | 50 |
| Consensus | MSKRGRGGSA | GNKFRMSLGL | PVAATVNCAD | NTGAKNLYII | SVKGI KGRLN | 50 |
| gi\|13430182 | RLPSACVGDM | VMATVKKGKP | DLRKKVLPAV | I VRQRKPWRR | KDGVFMYFED | 100 |
| CeresClone:568627 | RLPSACVGDM | VMATVKKGKP | DLRKKVMPAV | I VRQRKPWRR | KDGVFMYFED | 100 |
| CeresClone:1073644 | RLPSACVGDM | VMATVKKGKP | DLRKKVMPAV | I VRQRKPWRR | KDGVFMYFED | 100 |
| CeresClone:1447299 | RLPSACVGDM | VMATVKKGKP | DLRKKVMPAV | I VRQRKPWRR | KDGVFMYFED | 100 |
| CeresClone:1605872 | RLPSACVGDM | VMATVKKGKP | DLRKKVMPAV | I VRQRKPWRR | KDGVFMYFED | 100 |
| Lead-CeresClone9897 | RLPSACVGDM | VMATVKKGKP | DLRKKVLPAV | I VRQRKPWRR | KDGVFMYFED | 100 |
| CeresClone:1083013 | RLPSACVGDM | VMATVKKGKP | DLRKKVMPAV | I VRQRKPWRR | KDGVFMYFED | 100 |
| Consensus | RLPSACVGDM | VMATVKKGKP | DLRKKVMPAV | I VRQRKPWRR | KDGVFMYFED | 100 |
| gi\|13430182 | NAGVI VNPKG | EMKGSAI TGP | I GKECADLWP | RI ASAANAI V | | 140 |
| CeresClone:568627 | NAGVI VNPKG | EMKGSAI TGP | I GKECADLWP | RI ASAANAI V | | 140 |
| CeresClone:1073644 | NAGVI VNPKG | EMKGSAI TGP | I GKECADLWP | RI ASAANAI V | | 140 |
| CeresClone:1447299 | NAGVI VNPKG | EMKGSAI TGP | I GKECADLWP | RI ASAANAI V | | 140 |
| CeresClone:1605872 | NAGVI VNPKG | EMKGSAI TGP | I GKECADLWP | RI ASAANAI V | | 140 |
| Lead-CeresClone9897 | NAGVI VNPKG | DMKGSAI TGP | I GKECADLWP | RI ASAANAI V | | 140 |
| CeresClone:1083013 | NAGVI VNPKG | EMKGSAI TGP | I GKECADLWP | RI ASAANAI V | | 140 |
| Consensus | NAGVI VNPKG | EMKGSAI TGP | I GKECADLWP | RI ASAANAI V | | 140 |

```
CeresClone:605144        MATSTSALNK RLEGKVALIT GGASGIGKRI AEVFAQQGAK VVIADIQDEL   50
Lead-CeresClone9683      -----MSGLR RLDGKIAIIT GGASGIGAEA VRLFTDHGAK VVIVDIQEEL   45
gi|17104783              -----MSG-K RLDGKIVIIT GGASGIGAES VRLFTEHGAR VVIVDVQDEL   44

Consensus                -----MSG-K RLDGKIAIIT GGASGIGAE- VRLFT-HGAK VVIVDIQDEL   50

CeresClone:605144        GHSVAQSIGP STCCYVHCDV TDENQIKNAV QKAVDAYGKL DIMFNNAGIV  100
Lead-CeresClone9683      GQNLAVSIGL DKASFYRCNV TDETDVENAV KFTVEKHGKL DVLFSNAGVL   95
gi|17104783              GQNVAVSIGE DKASYYHCDV TNETEVENAV KFTVEKYGKL DVLFSNAGVI   94

Consensus                GQNVAVSIG- DKASYYHCDV TDET-VENAV KFTVEKYGKL DVLFSNAGV-  100

CeresClone:605144        DPNKNRIIDN DKADFERVLS VNVIGVFLGM KHAAQAMIPA RS-GSIISTA  149
Lead-CeresClone9683      EAFGS-VLDL DLEAFDRTMA VNVRGAAAFI KHAARSMVAS GTRGSIVCTT  144
gi|17104783              EPFVS-ILDL NLNELDRTIA INLRGTAAFI KHAARAMVEK GIRGSIVCTT  143

Consensus                EPF-S-ILDL DL--FDRT-A VNVRG-AAFI KHAARAMV-- G-RGSIVCTT  150

CeresClone:605144        SISSYVGGAA SHAYCCAKHA VVGLIKNAAV ELGQFGIRVN CLSPYALATP  199
Lead-CeresClone9683      SIAAEIGGPG PHSYTASKHA LLGLIRSACA GLGQYGIRVN GVAPYGVATG  194
gi|17104783              SVAAEIAGTA PHGYTTSKHG LLGLIKSASG GLGKYGIRVN GVAPFGVATP  193

Consensus                SIAAEIGG-A PH-YT-SKHA LLGLIKSA-- GLGQYGIRVN GVAPYGVATP  200

CeresClone:605144        LATKFVGAND EELETIMNSL ANLKGVTXKA EDVANAALYF ASDDSRYVSG  249
Lead-CeresClone9683      MTSAYNEEAV KMLEEYGEAL GNLKGVVLKA RHIAEAALFL ASDDSVYISG  244
gi|17104783              LVCNGFKMEP NVVEQNTSAS ANLKGIVLKA RHVAEAALFL ASDESAYVSG  243

Consensus                L--------- --LE----AL ANLKGVVLKA RHVAEAALFL ASDDS-YVSG  250

CeresClone:605144        QNLLIDGGFS IVNPSFHMFQ YPDSES   275
Lead-CeresClone9683      QNLVVDGGFS VVKLMST--- ------   261
gi|17104783              QNLAVDGGYS VVKP------ ------   257

Consensus                QNL-VDGGFS VVKP------ ------   276
```

```
Lead-CeresClone8490   MVGDYRGRFS SRRFSDDSDD SSDDASSVEG ETTSSMYSAG KEYMETEWTN  50
CeresClone:929917     ----MGEVYL GLDRSARPEP EPADVGI AQG NQVTNLVSAG -------WTD  39
CeresClone:923677     ----MGEVYL DRSV----KP EPADVGI AQG NQVTTLMSAG -------WTD  35
CeresClone:305463     ---------- ---------- ---------- ------MSAG -------WTD   7
CeresClone:258437     ---------- ---------- ---------- ------MSAG -------WTD   7
CeresClone:219341     ---------- ---------- ---------- ------MSAG -------WTD   7

Consensus             --------Y- ---------- ---D----QG ---T-LMSAG -------WTD  50

Lead-CeresClone8490   EKHSLYLKSM EASFVDQLYN SLGALGKNEN VSESTRFGSG RKPSQEQFKV 100
CeresClone:929917     ERHTDYI SSM EASFI NRLFN H----GNNAN ---------R KDSGT NGFKV  76
CeresClone:923677     ERHTDYI SSM EASFI KRLYN H----GNNVN ---------K KDPGTTGFKV  72
CeresClone:305463     ERHRLYI SSM EASFVDQLYN H----GSR-- ---------P RNANGIAFKA  42
CeresClone:258437     ERHMLYI SSM EASFVDQLYN H----GNH-- ---------P HDANGAGFKV  42
CeresClone:219341     ERHMLYI SSM EASFVDQLYN H----GNH-- ---------P HDANGAGFKV  42

Consensus             ERHTLYI SSM EASFVDQLYN H----GNN-N ---------P -DANG-GFKV 100

Lead-CeresClone8490   LHD--GFWQK I NVKQPEHRI NGRHGGNSHE FLRSPWI KHY KPLVK----T 144
CeresClone:929917     LQGGAGVWKK VEFARPGACA --QVGAKQS- LPANPWI QHF RSR-DCSSSS 122
CeresClone:923677     LQGGAGVWKK VEFERPNACA --QVGAKQN- LPANPWI QHF RSR-DC---S 115
CeresClone:305463     LRR-----EY VEYEKTDAPV --RRGAKCCG VPANPWMQHF RPRSDG---G  82
CeresClone:258437     LRR--GVWEY I EYEKTSAPV --RSGAKCC- VPANPWI RHF RPR-DC---G  83
CeresClone:219341     LRR--GVWEY I EYEKTSAPV --RSGAKCC- VPANPWI RHF RPR-DC---G  83

Consensus             LRR--GVWE- -EYEK--APV --R-GAKC-- VPANPWI QHF RPR-DC---- 150

Lead-CeresClone8490   QI PVTDEPEN QVVSSSNGKK GI CSSGSASS LKQLSSHSRD HDQI SVGEAE 194
CeresClone:929917     SSARGDGAQT LVGDHESGI R TIPGGTPLSH GRELGA-CKG E-NLLDQNSE 170
CeresClone:923677     SSARGVGAQT SVGDHESGLR TVPGSTPLSH GRELGA-CKG E-NLLDENTE 163
CeresClone:305463     NNARGDGLGD SVGDLESGTE ANRKSLSASH GRERDA-CEG EPQLLHESRE 131
CeresClone:258437     SNAQSDAVEA SVGDHESGTQ ASRKSPSVSH GRERGA-CKG EPQI LHESTE 132
CeresClone:219341     SNAQSDAVEA SVGDHESGTQ ASRKSPSVSH GRERGA-CKG EPQI LHESTE 132

Consensus             SNAR-DGVE- SVGDHESGT- ATRKS-S-SH GRE-GA-CKG EPQ-LHENTE 200
```

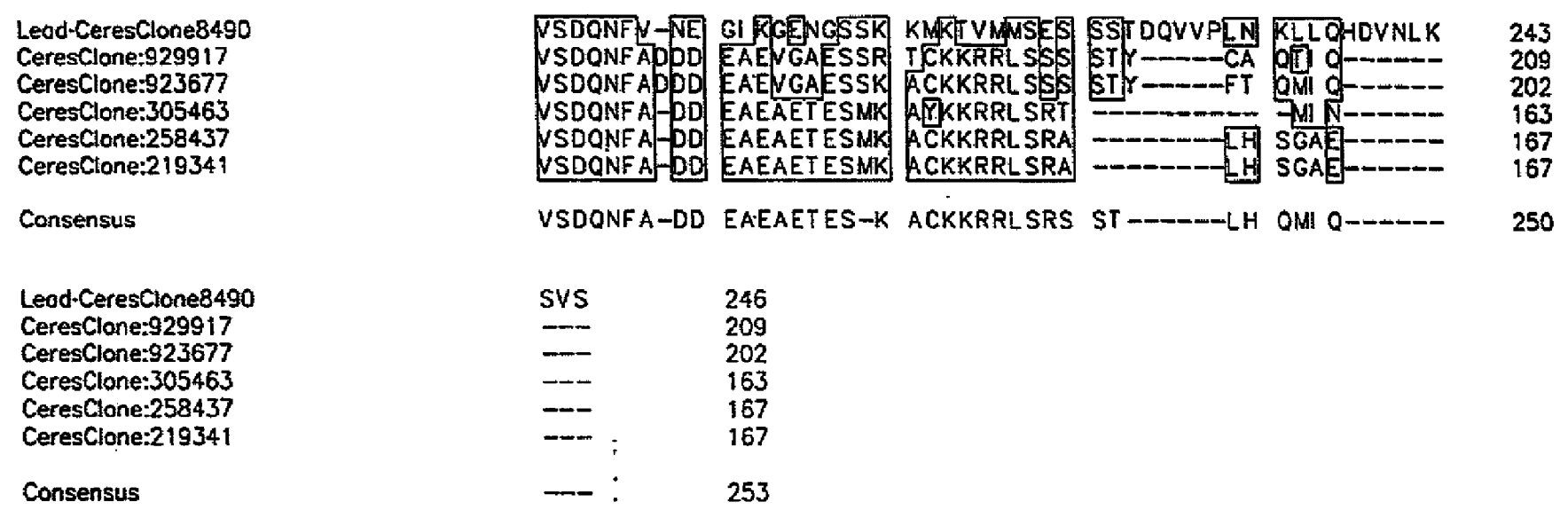

```
Lead-CeresClone8490   VSDQNFV-NE GIKGENGSSK KMKTVMMSES SSTDQVVPLN KLLQHDVNLK 243
CeresClone:929917     VSDQNFADDD EAEVGAESSR TCKKRRLSSS STY------CA QTI Q------ 209
CeresClone:923677     VSDQNFADDD EAEVGAESSK ACKKRRLSSS STY------FT QMI Q------ 202
CeresClone:305463     VSDQNFA-DD EAEAETESMK AYKKRRLSRT ---------- -MI N------ 163
CeresClone:258437     VSDQNFA-DD EAEAETESMK ACKKRRLSRA --------LH SGAE------ 167
CeresClone:219341     VSDQNFA-DD EAEAETESMK ACKKRRLSRA --------LH SGAE------ 167

Consensus             VSDQNFA-DD EAEAETES-K ACKKRRLSRS ST------LH QMI Q------ 250

Lead-CeresClone8490   SVS 246
CeresClone:929917     --- 209
CeresClone:923677     --- 202
CeresClone:305463     --- 163
CeresClone:258437     --- 167
CeresClone:219341     --- 167

Consensus             --- 253
```

```
gi|5679336               MNIQRKPGDW NCKSCQHLNF SRRDYCQRCH TPR--QDLPL GDGYVPGGVL  48
Lead-CeresClone8265      --MSR-PGDW NCRSCSHLNF QRRDSCQRCG DSR---SGPG GVGGLDFGNF  44
CeresClone:540561        --MSR-PGDW NCRSCQHLNF QRRDSCQRCG DSK------Y GDRVVDFGGF  41
gi|50906111              --MNRKPGDW DCRACQHLNF SRRDLCQRCG EPRGAADRGS GGGG-DYANF  47
CeresClone:1560255       --MNRKPGDW DCRACQHLNF SRRDICQRCS EPRGVADRGG GGGGGDYASF  48

Consensus                --M-RKPGDW NCRSCQHLNF SRRD-CQRCG -PR---D--- G-GGVD-GNF  50

gi|5679336               ---------- ----SSLDIR PGDWYC---N CGYHNFASRA SCFKCGAIVK  81
Lead-CeresClone8265      GGRAMSVFGF T---TGSDVR PGDWYCTVGN CGTHNFASRS TCFKCGTFKD  91
CeresClone:540561        GGRGGSSFGL ----TGSDVR PGDWYCAAAN CGAHNFASRS SCFKCGAFKD  87
gi|50906111              GGRGGSSFGG GFG-TGSDVR PGDWYC---N CGAHNFASRS SCFKCAAFKD  93
CeresClone:1560255       GGRGGSSFGG GFGAAGSDVR PGDWYC---S CGAHNFASRS SCFKCSAYKE  95

Consensus                GGRGGSSFG- ----TGSDVR PGDWYC---N CGAHNFASRS SCFKCGAFKD  100

gi|5679336               DLPAG--QGG GVAN-----G DFARALDSSA V--------- ------RAGW  109
Lead-CeresClone8265      ETGAG-GGGG GIGGPAMFDA DIMRSRVPGN GG-------- ------RSSW  126
CeresClone:540561        DL-----AGG GYNS-----S DILRSRAFGG SG-------- ------RPGW  113
gi|50906111              DAAVNSGGAG AFDG-----G DMSRSRGYGF GSGAVRA--- -----SRPGW  130
CeresClone:1560255       EAAVN-SGAG GFD------G DMSRSRGYGF GSGAAGAGAG AARTTNRPGW  138

Consensus                D------GGG GFD------G D-SRSR-YG- G--------- ------RPGW  150

gi|5679336               KAGDWICTRP GCNVHNFASR IECYRCNAPR EAGNVK---- ----  145
Lead-CeresClone8265      KSGDWICTRL GCNEHNFASR MECFRCNAPR DFSNRTS--- ---F  164
CeresClone:540561        KSGDWICSRS GCNEHNFASR MECFKCSAPR DTY------- ----  146
gi|50906111              KSGDWICTRS GCNEHNFASR MECFRCNAPR DSGTEV---- ----  166
CeresClone:1560255       KSGDWICTRS GCNEHNFASR MECFRCNAPR DSGSAAMTYE NYLH  182

Consensus                KSGDWICTRS GCNEHNFASR MECFRCNAPR DSG------- ----  194
```

| | | | | | | |
|---|---|---|---|---|---|---|
| Lead-CeresClone6685 | MLHSYLGSAE | MVPEFAKLGA | YFSFSGFLMS | MSEKKAKKML | KAVPSDRILL | 50 |
| CeresClone:463486 | MVH------- | ---EFSKLGA | YFSFSGFLMS | LKASKAKKML | KMVPPDRILL | 40 |
| Consensus | M-HSYLGSAE | MVPEF-KLGA | YFSFSGFLMS | ----KAKKML | K-VP-DRILL | 50 |
| Lead-CeresClone6685 | ETDSPDALPK | AESGCLYFVD | GDPSLPEE-- | --GNSAQDLD | SASYDKPNVS | 96 |
| CeresClone:463486 | ETDAPDALPM | SNIDSLYFVE | GDTSLTEELL | AQTTTSSTSG | SSLGNSSHVL | 90 |
| Consensus | ETD-PDALP- | -----LYFV- | GD-SL-EELL | AQ-------- | S-------V- | 100 |
| Lead-CeresClone6685 | SDSMKLTKET | LNHPANIHIV | LGYVAQLLDM | KNEELAELSY | QNAVRLFSYE | 146 |
| CeresClone:463486 | ADASMLPKET | LNHPANIHNV | LDYVASMLEI | TKEELAELSY | QNAVRLLSYE | 140 |
| Consensus | -D---L-KET | LNHPANIH-V | L-YVA--L-- | --EELAELSY | QNAVRL-SYE | 150 |
| Lead-CeresClone6685 | GSKILLDRGT | GDVSGHTQNQ | STTHVS | 172 | | |
| CeresClone:463486 | XSKVLQK--- | ---------- | ------ | 147 | | |
| Consensus | GSK-L--RGT | GDVSGHTQNQ | STTHVS | 176 | | |

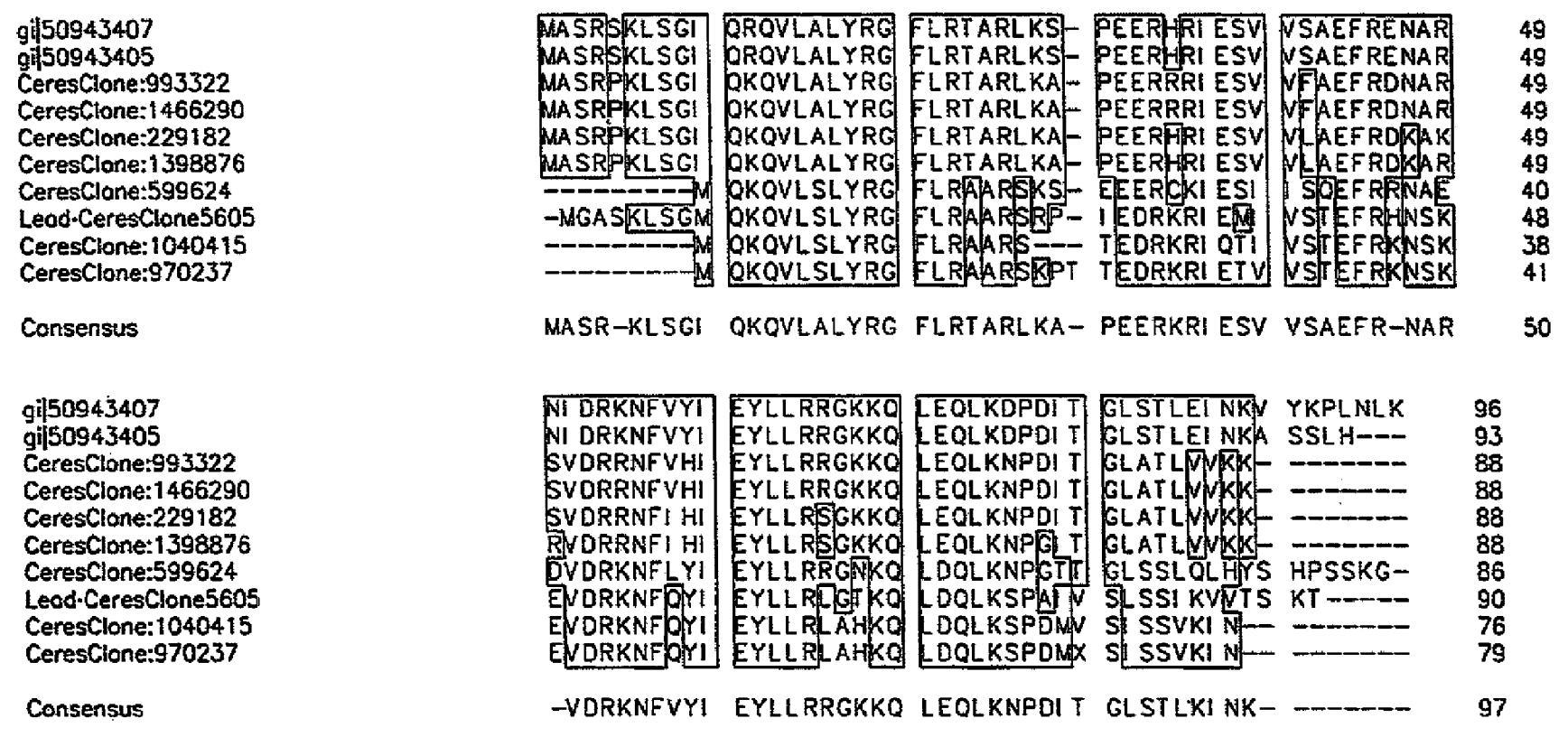

```
gi|50943407               MASRSKLSGI QRQVLALYRG FLRTARLKS- PEERHRI ESV VSAEFRENAR  49
gi|50943405               MASRSKLSGI QRQVLALYRG FLRTARLKS- PEERHRI ESV VSAEFRENAR  49
CeresClone:993322         MASRPKLSGI QKQVLALYRG FLRTARLKA- PEERRRI ESV VFAEFRDNAR  49
CeresClone:1466290        MASRPKLSGI QKQVLALYRG FLRTARLKA- PEERRRI ESV VFAEFRDNAR  49
CeresClone:229182         MASRPKLSGI QKQVLALYRG FLRTARLKA- PEERHRI ESV VLAEFRDKAK  49
CeresClone:1398876        MASRPKLSGI QKQVLALYRG FLRTARLKA- PEERHRI ESV VLAEFRDKAR  49
CeresClone:599624         ---------M QKQVLSLYRG FLRAARSKS- EEERCKI ESI I SQEFRRNAE  40
Lead-CeresClone5605       -MGASKLSGM QKQVLSLYRG FLRAARSRP- I EDRKRI EM VSTEFRHNSK  48
CeresClone:1040415        ---------M QKQVLSLYRG FLRAARS--- TEDRKRI QTI VSTEFRKNSK  38
CeresClone:970237         ---------M QKQVLSLYRG FLRAARSKPT TEDRKRI ETV VSTEFRKNSK  41

Consensus                 MASR-KLSGI QKQVLALYRG FLRTARLKA- PEERKRI ESV VSAEFR-NAR  50

gi|50943407               NI DRKNFVYI EYLLRRGKKQ LEQLKDPDI T GLSTLEI NKV YKPLNLK  96
gi|50943405               NI DRKNFVYI EYLLRRGKKQ LEQLKDPDI T GLSTLEI NKA SSLH---  93
CeresClone:993322         SVDRRNFVHI EYLLRRGKKQ LEQLKNPDI T GLATLVVKK- -------  88
CeresClone:1466290        SVDRRNFVHI EYLLRRGKKQ LEQLKNPDI T GLATLVVKK- -------  88
CeresClone:229182         SVDRRNFI HI EYLLRSGKKQ LEQLKNPDI T GLATLVVKK- -------  88
CeresClone:1398876        RVDRRNFI HI EYLLRSGKKQ LEQLKNPGI T GLATLVVKK- -------  88
CeresClone:599624         DVDRKNFLYI EYLLRRGNKQ LDQLKNPGTT GLSSLQLHYS HPSSKG-  86
Lead-CeresClone5605       EVDRKNFQYI EYLLRLGTKQ LDQLKSPAI V SLSSI KVVTS KT-----  90
CeresClone:1040415        EVDRKNFQYI EYLLRLAHKQ LDQLKSPDMV SI SSVKI N-- -------  76
CeresClone:970237         EVDRKNFQYI EYLLRLAHKQ LDQLKSPDMX SI SSVKI N-- -------  79

Consensus                 -VDRKNFVYI EYLLRRGKKQ LEQLKNPDI T GLSTLKI NK- -------  97
```

```
Lead-CeresClone17632  ---------- ---------- ---------- ----MD--TR KRGRPEAGSF   14
CeresClone:473410     ---------- ---------- ---------- ----MD--IR KRGRPEPG-F   13
CeresClone:277297     FLHFSASDLV ANRTGGLGFR CASAIGREAR LGMEGTAAAR KRSRPETA--   48
CeresClone:1459706    ---------- ---------- ---------- ----MDAAAR KRSRPESA--   14
CeresClone:703717     ---------- ---------- ---------- ----MD-AGR KRAVPEGA--   13
gi|50905911           ---------- ---------- ---------- ----MEVGGR KRGKPDGA--   14

Consensus             ---------- ---------- ---------- ----MD-A-R KR-RPE-A--   50

Lead-CeresClone17632  NSNGG-GYKK SKQEMESYST GLGSKSKPCT KFFSTSGCPF GENCHFLHYV   63
CeresClone:473410     SLNG--GFKK SKQEMESLST GVGSKSKPCT KFFSTAGCPF GEGCHFLHYV   61
CeresClone:277297     --NGAAAAGK RSKDTESFQT GLSSKSKPCT KFFSTIGCPF GEGCHFLHFV   96
CeresClone:1459706    --NGGAAGGK RSRESESQQT GLSSKSKPCT KFFSTVGCPF GEGCHFAHFV   62
CeresClone:703717     --NGG-AAVK RARESESVQT GVGSKSKPCT KFFSTAGCPF GSSCHFLHNF   60
gi|50905911           --NG--AGGK RARESESFQT GVGSKSKPCT KFFSTSGCPF GEGCHFLHHF   60

Consensus             --NGG-A-GK R-RESESFQT G-GSKSKPCT KFFST-GCPF GEGCHFLH-V  100

Lead-CeresClone17632  PGGYNAVSQM TNMGPPIPQV S-RNMQ---- ---------- ----------   88
CeresClone:473410     PGGYNAVAHM MNLTPAAPLP PTRNVAALPH VPNGS--APS AVKTRICNKF  109
CeresClone:277297     PGGYPAVAKM LNLSSSAVSA P-SRTHVDHA ALTGASHPAS TVKTRMCTKY  145
CeresClone:1459706    PGGYQAVSKS HSLGHAAVSA P-SRAPADHA --------AS GVKTRMCTKY  103
CeresClone:703717     PGGHQAVSKM TNLGGPAVSA PQGRMPMGPG VPDGP--PTP SLKTRLCNKF  108
gi|50905911           PGGYQAVAKM TNLGGPAIAP PPGRMPMGNA VPDGP--PTP TVKTRLCNKY  108

Consensus             PGGYQAV-KM TNLG--AVSA P--RMPM-HA VPDG---P-S -VKTR-CNKY  150

Lead-CeresClone17632  ---------- ---------- ---------- -----GSGNG GRFSGRGESG  103
CeresClone:473410     NTAEGCKFGD KCHFAHGEME LGKHIAPSFD DHRAMGPPGA GRLAGRMEPP  159
CeresClone:277297     NTTEGCKFGD KCHFAHSERE LAKP--AYMS QE---GPPNG GRY-GRAEPM  189
CeresClone:1459706    NTAECCKFCD KCHFAHGERE LGRPPSSYMS QESSYAPPMG GRYGGRHEPP  153
CeresClone:703717     NTAEGCKWGN KCHFAHGERE LGKP----ML LNNSMAPPMG PRPNGHFQPP  154
gi|50905911           NTAEGCKWGD KCHFAHGERE LGKP----ML MDSSMPPPMG PRPTGHFAPP  154

Consensus             NTAEGCKWGD KCHFAHGERE LGKP----M- --SSMGPPMG GRY-GR-EPP  200
```

```
CeresClone:1559567     MACPAQSMLS ASGCILLRSK --PRASSSHV RGGIIGGGCS SRPFQLTCNA  48
Lead-CeresClone17482   ---MSNVLLS PNGYVF--AS --PKPLGRFI NSKS--GGRK LFFSVVRASS  41
gi|51457942            MACAA---LS ANSCTIASSS TGRLSFSTYQ KDSKLRQRHS LVRFRVRAST  47
CeresClone:658444      MACALQATLA ANTYAF--SS --RRFSLKHQ KNSK----RR FSLFTVRADS  42

Consensus              MACAAQ--LS AN------SS ---R-SS-H- K-SK--GGR- L--F-VRASS  50

CeresClone:1559567     SSSPSPPSPA PAQEDPDCND EECAPEKEVG SLRAEWLAEE RTQVVGTFPP  98
Lead-CeresClone17482   ---------- ---DDADCNA EECAPEKEVG TVSMEWLAGE KTKVVGTFPP  78
gi|51457942            ---------- ---DDSDCNA EECAPDKEVG KVSMEWVAMD NTKVVGTFPP  84
CeresClone:658444      ---------- ---DDSDCNE EECAPDKEVG KVSVEWLAGE KTKVVGTFPP  79

Consensus              ---------- ---DDSDCN- EECAP-KEVG -VSMEWLAGE KTKVVGTFPP  100

CeresClone:1559567     RK-RGWTGLV EKDTAGQTNI YSVEPVVYVA ESAISSGAAG MSAEGAENTA  147
Lead-CeresClone17482   RKPRGWTGYV EKDTAGQTNV YSIEPAVYVA ESAISSGTAG SSADGAENTK  128
gi|51457942            RKPRGWTGYV EKDTAGQTNI YSVEPAVYVA ESAISSGTAG TSSDGAENTK  134
CeresClone:658444      RRKPGWTGYV EKDTAGQTNI YSVEPAVYVA ESAISSGTAG SSSDGAENTA  129

Consensus              RKPRGWTGYV EKDTAGQTNI YSVEPAVYVA ESAISSGTAG SS-DGAENTA  150

CeresClone:1559567     AIAAGLVLIT VAAASSILIQ VNKSQPQVPE AA-YNGPPLS YYVAKFQPAQ  196
Lead-CeresClone17482   AIVAGIALIA VAAASSILLQ VGKDAPTRPK AVDYSGPSLS YYINKFKPSE  178
gi|51457942            AISAGIALIS VAAASSILLQ VGKNSPPPIQ TVEYRGPSLS YYINKLKPAE  184
CeresClone:658444      AIVAGLALIS IAAASSILLQ VGKNAPPQIQ TAQYSGPSLS YYINKFTPPE  179

Consensus              AI-AG-ALIS VAAASSILLQ VGKNAPP--Q ---YNGPSLS YYINKFKPAE  200

CeresClone:1559567     TLEA------ --PAPAE--- AVEAQDGA-- -------AIV DDSAAPEAQE  226
Lead-CeresClone17482   IVQPSTPSVT EAPPVAELET SL-PETPPVA QQETSLPETM ASEAQPEASF  227
gi|51457942            IVQASITEAP TAPETEEVAI TPEVESSA-- -PEAPAPQVE VQSEAPQDTS  231
CeresClone:658444      LFQVSV---- --PSEAELSS SVQPESPP-- ------PEVS QVQVEAQASE  215

Consensus              IVQAS----- -AP--AEL-- SVEPESP--- --E---PE-- Q--A-P-ASE  250
```

```
Lead-CeresClone17632   P------GHV S-NFGDSATA RFSVDASLAG AIIGKGGVSS KQICRQTGVK  146
CeresClone:473410      --------GPA A-SFGANSTA KISVEASLAG AIIGKGGVNS KQICRQTGAK  201
CeresClone:277297      Q--PAAMGPP AGNFGASATA KISVDASLAG GIIGKGGVNT KQISRITGVK  237
CeresClone:1459706     L--PASMGPP AGNFGASSTC KVSVDAALAG GIIGKGGVNT KQICRITGVK  201
CeresClone:703717      PMPCPDMVPP S-TFGASATA KISVDASLAG AIIGKGGVNT KHISRMTGAK  203
gi|50905911            PMPSPAMSTP A-SFGASATA KISVDASLAG GIIGRGGVNT KQISRVTGAK  203

Consensus              P----AMGPP A-NFGASATA KISVDASLAG -IIGKGGVNT KQI-RMTG-K  250

Lead-CeresClone17632   LSIQDHERDP NLKNIVLEGT LEQISEASAM VKDLIGRLNS AAKKPPG---  193
CeresClone:473410      LSIREHESDP NLRNIELEGS FEQIKEASNM VKDLLLTLQM SA--PPK---  246
CeresClone:277297      LSIRDHESNP NLKNIELEGN FDQIKQASDL VRDLIATISA SM--PAKNPS  285
CeresClone:1459706     LSIRDHESNP DLKNIELEGS FDQIKQANDM VRDLIASISA ST--PSKNPA  249
CeresClone:703717      LAIRDNEADP NHKNIELEGS FDQVNHASAM VKELILRIGG NA--PPQ---  248
gi|50905911            LAIRDHESDT NLKNIELECT FDQIKNASAM VRELIVSIGG GA--PPQ---  248

Consensus              LSIRDHESDP NLKNIELEGS FDQIK-AS-M V-DLIL-ISA SA--PPK---  300

Lead-CeresClone17632   ------G--G LGGGGMGSE GKPHPGSNFK TKICERFSKG NCTFGDRCHF  235
CeresClone:473410      ------T--T PCVPCAPASH ------GSNFK TKLCENFAKG SCTFGDRCHF  283
CeresClone:277297      AAAAPAG--- GGRGGGPGGK -----SSNYK TKLCENFLKG ACTFGDRCHF  327
CeresClone:1459706     SAAAPAGRGG GGGGGGPGGR ------SNYK TKICENFLKG TCTFGERCHF  293
CeresClone:703717      -AKNP-G--R GFAGGGGG-- ------SNFK TKLCDNFNKG SCTFGDRCHF  286
gi|50905911            -GKKPVG--G SHRGGGPG-- ------SNFK TKLCENFTKG SCTFGDRCHF  287

Consensus              -A--P-G--G GG-GGGPG-- ------SNFK TKLCENF-KG SCTFGDRCHF  350

Lead-CeresClone17632   AHGEAELRKS GIV  248
CeresClone:473410      AHGASELRKS GV-  295
CeresClone:277297      AHGETEQRRG AA-  339
CeresClone:1459706     AHGETEQRKG AAV  306
CeresClone:703717      AHGESELRKS AAA  299
gi|50905911            AHGENELRKS AAA  300

Consensus              AHGE-ELRKS AA-  363
```

| | | |
|---|---|---|
| CeresClone:1559567 | AVLI S--- | 231 |
| Lead-CeresClone17482 | VPTTSSTS | 235 |
| gi\|51457942 | SSSSNI S- | 238 |
| CeresClone:658444 | TSSVNI FS | 223 |
| Consensus | -SS--I -S | 258 |

| | | | | | | |
|---|---|---|---|---|---|---|
| CeresClone:779692 | MSSEAAK-MV | VPESVLLKRK | REELWAAEKK | TKAVEEKKKS | SENLKVIYAR | 49 |
| CeresClone:240836 | MSSVASK-VA | VPESVLRKRK | REEQWAIEKK | EKALVEKKKS | IESRKLIFTR | 49 |
| CeresClone:281173 | MSSEAVK-VA | VPESVLRKRK | REEQWAAEKK | EKSLAERKKS | IENRKLIFTR | 49 |
| CeresClone:225601 | MSAAEAKAAA | VPESVLRKRK | REEQWAADKK | EKALADRKKA | LESRKIIFAR | 50 |
| Lead-CeresClone17409 | --MAESK-VV | VPESVLKKTK | RQEEWALAKK | DEAVAAKKKS | VEARKLIFKR | 47 |
| CeresClone:1073780 | --MGEAK-AL | VPESVVKKEK | RNEEWALAKK | QELDAAKKMR | FETRKLIFNR | 47 |
| Consensus | MSS--AK-V- | VPESVLRKRK | REEQWAAEKK | EKALAEKKKS | IE-RKLIF-R | 50 |
| CeresClone:779692 | AKQYAEEYDA | QDKELVQLKR | EARMKGGFYV | SPEAKLLFVV | RIRGINAMHP | 99 |
| CeresClone:240836 | AKQYAEEYDA | QEKELVQLKR | EARLKGGFYV | SPEAKLLFVV | RIRGINAMHP | 99 |
| CeresClone:281173 | AKQYAEEYDA | QEKELVQLKR | EARLKGGFYV | SPEAKLLFVI | RIRGINAMHP | 99 |
| CeresClone:225601 | AKQYAEEYHA | QEKELVQLKR | EARLKGGFYV | SPEAKLLFVV | RIRGINAMHP | 100 |
| Lead-CeresClone17409 | AEQYAKEYAE | KDNELIRLKR | EAKLKGGFYV | DPEAKLLFII | RIRGINAIDP | 97 |
| CeresClone:1073780 | AKQYSKEYDE | QQKELIRLKR | EAKLKGGFYV | EPEAKLLFII | RIRGINAMDP | 97 |
| Consensus | AKQYAEEYDA | QEKELVQLKR | EARLKGGFYV | SPEAKLLFV- | RIRGINAMHP | 100 |
| CeresClone:779692 | KTKKILQLLR | LRQIFNGVFL | KVNKATINML | RRVEPYVAYG | YPNLKSVREL | 149 |
| CeresClone:240836 | KTRKILQLLR | LRQIFNGVFL | KVNKATINML | RRVEPYVAYG | YPNLKSVREL | 149 |
| CeresClone:281173 | KTRKILQLLR | LRQIFNGVFL | KVNKATINML | RRVEPYVAYG | YPNLKSVREL | 149 |
| CeresClone:225601 | KTRKILQLLR | LRQIFNGVFL | KVNKATINML | RRVEPYVAYG | YPNLKSVREL | 150 |
| Lead-CeresClone17409 | KTKKILQLLR | LRQIFNGVFL | KVNKATVNML | RRVEPYVTYG | YPNLKSVKEL | 147 |
| CeresClone:1073780 | KTRKILQLLR | LRQIFNGVFL | KVNKATVNML | HRVEPYVTYG | YPNLKSVREL | 147 |
| Consensus | KTRKILQLLR | LRQIFNGVFL | KVNKATINML | RRVEPYVAYG | YPNLKSVREL | 150 |
| CeresClone:779692 | IYXRGYGKLX | KQRIPLTNNK | VIEEGLGKHN | IXCIEDLVHE | ILTVGPHFKE | 199 |
| CeresClone:240836 | IYKRGYGKLN | KQRIPLSNNQ | VIEEGLGKHN | IICIEDLVHE | IMTVGPHFKE | 199 |
| CeresClone:281173 | IYKRGYGKLN | KQRIPLSNNQ | VIEEGLGKHN | IICIEDLVHE | IMTVGPHFKE | 199 |
| CeresClone:225601 | IYKRGYGKLN | KQRIPLSNNS | VIEEGLGKHN | IICIEDLVHE | IMTVGPHFKE | 200 |
| Lead-CeresClone17409 | IYKRGYGKLN | HQRIALTDNS | IVDQALGKHG | IICVEDLIHE | IMTVGPHFKE | 197 |
| CeresClone:1073780 | IYKRGYGKVN | KQRIALTDNS | IIEQTLGKHG | IICVEDLIHE | IMTVGPHFKE | 197 |
| Consensus | IYKRGYGKLN | KQRIPL-NN- | VIEEGLGKHN | IICIEDLVHE | IMTVGPHFKE | 200 |

| | | | | | | |
|---|---|---|---|---|---|---|
| CeresClone:779692 | ANNFLWPFKL | KAPLGGLKKK | RXHYVEGGDA | GNRENYI NQL | VRRMN | 244 |
| CeresClone:240836 | ANNFLWPFKL | KAPLGGLKKK | RNHYVEGGDA | GNRENYI NEL | I KRMN | 244 |
| CeresClone:281173 | ANNFLWPFKL | KAPLGGLKKK | RNHYVEGGDA | GNRENYI NEL | I KRMN | 244 |
| CeresClone:225601 | ANNFLWPFKL | KAPLGGLKKK | RNHYVEGGDA | GNRENYI NEL | I KRMN | 245 |
| Lead-CeresClone17409 | ANNFLWPFQL | KAPLGGLKKK | RNHYVEGGDA | GNRENFI NEL | VRRMN | 242 |
| CeresClone:1073780 | ANNFLWPLKL | KAPLGGLEKK | RNHYVEGGDA | GNREDYI NEL | I RRMN | 242 |
| Consensus | ANNFLWPFKL | KAPLGGLKKK | RNHYVEGGDA | GNRENYI NEL | I -RMN | 245 |

```
gi|50918565              MA-------- ---------RK MI RVLLVEDE EI NRVVARAA LKAAGGCDVV   34
CeresClone:1051749       MAPKNLG--- ---------TK LETALVVDDN ILNRKIHQNL LESVGV--KN   36
Lead-CeresClone16461     MATKSIGGTE KIKSIEVKKK LINVLIVDDD PLNRRLHEMI IKTIGG---S   48
gi|3687688               MATKSMGDIE K------KKK  L-NVLIVDDD PLNLIIHEKI IKAIGG---S   42

Consensus                MATKS-G--E K-------KKK LINVLIVDDD PLNR-IHE-I -KAVGG--VS   50

gi|50918565              DEAENGEVAV QRVRDAAAPY DLVLMDKQMP VMDGHEATRR IRGMGVTTPI   84
CeresClone:1051749       QGVENGQEAV DI HCHGQI-F DLILMDMDMP IMNGIEATKE LRSMGIGSMI   85
Lead-CeresClone16461     QTAKNGEEAV ILHRDGEASF DLILMDKEMP ERDGVSTTKK LREMKVTSMI   98
gi|3687688               QTANNGEEAV IIHRDGGSSF DLILMDKEMP ERDGVSTTKK LREMEVKSMI   92

Consensus                QTAENGEEAV IIHRDG-ASF DLILMDKEMP --DGV--TKK LREM-VTSMI  100

gi|50918565              VAVSSDG-LP ADVDAFITAG ADDFTSKPLS KEKLGVILAK FRLA----    127
CeresClone:1051749       VGVSSRC-TE AEIRKFMEAG LNDYHEKPLN NAKLSSILDK INPSFTRN    132
Lead-CeresClone16461     VGVTSVADQE EERKAFMEAG LNHCLEKPLT KAKIFPLISH LFDA----    142
gi|3687688               VGVTSLADNE EERRAFMEAG LNHCLAKPLT KDKIIPLINQ LMDA----    136

Consensus                VGV-S-AD-E -E-RAFMEAG LN--L-KPLT K-K--P---K L-DA----    148
```

```
gi|22328869               MELTLSLLTI FLLFFALSGR CS--DKNDFP EGFIFGSATS AYQWEGAFDE  48
CeresClone:1352771        -MKLYSLLSV FLVILLATSD SDAFTRNNFP KDFLFGAATS AYQWEGAVAE  49
gi|27363302               -MKLYSLLSV FLVILLATSD SDAFTRNNFP KDFLFGAATS AYQWEGAVAE  49
gi|30687750               -MKHFSLLFI FLVILLATSY SDAFTRNSFP KDFLFGAATS AYQWEGAVAE  49
gi|7269635                -MKHFSLLFI FLVILLATSY SDAFTRNSFP KDFLFGAATS AYQWEGAVAE  49
gi|42566152               -MKPFSQFFV FVVIVSATSY IDAFTRNDFP NDFLFGAATS AYQWEGAFDE  49
Lead-CeresClone16412      -MKPFSRVFI ILVIVLLTSY IDAFTRNDFP EDFLFGAATS AYQWEGAVDE  49
gi|51971769               -MKHFNLLSI ILVIVLATSY IDAFTRNDFP EDFLFGAGTS AYQWEGAANE  49

Consensus                 -MK-FSLL-I FLVILLATSY SDAFTRNDFP KDFLFGAATS AYQWEGAV-E  50

gi|22328869               DGRKPSVWDT FLHTRNLS-- -NGDITSDGY HKYKEDVKLM VELGLDAFRF  95
CeresClone:1352771        DGRTPSVWDT FSHTYNRGNL GNGDITSDGY HKYKEDVKLM AEMGLESFRF  99
gi|27363302               DGRTPSVWDT FSHTYNRGNL GNGDITSDGY HKYKEDVKLM AEMGLESFRF  99
gi|30687750               DGRTPSVWDT FSNSYDTG-- -NGDVTSDGY HKYKEDVKLM ATMGLESFRF  96
gi|7269635                DGRTPSVWDT FSNSYDTG-- -NGDVTSDGY HKYKEDVKLM ATMGLESFRF  96
gi|42566152               DGKSPSVWDT TSHCDSGSN- -NGDIACDGY HKYKEDVMLM AEMGLESFRF  97
Lead-CeresClone16412      DGRTPSVWDT TSHCYSGS-- -NGDVACDGY HKYKEDVKLM VDMGLQAFRF  96
gi|51971769               DGRTPSVWDT TSHCYNGS-- -NGDIACDGY HKYKEDVKLM AEMGLESFRF  96

Consensus                 DGRTPSVWDT FSHTYN---- -NGDITSDGY HKYKEDVKLM AEMGLESFRF  100

gi|22328869               SISWSRLIPN GRGPVNPKGL QFYKNFIQEL VSHGIEPHVT LFHYDHPQYL  145
CeresClone:1352771        SISWSRLIPN GRGLINPKGL LFYKNLIKEL ISHGIEPHVT LYHYDLPQSL  149
gi|27363302               SISWSRLIPN GRGLINPKGL LFYKNLIKEL ISHGIEPHVT LYHYDLPQSL  149
gi|30687750               SISWSRLIPN GRGLINPKGL LFYNNLIKDL KSHGIEPHVT LYHYDLPQSL  146
gi|7269635                SISWSRLIPN GRGLINPKGL LFYNNLIKDL KSHGIEPHVT LYHYDLPQSL  146
gi|42566152               SISWSRLIPN GRGRINPKGL LFYKNLIKEL RSHGIEPQVT LYHYDLPQSL  147
Lead-CeresClone16412      SISWPR---PN GRGSMNPKGL LFYKNLIKEL RSHGIEPHVT LYHYDLPQPL  144
gi|51971769               SISWSRLIPN GRGRINPKGL LFYKNLIKEL RSHGIEPHVT LYHYDLPQSL  146

Consensus                 SISWSRLIPN GRGLINPKGL LFYKNLIKEL RSHGIEPHVT LYHYDLPQSL  150
```

```
gi|22328869             EDEYGGWI NR  RI I QDFTAYA  NVCFREFGHH  VKFWTTI NEA  NI FI I GGYND  195
CeresClone:1352771      EDEYGGWI NR  KI I EDFTAYA  DVCFREFGED  VKLWTTI NEA  TI FAI GSYDQ   199
gi|27363302             EDEYGGWI NR  KI I EDFTAYA  DVCFREFGED  VKLWTTI NEA  TI FAI GSYDQ   199
gi|30687750             EDEYGGWI NR  KI I EDFTAYA  DVCFREFGED  VKLWTTI NEA  TI FAI GSYDQ   196
gi|7269635              EDEYGGWI NR  KI I EDFTAYA  DVCFREFGED  VKLWTTI NEA  TI FAI GSYDQ   196
gi|42566152             EDEYGGWI NR  KI I EDFTAFA  DVCFREFGED  VKLWTKI NEA  TLFAI GSYGD   197
Lead-CeresClone16412    EDEYGGWI NR  KI I EDFTAFA  DVCFREFGDD  VKLWTTI NEA  TI FAI ATYGE   194
gi|51971769             EDEYGGWI NH  KI I EDFTAFA  DVCFREFGED  VKLWTTI NEA  TI FAFAFYGK   196

Consensus               EDEYGGWI NR  KI I EDFTAYA  DVCFREFGED  VKLWTTI NEA  TI FAI GSYDQ   200

gi|22328869             GI TPPGRCSS  PGR-NCSSGN   SSTEPYI VGH  NLLLAHASAS  RLYKQKYKDM  244
CeresClone:1352771      GI SPPGHCSP  NKFI NCTSGN  SSTEPYLAGH   NI LLAHASAS KLYKLKYKST  249
gi|27363302             GI SPPGHCSP  NKFI NCTSGN  SSTEPYLAGH   NI LLAHASAS KLYKLKYKST  249
gi|30687750             GTAPPGHCSP   NKFVNCSTGN   SSTEPYI AGH  NI LLAHASAS KLYKLKYKSK  246
gi|7269635              GTAPPGHCSP   NKFVNCSTGN   SSTEPYI AGH  NI LLAHASAS KLYKLKYKSK  246
gi|42566152             GMR-YGHCPP   M---NYSTAN   VCTETYI AGH  NMLLAHSSAS  NLYKLKYKTK  243
Lead-CeresClone16412    GVT-FGHCTP   TKFTNCSSGN   SCTETYI AGH  NMLLAHASAS  NLYKLKYQSK  243
gi|51971769             DVR-YG----   ----NCTTGN   YCMETYI AGH  NMLLAHASAS  NLYKLKYKSK  237

Consensus               GV-PPGHCSP   NKF-NCS-GN   SSTEPYI AGH  NI LLAHASAS KLYKLKYKSK  250

gi|22328869             QGGSVGFSLF   SLGFTPSTSS   KDDDI AVQRA  KDFYFGWMLE  PFI FGDYPDE  294
CeresClone:1352771      QKGSI GLSI F AFGLSPYTNS   KDDEI ATQRA  KAFFYGWMLK  PLVFGDYPDE  299
gi|27363302             QKGSI GLSI F AFGLSPYTNS   KDDEI ATQRA  KAFFYGWMLK  PLVFGDYPDE  299
gi|30687750             QKGSI GLSI F AFGLSPYTNS   KDDEI ATQRA  KTFLYGWMLK  PLVFGDYPDE  296
gi|7269635              QKGSI GLSI F AFGLSPYTNS   KDDEI ATQRA  KTFLYGWMLK  PLVFGDYPDE  296
gi|42566152             QRGSVGLSI Y  AYGLSPYTDS   KDDETATERA   EAFLFGWMLK  PLVVGDYPDD  293
Lead-CeresClone16412    QRGSI GLSI Y AFGLSPYTNS   KDDEI ATQRA  KAFLYGWMLK  PLVFGDYPDE  293
gi|51971769             QRGSI GLSI F ALGLTPYTNS   KDDEI ATQRA  KAFLYGWMLK  PLVFGDYPDE  287

Consensus               QKGSI GLSI F AFGLSPYTNS   KDDEI ATQRA  KAFLYGWMLK  PLVFGDYPDE  300
```

```
gi|22328869            MKRTVGSRLP VFSKEESEQV KGSSDFIGII HYLAASVTSI KIKPSI---S   341
CeresClone:1352771     MKRTVGSRLP VFSEEESEQL KGSSDFIGII HYTTFYVTN- KPSPSIFP-S   347
gi|27363302            MKRTVGSRLP VFSEEESEQL KGSSDFIGII HYTTFYVTN- KPSPSIFP-S   347
gi|30687750            MKKTVGSRLP VFSEEESEQV KGSSDFIGII HYTTFYVTNH QPSASLFP-S   345
gi|7269635             MKKTVGSRLP VFSEEESEQV KGSSDFIGII HYTTFYVTNH QPSASLFP-S   345
gi|42566152            MKRTLGSRLP VFSEEESKQV KGSSDFVGVV HYNTFYVTN- RPAPSLVT-S   341
Lead-CeresClone16412   MKRTLGSRLP VFSEAESEQM KGSSDFVGII HYTTVYVTN- QPAPYIFPSS   342
gi|51971769            MKRTLGSRLP VFSEEESEQV KGSSDFVGII HYTTMYVTN- QPAPYIFPSS   336

Consensus              MKRTVGSRLP VFSEEESEQV KGSSDFIGII HYTTFYVTN- QPSPSIFP-S   350

gi|22328869            GNPDFYSDMG VSMIWIVLGN FSAFEYAVAP WAMESVLEYI KQSYGNPPIY   391
CeresClone:1352771     MNEGFFKDMG VYMISA--AN SSFLLWEATP WGLEGILEYI KQSYNNPPIY   395
gi|27363302            MNEGFFKDMG VYMISA--AN SSFLLWEATP WGLEGILEYI KQSYNNPPIY   395
gi|30687750            MGEGFFKDMG VYIIPT--GN SSFLVWEATP WGLEGILEYI KQSYNNPPVY   393
gi|7269635             MGEGFFKDMG LL-------- --FLKWEATP WGLEGILEYI KQSYNNPPVY   385
gi|42566152            INKLFFADIG AYLIAA--GN ASLFEFDAVP WGLEGILQHI KQSYNNPPIY   389
Lead-CeresClone16412   VNKGFFKDMG AYIIST--GN SSLFEFEATP WGLEGVLEYL KQSYNNPPIY   390
gi|51971769            TNKDFFTDMG AYIIST--GN SSSFVFDAVP WGLEGVLQHI KHRYNNPPIY   384

Consensus              MNEGFFKDMG VY-IST--GN SSF--WEATP WGLEGILEYI KQSYNNPPIY   400

gi|22328869            ILENGTPMKQ DLQLQQKDTP RIEYLHAYIA AVLKSIRNGS DTRGYFIWSF   441
CeresClone:1352771     ILENGMPMGR DSTLQ--DTQ RIEFIQAYIG AMLNAIKNGS DTRGYFVWSM   443
gi|27363302            ILENGMPMGR DSTLQ--DTQ RIEFIQAYIG AMLNAIKNGS DTRGYFVWSM   443
gi|30687750            ILENGMPMVR DSTLQ--DTQ RIEYIQAYID AVLNAMKNGS DTRGYFVWSM   441
gi|7269635             ILENGMPMVR DSTLQ--DTQ RIEYIQAYID AVLNAMKNGS DTRGYFVWSM   433
gi|42566152            ILENGKPMKH GSTLQ--DTP RAEFIQAYIG AVHNAITNGS DTRGYFVWSM   437
Lead-CeresClone16412   ILENGTPMKH DSMLQ--DTP RVEYIQAYIG AVLNAIKNGS DTRGYFVWSL   438
gi|51971769            ILENGSPMKH DSMLQ--DTP RVEYIQAYIG AVLNAIKSGS DTRGYFVWSL   432

Consensus              ILENGMPMKR DSTLQ--DT- RIEYIQAYIG AVLNAIKNGS DTRGYFVWSM   450
```

| | | | | | | | |
|---|---|---|---|---|---|---|---|
| gi\|22328869 | MDLYELVKGY | EFSFGLYSVN | FSDPHRTRSP | KLSAHWYSAF | LKGNTTFLGS | 491 |
| CeresClone:1352771 | I DLYELLSGY | TTSFGMYYVN | FSDPGRKRTP | KLSASWYTGF | LNGTI D-VAT | 492 |
| gi\|27363302 | I DLYELLSGY | TTSFGMYYVN | FSDPGRKRTP | KLSASWYTGF | LNGTI D-VAT | 492 |
| gi\|30687750 | VDVYEI LSGY | TTSFGMYHVN | FSDPGRKRTP | KLSASWYTGF | LNGTI D-VAS | 490 |
| gi\|7269635 | VDVYEI LSGY | TTSFGMYHVN | FSDPGRKRTP | KLSASWYTGF | LNGTI D-VAS | 482 |
| gi\|42566152 | I DLYELI CRY | MTSYGMYYVN | FSDPGRKRSP | KLSASWYTGF | LNGTI D-VAS | 486 |
| Lead-CeresClone16412 | I DLYEI I GGY | KSSFGMYHVN | FSDPARKRSS | KLSASWYSGF | LNGTI D-VAS | 487 |
| gi\|51971769 | I DLFEVQVGY | KSSFGMYYVN | FSDPGRKRSP | KLSASWYTGF | LNGTI D-VAS | 481 |
| Consensus | I DLYELLSGY | TTSFGMYYVN | FSDPGRKR-P | KLSASWYTGF | LNGTI D-VAS | 500 |

| | | | |
|---|---|---|---|
| gi\|22328869 | QGI MQMQSNF | SSSASS | 507 |
| CeresClone:1352771 | QDTI QLQSN | SGSSSL | 508 |
| gi\|27363302 | QDTI QLQSN | SGSSSL | 508 |
| gi\|30687750 | QDTI QLWSNF | SVSSSL | 506 |
| gi\|7269635 | QDTI QLWSNF | SVSSSL | 498 |
| gi\|42566152 | QDTI QLQRKC | SGSSSL | 502 |
| Lead-CeresClone16412 | QNI TKLQNKF | SGSSSL | 503 |
| gi\|51971769 | QDMTQLQRNF | SGSSSL | 497 |
| Consensus | QDTI QLQSNF | SGSSSL | 516 |

```
CeresClone:1561415        MGLSFGKLFS RLFAKKEMRI LMVGLDAAGK TTILYKLKLG EIVTTIPTIG  50
CeresClone:380874         ---------- -------MRI LMVGLDAAGK TTILYKLKLG EIVTTIPTIG  33
CeresClone:416460         MGLTFIKLFS RLFAKKEMRI LMVGLDAAGK TTILYKLKLG EIVTTIPTIG  50
CeresClone:631823         MGLTFIKLFS RLFAKKEMRI LMVGLDAAGK TTILYKLKLG EIVTTIPTIG  50
CeresClone:1535974        ---------- -------MRI LMVGLDAAGK TTILYKLKLG EIVTTIPTIG  33
CeresClone:1428788        MGLAFGKLFS RLFAKKEMRI LMVGLDAAGK TTILYKLKLG EIVTTIPTIG  50
CeresClone:738726         MGLTFIKLFS RLFAKKEMRI LMVGLDAAGK TTILYKLKLG EIVTTIPTIG  50
CeresClone:276776         ---------- -------MRI LMVGLDAAGK TTILYKLKLG EIVTTIPTIG  33
CeresClone:240510         ---------- -------MRI LMVGLDAAGK TTILYKLKLG EIVTTIPTIG  33
CeresClone:529239         ---------- -------MRI LMVGLDAAGK TTILYKLKLG EIVTTIPTIG  33
Lead-CeresClone14909      MGLSFGKLFS KLFAKKEMRI LMVGLDAAGK TTILYKLKLG EIVTTIPTIG  50

Consensus                 MGL-F-KLFS RLFAKKEMRI LMVGLDAAGK TTILYKLKLG EIVTTIPTIG  50

CeresClone:1561415        FNVETVEYKN ISFTVWDVGG QDKIRPLWRH YFQNTQGLIF VVDSNDRERV  100
CeresClone:380874         FNVETVEYKN ISFTVWDVGG QDKIRPLWRH YFQNTQGLIF VVDSNDRDRV  83
CeresClone:416460         FNVETVEYKN ISFTVWDVGG QDKIRPLWRH YFQNTQGLIF VVDSNDRDRV  100
CeresClone:631823         FNVETVEYKN ISFTVWDVGG QDKIRPLWRH YFQNTQGLIF VVDSNDRDRV  100
CeresClone:1535974        FNVETVEYKN ISFTVWDVGG QDKIRPLWRH YFQNTQGLIF VVDSNDRDRV  83
CeresClone:1428788        FNVETVEYKN ISFTVWDVGG QDKIRPLWRH YFQNTQGLIF VVDSNDRDRV  100
CeresClone:738726         FNVETVEYKN ISFTVWDVGG QDKIRPLWRH YFQNTQGLIF VVDSNDRERV  100
CeresClone:276776         FNVETVEYKN ISFTVWDVGG QDKIRPLWRH YFQNTQGLIF VVDSNDRERV  83
CeresClone:240510         FNVETVEYKN ISFTVWDVGG QDKIRPLWRH YFQNTQGLIF VVDSNDRERV  83
CeresClone:529239         FNVETVEYKN ISFTVWDVGG QDKIRPLWRH YFQXTQGLIF VVDSNDRDRV  83
Lead-CeresClone14909      FNVETVEYKN ISFTVWDVGG QDKIRPLWRH YFQNTQGLIF VVDSNDRDRV  100

Consensus                 FNVETVEYKN ISFTVWDVGG QDKIRPLWRH YFQNTQGLIF VVDSNDRDRV  100
```

| | | | | | | |
|---|---|---|---|---|---|---|
| CeresClone:1561415 | VEARDELHRM | LNEDELRAPV | LLVFPNNQDL | PNAMNAPEI T | ANLGLHSLRQ | 150 |
| CeresClone:380874 | VEAKDELHRM | LNEDELRDAV | LLVFANKQDL | PNAMNAAEI T | DKLGLHSLRQ | 133 |
| CeresClone:416460 | VEARDELHRM | LNEDELRDAV | LLVFANKQDL | PNAMNAAEI T | DKLGLNSLRQ | 150 |
| CeresClone:631823 | VEARDELHRM | LNEDELRDAV | LLVFANKQDL | PNAMNAAEI T | DKLGLHSLRQ | 150 |
| CeresClone:1535974 | VEARDELHRM | LNEDELRDAV | LLVFANKQDL | PNAMNAAEI T | DKLGLHSLRQ | 133 |
| CeresClone:1428788 | VEARDELHRM | LNEDELRDAV | LLVFANKQDL | PNAMNAAEI T | DKLGLHSLRQ | 150 |
| CeresClone:738726 | VEARDELHRM | LNEDELRDAV | LLVFANKQDL | PNAMNAAEI T | DKLGLHSLRQ | 150 |
| CeresClone:276776 | VEARDELHRM | LNEDELRDAV | LLVFANKQDL | PNAMNAAEI T | DKLGLHSLRQ | 133 |
| CeresClone:240510 | VEARDELHRM | LNEDELRDAV | LLVFANKQDL | PNAMNAAEI T | DKLGLHSLRQ | 133 |
| CeresClone:529239 | VEARDELHRM | LNEDELRDAV | LLVFANXQDL | PNAMNAAEI T | DKLGLHSLRQ | 133 |
| Lead-CeresClone14909 | VEARDELHRM | LNEDELRDAV | LLVFANKQDL | PNAMNAAEI T | DKLGLHSLRQ | 150 |
| Consensus | VEARDELHRM | LNEDELRDAV | LLVFANKQDL | PNAMNAAEI T | DKLGLHSLRQ | 150 |

| | | | | | |
|---|---|---|---|---|---|
| CeresClone:1561415 | RHWSI QSPCA | PSGEGLYEGL | DWLSTNI STK | S | 181 |
| CeresClone:380874 | RHWYI QSTCA | TTGEGLYEGL | DWLSNNI ANK | A | 164 |
| CeresClone:416460 | RHWYI QSTCA | TTGEGLYEGL | DWLSSNI ATK | S | 181 |
| CeresClone:631823 | RHWYI QSTCA | TTGEGLYEGL | DWLSSNI ASK | P | 181 |
| CeresClone:1535974 | RHWYI QSTCA | TTGEGLYEGL | DWLSSNI ASK | A | 164 |
| CeresClone:1428788 | RHWYI QSTCA | TTGEGLYEGL | DWLSSNI ASK | A | 181 |
| CeresClone:738726 | RHWYI QSTCA | TSGEGLYEGL | DWLSNNI ANK | A | 181 |
| CeresClone:276776 | RHWYI QSTCA | TSGEGLYEGL | DWLSNNI ANK | S | 164 |
| CeresClone:240510 | RHWYI QSTCA | TSGEGLYEGL | DWLSNNI ANK | S | 164 |
| CeresClone:529239 | RHWYI QSTCA | TSGEGLYEGL | DWLSNNI ANK | A | 164 |
| Lead-CeresClone14909 | RHWYI QSTCA | TSGEGLYEGL | DWLSNNI ANK | A | 181 |
| Consensus | RHWYI QSTCA | TTGEGLYEGL | DWLSNNI ANK | A | 181 |

| | | | | | | |
|---|---|---|---|---|---|---|
| CeresClone:1042725 | ---MRRVILR | R---DGSRRC | SNNSPVTIVR | Q-----VKYG | KCCRNLACRI | 39 |
| CeresClone:29087 | -MRKRQVVLR | RASPEEPSRS | SSTASSLTVR | I-----VRYG | ECQKNHAAAV | 44 |
| CeresClone:1100582 | -MRKRQVVLR | RASPEEPSRS | SSTASSLTVR | G-----VRYG | ECQKNHAAAV | 44 |
| CeresClone:649770 | ---MRN---- | ---------- | ---------- | ------IRYG | ECQKNHAANI | 17 |
| Lead-CeresClone14583 | MMKKRQMVIK | QRSRNSNTSS | SWTTTSSSSS | SSEISNVRYV | ECQKNHAANI | 50 |
| CeresClone:1119033 | -MKKRQVVIK | QRSRNSNTSS | SWTTTSSSAT | SS----IRYV | ECQKNHAANI | 45 |
| Consensus | -M-KRQVVLR | R-S---N-RS | SST--ST-VR | S-----VRYG | ECQKNHAANI | 50 |

| | | | | | | |
|---|---|---|---|---|---|---|
| CeresClone:1042725 | GGHVVDGCTE | FVAS-GAEGT | REAMTCAICG | CHRNFHMKEE | ITQVLCACSS | 88 |
| CeresClone:29087 | GGYAVDGCRE | FMASRGEEGT | VAALTCAACG | CHRSFHRREI | ETEVVCDCNS | 94 |
| CeresClone:1100582 | GGYAVDGCRE | FMASNGEEGS | VAALTCAACG | CHRSFHRREI | ETEVVCDCNS | 94 |
| CeresClone:649770 | GGYAVDGCRE | FMAS-TGEGA | GGALTCAACG | CHRNFHRREV | NTEVVCEY-S | 65 |
| Lead-CeresClone14583 | GGYAVDGCRE | FMAA-GVEGT | VDALRCAACG | CHRNFHRKEV | DTEVVCEY-S | 98 |
| CeresClone:1119033 | GGYAVDGCRE | FMAA-GVEGT | DDSLRCAACG | CHRNFHRKEV | NTEVVCEY-S | 93 |
| Consensus | GGYAVDGCRE | FMAS-G-EGT | VDALTCAACG | CHRNFHR-EV | -TEVVCE-NS | 100 |

| | | |
|---|---|---|
| CeresClone:1042725 | HPITRTVGD | 97 |
| CeresClone:29087 | PPST---GN | 100 |
| CeresClone:1100582 | PPST---GN | 100 |
| CeresClone:649770 | PPNS---GR | 71 |
| Lead-CeresClone14583 | PPNA----- | 102 |
| CeresClone:1119033 | PPNA----- | 97 |
| Consensus | PPNT---GN | 109 |

| | | | | | | |
|---|---|---|---|---|---|---|
| Lead-CeresClone13263 | -MSSMSMSSS | SAPAFPPDHF | --SSTDQLCY | VHCSFCDTVL | AVSVPPSSLF | 47 |
| CeresClone:227877 | MSSSSSSSSS | AACCFPLDHL | APSPTEQLCY | VHCNCCDTIL | AVGVPCSSLF | 50 |
| CeresClone:228481 | -MMSSSSSSS | AACCFPLDHL | APSPTEQLCY | VHCNCCDTIL | AVGVPCSSLF | 49 |
| Consensus | -MSSSSSSSS | AACCFPLDHL | APSPTEQLCY | VHCNCCDTIL | AVGVPCSSLF | 50 |
| Lead-CeresClone13263 | KTVTVRCGHC | SNLLSVTVSM | RALLLPSVS- | -------NLGH | SFLPPPPP-- | 88 |
| CeresClone:227877 | KTVTVRCGHC | ANLLS--VNL | RGLLLPPAAP | APPNHLNFAH | SLLSPTSPHG | 98 |
| CeresClone:228481 | KTVTVRCGHC | ANLLS--VNL | RGLLLPPAAP | APPNHLNFAH | SLLSPTSPHG | 97 |
| Consensus | KTVTVRCGHC | ANLLS--VNL | RGLLLPPAAP | APPNHLNFAH | SLLSPTSPHG | 100 |
| Lead-CeresClone13263 | -------PPP | PNLLEEMRSG | GQNLNMNMMM | SHHASAHHPN | EHLVMATRNG | 131 |
| CeresClone:227877 | LLDELALQQA | PSFLMEQASA | NLSSTMTGRS | SNSSCASNLP | PPAPMPA--A | 146 |
| CeresClone:228481 | LLDELALQQA | PSFLMEQASA | NLSSTMTGRS | SNSSCASNLP | PPAPMPA--A | 145 |
| Consensus | LLDELALQQA | PSFLMEQASA | NLSSTMTGRS | SNSSCASNLP | PPAPMPA--A | 150 |
| Lead-CeresClone13263 | RSVDHLQEMP | RPPPA-NRPP | EKRQRVPSAY | NRFIKEEIQR | IKAGNPDISH | 180 |
| CeresClone:227877 | QPVQQEAELP | KTAPSVNRPP | EKRQRVPSAY | NRFIKDEIQR | IKAGNPDITH | 196 |
| CeresClone:228481 | QPVQQEAELP | KTAPSVNRPP | EKRQRVPSAY | NRFIKDEIQR | IKAGNPDITH | 195 |
| Consensus | QPVQQEAELP | KTAPSVNRPP | EKRQRVPSAY | NRFIKDEIQR | IKAGNPDITH | 200 |
| Lead-CeresClone13263 | REAFSAAAKN | WAHFPHIHFG | LMADHPPTKK | ANVRQQEGED | GMMGREGFYG | 230 |
| CeresClone:227877 | REAFSAAAKN | WAHFPHIHFG | LMPDQ-GLKK | TFKTHQDGAE | DMLLKDDLYA | 245 |
| CeresClone:228481 | REAFSAAAKN | WAHFPHIHFG | LMPDQ-GLKK | TFKT-QDGAE | DMLLKDDLYA | 243 |
| Consensus | REAFSAAAKN | WAHFPHIHFG | LMPDQ-GLKK | TFKT-QDGAE | DMLLKDDLYA | 250 |
| Lead-CeresClone13263 | SAA-----NV | GVAHN | 240 | | | |
| CeresClone:227877 | AAAAAAAANM | GITPF | 260 | | | |
| CeresClone:228481 | AAAAAAAANM | GITPF | 258 | | | |
| Consensus | AAAAAAAANM | GITPF | 265 | | | |

```
gi|27544804             MAAA---ASS ASSVHDFTVK DASGKDVDLS TYKGKVLLIV NVASQCGLTN  47
CeresClone:288261       MGAAE--SVP ETSIHEFTVK DCNGKEVSLE TYKGKVLLVV NVASKCGFTE  48
gi|11544696             MGAAE--SVP ETSIHEFTVK DCNGKEVSLE MYKGKVLIVV NVASKCGFTE  48
CeresClone:1059504      MGASE--SVP ETSVHEFTVK DCNGKEVCLD TYKGKVLLIV NVASKCGFTE  48
CeresClone:639745       MGASE--SVL ETSVHEFTVK DCNGKEVCLD TYKGKVLLIV NVASKCGFTE  48
Lead-CeresClone13092    MGASSSSSVS EKSIHQFTVK DSSGKEVDLS VYQGKVLLVV NVASKCGFTE  50
gi|25285637             MGASA--SVP ERSVHQFTVK DSSGKDLNMS IYQGKVLLIV NVASKCGFTE  48

Consensus               MGASE--SVP ETSVHEFTVK DCNGKEV-L- TYKGKVLLIV NVASKCGFTE  50

gi|27544804             SNYTELAQLY EKYKDQGFEI LAFPCNQFGG QEPGTNEEIV QFACTRFKAE  97
CeresClone:288261       TNYTQLTELY QKYRDKDFEI LAFPCNQFLR QEPGTDQQIQ DFACTRFKAE  98
gi|11544696             TNYTQLTELY QKHRDKDFEI LAFPCNQFLR QEPGSDQQIK DFACTRFKAE  98
CeresClone:1059504      TNYTQLTELY QKYREKDFEI LAFPCNQFLR QEPGSDQQIQ DFACTRFKAE  98
CeresClone:639745       TNYTQLTELY QKYREKDFEI LAFPCNQFLR QEPGSDQQIQ DFACTRFKAE  98
Lead-CeresClone13092    SNYTQLTELY RKYKDQGFVV LAFPCNQFLS QEPGTSEEAH QFACTRFKAE 100
gi|25285637             TNYTQLTELY RKYKDQDFEI LAFPCNQFLY QEPGTSQEAH EFACERFKAE  98

Consensus               TNYTQLTELY QKYRDKDFEI LAFPCNQFLR QEPGTDQQIQ DFACTRFKAE 100

gi|27544804             YPIFDKVDVN GDNVAPVYKF LKSSKGSLFG -DNIKWNFSK FLVDKDGNVV 146
CeresClone:288261       YPVFQKVRVN GPDAAPVYKF LKASKPGLFG SSRIKWNFTK FLVDKDGKVI 148
gi|11544696             YPVFQKVRVN GPDAAPLYKF LKASKPGLFG -SRIKWNFTK FLIDKNGKVI 147
CeresClone:1059504      YPVFQKVRVN GPDAAPLYKF LKASKPGLFG -SRIKWNFTK FLVDKNGKVI 147
CeresClone:639745       YPVFQKVRVN GPDAAPLYKF LKANKPGLFG -SRIKWNFTK FLVDKNGKVI 147
Lead-CeresClone13092    YPVFQKVRVN GQNAAPVYKF LKSKKPSFLG -SRIKWNFTK FLVGKDGQVI 149
gi|25285637             YPVFQKVRVN GQNAAPIYKF LKASKPTFLG -SRIKWNFTK FLVGKDGLVI 147

Consensus               YPVFQKVRVN GPDAAP-YKF LKASKPGLFG -SRIKWNFTK FLVDKDGKVI 150

gi|27544804             DRYAPTTSPL SIEKDIKKLL ASS------- ---------- 169
CeresClone:288261       ERYGTSTAPM AIEKDIQKAL EE-------- ---------- 170
gi|11544696             NRYSTATSPL SFEKDILKAL ED-------- ---------- 169
CeresClone:1059504      NRYATATTPF SFEKDIQKAL EEEPSDSQTK KEEESSDSQK 187
CeresClone:639745       NRYATATTPF SFEKDIQKAL EEEPSDSQTK KEEESSDSQK 187
Lead-CeresClone13092    DRYGTTVSPL SIQKDIEKAL AQEL------ ---------- 173
gi|25285637             DRYGTMVTPL SIEVSMLYIS KVPM------ ---------- 171

Consensus               -RYAT-T-PL SIEKDIQKAL EE-------- ---------- 190
```

```
CeresClone:1126078       MI SVVI LAEL LVEYTSAI AK LTVGMLPRRQ SGDSNVVRVG GFLLPCPSP-  49
CeresClone:1127491       MI SVVI I XEX LLEYTAALAK LXAGI XP-XR XGDGXVVRI G GFSLXCP---  46
CeresClone:1461734       MI SVVI I TEY LVEYTTALAK LTAGI LP-RR TGDRNVLRI G GFLLPSPS--  47
CeresClone:1070103       MI SVVI I TEL LVEYTTALAK LTAGI LP-RR RGDXDXI RI G GFSLRFP---  46
CeresClone:951883        MI SVVI I TEL LVEYTTALAK LAAGI LP-RR RGDGDVI RI G GFSLRFP---  46
CeresClone:1025550       MI SVVI I AEL LVEYTTALAK LTAGI LPSRR RGDSNVVRI G GFSLPCPSPS  50
gi|21593750              MI SVVI I AEL LVEYTTALAK LTAGI LPSRR RGDSNVVRI G GFSLPCPSPS  50
Lead-CeresClone12935     MI SVVI I TEL LLEYTTALAK LTAGVLP-RR QGDRNVI RI G GFSLPCP---  46
CeresClone:8827          MI SI VI I TEL LVEYTTALAK LTAGI LP-RR QGDGDVVRI G GFSLYCP---  46
gi|21617917              MI SI VI I TEL LVEYTTALAK LTAGI LP-RR QGDGDVVRI G GFSLYCP---  46

Consensus                MI SVVI I TEL LVEYTTALAK LTAGI LP-RR RGD-NVVRI G GFSLPCP---  50

CeresClone:1126078       -TSTNRSSPF PDFSSHLVDF  68
CeresClone:1127491       ----PRSSPI PDFSSHLVDX  62
CeresClone:1461734       ----SAVSRI PDFSAHLVDF  63
CeresClone:1070103       ----SRSXPX PDFSSHLVXF  62
CeresClone:951883        ----SRSTPV PDFSSHLVDF  62
CeresClone:1025550       SSSTSRSSAI PDFSSHLVDF  70
gi|21593750              SSSTSRSSAI PDFSSHLVDF  70
Lead-CeresClone12935     ----PRSSPV PDFSSHLVDF  62
CeresClone:8827          ----PRSSPI PDFSSHLVNF  62
gi|21617917              ----PRSSPI PDFSSHLVNF  62

Consensus                ----SRSSPI PDFSSHLVDF  70
```

```
CeresClone:933957        -MVFVKNQKT RAYSKRFQVK FKRRRQGKTD YRARLRLINQ DKNKYNTPKY   49
CeresClone:1538293       MGGFVKTHKT NAYFKRFQVK FKRRRAGKTD YRARIRLINQ DKNKYNTPKY   50
Lead-CeresClone32753     -MVFVKSTKS NAYFKRYQVK FRRRRDGKTD YRARIRLINQ DKNKYNTPKY   49
CeresClone:21756         -MVFVKSSKS NAYFKRYQVK FRRRRDGKTD YRARIRLINQ DKNKYNTPKY   49

Consensus                -MVFVKS-K- NAYFKR-QVK F-RRRDGKTD YRARIRLINQ DKNKYNTPKY   50

CeresClone:933957        RFVVRFTNKD VTAQIVYATI AGDIVMAAAY SHELPRYGLE VGXTXYXAAY   99
CeresClone:1538293       RFVVRFTNKD ITAQIISASI AGDMVLASAY SHELPRYGLE VGLTNYAAAY  100
Lead-CeresClone32753     RFVVRFTNKD IVAQIVSASI AGDIVKASAY AHELPQYGLT VGLTNYAAAY   99
CeresClone:21756         RFVVRFTNKD IVAQIVSASI AGDIVKASAY AHELPQYGLT VGLTNYAAAY   99

Consensus                RFVVRFTNKD I-AQIVSASI AGDIV-ASAY -HELP-YGL- VGLTNYAAAY  100

CeresClone:933957        CTGLLLAXRV LKCRDLDQEY EGNVEAXGED FSVEXXDERX PFXALLDVGL  149
CeresClone:1538293       CTGLLLARRV LKIRGLDKEY EGNVEATGED FSVEPADERR PFRALLDVGL  150
Lead-CeresClone32753     CTGLLLARRV LKMLEMDDEY EGNVEATGED FSVEPTDSRR PFRALLDVGL  149
CeresClone:21756         CTGLLLARRV LKMLEMDDEY EGNVEATGED FSVEPTDSRR PFRALLDVGL  149

Consensus                CTGLLLARRV LKM-E-D-EY EGNVEATGED FSVEPTD-RR PFRALLDVGL  150

CeresClone:933957        IRTTTGNRVF GALKGALDGG LDIPHSDKRF AGFKKDEKQL DAEIHRXYIX  199
CeresClone:1538293       IRTTTGNRVF GALKGALDGG LDIPHSEKRF AGFKKDDKQL DADIHRRYIY  200
Lead-CeresClone32753     IRTTTGNRVF GALKGALDGG LDIPHSDKRF AGFHKENKQL DAEIHRNYIY  199
CeresClone:21756         IRTTTGNRVF GALKGALDGG LDIPHSDKRF AGFHKENKQL DAEIHRNYIY  199

Consensus                IRTTTGNRVF GALKGALDGG LDIPHSDKRF AGF-K-NKQL DAEIHRNYIY  200

CeresClone:933957        GXHVADYMXS XXDEEXXKXQ XHFSEYIKRG ISADDMEAVY KKVHAAIRAD  249
CeresClone:1538293       GGHVADYMKN LAEEEPEKYQ SHFSAYIKKG VEADEIEALY KKVHAAIRAD  250
Lead-CeresClone32753     GGHVSNYMKL LGEDEPEKLQ THFSAYIKKG VEAESIEELY KKVHAAIRAX  249
CeresClone:21756         GGHVSNYMKL LGEDEPEKLQ THFSAYIKKG VEAESIEEMY KKVHAAIRAE  249

Consensus                GGHV--YMK- LGE-EPEKLQ THFSAYIKKG VEA--IE-LY KKVHAAIRAD  250
```

| | | | | | | |
|---|---|---|---|---|---|---|
| CeresClone:933957 | PIMAKSTKAP | PKTHKRYNPK | KLTYEQRKAS | LVERLNALNN | SAGAADDDED | 299 |
| CeresClone:1538293 | PSIVKSTKQP | PKEHKRYNPK | KLTYEQRKAS | LIERLNQLNS | SGGADDDDED | 300 |
| Lead-CeresClone32753 | PNXRKTVKPA | PKQHKRYNLK | KLTYEERKNK | LIERVRH--- | ---------- | 286 |
| CeresClone:21756 | PNHKKTEKSA | PKEHKRYNLK | KLTYEERKNK | LIERVKALNG | AGGDDDDEDD | 299 |
| Consensus | PN--K-TK-- | PKEHKRYN-K | KLTYE-RK-- | LIER--ALN- | SGGADDDDED | 300 |

| | | |
|---|---|---|
| CeresClone:933957 | DDE | 302 |
| CeresClone:1538293 | DE- | 302 |
| Lead-CeresClone32753 | --- | 286 |
| CeresClone:21756 | EE- | 301 |
| Consensus | DE- | 303 |

| | | |
|---|---|---|
| Lead-CeresClone32548 | --MSEVEYRC FVGGLAWATN DEDLQRTFSQ FGDVI DSKI I NDRESGRSRG | 48 |
| gi\|17819 | --MSEVEYRC FVGGLAWATG DAELERTFSQ FGEVI DSKI I NDRETGRSRG | 48 |
| gi\|18347 | --MAEVEYRC FVGGLAWATN DESLEQAFSQ FGDI IDSKI I NDRETGRSRG | 48 |
| CeresClone:7420 | MASGDVEYRC FVGGLAWATD DRALETAFAQ YGDVI DSKI I NDRETGRSRG | 50 |
| gi\|4567224 | MASGDVEYRC FVGGLAWATD DRALETAFAQ YGDVI DSKI I NDRETGRSRG | 50 |
| CeresClone:13879 | MASGDVEYRC FVGGLAWATD DRALETAFAQ YGDVI DSKI I NDRETGRSRG | 50 |
| gi\|21553354 | MASGDVEYRC FVGGLAWATD DRALETAFAQ YGDVI DSKI I NDRETGRSRG | 50 |
| gi\|1346180 | MASPDVEYRC FVGGLAWATD DRALETAFSQ YGEVLDSKI I NDRETGRSRG | 50 |
| gi\|1346181 | MASPDVEYRC FVGGLAWATD ERSLETAFSQ FGELVDSKI I NDRETGRSRG | 50 |
| Consensus | MAS-DVEYRC FVGGLAWATD DRALETAFSQ YGDVI DSKI I NDRETGRSRG | 50 |

| | | |
|---|---|---|
| Lead-CeresClone32548 | FGFVTFKDEK AMRDAI EEMN GKELDGRVI T VNEAQSRGSG GGGGGRGGSG | 98 |
| gi\|17819 | FGFVTFKDEK SMKDAI DEMN GKELDGRTI T VNEAQSRG-G GGGGGRG--G | 95 |
| gi\|18347 | FGFVTFKDEK SMRDAI EGMN GQELDGRNI T VNEAQSRGSG GGGGRREGGG | 98 |
| CeresClone:7420 | FGFVTFKDEK AMKDAI EGMN GQDLDGRSI T VNEAQSRGSG GGGGHRGGGG | 100 |
| gi\|4567224 | FGFVTFKDEK AMKDAI EGMN GQDLDGRSI T VNEAQSRGSG GGGGHRGGGG | 100 |
| CeresClone:13879 | FGFVTFKDEK AMKDAI EGMN GQDLDGRSI T VNEAQSRGSG GGGGHRGGGG | 100 |
| gi\|21553354 | FGFVTFKDEK AMKDAI EGMN GQDLDGRSI T VNEAQSRGSG GGGGHRGGGG | 100 |
| gi\|1346180 | FGFVTFKDEK SMKDAI EGMN GQDLDGRSI T VNEAQSRGSG GGGGGRGG-G | 99 |
| gi\|1346181 | FGFVTFKDEK SMKDAI EGMN GQDLDGRSI T VNEAQSRGSG AGGGGRGG-G | 99 |
| Consensus | FGFVTFKDEK AMKDAI EGMN GQDLDGRSI T VNEAQSRGSG GGGG-RGGGG | 100 |

| | | |
|---|---|---|
| Lead-CeresClone32548 | GGYRSGGGGG YSGG-GGGGY SGGGG----- GGYERRSGGY GSG--GGGGG | 140 |
| gi\|17819 | GGYGGRGGGG YGG--GGGGY GDRRG----G GGYGSGGGGR GGGGYGSGGG | 139 |
| gi\|18347 | GGY--GGGGG YGGRREGGCG GGYGGRRE-- ----GGGGGY -----GGGGG | 135 |
| CeresClone:7420 | GGYRSGGGGG YSG--GGGSY GGGGGRREGG GGY-SGGGGY SSR--GGGGG | 145 |
| gi\|4567224 | GGYRSGGGGG YSG--GGGSY GGGGGRREGG GGYSGGGGGY SSR--GGGGG | 146 |
| CeresClone:13879 | GGYRSGGGGG YSG--GGGSY GGGGGRREGG GGY-SGGGGY SSR--GXGGG | 145 |
| gi\|21553354 | GGYRSGGGGG YSG--GGGSY GGGGGRREGG GGY-SGGGGY SSR--GXGGG | 145 |
| gi\|1346180 | GGYRSGGGGG YGG--GGGGY GGGGR----E GGYSGGGGGY SSR--GGGGG | 141 |
| gi\|1346181 | GGYR--GGGG YGG--GGGGY --GGGRRE-G GGYSGGGGGY SSR--GGGGG | 140 |
| Consensus | GGYRSGGGGG YSG--GGGGY GGGGGRRE-G GGY--GGGGY SSR--GGGGG | 150 |

```
Lead-CeresClone32548   RGY-GGGGRR EGGGYGGGD- GGSYGG--GG GGW   169
gi|17819               -GYGGGGGRR DGGGYGGGD- GG-YGGGSGG GGW   169
gi|18347               -GY--GGRRE GG------D- GG-YGGGGGG SRW   157
CeresClone:7420        -SY-GGGRRE GGGGYGGGEG GG-YGGSGGG GGW   175
gi|4567224             -SY-GGGRRE GGGGYGGGEG GG-YGGSGGG GGW   176
CeresClone:13879       -SY-GGGRRE GGGGYGGGEG GG-YGGSGGG GGW   175
gi|21553354            -SY-GGGRRE GGGGYGGGEG GG-YGGSGGG GGW   175
gi|1346180             -GY-GGGGRR DG-----GEG GG-YGGSGGG GGW   166
gi|1346181             -GY-GGGGRR DGGGYGGGEG GG-YGG-GGG GGW   169

Consensus              -GY-GGGRRE GGGGYGGGEG GG-YGGSGGG GGW   183
```

| | | | | | | |
|---|---|---|---|---|---|---|
| CeresClone:241576 | RLHEOTTHPT | YPGRTGRQHN | MDLALLEKAL | LGLFAAAVVA | IAVAKLSGKR | 50 |
| CeresClone:755965 | ---------- | ---------- | MDFVFVEKLL | AGLLAAVVGA | LVVSKIRGRK | 30 |
| Lead-CeresClone32348 | ---------- | ---------- | MDLLLLEKSL | IAVFVAVILA | TVISKLRGKK | 30 |
| gi\|24571503 | ---------- | ---------- | MDLLLLEKAL | LGLFAAAVVA | IAVSKLRGKR | 30 |
| gi\|44889626 | ---------- | ---------- | MELLLLEKTL | ISLFFAITLA | IVISKLRGKK | 30 |
| gi\|3915112 | ---------- | ---------- | MDLLLVEKTL | LALFAAIIAS | IFISKLRGKR | 30 |
| gi\|586082 | ---------- | ---------- | MDLLLLEKTL | LGLFLAAVVA | IVVSKLRGKR | 30 |
| gi\|9965899 | ---------- | ---------- | MDLLFLEKVL | ISLFFTIIFA | ILVSKLRGKR | 30 |
| gi\|9965897 | ---------- | ---------- | MDLLFLEKAL | LGLFVAVVLA | IFISKLRGKR | 30 |
| gi\|12276037 | ---------- | ---------- | MDLLLLEKTL | LGSFVAILVA | ILVSKLRGKR | 30 |
| Consensus | ---------- | ---------- | MDLLLLEK-L | LGLF-AVVVA | IVVSKLRGKR | 50 |

| | | | | | | |
|---|---|---|---|---|---|---|
| CeresClone:241576 | YRLPPGPPGA | PVVGNWLQVG | DDLNHRNLMA | MAKRFGDIFL | LRMGVRNLVV | 100 |
| CeresClone:755965 | LRLPPGPFPV | PIFGNWLQVG | DDLNHRNLAA | MARKFGEVFL | LRMGQRNLVV | 80 |
| Lead-CeresClone32348 | LKLPPGPIPI | PIFGNWLQVG | DDLNHRNLVD | YAKKFGDLFL | LRMGQRNLVV | 80 |
| gi\|24571503 | FKLPPGPFGF | PVFGNWLQVG | DDLNQRKLAN | LSKKFGDVYL | LRMGQRNLVV | 80 |
| gi\|44889626 | FKLPPGPLPV | PIFGNWLQVG | DDLNHRNLAN | FAKKFGDVFL | LRMGQRNLVV | 80 |
| gi\|3915112 | FKLPPGPVPV | PIFGNWLQVG | DDLNHRNLTD | LAKKFGEIFL | LRMGQRNLVV | 80 |
| gi\|586082 | FKLPPGPLPV | PIFGNWLQVG | DDLNHRNLTQ | LAKRFGDIFL | LRMGQRNLVV | 80 |
| gi\|9965899 | FKLPPGPLPI | PVFGNWLQVG | DDLNHRNLTD | LAKKFGDIFL | LRMGQRNLVV | 80 |
| gi\|9965897 | FKLPPGPLPV | PVFGNWLQVG | DDLNHRNLTD | LAKKFGDIFL | LRMGQRNLVV | 80 |
| gi\|12276037 | FKLPPGPIPV | PVFGNWLQVG | DDLNHRNLTD | LAKKFGDIFL | LRMGQRNLVV | 80 |
| Consensus | FKLPPGPLPV | P-FGNWLQVG | DDLNHRNLTD | LAKKFGDIFL | LRMGQRNLVV | 100 |

| | | | | | | |
|---|---|---|---|---|---|---|
| CeresClone:241576 | VSTPELAKEV | LHTQGVEFGS | RTRNVVFDIF | TGKGQDMVFT | VYGDHWRKMR | 150 |
| CeresClone:755965 | VSSPPLAREV | LHTQGVEFGS | RTRNVVFDIF | TGEGQDMVFT | VYGDHWRKMR | 130 |
| Lead-CeresClone32348 | VSSPDLTKEV | LLTQGVEFGS | RTRNVVFDIF | TGKGQDMVFT | VYGEHWRKMR | 130 |
| gi\|24571503 | VSSPEMAKEV | LHTQGVEFGS | RTRNVVFDIF | TGKGQDMVFT | VYSEHWRKMR | 130 |
| gi\|44889626 | VSSPDLARDV | LHTQGVEFGS | RTRNVVFDIF | TGKGQDMVFT | VYGEHWRKMR | 130 |
| gi\|3915112 | VSSPNLAKEV | LHTQGVEFGS | RTRNVVFDIF | TGKGQDMVFT | VYGEHWRKMR | 130 |
| gi\|586082 | VSSPDLAKEV | LHTQGVEFGS | RTRNVVFDIF | TGEGQDMVFT | VYGEHWRKMR | 130 |
| gi\|9965899 | ISSPELAKEV | LHTQGVEFGS | RTRNVVFDIF | TGKGQDMVFT | VYGEHWRKMR | 130 |
| gi\|9965897 | VSSPELAKEV | LHTQGVEFGS | RTRNVVFDIF | TGKGQDMVFT | VYGEHWRKMR | 130 |
| gi\|12276037 | VSSPDLSKEV | LHTQGVEFGS | RTRNVVFDIF | TGKGQDMVFT | VYGEHWRKMR | 130 |
| Consensus | VSSP-LAKEV | LHTQGVEFGS | RTRNVVFDIF | TGKGQDMVFT | VYGEHWRKMR | 150 |

```
CeresClone:241576      RI MTVPFFTN KVVAQNRAGW EEEARLVVED VRKDPEAAAG GVVLRRRLQL  200
CeresClone:755965      RI MTVPFFTN KVVQQYRPGW EAEAAFVI DN VRADPRAATE GVVLRRHLQL  180
Lead-CeresClone32348   RI MTVPFFTN KVVQQNREGW EFEAASVVED VKKNPDSATK GI VLRKRLQL  180
gi|24571503            RI MTVPFFTN KVVQQQRFNW EDEAARVVED VKKDPQAATT GI VLRRRLQL  180
gi|44889626            RI MTVPFFTN KVVNQYRYGW EDEAGRVVED VKKDAKAATE GI VLRKRLQL  180
gi|3915112             RI MTVPFFTN KVVQQYRTGW EAEAAAVVDD VKKNPKAATE GVVI RKRLQL  180
gi|586082              RI MTVPFFTN KVVQQYRHGW EAEAAAVVDD VRKNPDAAVS GLVI RRRLQL  180
gi|9965899             RI MTVPFFTN KVVQQYRHGW EDEAASVVED VKKNPEAATN GI VLRRKLQL  180
gi|9965897             RI MTVPFFTN KVVQQYRFGW EDEAARVVED VRKNPEAATN GI VLRRRLQL  180
gi|12276037            RI MTVPFFTN KVVQQYRYGW EEEAAQVVED VKKNPEAATN GI VLRRRLQL  180

Consensus              RI MTVPFFTN KVVQQYR-GW EDEAA-VVED VKKNPEAAT- GI VLRRRLQL  200

CeresClone:241576      MMYNDMFRI M FDRRFDSEHD PLFNKLKALN AERSRLSQSF EYNYGDFI PV  250
CeresClone:755965      MMYNNMYRI M FDRRFESMDD PLFLRLRALN GERSRLAQSF EYNYGDFI PI  230
Lead-CeresClone32348   MMYNNMFRI M FDRRFESEDD PLFLRLKALN GERSRLAQSF EYNYGDFI PI  230
gi|24571503            LMYNNMYRI M FDRRFESVDD PLFNKLKALN GERSRLAQSF EYNYGDFI PI  230
gi|44889626            MMYNNMYRI M FDRRFESEND PLFLKLKALN GERSRLAQSF EYNYGDFI PI  230
gi|3915112             MMYNNMFRI M FDRRFESEDD PLFVKLKMLN GERSRLAQSF EYNYGDFI PI  230
gi|586082              MMYNNMYRI M FDRRFESEED PLFQRLKALN GERSRLAQSF EYNYGDFI PI  230
gi|9965899             MMYNNMYRI M FDRRFESEDD PLFVKLKALN GERSRLAQSF EYNYGDFI PI  230
gi|9965897             MMYNNMYRI M FDTRFESEDD PLFVRLKALN GERSRLAQSF EYNYGDFI PI  230
gi|12276037            MMYNNMYRI M FDRRFESEDD PLFNKLKALN GERSRLAQSF DYNYGDFI PI  230

Consensus              MMYNNMYRI M FDRRFESEDD PLF-KLKALN GERSRLAQSF EYNYGDFI PI  250

CeresClone:241576      LRPFLRGYLN RCHDLKTRRM KFFEDNFVQE RKKVMAQTG- -----EI RCAM  295
CeresClone:755965      LRPFLRGYLR LCKEVKETRL KLFKDYFLDE RKKLVSTKAM DNNGGLKCAI  280
Lead-CeresClone32348   LRPFLRGYLK I CQDVKDRRI ALFKKYFVDE RKQI ASSKPT GSE-GLKCAI  279
gi|24571503            LRPFLRGYLK LVKEVKERRL KLFKDYFVEE RKKLTSTKSM TEE-NFKCAI  279
gi|44889626            LRPFLRGYLK I CKEVKERRI QLFKDYFLEE RKKLSSTKPT DNA-GLKCAI  279
gi|3915112             LRPFLKGYLK LCKEVKEKRF QLFKDYFVDE RKKLGSTKSM DNN-QLKCAI  279
gi|586082              LRPFLKGYLK I CKEVKETRL KLFKDYFVDE RKNI GSTKST NNE-GLKCAI  279
gi|9965899             LRPFLRGYLK LCKEVKEI RL QLFRDQFLEE RKKLATTKRI DNN-ALKCAI  279
gi|9965897             LRPFLRGYLK I CKEVKDRRL QLFKDHFVEE RKKLGSTKSM NND-GLKCAI  279
gi|12276037            LRPFLRGYLK LCQEVKERRL QLFKDYFVDE RKKLASTKNM SNE-GLKCAI  279

Consensus              LRPFLRGYLK I CKEVKERRL QLFKDYFVDE RKKL-STKSM -N--GLKCAI  300
```

| | | | | | | |
|---|---|---|---|---|---|---|
| CeresClone:241576 | DHI LEAERKG | EI NHDNVLYI | VENI NVAAI E | TTLWSI EWGI | AELVNHPAI Q | 345 |
| CeresClone:755965 | DHI LEAEQKG | EI NEDNVLYI | I ENI NVAAI E | TTLWSI EWGL | AELVNHPEI Q | 330 |
| Leod-CeresClone32348 | DHI LEAEQKG | EI NEDNVLYI | VENI NVAAI E | TTLWSI EWGI | AELVNHPEI Q | 329 |
| gi\|24571503 | DHVLDAQQKG | EI NEDNVLYI | VENI NVAAI E | TTLWSI EWGI | AELVNHPDI Q | 329 |
| gi\|44889626 | DHI LDAEKKG | EI NEDNVLYI | VENI NVAAI E | TTLWSI EWGI | AELVNHPKI Q | 329 |
| gi\|3915112 | DHI LDAKDKG | EI NEDNVLYI | VENI NVAAI E | TTLWSI EWAI | AELVNHPEI Q | 329 |
| gi\|586082 | DHI LDAEKKG | EI NEDNVLYI | VENI NVAAI E | TTLWSI EWGI | AELVNHPEI Q | 329 |
| gi\|9965899 | DHI LDAQRKG | EI NEDNVLYI | VENI NVAAI E | TTLWSI EWGI | AELVNHPEI Q | 329 |
| gi\|9965897 | DHI LDAQQKG | EI NEDNVLYI | VENI NVAAI E | TTLWSI EWGI | AELVNHPEI Q | 329 |
| gi\|12276037 | DHI LDAQKKG | EI NEDNVLYI | VENI NVAAI E | TTLWSI EWGI | AELVNHPEI Q | 329 |
| Consensus | DHI LDAEQKG | EI NEDNVLYI | VENI NVAAI E | TTLWSI EWGI | AELVNHPEI Q | 350 |

| | | | | | | |
|---|---|---|---|---|---|---|
| CeresClone:241576 | HKLREELASV | LGAGVPVTEP | DLERLPYLQA | I VKETLRLRM | AI PLLVPHMN | 395 |
| CeresClone:755965 | QKLRDEMDAV | LGAGHQI TEP | ETHKLPYLQA | VI KETLRLRM | AI PLLVPHMN | 380 |
| Leod-CeresClone32348 | SKLRNELDTV | LGPGVQVTEP | DEHKLPYLQA | VVKETLRLRM | AI PLLVPHMN | 379 |
| gi\|24571503 | KKLRAEI DRV | LGPDHQI TEP | DTHKLPYLQA | VI KETLRLRM | AI PLLVPHMN | 379 |
| gi\|44889626 | RKLQHELDTV | LGPGTQI TEP | DTHRLPYLQA | VI KETLRLRM | AI PLLVPHMN | 379 |
| gi\|3915112 | AKLRHELVSQ | LGPGVQVTEP | DLHKLPYLQA | VI KETLRLRM | AI PLLVPHMN | 379 |
| gi\|586082 | QKVRDEI DRV | LGVGHQVTEP | DI QKLPYLQA | VVKETLRLRM | AI PLLVPHMN | 379 |
| gi\|9965899 | QKLRNEI DTV | LGPGVQVTEP | DTHKLPYLQA | VI KETLRLRM | AI PLLVPHMN | 379 |
| gi\|9965897 | KKLRHELDTV | LGPGNQI TEP | DTHKLPYLQA | VI KETLRLRM | AI PLLVPHMN | 379 |
| gi\|12276037 | KKLRHELDTL | LGPGHQI TEP | DTYKLPYLNA | VI KETLRLRM | AI PLLVPHMN | 379 |
| Consensus | -KLR-ELDTV | LGPGHQ-TEP | DTHKLPYLQA | VI KETLRLRM | AI PLLVPHMN | 400 |

| | | | | | | |
|---|---|---|---|---|---|---|
| CeresClone:241576 | LNDGKLAGYD | I PAESKI LVN | AWFLANDPKR | WVRPDEFRPE | RFLEEEKSVE | 445 |
| CeresClone:755965 | LHDAKLAGYN | I PAESKI LVN | AWFLANNPEQ | WKRPDEFRPE | RFLEEEKHVE | 430 |
| Leod-CeresClone32348 | LHDAKLAGYD | I PAESKI LVN | AWWLANNPNS | WKKPEEFRPE | RFFEEESHVE | 429 |
| gi\|24571503 | LNDAKLAGYD | I PAESKI LVN | AWWLANNPAH | WKDPQVFRPE | RFLEEESGVE | 429 |
| gi\|44889626 | LHDAKLGGYD | I PAESKI LVN | AWWLANNPAH | WKDPEEFRPE | RFLEEEAKVE | 429 |
| gi\|3915112 | LHDAKLGGYD | I PAESKI LVN | AWWLANNPDQ | WKKPEEFRPE | RFLEEESKVE | 429 |
| gi\|586082 | LHDAKLGGYD | I PAESKI LVN | AWWLANNPAH | WKKPEEFRPE | RFFEEESHVE | 429 |
| gi\|9965899 | LHDAKLGGYD | I PAESKI LVN | AWWLANNPAH | WKNPEEFRPE | RFFEEESKVE | 429 |
| gi\|9965897 | LHDAKLGGYD | I PAESKI LVN | AWWLANNPAN | WKNPEEFRPE | RFFEEEAKVE | 429 |
| gi\|12276037 | LHDAKLGGFD | I PAESKI LVN | AWWLANNPAH | WKNPEEFRPE | RFLEEEAKVE | 429 |
| Consensus | LHDAKLGGYD | I PAESKI LVN | AWWLANNPAH | WK-PEEFRPE | RFLEEESKVE | 450 |

```
CeresClone:241576        AHGNDFRFVP FGVGRRSCPG IILALPIIGI TLGRLVQNFQ LLPPPGLDKI 495
CeresClone:755965        ANGNDFRYLP FGVGRRSCPG IILALPILGI TIGRLVQNFV LIPPPGQDKL 480
Lead-CeresClone32348     ANGNDFRYVP FGVGRRSCPG IILALPILGI TIGRMVQNFE LLPPPGQSKV 479
gi|24571503              ANGNDFRYIP FGVGRRSCPG IILALPILGI TIGRMVQNFE LLPPPGQSKI 479
gi|44889626              ANGNDFRYIP FGVGRRSCPG IILALPILGI TIGRLVQNFD LMPPPGMDKI 479
gi|3915112               ANGNDFRYLP FGVGRRSCPG IILALPILGI TIGRLVQNFE LLPPPGQDKV 479
gi|586082                ANGNDFRYLP FGVGRRSCPG IILALPILGI TLGRLVQNFE LLPPPGQSQI 479
gi|9965899               ANGNDFRYLP FGVGRRSCPG IILALPILGI TLGRLVQNFE LLPPKGQSKL 479
gi|9965897               ANGNDFRYLP FGVGRRSCPG IILALPILGI TLGRLVQNFE LLPPPGQSQI 479
gi|12276037              ANGNDFRYLP FGVGRRSCPG IILALPILGI TLGRLVQNFE LLPPPGQSKI 479

Consensus                ANGNDFRYLP FGVGRRSCPG IILALPILGI T-GRLVQNFE LLPPPGQSKI 500

CeresClone:241576        DTTEKPGQFS NQIAKHATIV CKPLEA- 521
CeresClone:755965        DTTEKGGQFS LHILKHSTIV AKPRVF- 506
Lead-CeresClone32348     DTSEKGGQFS LHILNHSLIV MKPRNC- 505
gi|24571503              DTSEKGGQFS LFILNHSTIV LKPRSSV 506
gi|44889626              DTTEKGGQFS LHILNHSTIV AKPRVF- 505
gi|3915112               DTTEKGGQFS LHILKHSTIV AKPRVL- 505
gi|586082                DTSEKGGQFS LHILKHSTVV AKPRSF- 505
gi|9965899               DTSEKGGQFS LHILKHSTIV AKPRVF- 505
gi|9965897               DTTEKGGQFS LHILKHSTIV AKPRQF- 505
gi|12276037              DTAEKGGQFS LHILKHSTIV AKPRSF- 505

Consensus                DTTEKGGQFS LHILKHSTIV AKPR-F- 527
```

| | | | | | | |
|---|---|---|---|---|---|---|
| Lead-CeresClone27460 | MDARKRGRPE | AAASHNSNGG | FKRSKQEMES | I STGLGSKSK | PCTKFFSTSG | 50 |
| CeresClone:975540 | MDTRKRAGSF | NSNGGGGGGG | SKKSKQEMES | YSTGLGSKSK | PCTKFFSTSG | 50 |
| Consensus | MD-RKR---- | --------GG | -K-SKQEMES | -STGLGSKSK | PCTKFFSTSG | 50 |
| Lead-CeresClone27460 | CPFGDNCHFL | HYVPGGYNAA | AQMKNLRPPV | SQVSRNMQGS | -GGPGGRFSG | 99 |
| CeresClone:975540 | CPFGDNCHFL | HYVPGGYNAV | AQLTNMALPM | PQASRNMQGP | GGGGGGRFSG | 100 |
| Consensus | CPFGDNCHFL | HYVPGGYNA- | AQ--N---P- | -Q-SRNMQG- | GGG-GGRFSG | 100 |
| Lead-CeresClone27460 | R-GDPGSGPV | SI FGAS-I SK | I SVDASLAGA | I I GKGGI HSK | QI CRETGAKL | 147 |
| CeresClone:975540 | RGGESGPGHV | SSFGASATAK | I SVDASLAGA | I I GKGGVSSK | QI CRQTGAKL | 150 |
| Consensus | RGG--G-G-V | S-FGASAT-K | I SVDASLAGA | I I GKGG--SK | QI CR-TGAKL | 150 |
| Lead-CeresClone27460 | SI KDHERDPN | LKI I ELEGTF | EQI NVASGMV | RELI GRLGSV | ---KKPQGI G | 194 |
| CeresClone:975540 | SI QDHERDPN | LKNI ELEGTF | EQI NEASVMV | RELI GRLNSA | ASRRXPGGGG | 200 |
| Consensus | SI -DHERDPN | LK-I ELEGTF | EQI N-AS-MV | RELI GRL-S- | ASR-KP-G-G | 200 |
| Lead-CeresClone27460 | ------GPEG | KPHPGSNYKT | KI CDRYSKGN | CTYGDRCHFA | HGESELRRSG | 238 |
| CeresClone:975540 | GI GGGVGSEG | KPHPGSNFKT | KMCERFAKGN | CTFGDRCHFA | HGEAELRRSG | 250 |
| Consensus | GI GGGVG-EG | KPHPGSN-KT | K-C-R--KGN | CT-GDRCHFA | HGE-ELRRSG | 250 |
| Lead-CeresClone27460 | I A | 240 | | | | |
| CeresClone:975540 | I A | 252 | | | | |
| Consensus | I A | 252 | | | | |

```
gi|51490663                ----------  ----------  ----------  ----------  -MSNLDVSLD    9
CeresClone:568942          ----------  ----------  ----------  ----------  MADALDMSLD   10
CeresClone:293151          KEI SNSSPYP PRCFLLPVDL  DNLPPANPSP  ASEI YSARTA MAETLDMTLD   50
CeresClone:218083          KKI SNSPPQR ATLTRFGRFL  LCL-PLTLVQ  HPEI CSARAA MAETLDMTLD   49
CeresClone:240010          KKI SNSPPQR ATLTRFGRFL  LCL-PLTLVQ  HPEI CSARAA MAETLDMTLD   49
CeresClone:259439          ----------  ----------  ----------  YYMQFGKCKF  QSACIFNHSK   20
Lead-CeresClone26907       ----------  ----------  ----------  ----------  MSTGLDMSLD   10
gi|51490665                ----------  ----------  ----------  ---------M  AEAALDMSLD   11
CeresClone:564029          ----------  ----------  ----------  ----------  MSAAMDMSLD   10
CeresClone:473087          ----------  ----------  ----------  ----------  MSAALDMTLE   10

Consensus                  ----------  ----------  ----------  ----------  M---LDMSLD   50

gi|51490663                DLI KRNKSS- -SSRNPRPRT  SGSGSGTGSG  GP-SPR-RR-  FPSRAANR--   52
CeresClone:568942          DLI SKNKSSS QRGRGRRNPA  SGSGSGSASG  GP-APAGRR-  FQARAATRAA   58
CeresClone:293151          DI I KNNKKSN PSSRGARRSR GGSAPGGGTG  GV-GPT-RR-  PFKRAGNR--   95
CeresClone:218083          DI I KNNKKSN PSSGGARRSR GGSAPGGGSG  GV-GPT-RR-  SFKRAGNR--   94
CeresClone:240010          DI I KNNKKSN PSSGGARRSR GGSAPGGGSG  GV-GPT-RR-  SFKRAGNR--   94
CeresClone:259439          DI LSSGWH-- -PAECPFYMK  TRTCOFGSAC  EFYHPKDRR-  SFKRAGNR--   64
Lead-CeresClone26907       DMI AKNRK-- -SRGGAGPAR  GTGS----GS  GP-GPT-RRN  NPNRKSTR--   49
gi|51490665                DLI KKNKT-- -DTGGKRRGR  GRGG----AS  GP-GPA-RR-  FPNRSANR--   49
CeresClone:564029          DI I KNNKK-- -SGSGSSRGR IR------PS  GS-GPS-RR-  FPNRAANR--   46
CeresClone:473087          DI I KNNKK-- -SSLANTRGR GR------AS  GP-GPA-RR-  LPNRAANR--   46

Consensus                  DI I KNNKKS- -SS-G-RR-R GGS--G--SG  GP-GP--RR-  -P-RAANR--  100

gi|51490663                SAPYS--SGP  VHAPDSTWDH  NMFAEHAPAY  PAARGAGG--  -TSGIETGLK   97
CeresClone:568942          AAPYHQFNFP  PPAP-AAFAY  AAQQAHAHAH  AQVMAMVA--  PPTGVETGTK  105
CeresClone:293151          QAPYQ----P  PKAPDAAWQH  DMYPAVAAXG  G----GGG--  RVSALETGAK  135
CeresClone:218083          QAPYQ----P  PKAPDAAWQH  DMYPAVAAGG  G----GGG--  RVSALETGTK  134
CeresClone:240010          QAPYQ----P  PKAPDAAWQH  DMYPAVAAGG  G----GGG--  RVSALETGTK  134
CeresClone:259439          QAPYQ----P  PKAPDAAWQH  DMYPAVAAGG  G----GGG--  RVSALETGTK  104
Lead-CeresClone26907       SAPYQ----S  AKAPESTWGH  DMFSDRSEDH  R----SGR--  SSAGIETGTK   89
gi|51490665                AAPYS----T  AKAPEAAWNH  DMFAAADQAF  P-FGQAGGDQ  AASSISTGTK   94
CeresClone:564029          AAPYA----T  AKAPEATWQH  DLYADQQVAA  AGYPAQGG--  RAASIETGTK   90
CeresClone:473087          AAPYA----A  AKAPETAWKH  DMYANQPVAA  A---YPGG--  RASSIETGTK   87

Consensus                  AAPYQ----P  PKAPDAAWQH  DMYAA-A-A-  ------GG--  RVSAIETGTK  150
```

| | | | | | | |
|---|---|---|---|---|---|---|
| gi\|51490663 | LLI SNLDYGV | SNEDI KELFS | EAGDI KRYSI | HYDKSGRSKG | TAEVI FSRRR | 147 |
| CeresClone:568942 | LYI SNLDYNV | SNEDI KELFA | EVGDLKRYSI | NYDKSGRSKG | TAEVI FSRKS | 155 |
| CeresClone:293151 | LYI SNLDFGV | SNEDI KELFS | ELGDLKRFSI | NYDRSGRSKG | TAEVVFARRS | 185 |
| CeresClone:218083 | LYI SNLDFGV | SNDDI KELFS | ELGDLKRFSI | IYDRSGRSKG | TAEVVFARRS | 184 |
| CeresClone:240010 | LYI SNLDFGV | SNDDI KELFS | ELGDLKRFSI | IYDRSGRSKG | TAEVVFARRS | 184 |
| CeresClone:259439 | LYI SNLDFGV | SNDDI KELFS | ELGDLKRFSI | IYDRSGRSKG | TAEVVFARRS | 154 |
| Lead-CeresClone26907 | LYI SNLDYGV | MNEDI KELFA | EVGELKRYTV | HFDRSGRSKG | TAEVVYSRRG | 139 |
| gi\|51490665 | LYI SNLDYGV | SNEDI KELFS | EAGDLKRYAI | HYDRSGRSKG | TAEVVFSRRQ | 144 |
| CeresClone:564029 | LYI SNLDYGV | SSDDI KELFA | EVGDLKRHAV | HYDRSGRSKG | TAEVVFSRRA | 140 |
| CeresClone:473087 | LYI SNLDYGV | SNDDI KELFL | EVGDVKRHTV | HYDRSGRSKG | TAEVVFSRRA | 137 |
| Consensus | LYI SNLDYGV | SN-DI KELFS | E-GDLKR-SI | HYDRSGRSKG | TAEVVFSRRS | 200 |

| | | | | | | |
|---|---|---|---|---|---|---|
| gi\|51490663 | DAEAAI KKYN | NVQLDGKPMK | I EFAGPNI GA | PTLP-PLRN- | --RLYRNPNP | 193 |
| CeresClone:568942 | DALAALKRYN | NVQLDGKPMK | I EVI GTNI EA | PPPPPAI FTL | NTPTI GNFI P | 205 |
| CeresClone:293151 | DAVAAVKKYD | NVQLDGKPMK | I EI VGTNTPA | AASAHPVPN- | GGHARNAARS | 234 |
| CeresClone:218083 | DAVAAVKKYN | NVQLDGKPMK | I EI VGTNTPT | ASAALPVSN- | GGHARNAVRS | 233 |
| CeresClone:240010 | DAVAAVKKYN | NVQLDGKPMK | I EI VGTNTPT | ASAALPVSN- | GGHARNAVRS | 233 |
| CeresClone:259439 | DAVAAVKKYN | NVQLDGKPMK | I EI VGTNTPT | ASAALPVSN- | GGHARNAVRS | 203 |
| Lead-CeresClone26907 | DALAAVKKYN | DVQLDGKPMK | I EI VGTNLQI | AAAPS----- | GRPANGNSNG | 184 |
| gi\|51490665 | DALAAVKRYN | NVQLDGKPMK | I EI VGTNI AT | PAA--PAFN- | GAFGFGDTNG | 191 |
| CeresClone:564029 | DAVAAVKRYN | NVQLDGKPMK | I EI VGTNI ST | PGVA-PARN- | GA--I GNFQG | 186 |
| CeresClone:473087 | DAVAAVKRYN | NVQLDGKPMK | VEI VGTNI AT | HAAP-PAVN- | GT--FGNPTG | 183 |
| Consensus | DAVAAVKKYN | NVQLDGKPMK | I EI VGTNI -T | A-AA-PV-N- | G--A-GN--- | 250 |

| | | | | | | |
|---|---|---|---|---|---|---|
| gi\|51490663 | AP-RSQQ-RG | GGFRR--P-P | R-GGRGSMRK | EG-------- | GRGRGRV--- | 226 |
| CeresClone:568942 | SY-SGGRGRG | GDGGRGWPRG | R-GGFGGRSA | AGRGRGRGDV | GRGRGRGGRG | 253 |
| CeresClone:293151 | AP-KDAAPAG | MSQHR--P-- | --HQRGGRRA | AGSGGGR--- | -RGKERS--- | 270 |
| CeresClone:218083 | AP-RGAAPAG | VPQRR--P-- | --HQRGGRRS | GGSGGGR--- | -RGKERS--- | 269 |
| CeresClone:240010 | AP-RGAAPAG | VPQRR--P-- | --HQRGGRRS | GGSGGGR--- | -RGKERS--- | 269 |
| CeresClone:259439 | AP-RGAAPAG | MPQRR--P-- | --HQRGGRRS | GGSGGGR--- | -RGKERS--- | 239 |
| Lead-CeresClone26907 | APWRGGQGRG | GQRG------ | --GGRGGGGR | GGGGRGR--- | RPGKGPA--- | 220 |
| gi\|51490665 | GP-RTDQARS | GGFGR--SRG | G-RGRG-RGF | RGGSRGR--- | GRG-DRG--- | 229 |
| CeresClone:564029 | VP-RSGQGRG | GALRR--PGG | --RGQGVRRD | RGRGRGR--- | -GGAGRG--- | 224 |
| CeresClone:473087 | VP-RSGQGRS | GSLGR--PRG | GSRGRG---S | I QRGRGR--- | GRG-GRD--- | 220 |
| Consensus | AP-RG-Q-RG | G-QRR--P-- | ---GRGGRRS | -G-GRGR--- | -RGK-RS--- | 300 |

```
gi|51490663                 -ENI TAEDLD ADLEKYHAEA MQTN   249
CeresClone:568942           SQPVSANDLD  ADLDKYHSEA MQTS   277
CeresClone:293151           -KPKSTEELD  ADLEKYHADA MQTN   293
CeresClone:218083           -KPKSAEELD  ADLEKYHADA MQTN   292
CeresClone:240010           -KPKSAEELD  ADLEKYHADA MQTN   292
CeresClone:259439           -KPKSAEELD  ADLEKYHADA MQTN   262
Lead-CeresClone26907        -EKI SAEDLD ADLDKYHSGD METN   243
gi|51490665                 -EKVSAEDLD  ADLMKYHTEA MQTN   252
CeresClone:564029           -EKVSADDLD  ADLEKYHAEA MQLN   247
CeresClone:473087           -EKVSAEDLD  ADLEKYHAEA MQLN   243

Consensus                   -EPVSAEDLD  ADLEKYHADA MQTN   324
```

```
gi|52076162             MCSGSW---- -NSKNKLYLS LVVFRQDN-Q QQQQRKQPAH APMA-LRRKR   43
CeresClone:372782       MCSGSWSWSS SSSKKRPSLV VVNLKRQQ-L QKTPPPTPPR ASVA-IRRKR   48
CeresClone:226408       MCSGSWSWSS SSSKKRPSLV VVNLKRQQ-L QKTPPPTPPR ASVA-IRRKR   48
CeresClone:1424939      MCSGSWSW-- SSSKKRPSLV VVNLKRQQ-L QKTPPPTPPR ASVA-IRRKR   46
CeresClone:488797       MCSGSWSW-- SSSKKRPSLV VVNLKRQQ-L QKTPPPTPPR ASVA-IRRKR   46
CeresClone:582490       MCSFS----- -SKQ-TLYLA LP---RPW-T SKRHHHSHRH LRLGMLNRRR   39
CeresClone:607279       MCSFS----- -SEQSSPYDD LPLVHPPW-P SKRQ---PQH LRFSLHKRRR   40
Lead-CeresClone23203    MCLSS----- -SET---FSD TPTRLVLY-- ----LKTQSH VRIPRLSRRR   35
CeresClone:961876       MCLRS----- -SES---FPD TRKMTSASRH NKRKPKTQTH LRVLSLTRRR   41

Consensus               MCSGSW---- -SSK-RPYL- VV-LKR---- QK--P-TP-H A-VA--RRKR   50

gi|52076162             LRLRRRRETM R-RSDGMEME MVNLKLYLEN RCILEENERL REKASALHRE   92
CeresClone:372782       LRLRRLRAGA E------AME MVNLKLYLEN RCIIAENERL RERASALRRE   92
CeresClone:226408       LRLRRLRAGA E------AME MVNLKLYLEN RCIIAENERL RERASALRRE   92
CeresClone:1424939      LRLRRLRAGA E------AME MVNLKLYLEN RCIIAENERL RERASALRRE   90
CeresClone:488797       LRLRRLRAGA E------AME MVNLKLYLEN RCIIAENERL RERASALRRE   90
CeresClone:582490       AHLKEARQRK R-IVVKSEIQ MKNLKLYMEN QTIIEENEKL RKQAMLLHKE   88
CeresClone:607279       AQLQEARRRK RMIILKTEIK MRNLKLYMEN QSIIEENEKL RKQAVLLHKE   90
Lead-CeresClone23203    RMWREEK--- -------KME MINLKLYVEN QNIIRENEKL KKKALLLHQE   75
CeresClone:961876       RMLRAEK--- -------EME MRNMKLFLEN QSIIRENEAL KKKALFXXQE   81

Consensus               LRLRR-R--- -------EME MVNLKLYLEN RCII-ENERL RERASAL-RE   100

gi|52076162             NLALRADLRN TSSPATTAAA ASSC--   116
CeresClone:372782       NLALMPHCSP GIRFC----- ------   107
CeresClone:226408       NLALLQDLSK TPPVPEAGAG AA----   114
CeresClone:1424939      NLALLQDLSK TPAVPEAGAG AGAA--   114
CeresClone:488797       NLALLQDLSK TPAVPEAGAG AGAA--   114
CeresClone:582490       NQALSSQLQK KLSGQNNNTN NN----   110
CeresClone:607279       NEALEFQLQK KLSEQNNSKT NQIAVS   116
Lead-CeresClone23203    NKTLFSLLQT KKLSSVHK-- ------   93
CeresClone:961876       NNAKFXLLHP ---------- ------   91

Consensus               NLALL--L-K --S------- ------   126
```

```
Leod-CeresClone22461   MRTLKIQT--  ----------  TRGRRRANVS  SRTRVLHTCC  G--NGSSDGG   36
CeresClone:601676      MTTITRHSYK  LSLKRATKRI  TRRRRRNPHN  HRKRSTSTTI  DPFKPKCSNN   50

Consensus              M-T-----YK  LSLKRATKRI  TR-RRR----  -R-R---T--  -PF-------   50

Leod-CeresClone22461   KTVMEKLLAL  KSLLPPPVNV  GGGET---EE  LFQETAEYIV  KLRTQVVVLK   83
CeresClone:601676      NKVCEKLETL  KNLIP-----  GGEEAVKPDQ  LFKETAEYIV  LLRTRVVVLQ   95

Consensus              --V-EKL--L  K-L-PPPVNV  GG-E-VKP--  LF-ETAEYIV  -LRT-VVVL-  100

Leod-CeresClone22461   KLIEIYDNSS  D----QKKDV  VL--         101
CeresClone:601676      KLIEYYGNKD  DTQDENEHDA  VLFS         119

Consensus              KLIE-Y-N--  DTQDE---D-  VLFS         124
```

```
gi|52547872            MSSNSSPLEI DTSFSHSNFF FLQDQSPILQ WDDDLFFNDP WFDDDQSPII   50
Lead-CeresClone21068   ---------M DPLLIQSPFS GFSPEYSIGS SPESF----S SSSSNNYS-L   36
gi|25992126            ---------M DSSSSSSQFF -YSMNSDLNS SDSSY----E WSNFNTQSYL   36
gi|23452024            ---------M DSSSSSSQFF -YSMNSDLNS SDSSY----E WSNFNTQSYL   36

Consensus              ---------M DSSSSSSQFF -YSM-SD-NS SD-SY----E WSNFNTQSYL   50

gi|52547872            PCNSEKDENH QVF------- EESSDNTIMS KGSSHGQELE EVTSQEE--K   91
Lead-CeresClone21068   PFNENDSEEM FLYGLI---- EQSTQQTYI- ---DSELQDL PIKSVSS---   75
gi|25992126            PFNVNDSEEM LLFGVLNAAH EETTSETVT- ---SHRVKEE EVTSESEVIE   82
gi|23452024            PFNVNDSEEM LLFGVLNAAH EETTSETVT- ---SHRVKEE EVTSESEVIE   82

Consensus              PFNVNDSEEM LLFGVLNAAH EE-TSETV-- ---SHRVKEE EVTSESEVIE  100

gi|52547872            EKEEEEKHYI GVRKRPWGKY AAEIRDSTRN GIRVWLGTFD TAEEAALAYD  141
Lead-CeresClone21068   --RKSEKSYR GVRRRPWGKF AAEIRDSTRN GIRVWLGTFE SAEEAALAYD  123
gi|25992126            AIPAKEKSYR GVRRRPWGKF AAEIRDSTRN GVRVWLGTFD SAEDAALAYD  132
gi|23452024            AIPAKEKSYR GVRRRPWGKF AAEIRDSTRN GVRVWLGTFD SAEDAALAYD  132

Consensus              AIP-KEKSYR GVRRRPWGKF AAEIRDSTRN G-RVWLGTFD SAE-AALAYD  150

gi|52547872            QAALSMRGPW SLLNFPLEKV KKSLEKIEYS CKDGLSPAAV LKATHKTRRV  191
Lead-CeresClone21068   QAAFSMRGSS AILNFSAERV QESLSEIKCI YEDGCSPVVA LKRKHSMRR-  172
gi|25992126            QAAFSMRGNS AILNFPVETV RDSLRDMKCH VDDDCSPVVA LKKRHSMRK-  181
gi|23452024            QAAFSMRGNS AILNFPVETV RDSLRDMKCH VDDDCSPVVA LKKRHSMRK-  181

Consensus              QAAFSMRGNS AILNFPVE-V RDSLRD-KC- VDD-CSPVVA LKKRHSMR--  200

gi|52547872            KHKRSSRKKK NKETH----- ------NVIV FEDLGAELLE ELLMTSSQ--  228
Lead-CeresClone21068   --RMTNKKTK DSDFD-HRSM KLD---NVVV FEDLGEQYLE ELLGSSEN--  214
gi|25992126            --RSTNSKKV NSISKVVREV KMENVNNVVV FEDLGADYLE QLLSTSCQVI  229
gi|23452024            --RSTNSKKV NSISKVVREV KMENVNNVVV FEDLGADYLE QLLSSSS---  227

Consensus              --RSTN-KK- NS-SKVVREV KMENVNNVVV FEDLGADYLE -LLS-SS---  250
```

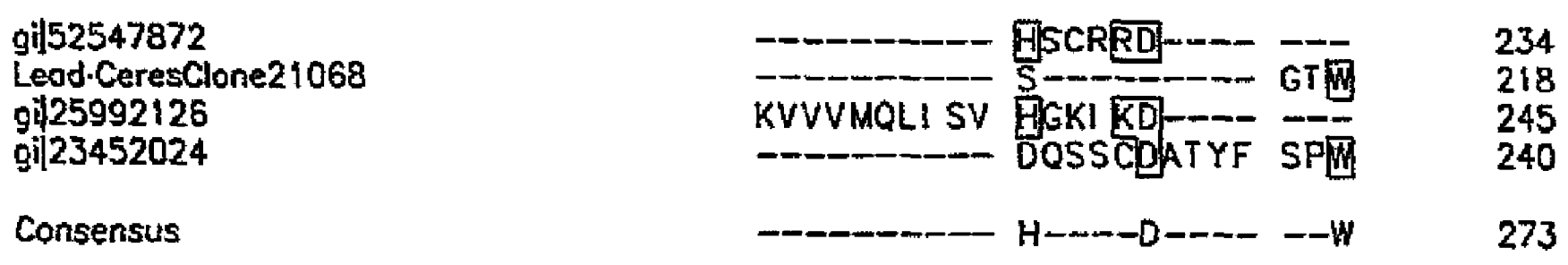

```
gi|52547872               ----------- HSCRRD----- ---      234
Lead-CeresClone21068      ----------- S---------- GTW      218
gi|25992126               KVVVMQLI SV HGKI KD----- ---      245
gi|23452024               ----------- DQSSCDATYF SPW      240

Consensus                 ----------- H----D----- --W      273
```

```
CeresClone:291379        -MGGGGAHGG  TTYKGYTI PH  NKRWHTVAGK  GLCAVMWFWV  FYRAKQDGAT   49
CeresClone:327661        -MGGGGAHGG  TTYKGYTI PH  NKRWHTVAGK  GLCAVMWFWV  FYRAKQDGAT   49
CeresClone:1317381       MGGGGGAHGG  TXYKGYTI PH  NKRWHTI AGK GLCATMWFX   FYRAXQXGAV   50
CeresClone:1047513       -MGGGGAHGG  TTYKGYTI PH  NKRWHTI AGK GLCATMWFWI  XYRAKQDGAV   49
CeresClone:1447025       -MGGGGAHGG  TTYKGYTI PH  NKRWHTI AGK GLCATMWFWI  FYRAKQDGAV   49
CeresClone:639625        -MGGG---GG  TTYKGYTI PH  NKRWHTI AGK GLCATMWFWI  FYRAKQDGAV   46
CeresClone:855445        -MGGGQGHG-  ITYKGVTI HQ  PKRWHTITGK  GLCAVMWFWV  FYRAKQDGPV   48
CeresClone:957946        ----------  MTYKGVSVQT   PKTWHTVAGK  GLCGVMWFWI  LYRAKQDGPV   40
Lead-CeresClone20257     -MGGGGHGGG  ITYKGVTVHT   PKTWHTVIGK  GLCAVMWFWI  LYRAKQDGPV   49
CeresClone:1038259       -MGGG---GG  ITYKGVTVHT   PKTWHTVAGK  GLCGVMWFWI  LYRAKQDGPV   46

Consensus                -MGGGGAHGG  TTYKGYTI PH  NKRWHT--AGK GLCAVMWFWI  FYRAKQDGAV   50

CeresClone:291379        LLGLRHPWDG  HDDHSHGHGH  GHEAS---SS  SSSH   80
CeresClone:327661        LLGLRHPWDG  HDDHSHGHGH  GHEAS---SS  SSSH   80
CeresClone:1317381       LLGMRHPWDG  HDDHAHXXFW  TCTRA-----  ----   75
CeresClone:1047513       LLGMRHPWDG  HDDHAHGHGH  AHEHEASSSS  SPSH   83
CeresClone:1447025       LLGMRHPWDG  HDDHAH----  ----------  ----   65
CeresClone:639625        LLGMRHPWDG  HDDHAHGHGH  AHEQEASSSS  SPSH   80
CeresClone:855445        VLGWRHPWEG  HHDD-HGKGH  ----------  ----   67
CeresClone:957946        VMGWRHPWDG  HGDH--GDHH  ----------  ----   58
Lead-CeresClone20257     VMGWRHPWDG  HGDHGHGDHH  ----------  ----   69
CeresClone:1038259       VMGWRHPWDG  HGDHGHGGDH  ----------  ---H   67

Consensus                LLGMRHPWDG  HDDHAHG-GH  ----------  ---H   84
```

```
Lead-CeresClone19188  MATLKASFLI KTLD------ ---------- ---------- ----------  14
CeresClone:953088     -----MATPK A--------- ---------- ---------- ----------   6
gi|33325041           -----MAFSS SARN------ ---------- ---------- ----------   9
gi|27476082           -----MRSLL AASTFLRSGA SPLLRPLSRP LP-------- ------SRLN  31
gi|3411152            ---------- ---------- ---------- ---------- ----------   0
CeresClone:284998     -----MRSMF ATRSLLAAAA AASAPTVLRA SAFASRSLLL YLPFRRGRAA  45
CeresClone:226318     MLGAARSI SS AAPS------ ---------- ---------- ----------  14
CeresClone:901252     -----MASS- ---------- ---------- ---------- ----------   4
CeresClone:524628     ---------- ---------- ---------- ---------- ----------   0

Consensus             -----MA--- A--------- ---------- ---------- ----------  50

Lead-CeresClone19188  ---------- ---------- NDVTGDFLSD LERRGSGAVH VIMGPMFSGK  44
CeresClone:953088     ---------- ---------- SVLLSDI SKD EGHLGSGAI H VITGPMFSGK  36
gi|33325041           ---------- ---------- PVDLRNGSKN SFC-PVGEI H VIVGPMFAGK  38
gi|27476082           LSRFGPVRPV SAAAAAADKS RGGGGSAMEA QPS-YPGEI H VIVGPMFAGK  80
gi|3411152            ---------- ---------- -------MEA QPS-YPGEI H VIVGPMFAGK  22
CeresClone:284998     RNMLGAARSI SSAAPA---- RVGGGAAMEV RAA-QSGEI H VIVGPMFAGK  90
CeresClone:226318     ---------- ---------- RVGGRAAMEV RAA-QSGEI H VIVGPMFAGK  43
CeresClone:901252     ---------- ---------- SSLSLDTAKD LSN-SSGEVH VIVGPMFAGK  33
CeresClone:524628     ---------- ---------- ---------- ---------- -----MFAGK   5

Consensus             ---------- ---------- -------ME- -----SGEI H VIVGPMFAGK 100

Lead-CeresClone19188  STSLLRRI KS EI SDGRSVAM LKSSKDTRYA KDSVVTHDGI GFPCWALPDL  94
CeresClone:953088     STSLLRRI KT EI SVGRSVAM VKSSKDTRYA KDSVVTHDGI GFPCWALPDL  86
gi|33325041           TTALLRRVNL ESNDGRNVVL I KSSKDARYA VDAVVTHDGT RFPCWSLPDL  88
gi|27476082           TTALLRRVQV EAGTGRNVAL I KSDKDNRYG LDSVVTHDGT KMPCWALPEL 130
gi|3411152            TTALLRRVQV EAGTGRNVAL I KSDKDNRYG LDSVVTHDGT KMPCWALPEL  72
CeresClone:284998     TTALLRRVQA EAGNGRSVAL I KSDKDNRYG LDSVVTHDGT KMACWALSEL 140
CeresClone:226318     TTALLRRVQA EAGNGRSVAL I KSDKDNRYG LDSVVTHDGT KMACWALSEL  93
CeresClone:901252     TTALLCRI ES ELNAAKNVVL LKSSKDTRYA I DSVVTHDGI KFPCRALPDL  83
CeresClone:524628     TTSLLRRI QS EI TNGRNVAI I KSSKDTRYG LDSI VTHDGA ELPCWALANL  55

Consensus             TTALLRRVQA E--NGRNVAL I KSSKD-RYG LDSVVTHDGT KMPCWALP-L 150
```

```
Lead-CeresClone19188   MSFPEKFGLD AYNKLDVI GI DEAQFFGDLY EFCCKVADDD GKI VI VAGLD   144
CeresClone:953088      MSFPERFGQD AYDKLDVI GI DEAQFFGDLY EFCCKVADVD GKTVVVAGLD    136
gi|33325041            SSFKQRFGKD AYEKVDVI GI DEAQFFGDLY EFCCNAADFD GKI I VVAGLD  138
gi|27476082            SSFQDKLGTE AYDKVDVI GI DEAQFFDDLH DFCCKAADRD GKI VVVAGLD   180
gi|3411152             SSFQDKLGTE AYDKVDVI GI DEAQFFDDLH DFCCKAADRD GKI VVVAGLD   122
CeresClone:284998      SSFHDKLGI D AYNKVDVI GI DEAQFFDDLY DFCCKAADRD GKI VVVAGLD  190
CeresClone:226318      SSFHDKLGI E AYNKVDVI GI DEAQFFDDLY DFCCKAADRD GKI VVVAGLD  143
CeresClone:901252      LSFREKHGDD AYQKLDVI GI DEAQFFEDLY EFCCKAADED GKTVI VAGLD   133
CeresClone:524628      SSFKQKFGI D AYEKLDVI GI DEAQFFDDLY EFCLQAADHD GKTVI VAGLD  105

Consensus              SSF--K-G-D AY-KVDVI GI DEAQFFDDLY DFCCKAAD-D GKI VVVAGLD   200

Lead-CeresClone19188   GDYLRRSFGA VLDI I PI ADS VTKLTARCEV CGHKAFFTLR KNCDTRTELI  194
CeresClone:953088      GDYLRRRFGA I LDI I PI ADS VTKLTARCEV CGQKGFFTLR KTCDTRTELI 186
gi|33325041            GDYLRKSFGS VLDI I PLADT VTKLTARCEL CNRRAFFTFR KTNETETELI   188
gi|27476082            GDYKRNKFGS VLDI I PLADS VTKLTARCEL CGRRAFFTLR KTRETKTELI   230
gi|3411152             GDYKRNKFGS VLDI I PLADS VTKLTARCEL CGRRAFFTLR KTRETKTELI   172
CeresClone:284998      GDYKRRKFGS I LDI VPLADS VTKLTARCEL CGRRAFFTLR KTQETKTELI  240
CeresClone:226318      GDYKRRKFGS I LDI VPLADS VTKLTARCEL CGRRAFFTLR KTQETKTELI  193
CeresClone:901252      GDYLRRSFGS VLHI I PLADS VTKLTARCEL CGKRAFFTLR KTEQRETELI   183
CeresClone:524628      GNYLRRSFGS VLDI I PLADS VTKLTARCEI CGKRACFTLR KTQDKQIELI   155

Consensus              GDYLRRKFGS VLDI I PLADS VTKLTARCEL CGRRAFFTLR KTQETKTELI   250

Lead-CeresClone19188   GGADVYMPVC RKHYI TNHI V I KASKKVLED SDKARAESCV AATI -----   238
CeresClone:953088      GGADVYMPVC RKHYVNNQI V LNASKKVL-D SDKERAESCV DTVATMVQV    234
gi|33325041            GGADI YMPVC RQHYVNGQSV NESAKMVL-E SHKVSNELI L ESPLVDP--   234
gi|27476082            GGADVYMPVC RQHYLDGQI V I EATRI VL-D LEKSKVI HAF K--------  270
gi|3411152             GGADVYMPVC RQHYLDGQI V I EATRI VL-D LEKSKVI HAF K--------  212
CeresClone:284998      GGADVYMPVC RQHYMDGQI V I EATRI VL-D LDRSTVTAKA LK-------   281
CeresClone:226318      GGADVYMPVC RQHYMDGQI V I EATRI VL-D LDRSTVTAKA LK-------   234
CeresClone:901252      GGADLYMPVC RLHYLNSQVF --AERSVL-E SQNFKTD--- ---------     216
CeresClone:524628      GGVDVYMPVC RQHYVSGQVA MEATRHVL-E SHKVECASHT ---------     194

Consensus              GGADVYMPVC RQHY--GQI V I EATRI VL-D S-KSK--S-- ---------   299
```

```
Lead-CeresClone18820   ---------M ---------GY ISNNNLINYL P--------- ----------  14
CeresClone:978584      HFRNKDIRAM KVHEFSN-GF SSWEQHDSPS S--------- ----------  30
CeresClone:673690      ---------M KVHQFAR-GF --WEHE---P S--------- ----------  16
CeresClone:277479      ---------M RLHHFHV-AY LDKAAGSPPP SSSPPSISPA SHSHSSSSAA  40
CeresClone:1018883     ---------M RVHHLHAPSY LEKAASASPS PATAPSTSPP S---------  32

Consensus              ---------M -VH-F---GY L------SP- S--------- ----------  50

Lead-CeresClone18820   ---------- -LSTTQPPLL LTHCD----- ---------- ---INGNDHH  35
CeresClone:978584      --LSLSCKR- -LRPLGPKLS GSPCSPSSSS GVTSATFDLK SFIKPDQTGP  76
CeresClone:673690      --LTLGCKR- -LRPLAPKLS NTDTISPPHH PVT--TFDLK SFIKPE-SAS  59
CeresClone:277479      TIVPLALQQY CLRPLAPKIS FPEAR----- ---------K MVVLPE--FA  74
CeresClone:1018883     ALFPFGAFQ- CLRPLAPKIS LPDQP----- ---------K KLVAPPDVLG  67

Consensus              --L-L--K-- -LRPLAPKLS -TD------- ---------K ----PE----  100

Lead-CeresClone18820   QLITASSGEH DIDERK---- ---NNIPAAA ILRWNPTPEQ IITLEELYRS  78
CeresClone:978584      RKFEYSIE-- --HQRDLP-- ---HVGTHQG GTRWNPTQEQ IGILEMLYKG  117
CeresClone:673690      RKLGIGSSDD NTNKRDPSSP QGQAETHIPG GIRWNPTQEQ IGILEMLYRG  109
CeresClone:277479      RVRNASSRLL NCTVQVPP-- ---TTTTVGG TTRWNPSPDQ IRVLEMLYRG  119
CeresClone:1018883     RVRNA-TKLL SCTVRNHT-- ---VQVPVGG TTRWNPSAEQ IKVLEALYRG  111

Consensus              RV--ASS--- N---RD---- -------V-G TTRWNPT-EQ I--LEMLYRG  150

Lead-CeresClone18820   GIRTPLTEQI QQIASKLRKY GRIEGKNVFY WFQNHKARER LKRRREGGA  128
CeresClone:978584      XXRTPNAQQI ENITSQLGKY GKIEGKNVFY WFQNHKARER QKQKR-----  162
CeresClone:673690      GMRTPNAQQI EQITAQLSKY GKIEGKNVFY WFQNHKARER QKQKR-----  154
CeresClone:277479      GMRTPNSFQI EQITEELGKY GRIEGKNVFY WFQNHKARER QKQKR-----  164
CeresClone:1018883     GMRTPNSAQI ERITEELGRH GRIEGKNVFY WFQNHKARER QKQKR-----  156

Consensus              GMRTPN-QQI EQITS-LGKY GRIEGKNVFY WFQNHKARER QKQKR-----  200
```

```
Lead-CeresClone18820   IIKPHKDVKD SSSGGHRVDQ TKLCPSFPHT .NRPQPQHELD PASYNKDNNA   178
CeresClone:978584      ---------- ---------- NNFLSLSCLS SFKTTNINNA  SVTTKTTTSS   192
CeresClone:673690      ---------- ---------- NNL----GLA HSPRTTLTTS  PPFSCCVITT   180
CeresClone:277479      ---------- ---------- AALL---TLS TTTTASTLLP  PAAE------   185
CeresClone:1018883     ---------- ---------- AALL---TLS TLDSSSL---  PATA------   174

Consensus              ---------- ---------- --LL----LS ---T-SL---  PA--------   250

Lead-CeresClone18820   NN-EDHGTTE ESDQRASEVG KYATWRNLVT WSTQQPEE   NDENVNGEE  227
CeresClone:978584      NDVIRRDSMV EKGELVEEA- EYK--RTCRS WG--FENLE  DSRRNLNSSK  237
CeresClone:673690      MDTTKRGEVV EREEEDSPL- ------KKCRS WA--FEYLE- DQREE-----  216
CeresClone:277479      ---TKEGVET KKEEACEDAS SRK--RRCRA WEDVVVHGGG DDAGTEVADD  230
CeresClone:1018883     ---TKDGAGD KKEDCDEATN SCK--RRCMK WS-----AGHG DAAAEVAAPD  215

Consensus              -D-TK-G--- EKEE--EE-- --K--RRCRS WS---E--E- D----V-A--  300

Lead-CeresClone18820   EETR------ --DNRTLNLF PVREYQEKTG RLIEKTKACN YCYYYEFMPL  269
CeresClone:978584      NATMATTFNK IIENVTLELF PLHP-EGR-- ---------- ----------  264
CeresClone:673690      ---------- --EHRTLELF PLHP-EGR-- ---------- ----------  231
CeresClone:277479      YYTD------ --DDVTLELF PLRPDQGK-- ---------- ----------  250
CeresClone:1018883     GCT------- --DNVTLELF PLRP-QGKAA ---------- ----------  235

Consensus              --T------- --DNVTLELF PLRP-QGK-- ---------- ----------  350

Lead-CeresClone18820   KN   271
CeresClone:978584      --   264
CeresClone:673690      --   231
CeresClone:277479      --   250
CeresClone:1018883     --   235

Consensus              --   352
```

```
gi|50919691            -MAAVQELLPL PPAAPPQPRR GKPGCWNTPP APPK------ --VCHYWKSG   41
CeresClone:925629      MAAVQRRQPL PPASH-QLRR ADPACPGT-- APPP------ --VCRYWKSG   39
CeresClone:374674      --MDIEADGR FGNKRVHNRL G-----PGSG APPS----TN GKVCNYWRAG   40
Lead-CeresClone18612   --MDFDLNG- -GNKRVFNRL GGGGGVGGGS TRPMAPTDTR QKVCFHWRAG   46
CeresClone:1359803     --MDLDMNG- -GNKRVFQRL ------GGGS NRPT--TDSN QKVCFHWRAG   38
gi|12057164            --MDLDMNG- -GNKRVFQRL ------GGGS NRPT--TDSN QKVCFHWRAG   38

Consensus              --MDLD-NG- -GNKRVF-RL G-----G-GS A-PT--TD-N QKVCF-WRAG   50

gi|50919691            RCSRNPCRFL HTDAPDPA-P PIAAVNTRSN TWVNPSCVAA ----------   80
CeresClone:925629      HCGRNPCRFL HAD-PAPPPP VVVVAKKRSN TWVNTSSKIA KPSAT-----   83
CeresClone:374674      RCNRFPCPFL HSELPEAA-P PKRPTGPGGN VWRNPNTGGR GGGH------   84
Lead-CeresClone18612   RCNRSPCPYL HRELPGPG-P GQGQGPGYTN KRVAEESGFA GPSHRRGPGF   95
CeresClone:1359803     RCNRYPCPYL HRELPG---P GSGPVAASSN KRVADESGFA GPSHRRGPGF   85
gi|12057164            RCNRYPCPYL HRELPG---P GSGPVAASSN KRVADESGFA GPSHRRGPGF   85

Consensus              RCNR-PCP-L H-ELPGP--P G-GPV---SN K-V-D-SGFA GPSHRRGPGF  100

gi|50919691            -----NSDGK -G-----RAP PVQPAKR--- ---------Q VEAPPETPAK  107
CeresClone:925629      -----TDEGE -A-----AVP PVPPPTKAKP SPATNAREAA VPLPPPERVQ  122
CeresClone:374674      -----NRWGK -GPGGCSGLA SHKPPER--- --PCKYFLAG TECSYGERCR  123
Lead-CeresClone18612   NGNSSSSWGR FG-----GNR TVTKTEK--- --VCNFWVDG -NCTYGDKCR  134
CeresClone:1359803     SG-TANNWGR FG-----GNR TVTKTEK--- --LCKFWVDG -NCPYGDKCR  123
gi|12057164            SG-TANNWGR FG-----GNR TVTKTEK--- --LCKFWVDG -NCPYGDKCR  123

Consensus              SG-TAN-WGR FG-----GNR TVT-TEK--- --LCKFWVDG -NCPYGDKCR  150

gi|50919691            RRCGGGAWCV GDGFCGVARL KGHAKAVTGF ALPEGSDKLF SGSLDSTVRA  157
CeresClone:925629      EPPCSGAWCV GDGIRGVARL EGHSKAVTGV AVPEGSGKLF SGSLDGTVRA  172
CeresClone:374674      YPH---SYCI SDSIAMLTLL KGHEQGVTGI ALPAGSDKLY SGSKDGTVRM  170
Lead-CeresClone18612   YLH---CWSK GESFALLTQL DGHEKLVSGI ALPSGSDKLY TGSKDETLRV  181
CeresClone:1359803     YLH---CWSK GDSFSLLTQL DGHQKVVTGI ALPSGSDKLY TASKDETVRI  170
gi|12057164            YLH---CWSK GDSFSLLTQL DGHQKVVTGI ALPSGSDKLY TASKDETVRI  170

Consensus              YLH----W-- GDSF-LLTQL DGH-KVVTGI ALPSGSDKLY -GSKDETVRV  200
```

```
gi|50919691            WDCSTGQCVR VEEMQEGEVH KLIAMGPWVL AGVRGAVKAI HTGTGKELRL  207
CeresClone:925629      WDCATGQCVR VAPVQEGEVG RLIAMGPWVL VRVRGAVRAF QAGSGEELRL  222
CeresClone:374674      WDCQTGQCAG VITM-GREVG CMIIEGPWLF VGIPDAVKVW NMQTAAEMSL  219
Lead-CeresClone18612   WDCASGQCTG VLKL-GGEIG CVLSEGPRLL VGMPNLVKAW NIETNADQSL  230
CeresClone:1359803     WDCASGQCTG VLNL-GGEVG CIISEGPWLL VGMPNLVKAW NIQNNADLSL  219
gi|12057164            WDCASGQCTG VLNL-GGEVG CIISEGPWLL VGMPNLVKAW NIQNNADLSL  219

Consensus              WDCA-GQCTG VL-M-GGEVG C-ISEGPWLL VGMPN-VKAW NIQTNA-LSL  250

gi|50919691            RGPA--SQIT AMLAEDEDHL FAGAEDGAVF MWRMNQEQQS FDEVAALTGH  255
CeresClone:925629      RLPVAAAQVT ALLAEDDERL FAGVEDGAIY MWRLDPGRQR FDEVAALAGH  272
CeresClone:374674      TGPT--GQVY ALAV-ASELL FAATQAGRIL AWRFSAATNC FEPAASLDGH  266
Lead-CeresClone18612   SGPV--GQVY SLVV-GTDLL FAGTQDGSIL AWRYNAATNC FEPAASLTGH  277
CeresClone:1359803     NGPV--GQVY SLVV-GTDLL FAGTQDGSIL VWRYNSTTSC FDPAASLLGH  266
gi|12057164            NGPV--GQVY SLVV-GTDLL FAGTQDGSIL VWRYNSTTSC FDPAASLLGH  266

Consensus              -GPV--GQVY -LVV-GTDLL FAGTQDGSIL -WRYN--T-C FDPAASL-GH  300

gi|50919691            Y-KAVVSLAQ GKGALYSGST DGSIRVWDLD THRCIYSFAG HSSTVTALLC  304
CeresClone:925629      DGHAVASLAQ GKGALYSGAA DGGIRVWDLE TRRCVCSFAG HASMVTALLC  322
CeresClone:374674      K-LAVVSLLV GGMRLYSASM DKTIRVWDLA TLQCIQTLSD HTDVVMSVLC  315
Lead-CeresClone18612   T-LAVVTLYV GANRLYSGSM DKTIKVWSLD NLQCIQTLTD HTSVVMSLIC  326
CeresClone:1359803     T-LAVVSLYV GANRLYSGAM DNSIKVWSLD NLQCIQTLTE HTSVVMSLIC  315
gi|12057164            T-LAVVSLYV GANRLYSGAM DNSIKVWSLD NLQCIQTLTE HTSVVMSLIC  315

Consensus              T-LAVVSLYV GANRLYSG-M D-SI-VW-LD -LQCIQTLT- HTSVVMSL-C  350

gi|50919691            WERFLLSSSD DGTVKVWQWK PDHD---DLD LEVHYTHKED -ERVVSMDGT  350
CeresClone:925629      WDRFLLSSSV DGTVKAWRSK PDRAGDVEPE LEVHYTHREE GERVVAMDGT  372
CeresClone:374674      WDQFLLSCSL DQTIKVWAAT ESGN------ LEVTYTHKED -QGALALSGM  358
Lead-CeresClone18612   WDQFLLSCSL DNTVKIWAAT EGGN------ LEVTYTHKEE -HGVLALCGV  369
CeresClone:1359803     WDQFLLSCSL DNTVKIWAAT EGGN------ LEVTYTHKEE -YGVLALCGV  358
gi|12057164            WDQFLLSCSL DNTVKIWAAT EGGN------ LEVTYTHKEE -YGVLALCGV  358

Consensus              WDQFLLSCSL DNTVKVWAAT EGGN------ LEVTYTHKEE --GVLALCGV  400
```

```
gi|50919691            YDADEKPVLL VSRGDGVVRV YDLPSLKKRG DI ICDDEVRT ISVRSRGVVF   400
CeresClone:925629      HDADKKPVLL VSRGDGVVRV CDLPSFKPRG QI RCNGEVTA MSLRTPGVLF   422
CeresClone:374674      PDAQSKPVLL CSLNDNTVRL YDLPSFSDRG RLFSKKEI RA I QMGPGGLFF  408
Lead-CeresClone18612   HDAEAKPVLL CACNDNTLRL YDLPSFTERG KI FAKQEI RA I QI GPGGI FF 419
CeresClone:1359803     HDAEAKPVLL CSCNDNSLHL YDLPSFTERG KI LAKQEI RS I QI GPGGI FF 408
gi|12057164            HDAEAKPVLL CSCNDNSLHL YDLPSFTERG KI LAKQEI RS I QI GPGGI FF 408

Consensus              HDAEAKPVLL CSCNDN--RL YDLPSFTERG KI LAKQEI RA I QI GPGGI FF 450

gi|50919691            TGDASGEVRV VKWTSLSDAA ESYLAMA   427
CeresClone:925629      TGDKSGEVRV VKWTPAAAA- -------   441
CeresClone:374674      TGDGTGELKV WQWVDLAQT- -------   427
Lead-CeresClone18612   TGDGTGQVKV WKWCTEPTAA LP-----   441
CeresClone:1359803     TGDGSCQVKV WKWSTESTPI LS-----   430
gi|12057164            TGDGSGQVKV WKWSTESTPI LS-----   430

Consensus              TGDGSG-VKV WKW-TESTA- LS-----   477
```

```
gi|50909895               ---------M PARAAALSCR GVSPHPR-AH SLLPGRRRRP VL-PFADEAA   39
CeresClone:304724         ---------- ---------- ---------- ---------- ----------    0
gi|34914598               MELLLRPSPP PPWAIPRRSS GERTKPCRSR SRSRTGTSKQ TF-PVPLLVG   49
CeresClone:1397168        --MALLLRLA APSVPPRRSS GLRALPRVVL PEVVSKQSFL RL------LVD  43
CeresClone:627169         ---------- --MVMLIRCS CFFARPRFSQ PQFYGNNTKP LL--------   30
Lead-CeresClone40729      ---------- --MAALIRCC SSFSHTSGGQ PPPRDKSRAP EIGKFATSIG   38
CeresClone:1604687        ---------- ---------- ---------- ---------- ----------    0

Consensus                 ---------- -------R-- -----P---- ---------- -L--------   50

gi|50909895               AAPLRVSSVP HSRAYGCGGG GYFVHLEDRD DGEASRLLRA LRRVLPDHQK   89
CeresClone:304724         ---------- ---------- ---------M DGEAPRLPHA LRRMLIDHQK   21
gi|34914598               KVGRRPFPVQ CSIVRCCLSS TDAIHSTSDD IHEDNGHGHF LMKSTSDLQK   99
CeresClone:1397168        STASMPCPIK CSAARCAPSL TEHNDSRNNG IHASSVYGHD LMKSMSDLQE   93
CeresClone:627169         ------PGKL AFLSLKPDKG VPHFEDTLDG SSKISCLLHC SKCKEDIHQR   74
Lead-CeresClone40729      YSVVRKPGDH PPFSKIIHSS SQPKERQGKG ILQTPFASVG SLDKFSAFEG   88
CeresClone:1604687        ---------- ---------- ---------- --------MG FVRALP----    8

Consensus                 ---------- ---------- ---------- --E-S---H- LMR-L-D-QK  100

gi|50909895               WAQPDLL-KA AVISTMSILA VPLEASASAE TCQPANSMA- -NMPIFIAVA  136
CeresClone:304724         MACPNLL-KA AVLSTMTLLA VPLEAS--AE MCQPPSSFA- -NMPIFIVVA   66
gi|34914598               VISSCFG-KA CLLSSV-MLV LPPSCF--AE PCEPEYSLP- -NMPLLFAIA  143
CeresClone:1397168        VVFSSFS-KA CLLSSCIIYG LPPSCI--AE PCEQEYFLP- -NMPLLFAIA  138
CeresClone:627169         FPSLIFV--- --ASNVLMFS MPNTAL--AE TCEADNSVF- -NMPILLAVA  115
Lead-CeresClone40729      IGRLKLPVMA VLLTNSLQMA TPLEALA-AE ICEPESSMF- -SMPILLIVA  135
CeresClone:1604687        --------VG SIIANALLLA TPLEAL--AE ACEAEQSIFN MNMPLLLLVA   48

Consensus                 V-------KA -LLS--L-LA -PLEAL--AE -CEPE-S--- -NMPILLAVA  150

gi|50909895               LIGAAVGGLL ARQRKEELKR LNIQLRQINI ALRRQAQIES FAPGLTYAPV  186
CeresClone:304724         LIGAAVGGLL ARQRKAELKR LNNQLRQINA ALRRQAQIES FAPGLTYAPV  116
gi|34914598               MIGATVGGLL ARQRRGELKR LNDQLRQINA ALRRQAKIES YAPSLSYAPV  193
CeresClone:1397168        MVGATVGGLL ARQRRGELAR LNDQLRQINA ALRRQAKIES YAPALSYAPV  188
CeresClone:627169         LIGATVGGLL ARQRRNELQR VNEQLIQINA ALRKQAKIES YAPSLSYAPI  165
Lead-CeresClone40729      LIGATVGGLL ARQRKGELQR LNEQLRQINA ALRRQAKIES YAPSLSYAPV  185
CeresClone:1604687        LIGATVGGLL ARQRKAELQR LNEQLRQINV ALKRQAKIES YAPALSYAPA   98

Consensus                 LIGATVGGLL ARQRK-EL-R LN-QLRQINA ALRRQAKIES YAPSLSYAPV  200
```

```
gi|50909895              --GRATETEV IVDPRKQQLI VNLRNGKTFM RNQDLDMAVK EFRAALELAK   234
CeresClone:304724        --GRTNETDV IVDPRKQQLV TNLRNGKNYM RNQDLDKAIV EFRTALELAE   164
gi|34914598              -GSKIPESEV IVDPQKDRLI SYLRAGKNYL RNQAPDKAFP EFKAAFDLAQ   242
CeresClone:1397168       -GSKIPESEV IVDPQKQRLI AYLRTGKNYL RNQAPDKAFP EFKAALDLAR   237
CeresClone:627169        GGGRILDNEI IVDPKKQELI SKLKNGKNFL RNQQPDKAFT EFKNALELAQ   215
Lead-CeresClone40729     -GARIPDSEI IVEPKKQELI SKLKTGKTFL RNQEPEKAYT EFKIALELAQ   234
CeresClone:1604687       -AARVPDSEV IVDPKKQELI SRLKK----- ---------- ----------   122

Consensus                -G-RIPESEV IVDPKKQ-LI S-LR-GKN-L RNQ-PDKAF- EFK-ALELAQ   250

gi|50909895              SVGDRFEEKK AARGLGASLQ RLGKYREAMN CYYKVLELSK ETGEDSGCTE   284
CeresClone:304724        SIGDRFEEKK AARGLEA--- ---------- ---------RE VPRSNETVQQ   193
gi|34914598              SLGDHVEEKK AARGLGASLQ RQGKYKEAIK YHSMVLNISK LTGEDAGVTE   292
CeresClone:1397168       SLGDHVEEKK AARGLGASLQ RQGKYKEAIN YHSMVLNISK VTGEDAGVTE   287
CeresClone:627169        NLKDPIEEKK AARGLGASLQ RQGKYRDAIK YHSMVLGISE REEEDSGSTE   265
Lead-CeresClone40729     SLKDPTEEKK AARGLGASLQ RQGKYREAIQ YHSMVLAISK RESEDSGITE   284
CeresClone:1604687       ---------- ---------- ---------- ---------- ----------   122

Consensus                SLGD--EEKK AARGLGASLQ RQGKYREAI- YHSMVL-ISK ---EDSGVTE   300

gi|50909895              AYGAIADCYT ELGDLERAAK LYDKYISRLQ PGCGE   319
CeresClone:304724        GSGAVQ---- ---------- ---------- --GDR   202
gi|34914598              AYGAIADCYT ELGELEKAGK FYDKYIARL- --END   324
CeresClone:1397168       AYGAIADCYT ELGELEKAGK FYDKYIARL- --ENE   319
CeresClone:627169        AFGAIADCYT ELGELEKAGQ FYDKYIARL- --EKD   297
Lead-CeresClone40729     AYGAIADCYT ELGDLEKAGK FYDTYIARL- --ETD   316
CeresClone:1604687       -WGKL----- ---------- ---------- -----   126

Consensus                AYGAIADCYT ELGELEKAGK FYDKYIARL- --E-D   335
```

```
gi|57900400            MAAAAPSPPP VAALEQMSRT KMFGGHNLRF RHHSATLGCP MTFSVFLPP-  49
CeresClone:217396      ---------- ---------- -MFDGFNLRF RHQSATLGCA MTFSIYLPP-  28
CeresClone:699913      --MAAAASPP AAALEQLSKT KMFGGHNLRF RHQSAALGCP MTFSLFLPA-  47
CeresClone:521881      ---------- ---------- -MFGGYNKRF KHFSLTLGCS MNFHIYFPP-  28
Lead-CeresClone40508   ---------M ASGLSETGST KMFDGYNKRY KHFSETLGCS MTFSIYFPPS  41
CeresClone:1063112     ---------M ENGLSEIGST KMFDGYNKRY KHNSETLGCS MTFSIYFPP-  40

Consensus              ---------- ---L--I--T KMF-GYN-RF -H-SATLGCS MTFSIY-PP-  50

gi|57900400            ---SPASDLP VLYWLSGLTC NDENFVTKAG AQRAAAAHGI ALVAPDTSPR  96
CeresClone:217396      ---SPASNLP VLYWLSGLTC TDENFIIKSG AQRAAAAHGI ALVAPDTSPR  75
CeresClone:699913      ---SPASKLP VLYWLSGLTC TDENFIIKSG AQRAAAAHGV ALVAPDTSPR  94
CeresClone:521881      -SPSPSHKFP VLYFLSGLTC TDENFIFKSG AQRAASAEGV ALVAPDTSPR  77
Lead-CeresClone40508   ASASSSHKSP VLYWLSGLTC TDENFIIKSG AQRAASTHGI ALVAPDTSPR  91
CeresClone:1063112     ----SSHRSP VLYWLSGLTC TDENFIIKSG AQRAASTHGI ALVVPDTSPR  86

Consensus              ---SP--KLP VLYWLSGLTC TDENFIIKSG AQRAA-AHGI ALVAPDTSPR  100

gi|57900400            GLNIEGEADS WDFGVGAGFY LNATNEKWKN WRMYDYVVKE LPKVLSDNFE  146
CeresClone:217396      GLNIEGESDS YDFGVGAGFY LNATNEKWKN WRMYDYIVKE LPKVLSDNFE  125
CeresClone:699913      GLNVEGEADS WDFGVGAGFY LNATNEKWKN WRMYDYVVKE LPKVLSDNFE  144
CeresClone:521881      GLNVEGEADS WDLGVGAGFY LNATQEKWKN WRMYDYVVKE LPKLLSDNFP  127
Lead-CeresClone40508   GLNVEGEADS YDFGVGAGFY LNATQEKWKN WRMYDYVVKE LPKLLSENFS  141
CeresClone:1063112     GLNIEGEADS YDFGVGAGFY LNATQEKWKN WRMYDYVVKE LPKLLSENFP  136

Consensus              GLN-EGEADS -DFGVGAGFY LNAT-EKWKN WRMYDYVVKE LPK-LSDNFE  150

gi|57900400            QLNTSRASIF GHSMGGHGAL TIYLKNTDKY KSVSAFSPVV NPINCPWGQK  196
CeresClone:217396      QLNTSQASIF GHSMGGHGAL TIYLKNTDKY KSVSAFAPIA NPINCPWGQK  175
CeresClone:699913      QLNTSCASIF GHSMGGHGAL TIYLKNTDKY KSVSAFAPIA NPINCPWGQK  194
CeresClone:521881      QLEISKASIF GHSMGGHGAL TIFLKNQDKY KSVSAFAPIA NPINCPWGQK  177
Lead-CeresClone40508   QLDTTKASIS GHSMGGHGAL TIYLRNLDKY KSVSAFAPIT NPINCAWGQK  191
CeresClone:1063112     QLDTTRASIS GHSMGGHGAL TIYLKNLDKY KSVSAFAPIA NPINCPWGQK  186

Consensus              QLNTS-ASIF GHSMGGHGAL TIYLKNTDKY KSVSAFAPIA NPINCPWGQK  200
```

| | | | | | | |
|---|---|---|---|---|---|---|
| gi\|57900400 | AFSNYLGPAK | SDWKEYDATC | LI KKCNKI ST | PI LI DQGEDD | KFLAK-QLLP | 245 |
| CeresClone:217396 | AFSNYLGSTK | SDWEEYDATC | LI KKNSKVPT | TI LI DQGEAD | KFLAEQQLLP | 225 |
| CeresClone:699913 | AFSNYLGTTK | SEWEEYDATL | LVKKCNTLST | P LVDQGEDD | KFLAE-QLLA | 243 |
| CeresClone:521881 | AFSNYLGDNK | SEWEDYDATR | LVTKFPNVSS | TI LI DQGEDD | KFLPD-QLLP | 226 |
| Lead-CeresClone40508 | AFTNYLGDNK | AAWEEYDATC | LI SKYNNLSA | TI LI DQGEND | QFYPD-QLLP | 240 |
| CeresClone:1063112 | AFTNYLGDNK | AAWEEYDATC | LI SKFNNLSA | TI LI DQGEND | QFYPD-QLLP | 235 |
| Consensus | AFSNYLGDNK | S-WEEYDATC | LI -KFNNI ST | TI LI DQGEDD | KFL-D-QLLP | 250 |

| | | | | | | |
|---|---|---|---|---|---|---|
| gi\|57900400 | RNFEEACKAV | GAPLTLRMQP | GYDHSYFFI A | TFI DDHI AHH | SQFLKSA | 292 |
| CeresClone:217396 | HKFEEACKAA | GAALTLRMQP | GYDHSYYFI A | TFVDDHI AHH | AQFLKSA | 272 |
| CeresClone:699913 | GNFEEACKAA | GAPLTLRMQP | GYDHSFFFI A | TFI DDHI AHH | AQFLKSG | 290 |
| CeresClone:521881 | HKFEEACKKA | NVPLLLRFQP | GYDHLYYFI A | TFI DDHI RHH | AQALRLN | 273 |
| Lead-CeresClone40508 | SKFEEACKKV | NAPLLLRLHP | GYDHSYYFI A | TFI EDHI SHH | AQALEL- | 286 |
| CeresClone:1063112 | NKFEEACKKV | NAPLLVRLQP | GYDHSYYFI A | TFI EDHI SHH | VQALEL- | 281 |
| Consensus | -KFEEACK-- | -APL-LRMQP | GYDHSYYFI A | TFI DDHI AHH | AQ-LK-- | 297 |

```
CeresClone:548136        -MVV------ ---------- -AVESVIQQP ---------- ---IPQGRVK  19
Lead-CeresClone39286     -MACKTILRS VFVSESRRTS GARRCFFLPP S-PASVPVHG LFPAPKSLCF  48
CeresClone:967750        -MACKTILRS VFISESRRAS AASRCFFIPP SLSASGPVPG LFPAPKGLSF  49
gi|50908821              MMACRAL--- ---------- -----ALLPL ------PAPS RLPRPRAASL  26
CeresClone:684651        -MACRAL--- ---------- -ALRTLLLPD ------PLHH LSLRAAASAP  29
gi|50923827              MACCRAL--- ---------- -ALRSLLVPD --------HP RAAAAAAARP  28
CeresClone:990852        -MACRAL--- ---------- -ALRFLLLPD ------PLHR LPATPPSVGR  29
CeresClone:460412        -MACRAL--- ---------- -ALRSLLLPD ------PLHR L---PAAAPP  26

Consensus                -MACRAL--- ---------- -ALRSLLLPD ------PLH- L---PKAA--  50

CeresClone:548136        QKLSARGKY- -VSV--NI-- ---------- --GPVQVM-- -------SSE  42
Lead-CeresClone39286     NGFASVPERA -TRL--NC-- --SHNDQSDQ G-PPQEAVLK AISEVSKTDG  90
CeresClone:967750        NNFASLPDRR LPRL--NCT- --LSNDQSEQ G-PPQEAVLK AIS-VSKTDG  92
gi|50908821              ARLDAARRRA SASLLVRCCA --NPAGPGGQ EDPPQDAVLK AISQVANSKG  74
CeresClone:684651        AAPFPCRRRR -RNL--RCCS SSSGGGPGEQ GQPPQEAVLE AIS-------  69
gi|50923827              AAGRRAPRRR SRHL--RCC- -----SGGDP GQPPQEAVLE AISKVARSKG  71
CeresClone:990852        ASGSRGGRR- -PHL--RCS- --SGGGGGEP GQPPQEAVLE AISKIARSKG  72
CeresClone:460412        VWRASRGGRR -PHL--RCC- --SGGGGGEP GQPPQEAVLE AISKIARSKG  70

Consensus                A--AS--RRR ---L--RCC- --S--G-GEQ GQPPQEAVLE AISKVARSKG 100

CeresClone:548136        QVFLSCILIS FPLVELNLCS LFFLLKMDL- ---------- --------FVK  74
Lead-CeresClone39286     RVGKTTNMII GGTVADDSAK DWLELDQKVN TYPTERGFTA IGTGGNDFVH 140
CeresClone:967750        RVGKTTNMII GGTVADDSAQ DWLELDQKVN TYPTDRGFTA IGTGGDDFVH 142
gi|50908821              RVAQTTNVVM GGTVTDDATD EWLVLDKQVN TYPTVRGFTA IGTGGDDFVQ 124
CeresClone:684651        ---------- SGTVTDDSSD EWLVLDQKVN TYPTDRGFTA IGTGGEDFVH 109
gi|50923827              RVALTTNMVL GGTVTDDASD EWLVLDQKVN SYPTNRGFTA IGTGGDDFVQ 121
CeresClone:990852        RVALTTNVVM GGTVMDDASD EWLALDQKVN SYPTDRGXTA IGIGXDDFVQ 122
CeresClone:460412        RVALTTNMVM GGTVTDDASD EWLVLDQKVN SYPTDRGFTA IGTGGDDFVQ 120

Consensus                RVALTTNMVM GGTVTDDASD EWLVLDQKVN TYPTDRGFTA IGTGGDDFVQ 150
```

```
CeresClone:548136      KHETPITQTL K------CVS LQMTLGEYTF DIQC----CC CCFQVQAVYN   114
Lead-CeresClone39286   AMVVAVESVI DRQI PEDCVK QTLSSKGKYV SVNI GPI QVV SSEQVQAVYN   190
CeresClone:967750      AMVVAVESVI ERQI PEDCVK QTLSSKGKYV SVNI GPI RVX SSEQVQAVYN   192
gi|50908821            AMVVAVESVL EEQI PKAQI S HKVSSKGKYV SVKI GPI PVV SSEQVQAVYN  174
CeresClone:684651      SMVDAVESVL QESI PKGQVS QKI SSRGKYV SVKI GPI RVA SSEQVQAVYR  159
gi|50923827            SMVVAVESVL QEPI PKG--- ---------- ---------- ---QVQAVYR   145
CeresClone:990852      SMVVAVE--- ---------- ---------- ---------- ----------   129
CeresClone:460412      SMVVAVESVL QESI PKGRVS QKLSSRGKYV SVNI GPI RVV SSEQVQAVYR   170

Consensus              SMVVAVESVL -E-I PK--VS QKLSSKGKYV SV-I GPI RV- SSEQVQAVYN   200

CeresClone:548136      AMRRDDRMKY FL     126
Lead-CeresClone39286   AMRRDERMKY FL     202
CeresClone:967750      AMRRDERMKY XL     204
gi|50908821            AMKKDERMKF FL     186
CeresClone:684651      AMRRDNRMKY FL     171
gi|50923827            AMRSDNRMKY FL     157
CeresClone:990852      ---------- --     129
CeresClone:460412      AMRRDNRMKY FL     182

Consensus              AMRRD-RMKY FL     212
```

```
Lead-CeresClone38690  MLNLI-AFLR RRLRRPR--- ---------K ARISVNHHHL SVDSSPETHH   37
gi|11994389           MLCVFRRKLG CLFSRLRWVI KKRV-----R ARVIVRRFR- --KARWRARR   42
gi|34898868           MLRRVLAGFR ALHPRPR--- RRRHGGAEGK ARVTVRRLG- --S----NGR   40

Consensus             ML----A-LR -L--RPR--- --R------K ARV-VRR--- ---------R   50

Lead-CeresClone38690  HQNGFSSAAA IHPNPDK--- ----TITVAT FNAAMFSMAP AVPSNKGLPF   80
gi|11994389           KESPESEVSS IHLSSNSGR- ----HIRVAT FNVAMFSLAP VVQTMEEFAF   87
gi|34898868           KEAAAAAAGA RRDNRGDGAT GEAVTIRVAT FNAAMFSMAP AVAA-ASSAF   89

Consensus             KE---S-A-A IH-N---G-- ----TIRVAT FNAAMFSMAP AV------AF  100

Lead-CeresClone38690  RSKSTVDR-- ---------P KSILKPMNAA ASPTHDSRKQ QRFAKSRPRR  119
gi|11994389           LGHLDSSNIT CPS------P KGILK----- QSPLHSS--- ----AVRKPK  119
gi|34898868           TATETARRVT TPAAGGGRRP KGILK----- AQASLAR--- ----TASKAR  127

Consensus             ----T--R-T -P-------P KGILK----- ASP-H-S--- ------RK-R  150

Lead-CeresClone38690  VSINLPDNEI SRQLSFR--- --EDPQHSPL RPGEIGLRS- ----------  153
gi|11994389           VCINLPDNEI SLAQSYSFLS MVENDNDGKE NRGSLSMRSP VCLPSCWWDQ  169
gi|34898868           VSINLQDNEI SRERS----- ---------- KLGSTAARST TTATTTPAAT  162

Consensus             VSINLPDNEI SR--S----- --E------- --GS---RS- ----------  200

Lead-CeresClone38690  ---------- TRTALEVLSE LDADVLALQD VKADEADQMR PLSDLAAALG  193
gi|11994389           ESFNGYSS-- RRSIAELLRE LDADILALQD VKAEEETLMK PLSDLASALG  217
gi|34898868           QQLNGGAEGR RRSVEEVLRE VGADIIGLQN VRAEEERGMS PLSELAEGLG  212

Consensus             ---NG----- RRS--EVLRE LDADILALQD VKAEEE--M- PLSDLA-ALG  250

Lead-CeresClone38690  MNYVFAESWA PEYGNAILSK WPIKSSNVLR IEDHEDFRNV LKASIEVPGS  243
gi|11994389           MKYVFAESWA PEYGNAILSK WPIKKWRVQR IADVDDFRNV LKVTVEIPWA  267
gi|34898868           MRYVFAESWA PEYGNAVLSR WPIKRWKSQR VADQSDF-NV LRATIEVPRA  261

Consensus             M-YVFAESWA PEYGNAILSK WPIK-W-VQR IAD--DFRNV LKATIEVP-A  300
```

| | | | | | | |
|---|---|---|---|---|---|---|
| Lead-CeresClone38690 | GEVEFHCTHL | DHLDEKWRMK | QVDAIIQSTN | VPHILAGALN | SLDESDYSPE | 293 |
| gi\|11994389 | GDVNVYCTQL | DHLDENWRMK | QIDAIFRGDE | SPHILLGGLN | SLDGSDYSIA | 317 |
| gi\|34898868 | GEVNFHCTHL | DHLDESWRMK | QMNAILRSSD | GPHILTGGLN | ALDGTDYSDE | 311 |
| Consensus | GEVNFHCTHL | DHLDE-WRMK | Q-DAI-RS-- | -PHIL-GGLN | SLDGSDYS-E | 350 |
| Lead-CeresClone38690 | RWIDIVKYYE | EMGKPIPKAQ | VMRFLKSKEY | TDAKDFAGEC | ESVVVVAKGQ | 343 |
| gi\|11994389 | RWNHIVKYYE | DSGKPTPRVE | VMRFLKGKGY | LDSKEFAGEC | EPVVIIAKGQ | 367 |
| gi\|34898868 | RWADIVKYYE | EIGKPTPKAE | VMKYLKGKQY | VDAKDFAGEC | EAVVVVAKGQ | 361 |
| Consensus | RW-DIVKYYE | E-GKPTPKAE | VMRFLKGK-Y | -DAKDFAGEC | E-VVVVAKGQ | 400 |
| Lead-CeresClone38690 | SVQGTCKYGT | RVDYILASSD | SPYRFVPGSY | SVLSSKGTSD | HHIVKVDVVK | 393 |
| gi\|11994389 | NVQGTCKYGT | RVDYILASPE | SPYEFVPGSY | SVVSSKGTSD | HHIVKVDLVI | 417 |
| gi\|34898868 | -VQGTCKYGT | RVDYILASPN | SPYKFVPGSY | TVISSKGTSD | HHIVKVDVTI | 410 |
| Consensus | -VQGTCKYGT | RVDYILASP- | SPY-FVPGSY | SV-SSKGTSD | HHIVKVDVVI | 450 |
| Lead-CeresClone38690 | ATSINVNE-Q | EQRPIRSHKL | QRITATTYNN | NSSLTKASWR | THYYKA- | 438 |
| gi\|11994389 | TKERSRGNFK | HSRKKAKQKI | FQI-------K | ANLMSKDTWK | LGNLMSS | 458 |
| gi\|34898868 | QDKKETDE-- | -ESGNQRQRV | VKI-------N | KKCSKKGLWA | AK----- | 443 |
| Consensus | -------E-- | --R----QK- | --I-------N | -----K--W- | ------- | 497 |

```
CeresClone:1061228        --MFVAALAL VVVMATTSTG GGRAA----- -----AACDP KPLVVCDPAF   38
CeresClone:1610064        ---MAAAYAL LVMLLAGYAE TTNAA----- ------TCSV TELSPCISSF   36
Lead-CeresClone38470      MKIVILVLVV FVILSTSFPA AIKAEDTGDT G-NVGVTCDA RQLQPCLAAI   49
CeresClone:1087891        ---MVLILMV FVILLTSFPV PNKAADT--- --NVEAACDP KQLQPCLAAI   42
CeresClone:946439         MKILALTLTV FVILSPSFAS PTKVA----- ---LGAACDA KQLQPCLAAI   42
gi|45593274               MKFTTLMLIL FVIIAMSSPV PIRATRVESF G-EVAQSCVV TELAPCLPAM   49
gi|28973415               MKFTGVVFLL FVLGTMLSPV PVKARVVKGS GEEVNVTCDA TQLSSCVTAV   50

Consensus                 MK-M-L-LV- FVIL--SFP- P-KAA----- ---V----CD- KQL-PCL-AI   50

CeresClone:1061228        MDGAKPAAAC CSTLRAQEAC LCVYAKDPKF AKYINNPNTA KTFTSCGIAI   88
CeresClone:1610064        TTSAPPSAQC CAKLKQQQPC LCGYIKNPSL KQYVNSPNAK KVSSTCGVPF   86
Lead-CeresClone38470      TGGGQPSGAC CAKLTEQQSC LCGFAKNPAF AQYISSPNAR KVLLACNVAY   99
CeresClone:1087891        TGGGQPSGDC CAKLKEQQPC LCGFAKNPAF AQYISSPNSR KVLTACGIPY   92
CeresClone:946439         TGGGQPSGDC CAKLKEQQPC LCGFSKNPAF AQYVSSPNSR KVVSACGVPY   92
gi|45593274               TLTGDPTIEC CDKLVEQKPC LCGYIRNPAY SMYVTSPNAR KVLDFCKVPF   99
gi|28973415               STGAPPSTDC CGKLKEHETC LCTYIQNPLY SSYVTSPNAR KTLAACDVAY  100

Consensus                 T-GGQPS--C CAKLKEQQPC LCGYAKNPAF AQYVSSPNAR KVL-ACGVPY  100

CeresClone:1061228        PKC    91
CeresClone:1610064        PKC    89
Lead-CeresClone38470      PTC   102
CeresClone:1087891        PSC    95
CeresClone:946439         PSC    95
gi|45593274               PSC   102
gi|28973415               PTC   103

Consensus                 PSC   103
```

```
CeresClone:944775        MADGEDIQPL VCDNGTGMVK AGFAGDDAPR AVFPSIVGRP RHTGVMV---   47
CeresClone:1078589       MADGEDIQPL VCDNGTGMVK AGFAGDDAPR AVFPSIVGRP RHTGVMV---   47
CeresClone:1067464       MADGEDIQPL VCDNGTGMVK AGFAGDDAPR AVFPSIVGRP RHTGVMV---   47
CeresClone:319835        MYGGDEVSAI VIDVGSYSCK AGYAGDDIPK AVFPSVVGSI EQTEDTDDPK   50
Lead-CeresClone38419     MYGGDEVSAI VVDLGSHTCK AGYAGEDAPK AVFPSVIGAV DGVEAMD---   47
CeresClone:1125315       MYGGDEVSAI VVDLGSHTCK AGYAGEDAPK AVFPSVVGAV DGVEAME---   47

Consensus                M-G------- V-D-G----K AG-AGDDAP- AVFPS-VG-- -HT-VM----   50

CeresClone:944775        ---------- ---------- ---GMGQKDA YVGDEA-QSK RGILTLKYPI   73
CeresClone:1078589       ---------- ---------- ---GMGQKDA YVGDEA-QSK RGILTLKYPI   73
CeresClone:1067464       ---------- ---------- ---GMGQKDA YVGDEA-QSK RGILTLKYPI   73
CeresClone:319835        PEKEADSASD SKNGAKP-MD VDKAKTKRRL YVGDEL-EFR RDHMEVISSM   98
Lead-CeresClone38419     --VDVDSITKT NSNSEDSKTE SEKEKGKRKL YVGSQAMSYR RDHMEVLSPI   95
CeresClone:1125315       --VDVDSAKT NSNSED---K SEKDKGKRKL CVGSQALNYR RDHMEILSPI   92

Consensus                ---D-DS--- N-N------- -EKG-G---- YVGDEA-Q-- R----L--PI  100

CeresClone:944775        EHGIVSNWDD MEKIWHHTFY NELRVAPEEH PVLLTEAPLN PKANRXE---  120
CeresClone:1078589       EHGIVNNWDD MEKIWHHTFY NELRVAPEEH PVLLTEAPLN PKANREKMTQ  123
CeresClone:1067464       EHGIVNNWDD MEKIWHHTFY NELRVAPEEH PVLLTEAPLN PKANREKMTQ  123
CeresClone:319835        KDGIVTDWDI VDNIWNHAFR RRLLINPEEH PMLIAEPSTN TAQQREKAAE  148
Lead-CeresClone38419     KDGIVSDWDL VDNIWEHAFK SCLMIDPTEH PMLLAEPPLN TQQQREKAAE  145
CeresClone:1125315       KDGIVSDWDL ---------- ---------- ---------- ----------  102

Consensus                --GIVS-WD- MEKIWHHTFY NELRVAPEEH PVLLTEAPLN PKANREK---  150

CeresClone:944775        ------DDPD -YVRD----- ---------- ---------- ----------  128
CeresClone:1078589       IMFETFNAPA MYVAIQAVL- ---------- ---------- ----------  142
CeresClone:1067464       IMFETFNTPA MYV------- ---------- ---------- ----------  136
CeresClone:319835        LIFENYKVPA LFLAKNAVLT SFASGRATSL VVDSGGGSTV VSAVHDGFVL  198
Lead-CeresClone38419     LMFEKYKVPA LFMAKNPVLT SFATGRATSL VVDCGGGSTT ISPVHDGYVL  195
CeresClone:1125315       ---------- ---------- ---------- ---------- ----------  102

Consensus                -MFE--N-PA -YVA---VL- ---------- ---------- ----------  200
```

```
CeresClone:944775         ---------- ---------- ---------- ---------- ----------  128
CeresClone:1078589        ---------- ---------- ---------- ---------- ----------  142
CeresClone:1067464        ---------- ---------- ---------- ---------- ----------  136
CeresClone:319835         QKSVSTSPVG GEFLTDCMMK SLESKGI VI R PRYSFKKKEI SPGEYKI VDL  248
Lead-CeresClone38419      QKAVVSSPLG GEFLTDCLLK SLESKGI KI R PRYSFKRKEV RAGEFQVEDV  245
CeresClone:1125315        ---------- ---------- ---------- ---------- ----------  102

Consensus                 ---------- ---------- ---------- ---------- ----------  250

CeresClone:944775         ---------- ---------- ---------- ---------- ----------  128
CeresClone:1078589        ---------- ---------- ---------- ---------- ----------  142
CeresClone:1067464        ---------- ---------- ---------- ---------- ----------  136
CeresClone:319835         DLPNTTESYR LYCMRAI ASD VKESVCRVPD TAFDEVAYAN VPTTSYELPD  298
Lead-CeresClone38419      DI PDTTESYK LFCQRMI VGD I KDSI CRVPD TPYDDKSYSN I PTTSYELPD  295
CeresClone:1125315        ---------- ---------- ---------- ---------- ----------  102

Consensus                 ---------- ---------- ---------- ---------- ----------  300

CeresClone:944775         ---------- ---------- ---------- ---------- ----------  128
CeresClone:1078589        ---------- ---------- ---------- ---------- ----------  142
CeresClone:1067464        ---------- ---------- ---------- ---------- ----------  136
CeresClone:319835         GQTI EVGADR FKVPDI LFNP SLSQTI PGI D GFADSI P-VR GLQRMVI DSV  347
Lead-CeresClone38419      GQTLEI GADR FKVPDVMFNP SI VQTI PGME KYADMI PSVR GLPHNVMESI  345
CeresClone:1125315        ---------- ---------- ---------- ---------- ----------  102

Consensus                 ---------- ---------- ---------- ---------- ----------  350

CeresClone:944775         ---------- ---------- ---------- ---------- ----------  128
CeresClone:1078589        ---------- ---------- ---------- ---------- ----------  142
CeresClone:1067464        ---------- ---------- ---------- ---------- ----------  136
CeresClone:319835         NKCDVDI RKE LFSNI LLSGG SSSI LQLKER LEKEVLEESP QAARVKVMAS  397
Lead-CeresClone38419      NKCDVDI RRE LYSSI LLAGG TSSMQQLKER LEKDLI EESP HSARVKVLAS  395
CeresClone:1125315        ---------- ---------- ---------- ---------- ----------  102

Consensus                 ---------- ---------- ---------- ---------- ----------  400
```

```
CeresClone:944775          ---------- ---------- ---------- ---------- ------    128
CeresClone:1078589         ---------- ---------- ---------- ---------- ------    142
CeresClone:1067464         ---------- ---------- ---------- ---------- ------    136
CeresClone:319835          GNSVERRFSV WI GGSI LASL GSFQQMWFSK AEYEEHGVSY I QRKCP    443
Lead-CeresClone38419       GNTTERRFSV WI GGSI LASL GSFQQMWFSK SEYEEHGASY I QRKCP    441
CeresClone:1125315         ---------- ---------- ---------- ---------- ------    102

Consensus                  ---------- ---------- ---------- ---------- ------    446
```

| | | | | | | | |
|---|---|---|---|---|---|---|---|
| CeresClone:34479 | ---------- | --------MVK | AGFAGDDAPR | AVFPSVVGRP | RHHGVMVGMN | | 33 |
| CeresClone:223048 | ---------- | --------MVK | AGFAGDDAPR | AVFPSI VGRP | RHT GVMVGMG | | 33 |
| CeresClone:1549130 | ---------- | --------MVK | AGFAGDDAPR | AVFPSI VGRP | RHT GVMVGMG | | 33 |
| CeresClone:41421 | ---------- | --------MVK | AGFAGDDAPR | AVFPSI VGRP | RHT GVMVGMG | | 33 |
| CeresClone:116045 | ---------- | --------MVK | AGFAGDDAPR | AVFPSI VGRP | RHT GVMVGMG | | 33 |
| CeresClone:1073372 | ---------- | --------MVK | AGFAGDDAPR | AVFPSI VGRP | RHT GVMVGMG | | 33 |
| Leod-CeresClone38101 | MADGEDI QPL | VCDNGT GMVK | AGFAGDDAPR | AVFPSI VGRP | RHT GVMVGMG | | 50 |
| CeresClone:338602 | ---------- | --------MVK | AGFAGDDAPR | AVFPSI VGRP | RHT GVMVGMG | | 33 |
| CeresClone:331439 | ---------- | --------MVK | AGFAGDDAPR | AVFPSI VGRP | RHT GVMVGMG | | 33 |
| CeresClone:294922 | MADSEDI QPL | VCDNGT GMVK | AGFAGDDAPR | AVFPSI VGRP | RHT GVMVGMG | | 50 |
| CeresClone:292789 | ---------- | --------MVK | AGFAGDDAPR | AVFPSI VGRP | RHT GVMVGMG | | 33 |
| CeresClone:996136 | ---------- | --------MVK | AGFAGDDAPR | AVFPSI VGRP | RHT GVMVGMG | | 33 |
| Consensus | ---------- | --------MVK | AGFAGDDAPR | AVFPSI VGRP | RHT GVMVGMG | | 50 |

| | | | | | | |
|---|---|---|---|---|---|---|
| CeresClone:34479 | QKDAYVGDEA | QSKRGI LTLK | YPI EHGVVSN | WDDMEKI WHH | TFYNELRI AP | 83 |
| CeresClone:223048 | QKDAYVGDEA | QAKRGI LTLK | YPI EHGI VNN | WDDMEKI WHH | TFYNELRVSP | 83 |
| CeresClone:1549130 | QKDAYVGDEA | QSKRGI LTLK | YPI EHGI VGN | WDDMEKI WHH | TFYNELRVAP | 83 |
| CeresClone:41421 | QKDAYVGDEA | QSKRGI LTLK | YPI EHGI VNN | WDDMEKI WHH | TFYNELRVAP | 83 |
| CeresClone:116045 | QKDAYVGDEA | QSKRGI LTLK | YPI EHGI VNN | WDDMEKI WHH | TFYNELRVAP | 83 |
| CeresClone:1073372 | QKDAYVGDEA | QSKRGI LTLK | YPI EHGI VSN | WDDMENI WHH | TFYNELRVAP | 83 |
| Leod-CeresClone38101 | QKDAYVGDEA | QSKRGI LTLK | YPI EHGI VSN | WDDMEKI WHH | TFYNELRVAP | 100 |
| CeresClone:338602 | QKDAYVGDEA | QSKRGI LTLK | YPI EHGI VSN | WDDMEKI WHH | TFYNELRVAP | 83 |
| CeresClone:331439 | QKDAYVGDEA | QSKRGI LTLK | YPI EHGI VSN | WDDMEKI WHH | TFYNELRVAP | 83 |
| CeresClone:294922 | QKDAYVGDEA | QSKRGI LTLK | YPI EHGI VSN | WDDMEKI WHH | TFYNELRVAP | 100 |
| CeresClone:292789 | QKDAYVGDEA | QSKRGI LTLK | YPI EHGI VSN | WDDMEKI WHH | TFYNELRVAP | 83 |
| CeresClone:996136 | QKDAYVGDEA | QSKRGI LTLK | YPI EHGI VNN | WDDMEKI WHH | TFYNELRVAP | 83 |
| Consensus | QKDAYVGDEA | QSKRGI LTLK | YPI EHGI VSN | WDDMEKI WHH | TFYNELRVAP | 100 |

| | | | | | | |
|---|---|---|---|---|---|---|
| CeresClone:34479 | EEHPVLLTEA | PLNPKANREK | MTQI MFETFN | SPAMYVAI QA | VLSLYASGRT | 133 |
| CeresClone:223048 | EDHPVLLTEA | PLNPKANREK | MTQI MFETFE | CPAI YVAI QA | VLSLYASGRT | 133 |
| CeresClone:1549130 | EEHPI LLTEA | PLNPKANREK | MTQI MFETFN | CPAMYVAI QA | VLSLYASGRT | 133 |
| CeresClone:41421 | EEHPVLLTEA | PLNPKANREK | MTQI MFETFN | TPAMYVAI QA | VLSLYASGRT | 133 |
| CeresClone:116045 | EEHPI LLTEA | PLNPKANREK | MTQI MFETFN | APAMYVAI QA | VLSLYASGRT | 133 |
| CeresClone:1073372 | EEHPVLLTEA | PLNPKANREK | MTHI MFETFN | VPAMYVAI QA | VLSLYASGRT | 133 |
| Lead-CeresClone38101 | EEHPVLLTEA | PLNPKANREK | MTQI MFETFN | TPAMYVAI QA | VLSLYASGRT | 150 |
| CeresClone:338602 | EEHPVLLTEA | PLNPKANREK | MTQI MFETFN | TPAMYVAI QA | VLSLYASGRT | 133 |
| CeresClone:331439 | EEHPVLLTEA | PLNPKANREK | MTQI MFETFN | VPAMYVAI QA | VLSLYASGRT | 133 |
| CeresClone:294922 | EEHPVLLTEA | PLNPKANREK | MTQI MFETFN | VPAMYVAI QA | VLSLYASGRT | 150 |
| CeresClone:292789 | EEHPVLLTEA | PLNPKANREK | MTQI MFETFN | VPAMYVAI QA | VLSLYASGRT | 133 |
| CeresClone:996136 | EEHPVLLTEA | PLNPKANREK | MTQI MFETFN | VPAMYVAI QA | VLSLYASGRT | 133 |
| Consensus | EEHPVLLTEA | PLNPKANREK | MTQI MFETFN | -PAMYVAI QA | VLSLYASGRT | 150 |

| | | | | | | |
|---|---|---|---|---|---|---|
| CeresClone:34479 | TGI VLDSGDG | VSHTVPI YEG | FSLPHAI LRL | DLAGRDLTDY | LMKI LTERGY | 183 |
| CeresClone:223048 | TGI VMDSGDG | VSHTVPI YEG | YTLPHAI LRL | DLAGRDLTDH | LMKI LTERGY | 183 |
| CeresClone:1549130 | TGI VLDSGDG | VSHTVPI YEG | YTLPHAI LRL | DLAGRDLTDN | LMKI LTERGY | 183 |
| CeresClone:41421 | TGI FLDSGDG | VSHTVPI YEG | YALPHAI LRL | DLAGRDLTDH | LMKI LTERGY | 183 |
| CeresClone:116045 | TGI VLDSGDG | VSHTVPI YEG | YALPHAI LRL | DLAGRDLTDA | LMKI LTERGY | 183 |
| CeresClone:1073372 | TGI VLDSGDG | VSHTVPI YEG | YALPHAI LRL | DLAGRDLTDS | LMKI LTERGY | 183 |
| Lead-CeresClone38101 | TGI VLDSGDG | VSHTVPI YEG | YALPHAI LRL | DLAGRDLTDY | LMKI LTERGY | 200 |
| CeresClone:338602 | TGI VLDSGDG | VSHTVPI YEG | YALPHAI LRL | DLAGRDLTDY | LMKI LTERGY | 183 |
| CeresClone:331439 | TGI VLDSGDG | VSHTVPI YEG | YALPHAI LRL | DLAGRDLTDS | LMKI LTERGY | 183 |
| CeresClone:294922 | TGI VLDSGDG | VSHTVPI YEG | YALPHAI LRL | DLAGRDLTDS | LMKI LTERGY | 200 |
| CeresClone:292789 | TGI VLDSGDG | VSHTVPI YEG | YALPHAI LRL | DLAGRDLTDS | LMKI LTERGY | 183 |
| CeresClone:996136 | TGI VLDSGDG | VSHTVPI YEG | YALPHAI LRL | DLAGRDLTDS | LMKI LTERGY | 183 |
| Consensus | TGI VLDSGDG | VSHTVPI YEG | YALPHAI LRL | DLAGRDLTD- | LMKI LTERGY | 200 |

| | | | | | | |
|---|---|---|---|---|---|---|
| CeresClone:34479 | MFTTTAEREI | VRDI KEKLSF | VSVDYEQEME | TSKTSSSI EK | NYELPDGQVI | 233 |
| CeresClone:223048 | SLTTSAEREI | VRDI KEKLAY | VALDYEQELE | TARSSSSVEK | SYEMPDGQVI | 233 |
| CeresClone:1549130 | SFTTTAEREI | VRDI KEKLAY | VALDYEQELE | TARTSSSVEK | SYELPDGQVI | 233 |
| CeresClone:41421 | SFTTTAEREI | VRDMKEKLSY | I ALDFEQELE | TSKTSSSVEK | SFELPDGQVI | 233 |
| CeresClone:116045 | SFTTTAEREI | VRDI KEKLCY | I ALDYEQELE | TAKTSSSVEK | NYELPDGQVI | 233 |
| CeresClone:1073372 | MFTTTAEREI | VRDI KEKLAY | VALDYEQELE | TAKSSSSVEK | NYELPDGQVI | 233 |
| Lead-CeresClone38101 | SFTTSAEREI | VRDVKEKLAY | I ALDYEQEME | TANTSSSVEK | SYELPDGQVI | 250 |
| CeresClone:338602 | SFTTTAEREI | VRDMKEKLAY | I ALDYDQEME | TAKTSSSVEK | SYELPDGQVI | 233 |
| CeresClone:331439 | SFTTSAEREI | VRDI KEKLAY | I ALDYEQELE | TAKNSSSVEK | SYELPDGQVI | 233 |
| CeresClone:294922 | SFTTSAEREI | VRDI KEKLAY | I ALDYEQELE | TAKNSSSVEK | SYELPDGQVI | 250 |
| CeresClone:292789 | SFTTTAEREI | VRDI KEKLAY | VALDYDQELE | NAKSSSSVEK | SYELPDGQVI | 233 |
| CeresClone:996136 | SFTTSAEREI | VRDI KEKLAY | VALEYDQELE | NAKSSSSVEK | SYELPDGQVI | 233 |
| Consensus | SFTTTAEREI | VRDI KEKLAY | -ALDYEQELE | TAKTSSSVEK | SYELPDGQVI | 250 |

| | | | | | | |
|---|---|---|---|---|---|---|
| CeresClone:34479 | TI GAERFRCP | EVLFQPSFVG | MEAAGI HETT | YNSI MKCDVD | I RKDLYGNI V | 283 |
| CeresClone:223048 | TI GSERFRCP | EVLFQPSLVG | MESPGVHEAT | YNSI MKCDVD | I RKDLYGNVV | 283 |
| CeresClone:1549130 | TI GAERFRCP | EVLFQPSFI G | MESAGI HEAT | YNSI MKCDVD | I RKDLYGNVV | 283 |
| CeresClone:41421 | TI GAERFRCP | EVLFQPSMI G | MENPGI HETT | YNSI MKCDVD | I RKDLYGNI V | 283 |
| CeresClone:116045 | TI GSERFRCP | EVLYQPSMI G | MENAGI HETT | YNSI MKCDVD | I RKDLYGNI V | 283 |
| CeresClone:1073372 | TI GAERFRCP | EVLFQPSLVG | MEAPGI HETT | YNSI MKCDVD | I RKDLYGNI V | 283 |
| Lead-CeresClone38101 | TI GGERFRCP | EVLFQPSLVG | MEAAGI HETT | YNSI MKCDVD | I RKDLYGNI V | 300 |
| CeresClone:338602 | TI GAERFRCP | EVLFQPSFI G | MEAAGI HETT | YNSI MKCDVD | I RKDLYGNI V | 283 |
| CeresClone:331439 | TI GAERFRCP | EVLFQPSMI G | MEAAGI HETT | YNSI MKCDVD | I RKDLYGNI V | 283 |
| CeresClone:294922 | TI GAERFRCP | EVLFQPSMI G | MEAAGI HETT | YNSI MKCDVD | I RKDLYGNI V | 300 |
| CeresClone:292789 | TI GAERFRCP | EVLFQPSFI G | MEAPGI HETT | YNSI MKCDVD | I RKDLYGNI V | 283 |
| CeresClone:996136 | TI GAERFRCP | EVLFQPSFI G | MEAPGI HETT | YNSI MKCDVD | I RKDLYGNI V | 283 |
| Consensus | TI GAERFRCP | EVLFQPSMI G | MEAAGI HETT | YNSI MKCDVD | I RKDLYGNI V | 300 |

| | | | | | | |
|---|---|---|---|---|---|---|
| CeresClone:34479 | LSGGTTMFSG | IADRMSKEIT | ALAPSSMKIK | VVAPPERKYS | VWIGGSILAS | 333 |
| CeresClone:223048 | LSGGSTMFPG | IADRMSKEIT | SLAPSSMKVK | VIAPPERKYS | VWIGGSILAS | 333 |
| CeresClone:1549130 | LSGGSTMFPG | IGDRMSKEIT | ALAPSSMKVK | VVAPPERKYS | VWIGGSILAS | 333 |
| CeresClone:41421 | LSGGTTMFGG | IGDRMSKEIT | ALAPSSMKIK | VVAPPERKYS | VWIGGSILAS | 333 |
| CeresClone:116045 | LSGGTTMFPG | IADRMSKEIT | ALAPSSMKIK | VVAPPERKYS | VWIGGSILAS | 333 |
| CeresClone:1073372 | LSGGSTMFPG | IADRMSKEIT | ALAPSSMKIK | VVAPPERKYS | VWIGGSILAS | 333 |
| Leod-CeresClone38101 | LSGGTTMFPG | IADRMSKEIT | ALAPSSMKIK | VVAPPERKYS | VWIGGSILAS | 350 |
| CeresClone:338602 | LSGGTTMFPG | IADRMSKEIT | ALAPSSMKIK | VVAPPERKYS | VWIGGSILAS | 333 |
| CeresClone:331439 | LSGGSTMFPG | IADRMSKEIT | SLAPSSMKIK | VVAPPERKYS | VWIGGSILAS | 333 |
| CeresClone:294922 | LSGGSTMFPG | IADRMSKEIT | SLAPSSMKIK | VVAPPERKYS | VWIGGSILAS | 350 |
| CeresClone:292789 | LSGGTTMFPG | IADRMSKEIT | ALAPSSMKIK | VVAPPERKYS | VWIGGSILAS | 333 |
| CeresClone:996136 | LSGGTTMFPG | IADRMSKEIT | ALAPSSMKIK | VVAPPERKYS | VWIGGSILAS | 333 |
| Consensus | LSGGTTMFPG | IADRMSKEIT | ALAPSSMKIK | VVAPPERKYS | VWIGGSILAS | 350 |

| | | | | |
|---|---|---|---|---|
| CeresClone:34479 | LSTFQQMWIS | KAEYDEAGPG | IVHRKCF | 360 |
| CeresClone:223048 | LSTFQQMWIS | KGEYDETGPG | IVHMKCF | 360 |
| CeresClone:1549130 | LSTFQQMWIS | KEEYDESGPG | IVHMKCF | 360 |
| CeresClone:41421 | LSTFQQMWIA | KAEYDESGPS | IVHRKCF | 360 |
| CeresClone:116045 | LSTFQQMWIA | KAEYDESGPS | IVHRKCF | 360 |
| CeresClone:1073372 | LSTFQQMWIS | KGEYDESGPS | IVHRKCF | 360 |
| Leod-CeresClone38101 | LSTFQQMWIA | KAEYDESGPS | IVHRKCF | 377 |
| CeresClone:338602 | LSTFQQMWIA | KAEYDESGPS | IVHRKCF | 360 |
| CeresClone:331439 | LSTFQQMWIS | KEEYDESGPA | IVHRKCF | 360 |
| CeresClone:294922 | LSTFQQMWIS | KEEYDESGPA | IVHRKCF | 377 |
| CeresClone:292789 | LSTFQQMWIS | KAEYDESGPA | IVHRKCF | 360 |
| CeresClone:996136 | LSTFQQMWIS | KAEYDESGPG | IVHRKCF | 360 |
| Consensus | LSTFQQMWIS | KAEYDESGPS | IVHRKCF | 377 |

```
Lead-CeresClone37663   MDTAQWPQEI VVKPLEEI-V TNTCPKPQPQ PLQTQQPPSV GGERKARPEK   49
CeresClone:476994      ---------M VVKPIEDIVV TNTCPKAV-- ---------- --ESKPRPQK   27
Consensus              MDTAQWPQE- VVKP-E-IVV TNTCPK--PQ PLQTQQPPSV GGE-K-RP-K   50

Lead-CeresClone37663   DQAVNCPRCN STNTKFCYYN NYSLTQPRYF CKGCRRYWTE GGSLRNIPVG   99
CeresClone:476994      EQAINCPRCH SINTKFCYYN NYSLTQPRYF CKTCRRYWTE GGTLRNIPVG   77
Consensus              -QA-NCPRC- S-NTKFCYYN NYSLTQPRYF CK-CRRYWTE GG-LRNIPVG   100

Lead-CeresClone37663   GGSRKNKRSH SFSSDISNNH SDSTQPATKK HLSDHHHHLM SMSQQGLTGQ   149
CeresClone:476994      GGSRKNKRSS A-SCSTPNNS HNNNNSTNKK LLSDLVITPP TLSHT----Q   122
Consensus              GGSRKNKRS- -FS----NN- --------KK -LSD------ --S--GLTGQ   150

Lead-CeresClone37663   NPKFLETTQ- -QDLNLGFSP HGMIRTNFTD LIHNIGNNTN KSNNNNNPLI   197
CeresClone:476994      NPNSNNTIHQ GQDLNLAFPS STPDFRKISE LVQQNNNNNN SSNNSMSASA   172
Consensus              NP----T--Q GQDLNL-F-- ---------- L-----NN-N -SNN------   200

Lead-CeresClone37663   VSSCSTMATS S-----LDLI RNNSNNGNSS NSSFMGFPVH NEDPA--SGG   240
CeresClone:476994      SSSSTTTTTS TSHLSALELL TGITSSSSAG LTSFMPVPVP SDPNSIYTCG   222
Consensus              -SS--T--TS -SHLSAL-L- ---------- --SFM--PV- ------IY--G   250

Lead-CeresClone37663   FSMQDHYKPC NTNTTLLGFS LDHHHNNGFH GGFQGGEEGG EGGDDVNGRH   290
CeresClone:476994      FPLQD-FKPT ------LNFS LD-----GIG NGYTSLQ--- ---NVQSGRL   254
Consensus              F--QDH-KP- NTNTTLL-FS LDHHHNNG-- -G------EGG EGG-----GR-   300

Lead-CeresClone37663   LFPFEDLKLP VSSSSATINV DINEHQKRGS GSDAAATSGG YWTGMLSGGS   340
CeresClone:476994      LFPSDDLRQV SSSTITTM-- ---DQKQQGD ST-------G YWTGMLGGGS   292
Consensus              LFP--DL--- -SS---T-NV DIN------G- --DAAATSGG YWTGML-GGS   350
```

| | | |
|---|---|---|
| Lead-CeresClone37663 | WC | 342 |
| CeresClone:476994 | W- | 293 |
| Consensus | WC | 352 |

| | | | | | | |
|---|---|---|---|---|---|---|
| Lead-CeresClone37298 | MGSQQAAVSF | LSNLAKAAFG | LGIAATVLNT | SLFTVDGGER | AVIFDRFRGV | 50 |
| CeresClone:33731 | MGSQQAAI SF | LTNLAKAAFG | LGVAATALNS | SLYTVDGGER | AVLFDRFRGV | 50 |
| gi\|21592895 | MGSQQAAI SF | LTNLAKAAFG | LGVAATALNS | SLYTVDGGER | AVLFDRFRGV | 50 |
| gi\|27765032 | MGSQQVAI SF | LTNLAKAAFG | LGVAATALNS | SLYTVDGGER | AVLFDRFRGV | 50 |
| gi\|9294221 | MGSQQVAI SF | LTNLAKAAFG | LGVAATALNS | SLYTVDGGER | AVLFDRFRGV | 50 |
| CeresClone:523811 | MGSNQAAI SF | LTNVARAAFG | LGAAATALSS | SLYTVDGGQR | AVLFDRFRGI | 50 |
| gi\|58979188 | MGSNQAAVSF | LTNLARAAFG | LGI SATVVNS | SLYTVDGGQR | AVLFDRFRGV | 50 |
| gi\|1946329 | MGSSQAAVSF | LTNVARAAFG | LGI SATVLNS | SLYTVDGGQR | AVLFDRFRGV | 50 |
| CeresClone:238897 | ---------- | MTRMAKVAAG | LGVAASAAST | SFYTVDGGER | AVIFDRVRGV | 40 |
| CeresClone:296971 | MAGGPAAVSF | LTNI AKVAAG | LGAAASLASA | SLYTVDGGER | AVIFDRFRGV | 50 |
| Consensus | MGSQQAAI SF | LTNLAKAAFG | LGVAATALNS | SLYTVDGGER | AVLFDRFRGV | 50 |

| | | | | | | |
|---|---|---|---|---|---|---|
| Lead-CeresClone37298 | MDQTVGEGTH | FLIPLLQRPH | IFDIRTKPHT | FSSISGTKDL | QMVNLTLRVL | 100 |
| CeresClone:33731 | LDQTVGEGTH | FLIPYLQTPH | IYDIRTKPHT | FSSKSGTKDL | QMVNLTLRVL | 100 |
| gi\|21592895 | LDQTVGEGTH | FLIPYLQTPH | IYDIRTKPHT | FSSKSGTKDL | QMVNLTLRVL | 100 |
| gi\|27765032 | LDQTVGEGTH | FLIPYLQTPH | IYDIRTKPHT | FSSKSGTKDL | QMVNLTLRVL | 100 |
| gi\|9294221 | LDQTVGEGTH | FLIPYLQTPH | IYDIRTKPHT | FSSKSGTKDL | QMVNLTLRVL | 100 |
| CeresClone:523811 | LDSTVGEGTH | FLVPWVQKPY | IFDIRTRPHT | FSSVSGTKDL | QMVNLTLRVL | 100 |
| gi\|58979188 | IDDTVGEGTH | FLIPWLQKPF | IFDIRTRPHT | FSSTSGTKDL | QMVNLTLRVL | 100 |
| gi\|1946329 | IDDTVGEGTH | FLVPWLQKPF | IFDIRTRPHT | FSSVSGTKDL | QMVHLTLRVL | 100 |
| CeresClone:238897 | LPRTMSEGTH | LLVPILQKPF | IFDIRTRPHS | FSSTSGTKDL | QMVSLTLRVL | 90 |
| CeresClone:296971 | LPETVGEGTH | FLVPWLQKPF | IFDIRTRPHN | FSSNSGTKDL | QMVNLTLRLL | 100 |
| Consensus | LDQTVGEGTH | FLIP-LQKPH | IFDIRT-PHT | FSS-SGTKDL | QMVNLTLRVL | 100 |

| | | | | | | |
|---|---|---|---|---|---|---|
| Lead-CeresClone37298 | SRPEVSRLPY | IFQTLGLEYD | EKVLPSI GNE | VLKAVVAQFN | ADQLLTERPH | 150 |
| CeresClone:33731 | FRPEVSRLPY | IFQTLGLEYD | EKVLPSI GNE | VLKAVVANFN | ADQLLTERPQ | 150 |
| gi\|21592895 | FRPEVSRLPY | IFQTLGLEYD | EKVLPSI GNE | VLKAVVANFN | ADQLLTERPQ | 150 |
| gi\|27765032 | FRPEVSRLPY | IFQTLGLEYD | EKVLPSI GNE | VLEAVVANFN | ADQLLTERPQ | 150 |
| gi\|9294221 | FRPEVSRLPY | IFQTLGLEYD | EKVLPSI GNE | VLKAVVANFN | ADQLLTERPQ | 150 |
| CeresClone:523811 | SRPDTEKLPT | IVQNLGLEYD | EKVLPSI GNE | VLKAVVAQFN | ADQLLTDRSQ | 150 |
| gi\|58979188 | SRPEVARLPD | IFKTLGLEYD | EKVLPSI GNE | VLKAVVAQFN | ADQLLTERPQ | 150 |
| gi\|1946329 | SRPEVARLPA | IFKTLGLEYD | EKVLPSI GNE | VLKAVVAQFN | ADQLLTERPQ | 140 |
| CeresClone:238897 | SRPDVEHLPD | IFTSLGLEYD | EKVLPSI GNE | VLKAVVAQFN | ADQLLTERPH | 140 |
| CeresClone:296971 | SRPDVQHLPT | IFTSLGLEYD | DKVLPSI GNE | VLKAVVAQFN | ADQLLTDRPH | 150 |
| Consensus | SRPEVSRLPY | IFQTLGLEYD | EKVLPSI GNE | VLKAVVAQFN | ADQLLTERPQ | 150 |

```
Lead-CeresClone37298   VSALVRESLI TRAKDFNI VL DDVAI THLSY GVEFSRAVEQ KQVAQQEAER 200
CeresClone:33731       VSALVREALI KRAREFNI EL DDI AI THLSY GAEFSRAVEA KQVAQQEAER 200
gi|21592895            VSALVREALI KRAREFNI EL DDI AI THLSY GAEFSRAVEA KQVAQQEAER 200
gi|27765032            VSALVRDALI KRAREFNI EL DDI AI THLSY GAEFSRAVEA KQVAQQEAER 200
gi|9294221             VSALVRDALI KRAREFNI EL DDI AI THLSY GAEFSRAVEA KQVAQQEAER 200
CeresClone:523811      VSALVRESLI RRARDFNI VL DDVAI THLSY GGEFSRAVEQ KQVAQQEAER 200
gi|58979188            VSALVRESLI RRAKDFNI VL DDVAI THLSY GAEFSKAVEQ KQVAQQEAER 200
gi|1946329             VSALVRESLI RRAKDFNI VL DDVAI THLSY GAEFSKAVEQ KQVAQQEAER 200
CeresClone:238897      VSALVRESLI KRAREFNI VL DDVAI THLAY GQEFAQAVEK KQVAQQEAER 190
CeresClone:296971      VSALVRDALI RRAREFNI I L DDVAI THLSY GI EFSLAVEK KQVAQQEAER 200

Consensus              VSALVRE-LI KRAREFNI VL DDVAI THLSY GAEFSRAVEQ KQVAQQEAER 200

Lead-CeresClone37298   SKFVVMKADQ ERRAAVI RAE GESEAAQLI S DATAKAGMGL I ELRRI EASR 250
CeresClone:33731       SKFVVMKADQ ERRAAVI RAE GESEAAQLI S DATAKAGMGL I ELRRI EASR 250
gi|21592895            SKFVVMKADQ ERRAAVI RAE GESEAAQLI S DATAKAGMGL I ELRRI EASR 250
gi|27765032            SKFVVMKADQ ERRAAVI RAE GESEAAQLI S DATAKAGMGL I ELRRI EASR 250
gi|9294221             SKFVVMKADQ ERRAAVI RAE GESEAAQLI S DATAKAGMGL I ELRRI EASR 250
CeresClone:523811      SKFVVMKAEQ ERRAAI I RAE GESDAAKLI S DATASAGMGL I ELRRI EASR 250
gi|58979188            SKFVVMKAEQ ERRAAI I RAE GESESAKLI S DATAAAGMGL I ELRRI EASR 250
gi|1946329             SKFVVMKAEQ ERRAAI I RAE GESESAKLI S DATAAAGMGL I ELRRI EASR 250
CeresClone:238897      SRFLVARAEQ ERRAAI VRAE GESESARLI S EATTTAGNGL I ELRRI EAAK 240
CeresClone:296971      SKFLVAKAEQ ERRAAI VRAE GESESARLI S EATAMAGTGL I ELRRI EAAK 250

Consensus              SKFVVMKA-Q ERRAA-I RAE GESEAAQLI S DATAKAGMGL I ELRRI EASR 250

Lead-CeresClone37298   EI ASTLARSP NVAYLPGGQS --MLFALN-- ---R 277
CeresClone:33731       EVAATLARSP NVAYLPGGQS --MLFNLNPG ---R 279
gi|21592895            EVAATLARSP NVAYLPGGQS --MLFNLNPG ---R 279
gi|27765032            EVAATLARSP NVAYLPGGQS --MLFNLNPG ---R 279
gi|9294221             EVAATLARSP NVAYLPGGQS --MLFNLNPG ---R 279
CeresClone:523811      EVAATLAKSP NVSYLPGGQN --LLMALGPS ---R 279
gi|58979188            EVAATLAKTP NVAYLPKQGN --MLLGLNAS ---R 279
gi|1946329             EVAATMAKTP NVAYLPKQGN --MLLGLNAS ---R 279
CeresClone:238897      EI ASVLSRTP NVSYI PAGDN GQMLLGLNAA ---R 271
CeresClone:296971      EI AAELARSP NVAYI PSGEN GKMLLGLNAT GFVR 284

Consensus              EVAATLARSP NVAYLPGGQ- --ML--LNPS ---R 284
```

```
gi|50947067              MAS--SSLLV RLASDEMPQT LDASS----- -SSSCYDAFV PVFHPD----  38
CeresClone:299434        MADFGDELFL DVGDDGFGDL ---------- ----SYVSFS ESIELDLAC-  35
Lead-CeresClone116843    MASTKPDSAL NLEEEAEGDG VAVDDPIFIP ETTNLLVRYS PFDDRDIDCN  50
gi|4651204               ---------- ---------- ---------- ---------- ----------   0

Consensus                MAS----L-- -L--D--GD- ---------- -----YV-FS P----D--C-  50

gi|50947067              -------PSS GFSAASVVAA ADRLRSQFLS V------EPD LFH----DAL  71
CeresClone:299434        -------PRD VFSAGFDPET LTHLPGSPIS F----DSDPD LRHLSPSLTC  74
Lead-CeresClone116843    PYFPFTGPIS DSGSGSYSDS EPDPNSCPID FFDRDSSDVD VAEYLESGGL 100
gi|4651204               ---------- ---------- ---------- ---------- ----------   0

Consensus                -------P-S -FSAGS---- -----S-PIS F-----SDPD L-H---S--L 100

gi|50947067              VAPSPDHLGF PDEEEEEEIR WDCL------ ---------- ----QLDDDD 101
CeresClone:299434        SPPFWDCLDD AASFEWEEIA DAALGVGGGA GGAGGGGQ-- ----GLEGDA 118
Lead-CeresClone116843    TAGDYNIWGF YDPKEDEEEE EIVLGTSGSD LQPGDSGEQG LRVTGIDSDS 150
gi|4651204               ---------- ---------- ---------- ---------- ----------   0

Consensus                -AP--D-LGF -D--E-EEI- ---LG--G-- --G--G---- ----GLD-D- 150

gi|50947067              EEEEGVADL- ---------- ---RLEASNA A--------- ---------- 118
CeresClone:299434        DADADVFGFL DERE------ ---MLGVMEG I--------- ---------- 140
Lead-CeresClone116843    DCEDGVFDFI SEDSSGNRCN DSCRVEVGTG LPPVWDHLFG EGTVLADEEW 200
gi|4651204               ---------- ---------- -----ERGVG L--------- ----------   6

Consensus                D-E-GVFDF- -E-------- ---RLEVG-G L--------- ---------- 200

gi|50947067              ---------- ------EEFD WEEVASPSGG AGMDQPEPEW EVLADVPPPP 152
CeresClone:299434        ---------- ------DSGD DDSIFSDEPP FDFGDGDTEL EGIFRSGVGW 174
Lead-CeresClone116843    EEVQNAINWT AFSGPEDEDE EDELSSLSRD DEEEDHELDW QVLLTVNNVV 250
gi|4651204               ---------- -------EHE DENIADLF-- ---------- ----------  16

Consensus                ---------- ------DE-- D--IASLS-- ----D-E-EW EVL--V---- 250
```

```
gi|50947067                 P-PPADEGF- ---------- -VYISDRDVY ---------- EVLVGEGLF-   178
CeresClone:299434           ELLPVP---- ---------- ----LDEDEF ---------- EVLPGHVVE-   195
Lead-CeresClone116843       NYIEQAEGIM LNPDDIDPDY YLYLSGLDEF DENQSGHYDA DAILGQMFDD   300
gi|4651204                  -YLAVQDGI- ---------- -LF-SGTTDY ---------- DILFGQLLEN   41

Consensus                   -YLPV-EGI- ---------- --Y-S--DE- ---------- -VL-GQ-LE-   300

gi|50947067                 ---LKSKPPA ARSAVEALPS AVVAAGE-DG EGEECAVCRD GVAAGERVKR   224
CeresClone:299434           ---VGGAPPA ARAVVERLQV VAVRGEEVVQ E---CAVCKE GMEQGELTTG   239
Lead-CeresClone116843       ETGIRGNPPA AKSVIQDLPV VELAVEELDK GNNVCAVCKD EMLVEEKVRR   350
gi|4651204                  ESGLKGSPPF AKSFVENLPL VELTEEELKG KDIVCAVCKD EVMLEEKVRK   91

Consensus                   E-GLKG-PPA A-SVVE-LPV VE-A-EELD- E--VCAVCKD -----EKVRR   350

gi|50947067                 LPCSHGYHEE CIMPWLDVRN SCPLCRFELP TDDPQYESWK ASRAAA----   270
CeresClone:299434           LPCGHFYHGA CIGPWLAIRN TCPVCRYELP TDDPEYEKRR ARRHSAGGST   289
Lead-CeresClone116843       LPCSHFYHGE CIIPWLGIRN TCPVCRYELP TDDLEYERHK SSERGDTGLA   400
gi|4651204                  LPCSHCYHGD CILPWLSIRN TCPVCRFELP TDDADYERSK ----------   131

Consensus                   LPCSHFYHGE CI-PWL-IRN TCPVCR-ELP TDDPEYER-K ASR--A-G--   400

gi|50947067                 ---------A   271
CeresClone:299434           PQLGAPMQV    298
Lead-CeresClone116843       RNVLPGRYS    409
gi|4651204                  ----------   131

Consensus                   ----------   409
```

```
Leod-CeresClone110454   MDSNFHYSID LNEDONHHEQ PFFYPLGSSS SLHHHHHHHH HQVPSNSSSS   50
CeresClone:544756       ---------- --------MT PY--SLNPPG PSI QAGQ--- -----TQLFNI  23
gi|50906397             ---------- -------MST IYMSQLPATL PLMEGDQ--- ---DQGLYPA   27
CeresClone:788183       ---------- -------MST IYMSQLSTSF PLMEEDH--H QDHHQGHFQA   31
CeresClone:1536888      ---------- -------MSA IYMSQLSTAL PLMEGDHQDH HHHHQGHFQA   33

Consensus               ---------- -------MST IYMSQLS-S- PLME-DH--H -----QG-F-A  50

Leod-CeresClone110454   SSSISSLSSY LPFLIN--SQ EDQHVAYNNI YHADHLHL-- --SQPLKAKM   94
CeresClone:544756       SPNNQDCRTI FNIF----DP RKTRIEIGG- --------LRD NYHQODDKMM  61
gi|50906397             FHRAKDPPIL FPFMIDSAVE HQGQ-IYGDQ GLRRQQVLGE SNQDFND---   73
CeresClone:788183       FTLPKDPPIL FPFVISNSSP SDNS-SLGYG S--DQHLM-- QHHAMLDQPQ   76
CeresClone:1536888      FTLPKETPIL FPFVISNSSA SEGSLSYGSA A--DHHLLRQ RHOAMLE-PQ   80

Consensus               FT--KD-PIL FPFMI-NSS- -----SYG-- ---D--LL-- -H-Q-LD---  100

Leod-CeresClone110454   FVANGGS--- --------SS CDHMVPKKET RLKLTIRKKD HEDQPHPLHQ  133
CeresClone:544756       VLHDGSSSNS NKSSFNNNIS PEPVVVMVDP II SSACDQQ- HNL-PYEEES  109
gi|50906397             HMMMGGS--- --DVF---LI PSPFRPTIQS IGSDMIQRS- SYD-PYDIES  113
CeresClone:788183       HMIGGSS--- --SVF---ST PF---PTVES IRDDMIERSY SYD-PYDMEK  114
CeresClone:1536888      HMIGGSSTAT GNSVF---ST PF---PTVES IRDDMIEPA- SYD-PYDMGK  122

Consensus               HMI-GSS--- --SVF---ST P----PTVES I--DMIERS- SYD-PYDMEK  150

Leod-CeresClone110454   NPTKPDS--D SDKWLMSP-- -KMRLIKKTI INNKQLTDQT NNNNHKESDH  178
CeresClone:544756       KNIDDHG--S GNKWMSS--- -KMRLMKK-- MMRPSMSPTT DK--------  143
gi|50906397             NNKQHANG-S TSKWMSTPP- MKMRIIRKGA ATDPEGG--- ----------  148
CeresClone:788183       LQATSGGSLK IGKWAAPAPA AKMRITRK-- TSDP------ ----------  146
CeresClone:1536888      LQV--GGSMD ACSM--TPAA AKMRITRK-A TADPSAG--- ----------  154

Consensus               ------G--- --KWMS-P-- -KMRIIRK-- T-DP------ ----------  200
```

```
Lead-CeresClone110454  YPLNHKTNFD EDHHEDLNFK NVLTRKTTAA TTENRYNTIN ENGYSNNNGV  228
CeresClone:544756      ---------- ---------- ---AINSGLE SSSSRYSORS LCN-NNASST  169
gi|50906397            ---------- ---------- ---AVRKPRR RAQAHQDE-S QQQLQQALGV  174
CeresClone:788183      ---------- ---------- ---GVKKPRK RAQAYEDHGH MGGMNQALGV  173
CeresClone:1536888     ---------- ---------- -----KKPRR RAQAGYDD-T MSG-QPNLGV  177

Consensus              ---------- ---------- ----VKKPR- RAQA-YD--N M-G-N-ALGV  250

Lead-CeresClone110454  IRVCSDCNTT KTPLWRSGPR GPKSLCNACG IRQRKARRAA MAAAAAAGDQ  278
CeresClone:544756      TRVCSDCNTS TTPLWRSGPK GPKSLCNACG IRQRKARRAM TKATSGLITP  219
gi|50906397            VRVCSDCNTT KTPLWRSGPC GPKSLCNACG IRQRKARRAM AAAANGGAAV  224
CeresClone:788183      IRTCSDCNTT KTPLWRSGPC GPKSLCNACG IRQRKARRAM MAT--GAAPA  221
CeresClone:1536888     IRVCSDCNTT KTPLWRSGPC GPKSLCNACG IRQRKARRAM MAAASGSVSA  227

Consensus              IRVCSDCNTT KTPLWRSGPC GPKSLCNACG IRQRKARRAM MAAASGA---  300

Lead-CeresClone110454  EVAVA----- ---------- -PRVQQ---- ------LPLK KKLQNKKKEI  302
CeresClone:544756      ITCAK----- ---------- -TRVHNKEKK SRANHFAQFK NKYK------  247
gi|50906397            APAKSVAAAP VNNK------ -PAAKKEKRA ADVDRSLPFK KRCKMVDHVA  267
CeresClone:788183      TDVGAKAAAP GDAAVTVRP- -PKVKKEKRA VDVDRSLPFK KRCKVVQDHT  269
CeresClone:1536888     VPTDSGKASP SNAAVAAAAA HPKVKKEKR- VDVDRSLPFK KRCKVVQQGH  276

Consensus              -------AAP -N-------- -P-VKKEKR- -DVDRSLPFK KRCKVVQ---  350

Lead-CeresClone110454  KRRGKIQSLS SNGGQGQKVQ DQRGRGEGNG SGNGC----- ----------  337
CeresClone:544756      ------STTI TSAGSSEGVR KLEYLKDFAI SLRSN----- ----------  276
gi|50906397            AA-----VAAT KPTAAGEVVA AAPKDQDHVI VVGGE----N AAATSMPAQN  309
CeresClone:788183      ATHDAASTTV EAAAEPPVVV PTTAPA---A APGSD-LVDT IGA--NWSKS  313
CeresClone:1536888     GAAVVVAAPA AATDSATVVQ ATAEDGDDDT CPSRDLLVDD IGGLISWSRS  326

Consensus              ------S--- ----S-EVVQ ------D--- S---D----- -------S-S  400
```

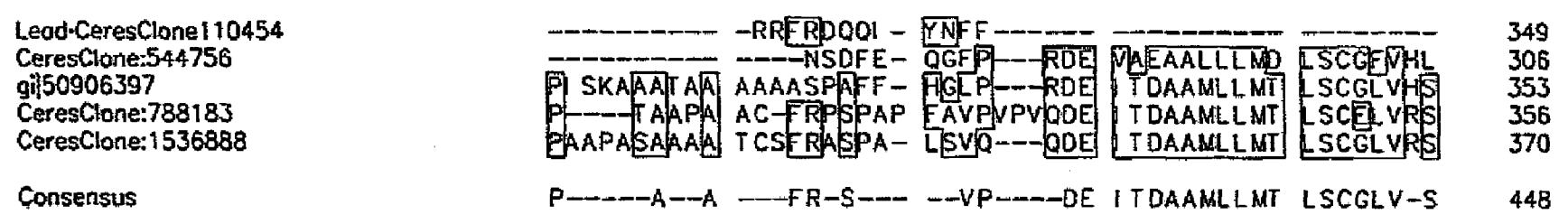

```
Lead-CeresClone110454   ---------- -RRFRDQQI- YNFF------ ---------- ----------  349
CeresClone:544756       ---------- ----NSDFE- QGFP---RDE VAEAALLLMD LSCGFVHL    306
gi|50906397             PISKAAATAA AAAASPAFF- HGLP---RDE ITDAAMLLMT LSCGLVHS    353
CeresClone:788183       P----TAAPA AC-FRPSPAP FAVPVPVQDE ITDAAMLLMT LSCELVRS    356
CeresClone:1536888      PAAPASAAAA TCSFRASPA- LSVQ---QDE ITDAAMLLMT LSCGLVRS    370

Consensus               P-----A--A ---FR-S--- --VP----DE ITDAAMLLMT LSCGLV-S    448
```

```
Lead-CeresClone107731   --MSISTKLA VESTFLALFL W--------- ---------- ----------  19
CeresClone:726433       MREILHIQGG QCGNQIGAKF WEVICGEHGV DPTGQYTGSA --PEQLERMD  48
CeresClone:1412402      MREILHIQGG QCGNQIGAKF WEVICGEHCV DSTGRYSGTS SQQLELERIN  50
CeresClone:264576       MREILHIQGG QCGNQIGAKF WEVICGEHGV DSTGCYSGVS --PQQLERIN  48
CeresClone:725504       MREILHIQGG QCGNQIGAKF WEVVCDEHGI DPTGRYTGTS --DLQLERVN  48
CeresClone:705622       MREILHIQGG QCGNQIGSKF WEVVCDEHGI DPTGRYVGTS --DLQLERVN  48
CeresClone:364892       ---------- ---------- ---------- ---------- ----------   0
CeresClone:686137       MREILHIQGG QCGNQIGAKF WEVICDEHGI DGTGRYAGDS --DLQLERIN  48
CeresClone:306678       ---------- ---------- ---------- ---------- ----------   0
CeresClone:471579       MREILHIQGG QCGNQIGAKF WEVICDEHGI DHTGKYSGDS --ELQLERIN  48
CeresClone:661643       ---------- ---------- ---------- ---------- ----------   0
CeresClone:861902       MREILHIQGG QCGNQIGAKF WEVICDEHGI DQTGKYAGDS --DLQLERIN  48
CeresClone:422618       MREILHIQGG QCGNQIGAKF WEVICDEHGI DHTGKYAGDS --DLQLERIN  48

Consensus               MREILHIQGG QCGNQIGAKF WEVIC-EHGI D-TGRY-G-S ---LQLERIN  50

Lead-CeresClone107731   ---------- ------MWSL VPWILSDLVR SVRFSVLLTS SLVNLVPEIT  53
CeresClone:726433       VYFNEAGGNR YVPRAVLMDL EPGTM-DSLR SGPIGAIFRP D--NFVYGQS  95
CeresClone:1412402      VYYNEAGGGR YVPRAVLMDL EPGTM-ESIR AGPFGQIFRP D--NFVYGQS  97
CeresClone:264576       VYYNEAGGGR YVPRAVLMDL EPGTM-ESIR AGPFGQIFRP D--NFVYGQS  95
CeresClone:725504       VYYNEASCGR FVPRAVLMDL EPGTM-DSVR TGPYGQIFRP D--NFVFGQS  95
CeresClone:705622       VYYNEASCGR FVPRAVLMDL EPGTM-DSVR TGPYGQIFRP D--NFVFGQS  95
CeresClone:364892       ---------- -------MDL EPGTM-DSVR TGPYGQIFRP D--NFVFGQS  30
CeresClone:686137       VYYNEASGGR FVPRAVLMDL EPGTM-DSVR SGPFGQIFRP D--NFVFGQS  95
CeresClone:306678       ---------- ---------- ----M-DSVR SGPFGQIFRP D--NFVFGQS  23
CeresClone:471579       VYYNEASGGR YVPRAVLMDL EPGTM-DSVR SGPFGQIFRP D--NFVFGQS  95
CeresClone:661643       ---------- -------MDL EPGTM-DSVR SGPYGQIFRP D--NFVFGQS  30
CeresClone:861902       VYYNEASGGR FVPRAVLMDL EPGTM-DSLR SGPYGQIFRP D--NFVFGQS  95
CeresClone:422618       VYYNEASGGR FVPRAVLMDL EPGTM-DSVR SGPFGQIFRP D--NFVFGQS  95

Consensus               VYYNEA-GGR YVPRAVLMDL EPGTM-DSVR SGPFGQIFRP D--NFVFGQS 100
```

```
Lead-CeresClone107731  G------RKVI TPKXXELI DS VLDVVRKEAE NSDCLQGFQV CHSLGGGTGS   98
CeresClone:726433      GAGNNWAKGH YTEGAELI DS VLDVVRKEAE NSDCLQGFQV CHSLGGGTGS   145
CeresClone:1412402     GAGNNWAKGH YTEGAELI DS VLDVVRKEAE NCDCLQGFQV CHSLGGGTGS   147
CeresClone:264576      GAGNNWAKGH YTEGAELI DS VLDVVRKEAE NCDCLQGFQV CHSLGGGTGS   145
CeresClone:725504      GAGNNWAKGH YTEGAELI DS VLDVVRKEAE NCDCLQGFQV CHSLGGGTGS   145
CeresClone:705622      GAGNNWAKGH YTEGAELI DS VLDVVRKEAE NCDCLQGFQV CHSLGGGTGS   145
CeresClone:364892      GAGNNWAKGH YTEGAELI DS VLDVVRKEAE NCDCLQGFQV CHSLGGGTGS   80
CeresClone:686137      GAGNNWAKGH YTEGAELI DS VLDVVRKEAE NCDCLQGFQV CHSLGGGTGS   145
CeresClone:306678      GAGNNWAKGH YTEGAELI DS VLDVVRKEAE NCDCLQGFQV CHSLGGGTGS   73
CeresClone:471579      GAGNNWAKGH YTEGAELI DS VLDVVRKEAE NCDCLQGFQV CHSLGGGTGS   145
CeresClone:661643      GAGNNWAKGH YTEGAELI DS VLDVVRKEAE NCDCLQGFQV CHSLGGGTGS   80
CeresClone:861902      GAGNNWAKGH YTEGAELI DS VLDVVRKEAE NCDCLQGFQV CHSLGGGTGS   145
CeresClone:422618      GAGNNWAKGH YTEGAELI DS VLDVVRKEAE NCDCLQGFQV CHSLGGGTGS   145

Consensus              GAGNNWAKGH YTEGAELI DS VLDVVRKEAE NCDCLQGFQV CHSLGGGTGS   150
```

```
Lead-CeresClone107731  GMGTLLI SKI REEYPDRMMM TFSVFPSPKV SDTVVEPYNA TLSVHQLVEN   148
CeresClone:726433      GMDTLLI SKI REEYPDRMML TFSVFPSPKV SDTVVEPYNA TLSVHQLVEN   195
CeresClone:1412402     GMGTLLI SKI REEYPDRMML TFSVFPSPKV SDTVVEPYNA TLSVHQLVEN   197
CeresClone:264576      GMGTLLI SKI REEYPDRMML TFSVFPSPKV SDTVVEPYNA TLSVHQLVEN   195
CeresClone:725504      GMGTLLI SKI REEYPDRMML TFSVFPSPKV SDTVVEPYNA TLSVHQLVEN   195
CeresClone:705622      GMGTLLI SKI REEYPDRMML TFSVFPSPKV SDTVVEPYNA TLSVHQLVEN   195
CeresClone:364892      GMGTLLI SKI REEYPDRMML TFSVFPSPKV SDTVVEPYNA TLSVHQLVEN   130
CeresClone:686137      GMGTLLI SKI REEYPDRMML TFSVFPSPKV SDTVVEPYNA TLSVHQLVEN   195
CeresClone:306678      GMGTLLI SKI REEYPDRMML TFSVFPSPKV SDTVVEPYNA TLSVHQLVEN   123
CeresClone:471579      GMGTLLI SKI REEYPDRMML TFSVFPSPKV SDTVVEPYNA TLSVHQLVEN   195
CeresClone:661643      GMGTLLI SKI REEYPDRMML TFSVFPSPKV SDTVVEPYNA TLSVHQLVEN   130
CeresClone:861902      GMGTLLI SKI REEYPDRMML TFSVFPSPKV SDTVVEPYNA TLSVHQLVEN   195
CeresClone:422618      GMGTLLI SKI REEYPDRMML TFSVFPSPKV SDTVVEPYNA TLSVHQLVEN   195

Consensus              GMGTLLI SKI REEYPDRMML TFSVFPSPKV SDTVVEPYNA TLSVHQLVEN   200
```

| | | | | | | |
|---|---|---|---|---|---|---|
| Lead-CeresClone107731 | ADECMVLDNE | ALYDI CFRTL | KLANPTFGDL | NHLI SATMSG | VTCCLRFPGQ | 198 |
| CeresClone:726433 | ADECMVLDNE | ALYDI CFRTL | KLTNPSFGDL | NHLI SATMSG | VTCCLRFPGQ | 245 |
| CeresClone:1412402 | ADECMVLDNE | ALYDI CFRTL | KLTNPSFGDL | NHLI SATMSG | VTCCLRFPGQ | 247 |
| CeresClone:264576 | ADECMVLDNE | ALYDI CFRTL | KLTNPSFGDL | NHLI SATMSG | VTCCLRFPGQ | 245 |
| CeresClone:725504 | ADECMVLDNE | ALYDI CFRTL | KLTTPSFGDL | NHLI SATMSG | VTCCLRFPGQ | 245 |
| CeresClone:705622 | ADECMVLDNE | ALYDI CFRTL | KLTTPSFGDL | NHLI SATMSG | VTCCLRFPGQ | 245 |
| CeresClone:364892 | ADECMVLDNE | ALYDI CFRTL | KLTTPSFGDL | NHLI SATMSG | VTCCLRFPGQ | 180 |
| CeresClone:686137 | ADECMVLDNE | ALYDI CFRTL | KLATPSFGDL | NHLI SATMSG | VTCCLRFPGQ | 245 |
| CeresClone:306678 | ADECMVLDNE | ALYDI CFRTL | KLSTPSFGDL | NHLI SATMSG | VTCCLRFPGQ | 173 |
| CeresClone:471579 | ADECMVLDNE | ALYDI CFRTL | KLATPTFGDL | NHLI SATMSG | VTCCLRFPGQ | 245 |
| CeresClone:661643 | ADECMVLDNE | ALYDI CFRTL | KLATPTFGDL | NHLI SATMSG | VTCCLRFPGQ | 180 |
| CeresClone:861902 | ADECMVLDNE | ALYDI CFRTL | KLATPTFGDL | NHLI SATMSG | VTCCLRFPGQ | 245 |
| CeresClone:422618 | ADECMVLDNE | ALYDI CFRTL | KLSTPTFGDL | NHLI SATMSG | VTCCLRFPGQ | 245 |
| Consensus | ADECMVLDNE | ALYDI CFRTL | KL-TPSFGDL | NHLI SATMSG | VTCCLRFPGQ | 250 |

| | | | | | | |
|---|---|---|---|---|---|---|
| Lead-CeresClone107731 | LNSDLRKLAV | NLI PFPRLHF | FMVGFAPLTS | RGSQQYSALS | VPELTQQMWD | 248 |
| CeresClone:726433 | LNSDLRKLAV | NLI PFPRLHF | FMVGFAPLTS | RGSQQYRALT | VPELTQQMWD | 295 |
| CeresClone:1412402 | LNSDLRKLAV | NLI PFPRLHF | FMVGFAPLTS | RGSQQYRALT | VPELTQQMWD | 297 |
| CeresClone:264576 | LNSDLRKLAV | NLI PFPRLHF | FMVGFAPLTS | RGSQQYRALT | VPELTQQMWD | 295 |
| CeresClone:725504 | LNSDLRKLAV | NLI PFPRLHF | FMVGFAPLTS | RGSQQYRALT | VPELTQQMWD | 295 |
| CeresClone:705622 | LNSDLRKLAV | NLI PFPRLHF | FMVGFAPLTS | RGSQQYRALT | VPELTQQMWD | 295 |
| CeresClone:364892 | LNSDLRKLAV | NLI PFPRLHF | FMVGFAPLTS | RGSQQYRALT | VPELTQQMWD | 230 |
| CeresClone:686137 | LNSDLRKLAV | NLI PFPRLHF | FMVGFAPLTS | RGSQMYRALT | VPELTQQMWD | 295 |
| CeresClone:306678 | LNSDLRKLAV | NLI PFPRLHF | FMVGFAPLTS | RGSQQYRALT | VPELTQQMWD | 223 |
| CeresClone:471579 | LNSDLRKLAV | NLI PFPRLHF | FMVGFAPLTS | RGSQQYRNLT | VPELTQQMWD | 295 |
| CeresClone:661643 | LNSDLRKLAV | NLI PFPRLHF | FMVGFAPLTS | RGSQQYRALT | VPELTQQMWD | 230 |
| CeresClone:861902 | LNSDLRKLAV | NLI PFPRLHF | FMVGFAPLTS | RGSQQYRALT | VPELTQQMWD | 295 |
| CeresClone:422618 | LNSDLRKLAV | NLI PFPRLHF | FMVGFAPLTS | RGSQQYRALT | VPELTQQMWD | 295 |
| Consensus | LNSDLRKLAV | NLI PFPRLHF | FMVGFAPLTS | RGSQQYRALT | VPELTQQMWD | 300 |

```
Lead-CeresClone107731   AKNMMCAADP RHGRYLTASA VFRGKLSTKE VDEQMMNI QN KNSSYFVEWI   298
CeresClone:726433       AKNMMCAADP RHGRYLTASA MFRGKMSTKE VDEQMMNVQN KNSSYFVEWI   345
CeresClone:1412402      AKNMMCSADP RHGRYLTASA MFRGKMSTKE VDEQMI NVQN KNSSYFVEWI   347
CeresClone:264576       AKNMMCAADP RHGRYLTASA MFRGKMSTKE VDEQMI NVQN KNSSYFVEWI   345
CeresClone:725504       AKNMMCAADP RHGRYLTASA MFRGKMSTKE VDEQMI NVQN KNSSYFVEWI   345
CeresClone:705622       AKNMMCAADP RHGRYLTASA MFRGKMSTKE VDEQMI NVQN KNSSYFVEWI   345
CeresClone:364892       AKNMMCAADP RHGRYLTASA MFRGKMSTKE VDEQMI NVQN KNSSYFVEWI   280
CeresClone:686137       AKNMMCAADP RHGRYLTASA CFRGKMSTKE VDEQMLNVQN KNSSYFVEWI   345
CeresClone:306678       AKNMMCAADP RHGRYLTASA MFRGKMSTKE VDEQMLNVQN KNSSYFVEWI   273
CeresClone:471579       SKNMMCAADP RHGRYLTASA MFRGKMSTKE VDEQMI NVQN KNSSYFVEWI   345
CeresClone:661643       AKNMMCAADP RHGRYLTASA MFRGKMSTKE VDEQMI NVQN KNSSYFVEWI   280
CeresClone:861902       SKNMMCAADP RHGRYLTASA MFRGKMSTKE VDEQMLNVQN KNSSYFVEWI   345
CeresClone:422618       SKNMMCAADP RHGRYLTASA MFRGKMSTKE VDEQMLNVQN KNSSYFVEWI   345

Consensus               AKNMMCAADP RHGRYLTASA MFRGKMSTKE VDEQMI NVQN KNSSYFVEWI   350

Lead-CeresClone107731   PNNVKSSVCD IAPKGLKMAS TFI GNSTSI Q EMF------- ----------   331
CeresClone:726433       PNNVKSSVCD I PPVGLAMSS TFVGNSTSI Q EMFRRVSEQF TAMFRRKAFL   395
CeresClone:1412402      PNNVKSSVCD I PPVGLPMAS TFVGNSTSI Q EMFRRVSEQF TAMFRRKAFL   397
CeresClone:264576       PNNVKSSVCD I PPVGLSMSS TFVGNSTSI Q EMFRRVSEQF TAMFRRKAFL   395
CeresClone:725504       PNNVKSSVCD I PPTGLSMAS TFVGNSTSI Q EMFRRVSEQF TSMFRRKAFL   395
CeresClone:705622       PNNVKSSVCD I PPRGLSMAS TFI GNSTSI Q EMFRRVSEQF TAMFRRKAFL   395
CeresClone:364892       PNNVKSSVCD I PPRGLSMAS TFI GNSTSI Q EMFRRVSEQF TAMFRRKAFL   330
CeresClone:686137       PNNVKSSVCD MPPRGLKMAG TFVGNSTSI Q EMFRRVSEQF TAMFRRKAFL   395
CeresClone:306678       PNNVKSSVCD I PPRGLKMAG TFVGNSTSI Q EMFRRVSEQF TAMFRRKAFL   323
CeresClone:471579       PNNVKSSVCD I PPKGLKMSS TFI GNSTSI Q EMFRRVSEQF TAMFRRKAFL   395
CeresClone:661643       PNNVKSSVCD I PPKGLKMAS TFI GNSTSI Q EMFRRVSEQF TAMFRRKAFL   330
CeresClone:861902       PNNVKSSVCD I PPTGLSMSS TFVGNSTSI Q EMFRRVSEQF TAMFRRKAFL   395
CeresClone:422618       PNNVKSSVCD I PPIGLKMSS TFVGNSTSI Q EMFRRVSEQF TAMFRRKAFL   395

Consensus               PNNVKSSVCD I PPKGL-MAS TFVGNSTSI Q EMFRRVSEQF TAMFRRKAFL   400
```

```
Lead-CeresClone107731   ----------  ----------  ----------  ----------  ----------   331
CeresClone:726433       HWYTSEGMDE  MEFTEAESNM  NDLVAEYQQY  QDATAEE--D  YEEEEEPAAD   443
CeresClone:1412402      HWYTSEGMDE  MEFTEAESNM  NDLVAEYQQY  QDATAE---E  YEEEEHDGEE   444
CeresClone:264576       HWYTSEGMDE  MEFTEAESNM  NDLVAEYQQY  QDATAE---E  YDEEEQDGEE   442
CeresClone:725504       HWYTGEGMDE  MEFTEAESNM  NDLVSEYQQY  QDATSDEEGE  YEDEDQEPEE   445
CeresClone:705622       HWYTGEGMDE  MEFTEAESNM  NDLVSEYQQY  QDATADEEAE  YEDEEAIQDE   445
CeresClone:364892       HWYTGEGMDE  MEFTEAESNM  NDLVSEYQQY  QDATADEE-E  YEDEEEVHDE   379
CeresClone:686137       HWYTGEGMDE  MEFTEAESNM  NDLVAEYQQY  QDATAEE--E  YDEEEEEERD   443
CeresClone:306678       HWYTGEGMDE  MEFTEAESNM  NDLVAEYQQY  QDATADE--E  YEDEEEEENV   371
CeresClone:471579       HWYTGEGMDE  MEFTEAESNM  NDLVAEYQQY  QDATADEE-E  YEDEEEEA--   442
CeresClone:661643       HWYTGEGMDE  MEFTEAESNM  NDLVAEYQQY  QDATADEE-E  YEEEEEEEEE   379
CeresClone:861902       HWYTGEGMDE  MEFTEAESNM  NDLVAEYQQY  QDATADEEEE  YDEEEEEEAA   445
CeresClone:422618       HWYTGEGMDE  MEFTEAESNM  NDLVAEYQQY  QDATAEDE-E  YEEEEEEEEE   444

Consensus               HWYTGEGMDE  MEFTEAESNM  NDLVAEYQQY  QDATADEE-E  YEEEEEE--E   450

Lead-CeresClone107731   ---   331
CeresClone:726433       QP-   445
CeresClone:1412402      EHA   447
CeresClone:264576       EHA   445
CeresClone:725504       DM-   447
CeresClone:705622       ---   445
CeresClone:364892       ---   379
CeresClone:686137       A--   444
CeresClone:306678       AE-   373
CeresClone:471579       ---   442
CeresClone:661643       GA-   381
CeresClone:861902       ---   445
CeresClone:422618       T--   445

Consensus               ---   453
```

```
Lead-CeresClone100465   ----------  --MHRRAAIQ  ESDDEEDETY  NDVV-PESPS  SCEDSKISKP   37
gi|49333371             MDGGGSSSNS  FRKVRNPFVT  DQELEESDNV  SSVTGAESPP  PS--------   42
gi|49333385             MDSGGSSSSS  FRKVRNPFVT  DQELEESDNV  SSVTGAESPP  PS--------   42

Consensus               MD-GGSSS-S  FRKVRNPFVT  DQELEESDNV  SSVTGAESPP  PS--------   50

Lead-CeresClone100465   TPKKSRRNVE  KRVVSVPIAD  VEGSKSRGEV  YPPSDSWAWR  KYGQKPIKGS   87
gi|49333371             TTKKGKRSMQ  KRVVSVPIKD  VEGSRLKGEG  APPSDSWAWR  KYGQKPIKGS   92
gi|49333385             TTKKGKRSMQ  KRVVSVPIKD  VEGSRLKGEG  APPSDSWAWR  KYGQKPIKGS   92

Consensus               TTKKGKRSMQ  KRVVSVPIKD  VEGSRLKGEG  APPSDSWAWR  KYGQKPIKGS   100

Lead-CeresClone100465   PYPRGYYRCS  SSKGCPARKQ  VERSRVDPSK  LMITYACDHN  HPFPSSSANT   137
gi|49333371             PYPRGYYRCS  SSKGCPARKQ  VERSRVNPTM  LVITYSCEHN  HAWPASRHNN   142
gi|49333385             PYPRGYYRCS  SSKGCPARKQ  VERSRVNPTM  LVITYSCEHN  HAWPASRHNN   142

Consensus               PYPRGYYRCS  SSKGCPARKQ  VERSRVNPTM  LVITYSCEHN  HAWPASRHNN   150

Lead-CeresClone100465   KSHHRSSVVL  KTAKKFEEYE  E----FEFEL  TVTAAEEPPA  GLD---LSHV   180
gi|49333371             TSAKQAAAA-  AGEASESPTK  STTAVKHDPS  TSQPDTEPDS  GMEDGFACLT   191
gi|49333385             TSAKQAAAAA  AGEASESPTK  SSTAVKHEPS  TSQPDTEPDS  GMEDGFACLT   192

Consensus               TSAKQAAAA-  AGEASESPTK  S-TAVKHEPS  TSQPDTEPDS  GMEDGFACLT   200

Lead-CeresClone100465   DSPLLLGGCY  SEIGEFGWFY  DASISSSSGS  SNFLDVTL--  ERGFSVG---   225
gi|49333371             EDSILTTG--  ---DEFAWFG  EMETTSST--  --VLESSLFS  ERDNSEADDT   232
gi|49333385             EDSILTTG--  ---DEFAWFG  EMETTSST--  --VLESPLFS  ERDNSEADDT   233

Consensus               EDSILTTG--  ---DEFAWFG  EMETTSST--  --VLES-LFS  ERDNSEADDT   250

Lead-CeresClone100465   ------QEED  ESLFGDLGDL  PDCASVFRRG  TVATEEQHRR  CDFGAIPFCD   269
gi|49333371             AVISPMREED  ESLFADLGEL  PECSFVFR--  -------HQR  NVGPQVGIC-   272
gi|49333385             AMIFPMREED  ESLFADLFEL  PECSFVFR--  -------HQR  NVGPQVGIC-   273

Consensus               A-I-PMREED  ESLFADLGEL  PECSFVFR--  -------HQR  NVGPQVGIC-   300
```

| | | |
|---|---|---|
| Leod-CeresClone100465 | SSR | 272 |
| gi\|49333371 | --- | 272 |
| gi\|49333385 | --- | 273 |
| Consensus | --- | 303 |

```
Lead-CeresClone99657   MANAASGMAV HDDCKLKFME LKAKRTFRTI VYKI ED--KQ VI VEKLGEPE   48
CeresClone:1053159     -------MAV HDDCKLRFLE LKAKRTHRFI VYKI EEKQKQ VI VEKVGEPI   43
CeresClone:976676      -------MAV HDDCKLKFLE LKAKRTFRTI VYKI ED--KQ VI VEKLGEPE   41
CeresClone:1076675     -------MAV HDDCKLKFLE LKAKRTYRFI VYKI EEQQKQ VVVEKLGEPG   43
CeresClone:1061399     -------MAV HDDCKLKFLE LKAKRTYRFI VYKI EEQQKQ VVVEKLGEPG   43

Consensus              -------MAV HDDCKLKFLE LKAKRT-RFI VYKI EEQQKQ VI VEKLGEP-   50

Lead-CeresClone99657   QSYDDFAASL PADDCRYCI Y DFDFVTAENC QKSKI F---- ----------   84
CeresClone:1053159     QTYEDFAASL PAEECRYAI Y DFDFVTAENC QKSKI FFI AW CPDVAKVRSK   93
CeresClone:976676      QSYDDFAASL PDNECRYAI Y DFDFVTEENC QKSKI FFI AW SPDTAKVRDK   91
CeresClone:1076675     QSHDDFAASL PADECRYAI F DFDFVTAENC QKSKI FFI AW SPDTARVRSK   93
CeresClone:1061399     QSHDDFAASL PADECRYAI F DFDFVTAENC QKSKI FFVAW SPDTARVRSK   93

Consensus              QSYDDFAASL PADECRYAI Y DFDFVTAENC QKSKI FFI AW SPDTA-VRSK   100

Lead-CeresClone99657   ---------- ---LHGLRTL PK-------- ----------   93
CeresClone:1053159     MI YASSKDRF KRELDGI QVE LQATDPTEMD LDVFKSRVN   132
CeresClone:976676      MI YASSKDRF KRELDGI QVE L--------- ----------   112
CeresClone:1076675     MI YASSKDRF KRELDGI QVE LQATDP---- ----------   119
CeresClone:1061399     MI YASSKDRF KRELDGI QVE LQATDPTEMD LDVFKSRAN   132

Consensus              MI YASSKDRF KRELDGI QVE LQATDP---- ----------   139
```

| | | | | | | |
|---|---|---|---|---|---|---|
| CeresClone:963616 | MS--EVEYRC | FVGGXAWATG | DAELERTFSQ | FGEVI DSKII | NDRETGRSRG | 48 |
| CeresClone:972545 | MS--EVEYRC | FVXGLAWATG | DAELERTFXQ | FGEVI DSKII | NDRETGRSRG | 48 |
| Lead-CeresClone98855 | MASGDVEYRC | FVGGLAWATD | DRALETAFAQ | YGDVI DSKII | NDRETGRSRG | 50 |
| CeresClone:965777 | MASPDVEYRC | FVGGLAWATD | ERSLETAFSK | FGELVDSKII | NDRETGRSRG | 50 |
| CeresClone:945779 | MAAPDVEYRC | FVGGLAWATD | ERSLETAFSK | FGELVDSKII | NDRETGRSRG | 50 |
| CeresClone:1092319 | MAAPDVEYRC | FVGGLAWATD | ERSLETAFSK | FGELVDSKII | NDRETGRSRG | 50 |
| CeresClone:977670 | MASPDVEYRC | FVGGLAWATD | DRALETAFSQ | YGDVLDSKII | NDRETGRSRG | 50 |
| CeresClone:1091493 | MASPDVEYRC | FVGGLAWATD | DRALETAFSQ | FGDVLDSKII | NDRETGRSRG | 50 |
| Consensus | MASPDVEYRC | FVGGLAWATD | DR-LETAFSQ | FGEV-DSKII | NDRETGRSRG | 50 |
| CeresClone:963616 | FGFVTFKDEK | SMKDAI DEMN | GKELDGRTIT | VNEAQSRGGG | GGGGR---GG | 95 |
| CeresClone:972545 | FGFVTFKDEK | SMKDAI DEMN | GKELDGRTIX | VXEAQSRGGG | GGGGR---GG | 95 |
| Lead-CeresClone98855 | FGFVTFKDEK | AMKDAI EGMN | GQDLDGRSIT | VNEAQSRGSG | GGGGHRGGGG | 100 |
| CeresClone:965777 | FGFVTFKDEQ | SMKDAI EGMN | GQDLDGRSIT | VNEAQSRGSG | GGGGGRG-GG | 99 |
| CeresClone:945779 | FGFVTFKDEQ | SMKDAI EGMN | GQDLDGRSIT | VNEAQSRGSG | GGGRG---GG | 97 |
| CeresClone:1092319 | FGFVTFKDEQ | SMKDAI EGMN | GQDLDGRSIT | VNEAQSRGSG | GGGGGRG-GG | 99 |
| CeresClone:977670 | FGFVTFKDEK | SMKDAI EGMN | GQDLDGRSIT | VNEAQSRGGG | GGGGR-GGGG | 99 |
| CeresClone:1091493 | FGFVTFKDEK | SMKDAI EGMN | GQDLDGRSIT | VNEAQSRGSG | GGGGGRGGGG | 100 |
| Consensus | FGFVTFKDEK | SMKDAI EGMN | GQDLDGRSIT | VNEAQSRGSG | GGGGGRG-GG | 100 |
| CeresClone:963616 | GGYGDRRGGG | GYGSGGGGYG | GGGGRRDGGG | YGGGDGSY-- | ---------- | 133 |
| CeresClone:972545 | GGYGDRRGGG | GYXSGGGGR- | -GG-----GG | YXSGG----- | ---------- | 123 |
| Lead-CeresClone98855 | GGYSSRGGGG | GSY--GGGRR | EGG-----GG | YGGGEGGYG | GNGGGGGW-- | 141 |
| CeresClone:965777 | GGY--RGGGG | GYG-GGGGY- | -GGGRRE-GG | YSGGGGGYS | SRGGGGGYG | 143 |
| CeresClone:945779 | GGYR-GGGGG | GYGGGGGGY- | -GGGRRE-GG | YSGGGGGYSS | RGGGGGGYGG | 143 |
| CeresClone:1092319 | GGYRGGGGGG | GYGGGGGGY- | -GGGRRE-GG | YSGGGGGYSS | RGGGGGGYGG | 146 |
| CeresClone:977670 | GGYR-SGGGG | GYGGGGGGYG | GGGGRRE-GG | YSGGGGG--- | ---------- | 134 |
| CeresClone:1091493 | GGYR-SGGGG | GYGGGGGGYG | GGGGRRE-GG | YSGGGGG--- | ---------- | 136 |
| Consensus | GGYR-RGGGG | GYGGGGGGY- | -GGGRRE-GG | YSGGGGG--- | --GGGGG--- | 150 |

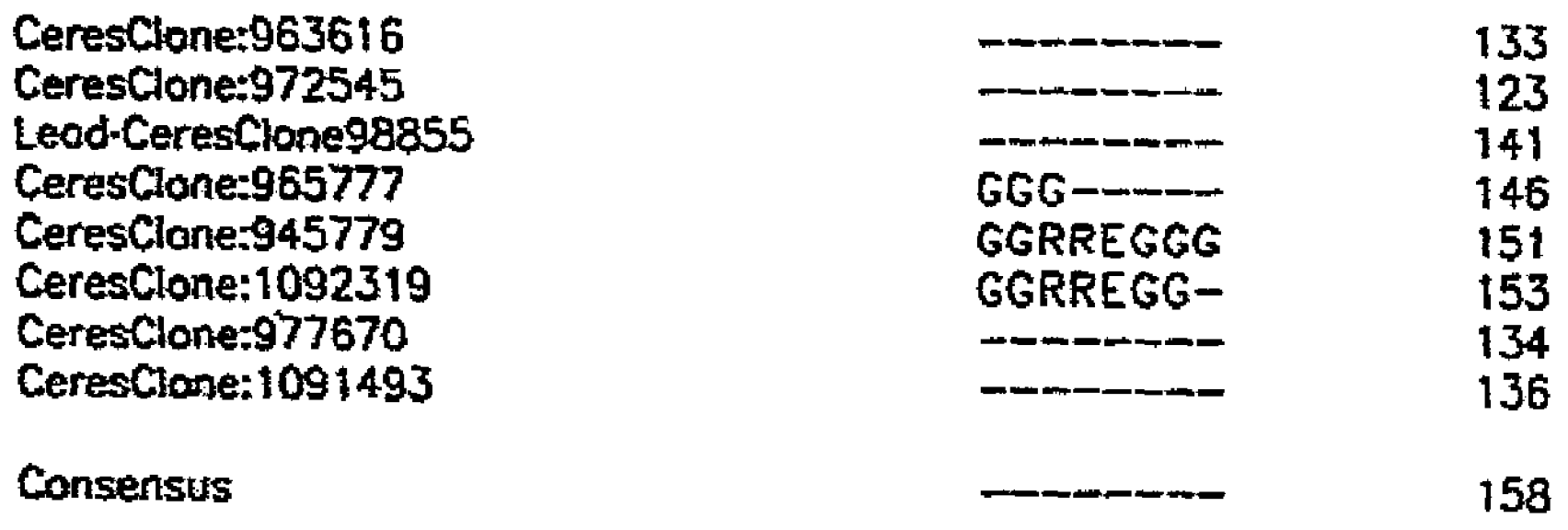

| | | |
|---|---|---|
| CeresClone:963616 | -------- | 133 |
| CeresClone:972545 | -------- | 123 |
| Lead-CeresClone98855 | -------- | 141 |
| CeresClone:965777 | GGG----- | 146 |
| CeresClone:945779 | GGRREGGG | 151 |
| CeresClone:1092319 | GGRREGG- | 153 |
| CeresClone:977670 | -------- | 134 |
| CeresClone:1091493 | -------- | 136 |
| Consensus | -------- | 158 |

| | | | | | | |
|---|---|---|---|---|---|---|
| CeresClone:632026 | QNKRVLVHQP | QQTRWRQRQL | MGSMAAEMTA | VEEEACI--Y | AMQLSSTAVL | 48 |
| gi\|15218138 | ---------- | --MGYLLEET | LSSNSKTPIV | IDDDNELGLM | AVRLANAAAF | 38 |
| gi\|28973283 | ---------- | --MGYLFEET | LSSNPKTPIV | VDDDNELGLM | AVRLANAAAF | 38 |
| CeresClone:12023 | ---------- | --MGYLFEET | LSSNPKTPIV | VDDDNELGLM | AVRLANAAAF | 38 |
| gi\|12744973 | ---------- | --MGYLFEET | LSSNPKTPIV | VDDDNELGLM | AVRLANAAAF | 38 |
| gi\|62320460 | ---------- | --MGYLFEET | LSSNPKTPIV | VDDDNELGLM | AVRLANAAAF | 38 |
| CeresClone:1347792 | ---------- | ---------- | ---------- | ---------M | AVRLANAAAF | 11 |
| gi\|23506107 | ---------- | --MGYLFQET | LSSNPKTPIV | VDDDNELGLM | AVRLANAAAF | 38 |
| Lead-CeresClone97958 | ---------- | ---------- | ---------- | ---------- | ---------- | 0 |
| CeresClone:101583 | ---------- | ---------- | ---------- | ---------- | ---------- | 0 |
| CeresClone:561287 | ---------- | ---------- | ---MHLKQVE | EEQDGIL--F | AMNMMSTMVY | 25 |
| gi\|57157826 | ---------- | -----MDSTP | VIQIPTPYPF | SDEEACL--Y | AMQLRSFSVL | 33 |
| gi\|47232556 | ---------- | --MRSTSPQT | IDSTPMSHPQ | QEEEEELGKQ | AIRLANVVIL | 38 |
| gi\|4808524 | ---------- | -------MGS | TQKNHNLTPE | EEEEACL--H | AMQLASASVL | 31 |
| CeresClone:974547 | ---------- | ---------- | ---------- | ---------- | ---------- | 0 |
| gi\|5031494 | ---------- | -------MSS | TANNPQINS- | DEEENFL--F | AMQLASASVL | 30 |
| gi\|5031492 | ---------- | -------MGS | ATNTPQINS- | DEEENFL--F | AMQLASASVL | 30 |
| Consensus | ---------- | ---------T | L-S-P----- | -D-D--L--- | AMRLANAA-- | 50 |

| | | | | | | |
|---|---|---|---|---|---|---|
| CeresClone:632026 | PLTLKNAIEL | GMLEVLMGAG | ---GKMLSPS | EVAARLPPTT | TNPDAPAMVD | 95 |
| gi\|15218138 | PMVLKAALEL | GVFDTLYAEA | SRSDSFLSPS | EIASKLPTTP | RNPEAPVLLD | 88 |
| gi\|28973283 | PMVLKASLEL | GVFDTLYAEA | SRTDSFLSPS | EIASKLPTTP | RNPGAPVLLD | 88 |
| CeresClone:12023 | PMVLKASLEL | GVFDTLYAEA | SRTDSFLSPS | EIASKLPTTP | RNPGAPVLLD | 88 |
| gi\|12744973 | PMVLKASLEL | GVFDTLYAEA | SRTDSFLSPS | EIASKLPTTP | RNPGAPVLLD | 88 |
| gi\|62320460 | PMVLKASLEL | GVFDTLYAEA | SRTDSFLSPS | EIASKLPTTP | RNPGAPVLLD | 88 |
| CeresClone:1347792 | PMVLKAALEL | GVFDTLYAAA | SRTDSFLSPY | EIASKLPTTP | RNPEAPVLLD | 61 |
| gi\|23506107 | PMVLKAALEL | GVFDTLYAAA | SRTDSFLSPY | EIASKLPTTP | RNPEAPVLLD | 88 |
| Lead-CeresClone97958 | ---------- | ---------- | ---------- | ---------- | ---------- | 0 |
| CeresClone:101583 | ---------- | ---------- | ---------- | ---------- | ---------- | 0 |
| CeresClone:561287 | PEVVRTAIEL | GIFDIIAKAG | E--GAKLSAE | EILEQLGTK- | -NPEAPTMLD | 71 |
| gi\|57157826 | PMTLKAAIEL | DLLEIIAKAG | P--GAYLSPA | EISSQLPTE- | -NPEAPAMID | 79 |
| gi\|47232556 | PMVLKSALEL | NVIDIIWGAG | D--GESLSPS | DIAAQLPTK- | -NSNAPAVLD | 84 |
| gi\|4808524 | PMVLKAAIEL | SVLEIIAKAG | Q--GAYVAPT | EIASQLSTS- | -NSQAPIILD | 77 |
| CeresClone:974547 | ---------- | ---------- | ---------- | ---------- | ---------- | 0 |
| gi\|5031494 | PMVLKSAIEL | DLLELIKKAG | A--GAFVSPA | ELAAQLLTT- | -NAEAHVMLD | 76 |
| gi\|5031492 | PMVLKSAIEL | DLLELIKKSG | A--GAFVSPV | DLAAQLPTT- | -NPDAHVMLD | 76 |
| Consensus | PMVLKAALEL | GV-D-L--A- | S---SFLSPS | EIASKLPTT- | -NPEAPVMLD | 100 |

```
CeresClone:632026       RMLHLLASLQ GGVVAKVXX- -XTH---APX XTGPTPVCKW FTPNQDG--I 138
gi|15218138             RMLRLLASYS VVKCGKVS-- -EGK---GER VYRAEPI CRF FLKDNI QDI G 132
gi|28973283             RMLRLLASYS MVKCEKVS-- -VGK---EQR VYRAEPI CRF FLKNNI QDI G 132
CeresClone:12023        RMLRLLASYS MVKCEKVS-- -VGK---GER VYRAEPI CRF FLKNNI QDI G 132
gi|12744973             RMLRLLASYS MVKCEKVS-- -VGK---GER VYRAEPI CRF FLKNNI QDI G 132
gi|62320460             RMLRLLASYS MVKCEKVS-- -VGK---GER VYRAEPI CRF FLKNNI QDI G 132
CeresClone:1347792      RMLRLLASYS MVKCGKAL-- -SGK---GER VYRAEPI CRF FLKDNI QDI G 105
gi|23506107             RMLRLLASYS MVKCGKAL-- -SGK---GER VYRAEPI CRF FLKDNI QDI G 132
Lead-CeresClone97958    ---------- ---------- ---------- ---------- ---------- 0
CeresClone:101583       ---------- ---------- ---------- ---------- ---------- 0
CeresClone:561287       RLLRLLASHS MLSSSLDTED LQHCQNSPKR LYSLTYASKY FVTDADG--V 119
gi|57157826             RMLRLLACYS VVSCRVDAAG DDGK---PRR RYCAERVVKY LTKNEDG--V 124
gi|47232556             RMLRLLASHS I LKCSARTGS -DGQ---VER LYSAGPI CKF LVKDQNGGTR 130
gi|4808524              RI LRLLASYK VLTCNLRTLE -DGG---VER LYGLAPVCKF LVKNEDG--V 121
CeresClone:974547       ---------- ---------- ---------- ---------- ---------- 0
gi|5031494              RI LRLLTSYA I LECRLKTLP -DGG---VQR LYGLAPVCKF LTKNEDG--V 120
gi|5031492              RI LRLLTSYA I LECRLKTLP -DGG---VER LYGLAPVCKF LTKNEDG--V 120

Consensus               RMLRLLASYS MVKC------ --GK----ER VY-A-PI C-F FLKN------ 150

CeresClone:632026       SMAPLLLLTN DKVPMESLYH LKDAVLDGGL PFHKAHG-MT MYEYTKTDAR 187
gi|15218138             SLASQVI VNF DSVFLNTWAQ LKDVVLEGGD AFGRAHGGMK LFDYMGTDER 182
gi|28973283             SLASQVI VNF DSVFLNTWAQ LKDVVLEGGD AFGRAHGGMK LFDYMGTDER 182
CeresClone:12023        SLASQVI VNF DTVFLNTWAQ LKDVVLEGGD AFGRAHGGMK LFDYMGTDER 182
gi|12744973             SLASQVI VNF DSVFLNTWAQ LKDVVLEGGD AFGRAHGGMK LFDYMGTDER 182
gi|62320460             SLASQVI VNF DSVFLNTWAQ LKDVVLEGGD AFGRAHGGMK LFDYMGTDER 182
CeresClone:1347792      SLASQVI VNF DSVFLNTWAQ LKDVVLEGGD AFGRAHGGMK LFDYMGTDER 155
gi|23506107             SLASQVI VNF DSVFLNTWAQ LKDVVLEGGD AFGRAHGGMK LFDYMGTDER 182
Lead-CeresClone97958    ---------- ---------- ---------- --------MK LFDYMGTDER 12
CeresClone:101583       ---------- ---------- ---------- ---------- ----MGTDER 6
CeresClone:561287       SFGATLNLLL DKVFLESWTE LKGAI LEGGV AFNRVHS-MH SFEYPAVDPR 168
gi|57157826             SMAALTLMNQ DKVFMESWYH LKDAVLEGGI PFKKAFG-MS PFEYQGTDPR 173
gi|47232556             SVGPLFLLHH DKVFMEGWFH LNDAI LEGGI PFNRAYG-MT AFEYPETDER 179
gi|4808524              SI APLVLMNQ DKVLMESWYH LKDAVLDGGI PFNKAYG-MT AFEYHGTDPR 170
CeresClone:974547       ---------- ---------- ---------- ---------- ---------- 0
gi|5031494              SMAPLALMNQ DKVLMESWYH LKDAVLDGGI PFNKAYG-MT AFEYHGTDPR 169
gi|5031492              SMAPLTLMNQ DKVLMESWYH LSDAVVDGGI PFNKAYG-MT AFEYHGTDPR 169

Consensus               SLAS-VI VN- D-VFM-TW-- LKD-VLEGG- -F-RAHG-M- LFDYMGTDER 200
```

```
CeresClone:632026      LNHVFNEAMK SYTTI VTGKL VELYI GFHDV ATLVDVGGXV GATI RAVTSK  237
gi|15218138            FSKLFNQ--T GFTI AVVKKA LEVYQGFKGV NVLVDVGGGV GNTLGVVASK  230
gi|28973283            FSKLFNQ--T GFTI AVVKKA LEVYQGFKGV NVLVDVGGGV GNTLGVVTSK  230
CeresClone:12023       FSKLFNQ--T GFTI AVVKKA LEVYEGFKGV NVLVDVGGGV GNTLGVVTSK  230
gi|12744973            FSKLFNQ--T GFTI AVVKKA LEVYQGFKGV NVLVDVGGGV GNTLGVVTSK  230
gi|62320460            FSKLFNQ--T GFTI AVVKKA LEVYQGFKGV NVLVDVGGGV GNTLGVVTSK  230
CeresClone:1347792     FSKLFNQ--T GFTI AVVKKA LEVYEGFKGV KVLVDVGGGV GNTLGVVTSK  203
gi|23506107            FSKLFNQ--T GFTI AVVKKA LEVYEGFKGV KVLVDVGGGV GNTLGVVTSK  230
Lead-CeresClone97958   FSKLFNQ--T GFTI AVVKKA LEVYQGFKDV DVLVDVGGGV GNTLGVVTSK  60
CeresClone:101583      FSKLFNQ--T GFTI AVVKKA LEVYQGFKDV NVLVDVGGGV GNTLGVVTSK  54
CeresClone:561287      FNDVFNKAMF NLTTI VMKRV LEFYEGFKNI NRLVDVGGGL GI NLNLI TSK  218
gi|57157826            FNKVFNEGMR NHSAFI MKKI LETYQGFDSV KLLVDVGGGL GGTMKAI VTK  223
gi|47232556            FNRVFNQAMS NHTTLI LKKI LDVYRGFEGI NVLVDVGGGI GVTLNLI TNK  229
gi|4808524             FNKVFNRGMA DHSTI TMKKL LELYKGFEGL KSVVDVGGGT GATI NMI VTK  220
CeresClone:974547      --------MS NHSTI TMKKI LETYNGFEGL VSLVDVGGGI GATLKMI VSK  42
gi|5031494             FNKVFNQGMS NHSTI TMKKI LETYTGFDGL KTVVDVGGGT GATLNMI ISK  219
gi|5031492             FNKVFNQGMS NHSTI TMKKI LETYTGFDGL KTVVDVGGGT GATLNMI VSK  219

Consensus              FNKLFNQ--T GFTI AVVKKA LEVYQGFKGV NVLVDVGGGV GNTLGVVTSK  250

CeresClone:632026      YPHI KGI NFD LPHVI AEAPQ SPGVEHVAGD MFKNVPSGDA I VLKWI LHNW  287
gi|15218138            YPNI KGI NFD LTCALAQAPS YPGVEHVAGD MFVDVPTGDA MI LKRI LHDW  280
gi|28973283            YPNI KGI NFD LTCALAQAPT YPGVEHVAGD MFVDVPTGNA MI LKRI LHDW  280
CeresClone:12023       YPNI KGI NFD LTCALAQAPS YPGVEHVAGD MFVDVPTGDA MI LKRI LHDW  280
gi|12744973            YPNI KGI NFD LTCALAQAPS YPGVEHVAGD MFVDVPTGDA MI LKRI LHDW  280
gi|62320460            YPNI KGI NFD LTCALAQAPS YPGVEHVAGD MFVDVPTGDA MI LKRI LHDW  280
CeresClone:1347792     YPNI KGI NFD LTCALAQAPS YPGVEHVAGD MFVDVPTGDA MI LKRI LHDW  253
gi|23506107            YPNI KGI NFD LTCALAQAPS YPGVEHVAGD MFVDVPTGDA MI LKRI LHDW  280
Lead-CeresClone97958   YPNI KGI NFD LTCALAQAPS YPGVEHVAGD MFVDI PTGDA MI LKRI LHDW  110
CeresClone:101583      YPNI KGI NFD LTCALAQAPS YPGVEHVAGD MFVDI PTGDA MI LKRI LHDW  104
CeresClone:561287      YPHVQGVNFD LPHVI EHAPT YPGI EHVGGD MFESVPNGDA I FMKWI LHDW  268
gi|57157826            YPHI EGI NFD LSHVI SEAPP I PGVKHVGGD MFESVPSGDA I FMKWI LHDW  273
gi|47232556            YPHI KGI NFD LPHVLADAPS YPGVEHVGGD MFKSVPQGDA I FMKWI LHDW  279
gi|4808524             HPTI KGI NFD LPHVI DDAPA YPGVEHI GGD MFVSVPKGDA I FMKWI LHDW  270
CeresClone:974547      YPNLKGI NFD LPHVI EDAPS HPGVEHVGGD MFVSVPKGDA I FMKWI CHDW  92
gi|5031494             YPSI KGI NFD LPHVVEDAPS YPGVEHVGGD MFVSVPKGDA I FMKWI CHDW  269
gi|5031492             YPSI KGI NFD LPHVI EDAPS YPGVEHVGGD MFVSVPKGDA I FMKWI CHDW  269

Consensus              YPNI KGI NFD LTCALAQAPS YPGVEHVAGD MFVDVPTGDA MI MKRI LHDW  300
```

| | | | | | | |
|---|---|---|---|---|---|---|
| CeresClone:632026 | TDEHCTTLLR | NCYNALPAHG | KVVVVEGLP | VEPEAT-SRG | QQASLSDMIM | 336 |
| gi\|15218138 | TDEDCVKILK | NCWKSLPESG | KVVVIELVTP | DEAENGDINA | NIAFDMDMLM | 330 |
| gi\|28973283 | TDEDCVKILK | NCWKSLPQNG | KVVVIELVTP | DEAENGDINA | NIAFDMDMLM | 330 |
| CeresClone:12023 | TDEDCVKILK | NCWKSLPKNG | KVVVIELVTP | DEAENGDINA | NIAFDMDMLM | 330 |
| gi\|12744973 | TDEDCVKILK | NCWKSLPENG | KVVVIELVTP | DEAENGDINA | NIAFDMDMLM | 330 |
| gi\|62320460 | TDEDCVKILK | NCWKSLPENG | KVVVIELVTP | DEAENGDINA | NIAFDMDMLM | 330 |
| CeresClone:1347792 | TDEDCVKILK | NCWKSLPENG | KVVVIELVIP | DEAENGDINA | NIAFDMDMLM | 303 |
| gi\|23506107 | TDEDCVKILK | NCWKSLPENG | KVVVIELVTP | DEAENGDINA | NIAFDMDMLM | 330 |
| Lead-CeresClone97958 | TDEDCVKILK | NCWKSLPENG | KVVVIELVTP | DEAENGDINA | NIAFDMDMLM | 160 |
| CeresClone:101583 | TDEDCVKILN | NCWKSLPENG | KVVVIELVTP | DEAENGDINA | NIAFDMDMLM | 154 |
| CeresClone:561287 | SDEQCLKLLK | NCHKAIPSDG | KVIVVDLILP | ILPESI-VIA | KSGFQADLLM | 317 |
| gi\|57157826 | SDAHCLKLLS | NCWKALPEDG | KVIVMEGILP | TIPEPT-SAA | QGVVHIDLVM | 322 |
| gi\|47232556 | SDEHCLTLLK | NCCKSLPSSG | KVIFVESILP | EVPDST-VTS | NIVCEQDLLM | 328 |
| gi\|4808524 | SDEHSVKFLK | NCYESIPADG | KVIIVESILP | VYPETN-LAS | NACFQLDNIM | 319 |
| CeresClone:974547 | SDEHCLKFLK | NCYEALPENG | KVILAECILP | ETLDSS-LST | KQVVNVDCIM | 141 |
| gi\|5031494 | SDAHCVKFLK | KCYEALPENG | KVILAECVLP | EAPDTG-LAT | KNVVHIDVIM | 318 |
| gi\|5031492 | SDEHCVKFLK | NCYDALPQNG | KVILAECVLP | EAPDTG-LAT | KNVVHIDVIM | 318 |
| Consensus | TDEDCVKILK | NCWKSLPENG | KVVVIELVLP | DEAENGDINA | NIAF-MDMLM | 350 |

| | | | | | | |
|---|---|---|---|---|---|---|
| CeresClone:632026 | LTHTAGGKER | NQREFEQLAK | AAGFTGVKTA | YIYSNT---- | LGH | 375 |
| gi\|15218138 | FTQCSGGKER | SRAEFEALAA | ASGFTHCKFV | CQAYHCWIIE | FCK | 373 |
| gi\|28973283 | FTQCSGGKER | SRAEFEALAA | ASGFSHCQFV | CQAYHCWIIE | FCK | 373 |
| CeresClone:12023 | FTQCSGGKER | SRAEFEALAA | ASGFTHCKFV | CQAYHCWIIE | FCK | 373 |
| gi\|12744973 | FTQCSGGKER | SRAEFEALAA | ASCFTHCKFV | CQAYHCWIIE | FCK | 373 |
| gi\|62320460 | FTQCSGGKER | SRAEFEALAA | ASCFTHCKFV | CQAYHCWIIE | FCK | 373 |
| CeresClone:1347792 | FTQCSGGKER | SRAEFEALAA | ASGFTHCKFV | CQAYHCWIIE | FCK | 346 |
| gi\|23506107 | FTQCSGGKER | SRAEFEALAA | ASGFTHCKFV | CQAYHCWIIE | FCK | 373 |
| Lead-CeresClone97958 | FTQCSGGKER | SRAEFEALAA | ASGFTHCKFV | CQAYHCWIIE | FCK | 203 |
| CeresClone:101583 | FTQCSGGKER | SRAEFEALAA | ASGFTHCKFV | CQAYHCWIIE | FCK | 197 |
| CeresClone:561287 | MTQNSGGKER | TQHEFMELAL | SSGFSGIKIV | CSVSGFWVME | FYK | 360 |
| gi\|57157826 | MAHNPGGKER | TKAEFESLAR | DAGFSGSKAL | CSYANCWILE | FYK | 365 |
| gi\|47232556 | FTQNPGGKER | TKKEYEALAL | KSGFSRLEVV | CSAYNSWVME | FHK | 371 |
| gi\|4808524 | LAHNPGGKER | TEKDFEALSA | KAGFTGFKIV | CGAFGSWVME | FCK | 362 |
| CeresClone:974547 | LALNP----- | ---------- | ---------- | ---------- | --- | 146 |
| gi\|5031494 | LAHNPGGKER | TEKEFQVLAK | ASGFKQFNKV | CCAYNSWIME | LLK | 361 |
| gi\|5031492 | LAHNPGGKER | TEKEFQGLAK | AAGFKQFNKA | CCAYNTWIME | LLK | 361 |
| Consensus | FTQCSGGKER | SRAEFEALAA | ASGFTHCKFV | CQAYHCWIIE | FCK | 393 |

```
Lead-CeresClone97480   MSGRKETVLD LAKFVDKGVQ VKLTGGRQVT GTLKGYDQLL NLVLDEAVEF   50
CeresClone:1073419     MSGRKETVLD LAKFVDKGVQ VKLTGGRQVT GTLKGYDQLL NLVLDGALES   50
CeresClone:1064362     MSGRKETVLD LAKFVDKGVQ VKLTGGRQVT GTLKGYDQLL NLVLDGALES   50
CeresClone:1067161     MSGRKETVLD LAKFVDKGVQ XKLTGGRQVT GTLKGYDQLL NLXLDAAVES   50
CeresClone:685838      MSGRKETVLD LAKFVDKGI Q VKLTGGRQVT GTLKGYDQLL NLVLDEAI EF   50
gi|50941651            MSGRKETVLD LAKFVDKGVQ VKLTGGRQVT GTLKGYDQLL NLVLDEAVEF   50
CeresClone:462970      MAGRKETALD LAKFVDKGVQ VKLTGGRQVT GTLKGYDQLL NLVLDEAVEY   50
CeresClone:393073      MAGRKETALD LAKFVDKGVQ VKLTGGRQVT GTLKGYDQLL NLVLDEAVEY   50
CeresClone:606064      MAGRKETALD LAKFVDKGVQ VKLTGGRQVT GTLKGYDQLL NLVLDEAVES   50
CeresClone:1018838     MAGRKETALD LAKFVDKGVQ VKLTGGRQVT GTLKGYDQLL NLVLDEAVES   50
CeresClone:1502051     MAGRKETALD LAKFVDKGVQ VKLTGGRQVT GTLKGYDQLL NLVLDEAVES   50
CeresClone:1031827     MAGRKETALD LAKFVDKGVQ VKLTGGRQVT GTLKGYDQLL NLVLDEAVES   50
CeresClone:1054195     MAGRKETALD LAKFVDKGVQ VKLTGGRQVT GTLKGYDQLL NLVLDEAVES   50

Consensus              MAGRKETALD LAKFVDKGVQ VKLTGGRQVT GTLKGYDQLL NLVLDEAVES   50

Lead-CeresClone97480   VRDHDDPLKT TDQTRRLGLI VCRGT----- ----GDACLT NRWHRRNR--   89
CeresClone:1073419     VRDHDDPLKT TDQTRRLGLI VCRGTAVMLV SPTDGTEEIA NPFNQPEAL-   99
CeresClone:1064362     VRDHDDPLKT TDQTRRLGLI VCRGTAVMLV SPTDGTEEIA NPFNQPEAV-   99
CeresClone:1067161     VRDHDDPLKT TDQTRRLGLI VCRGXAVMLV SPTDGT---- ----------   86
CeresClone:685838      EREQDDPLKL STKTRQLGLI VCRGTAVMLV SPTEGTEEIK NPFQEADGEQ  100
gi|50941651            EREQDDPLKL SGKTRQLGLI VCRGTAVMLV SPTDGTDEIA NPFQS-DGA-   98
CeresClone:462970      EREQDDPLKL SGKTRQLGLI VCRGTAVMLV SPTDGTDEIA NPFLA-EGA-   98
CeresClone:393073      EREQDDPLKL SGKTRQLGLI VCRGTAVMLV SPTDGTDEIA NPFLA-EGA-   98
CeresClone:606064      EREQDDPLKL STKTRQLGLI VCRGTAVMLV SPTDGTDEIA NPFLAAEGAS  100
CeresClone:1018838     EREQDDPLKL STKTRQLGLI VCRGTAVMLV SPTDGTDEIA NPFLAAEGAS  100
CeresClone:1502051     EREQDDPLKL STKTRQLGLI VCRGTAVMLV SPTDGTDEIA NPFLAAEGAS  100
CeresClone:1031827     EREQDDPLKL STKTRQLGLI VCRGTAVMLC LRLMEPTRLP TPSSQRXGAS  100
CeresClone:1054195     EREQDDPLKL STKTRQLGLX CVQ------- ---------- ----------   73

Consensus              EREQDDPLKL S-KTRQLGLI VCRGTAVMLV SPTDGTDEIA NPF---EGA-  100
```

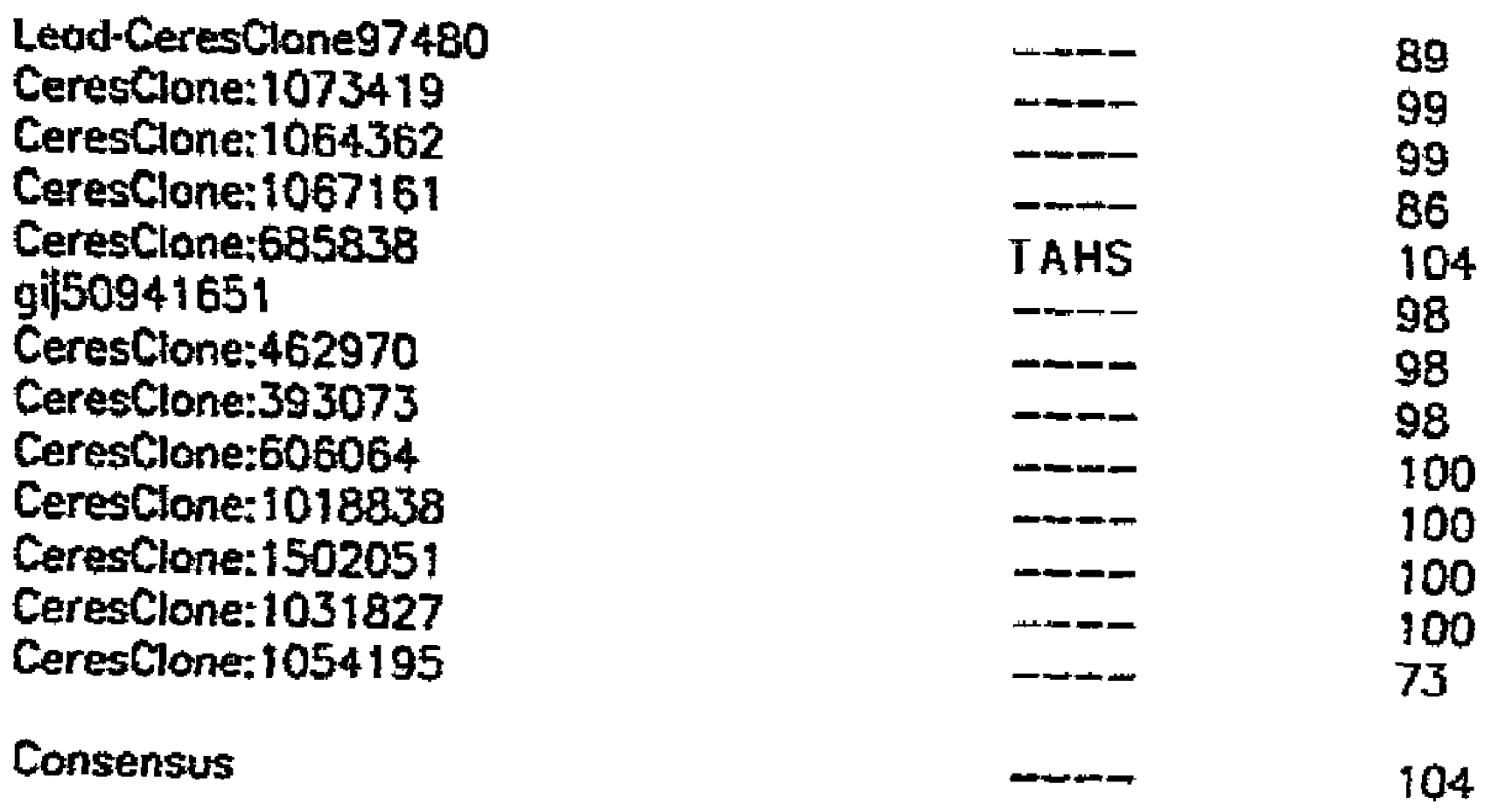

| | | |
|---|---|---|
| Lead-CeresClone97480 | ---- | 89 |
| CeresClone:1073419 | ---- | 99 |
| CeresClone:1064362 | ---- | 99 |
| CeresClone:1067161 | ---- | 86 |
| CeresClone:685838 | TAHS | 104 |
| gi\|50941651 | ---- | 98 |
| CeresClone:462970 | ---- | 98 |
| CeresClone:393073 | ---- | 98 |
| CeresClone:606064 | ---- | 100 |
| CeresClone:1018838 | ---- | 100 |
| CeresClone:1502051 | ---- | 100 |
| CeresClone:1031827 | ---- | 100 |
| CeresClone:1054195 | ---- | 73 |
| Consensus | ---- | 104 |

```
Lead-CeresClone482122   --------MN ILGQSLHQ-- SNNGSYSCSS PETANSSNLP TTPKAVHSDE  40
CeresClone:1609048      --------MN IFKSPLDHDL NCGGIFHDSA EASYSSET-- ---RSTPSDE  37
gi|55824656             ------MFTL NHSSDLYHVS PELSSSLDTS SPASEGSR-- ---GVAFSDE  39
CeresClone:481710       ------MFTL NHSSDLYHVS PELSSSLDTS SPASEGSR-- ---GVAFSDE  39
gi|33304979             ------MFTL NHSSDLYHVS PELSSSLDTS SPASEGSR-- ---GVAFSDE  39
CeresClone:1620272      ------MYTL NHSSYLYHVS PELSSSLDSS SPASEGSR-- ---GVAFSDE  39
gi|23495458             --------MD MIYSQLSDLA SMENPDTSSF SDASVTAR-- ---RASLSDE  37
gi|49658405             --------MD MFFSQLSD-- SVDQPQSSLL SDASVTTR-- ---GASCSDG  35
gi|38683266             MNSSFSAFSE MFGSEYES-- PVSSGGGDYC PT-------- ----------  30
CeresClone:1014380      ---------- MFGSDYES-- SVSS-GGDYI PT-------- ----------  19
gi|12003384             --------MD IFRSYYSD-- PLAE-YSSIS DSSSSSCN-- ---RANHSDE  34
gi|37147896             --------MN IFRSYYSD-- PLTESSSSFS DSSIYSPN-- ---RAIFSDE  35
gi|40647095             --------MN IFRSYYSD-- PLTESSSSFS DSSIYSPN-- ---RAIFSDE  35

Consensus               --------M- MF-S-L---- P--SS--DTS ---S-SS--- ----A--SDE  50

Lead-CeresClone482122   EVNTLASAHP KKRAGRRIFK ETRHPVYRGV RRRNNNKWVC EVRVPNDKST  90
CeresClone:1609048      EV-ILASARP KKRAGRRVFK ETRHPVYRGV RRRNKNKWVC EMRVPN-NNS  85
gi|55824656             EV-RLAVRHP KKRAGRKKFR ETRHPVYRGV RRRNSDKWVC EVREPN-KKT  87
CeresClone:481710       EV-RLAVRHP KKRAGRKKFR ETRHPVYRGV RRRNSDKWVC EVREPN-KKT  87
gi|33304979             EV-RLAVRHP KKRAGRKKFR ETRHPVYRGV RRRNSDKWVC EVREPN-KKT  87
CeresClone:1620272      EV-RLAVRHP KKRAGRKKFR ETRHPVYRGV RRRNTDKWVS EVREPN-KKT  87
gi|23495458             EV-ILASSCP KRRAGRRVFK ETRHPVYRGV RRRNNNKWVC ELRAPNNKKA  86
gi|49658405             DV-ILASSRP KKRAGRRVFK ETRHPVYRGV RRRNNDKWVC EMREPNKKKS  84
gi|38683266             ----LATSCP KKPAGRKKFR ETRHPVYRGV RRRNSGKWVC EVREPN-KKS  75
CeresClone:1014380      ----LASSCP KKPAGRKKFR ETRHPIYRGV RRRNSGKWVC EVREPN-KKT  64
gi|12003384             EV-MLASNNP KKRAGRKKFR ETRHPVYRGV RKRNSDKWVC ELREPN-KKS  82
gi|37147896             EV-ILASNNP KKPAGRKKFR ETRHPVYRGV RKRNSGKWVC EVREPN-KKS  83
gi|40647095             EV-ILASNNP KKPAGRKKFR ETRHPVYRGV RKRNSGKWVC EVREPN-KKS  83

Consensus               EV--LASNHP KKRAGRKKFR ETRHPVYRGV RRRNSDKWVC EVREPN-KK- 100
```

| | | | | | | |
|---|---|---|---|---|---|---|
| Lead-CeresClone482122 | RI WLGTYPTP | EMAARAHDVA | ALSLRGKSAC | LNFADSAWRL | PLPASTNAKE | 140 |
| CeresClone:1609048 | RI WLGTYPTP | EMAARAHDVA | ALALRGKSAC | LNFADSRWRL | TVPATTNAEE | 135 |
| gi\|55824656 | RI WLGTFPTP | EMAARAHDVA | AMALRGRYAC | LNFADSAWRL | PVPATAEAKD | 137 |
| CeresClone:481710 | RI WLGTFPTP | EMAARAHDVA | AMALRGRYAC | LNFADSAWRL | PVPATAEAKD | 137 |
| gi\|33304979 | RI WLGTFPTP | EMAARAHDVA | AMALRGRYAC | LNFADSAWRL | PVPATAEAKD | 137 |
| CeresClone:1620272 | RI WLGTFPTP | EMAARAHDVA | AMALRGRYAC | LNFADSTWRL | PI PATANAKD | 137 |
| gi\|23495458 | RI WLGTYPTA | EMAARAHDVA | VLAFRGKLAC | LNFADSAWRL | PVPASTDAAE | 136 |
| gi\|49658405 | RI WLGTYPTA | EMAARAHDVA | ALAFRGKLAC | I NFADSAWRL | PVPASMDTMD | 134 |
| gi\|38683266 | RI WLGTFPTA | DMAARAHDVA | AI ALRGRSAC | LNFADSAWRL | RI PESTGAKE | 125 |
| CeresClone:1014380 | RI WLGTFQTA | EMAARAHDVA | ALALRGRSAC | LNFADSAWRL | RI PESTCAKD | 114 |
| gi\|12003384 | RI WLGTFPSA | EMAARAHDVA | AI ALRGRSAC | LNFADSAWKL | PI PASTDAKD | 132 |
| gi\|37147896 | RI WLGTFPTA | EMAARAHDVA | AI ALRGRSAC | LNFADSAWRL | PVPASSDTKD | 133 |
| gi\|40647095 | RI WLGTFPTA | EMAARAHDVA | AI ALRGRSAC | LNFADSAWRL | PVPASSDTKD | 133 |
| Consensus | RI WLGTFPTA | EMAARAHDVA | ALALRGRSAC | LNFADSAWRL | PVPAS-DAKD | 150 |

| | | | | | | |
|---|---|---|---|---|---|---|
| Lead-CeresClone482122 | RRVAAAAAV | AI AAEDSRGK | QLRTNAI DAV | ADCEVSSSDI | GVDENCNNNK | 190 |
| CeresClone:1609048 | RRAAGEAAE | AFAV------ | ------ADGDD | VNI DQQQSVM | ATNDDEVQEP | 174 |
| gi\|55824656 | QKAAAEAAQ | AFRPDQTLK- | ------NANTR | QECVEAVAVA | VADTTTATAQ | 181 |
| CeresClone:481710 | QKAAAEAAQ | AFRPDQTLK- | ------NANTR | QECVEAVAVA | VAETTTATAQ | 181 |
| gi\|33304979 | QKAAAEAAQ | AFRPDQTLK- | ------NANTR | QECVEAVAVA | VAETTTATAQ | 181 |
| CeresClone:1620272 | QKAAAEAAE | AFRPSQTLE- | ------NTNTK | QECVKVVT-- | ---TTTITEQ | 176 |
| gi\|23495458 | RRAATEAAE | AFRQAEDGGV | ------DEKES | KAVVSEEKGC | VGMEGSS--- | 178 |
| gi\|49658405 | RRAAAEAAE | GFRPVEFGGV | CSGSSDEKER | MVVQVEEKNK | KGSVNLERSR | 184 |
| gi\|38683266 | QKAAAEAAL | AFQDEMMMSD | ------TTTTD | HGFDMEET-- | -FVEAI VTAE | 167 |
| CeresClone:1014380 | QKAAAEAAL | AFQDEMC--- | ------DATTD | HGFDMEETLV | EAI YTAEQSE | 156 |
| gi\|12003384 | QKAAAEAAE | AFRSS----- | ------EAENM | PEYSGEDT-- | --KEVNSTPE | 168 |
| gi\|37147896 | QKAAAEAAE | AFRP------ | --------LKL | EGI SKESS-- | ------SSTPE | 163 |
| gi\|40647095 | QKAAAEAAE | ALRP------ | --------LKL | EGI SKESS-- | ------SSTPE | 163 |
| Consensus | I QKAAAEAAE | AFRP------ | ---------- | Q----E---- | ------ST-- | 200 |

```
Lead-CeresClone482122   ASQRFCDLDE ITMPDAPVFE DMHEWLQTMA AEPLRSPTFV TYVNVRDVWN   240
CeresClone:1609048      ---------- --LQQEE-VQ DLHDLLLSIA NEPLMSPPPC AR-DGRD-WN   209
gi|55824656             --GVFY---- --MEEEEQVL DMPELLRNM- --VLMSPTHC LGYEYED-AD   219
CeresClone:481710       --GVFY---- --MEEEEQVL DMPELLRNM- --VLMSPTHC LGYEYED-AD   219
gi|33304979             --GVFY---- --MEEEEQVL DMPELLRNM- --VLMSPTHC LGYEYED-AD   219
CeresClone:1620272      KRGMFY---- --MEEEEQVL DMPELLRNM- --VLMSPTHC IGYEYED-AD   216
gi|23495458             --NLFY---- --LDEDE-IF EMPRLLDDMA DGIMLCPPQC LD-GYMD-WN   217
gi|49658405             SLSLSY---- --WDEEE-VF HMPRLLHDMA EGLLLSPSQC LG-GYMN-LD   225
gi|38683266             QSASLY---- --IDEED-MF GMPSLMASMA EGMLLPLPSV QWNHNYD---   207
CeresClone:1014380      --NAFY---- --MHDEA-MF EMPSLLANMA EGMLLPLPSV QWNHNHE---   194
gi|12003384             --NMFY---- --MDEEA-LF FMPGLLVNMA EGLMLPPPQC SQIG--D--H   205
gi|37147896             --SMFF---- --MDEEA-LF CMPGLLTNMA EGLMLPPPQC AEIG--D--H   200
gi|40647095             --SMFF---- --MDEEA-LF CMPGLLTNMA EGLMLPPPQC AEIG--D--H   200

Consensus               ---MFY---- --M-EEE-VF DMP-LL-NMA -G-LMSPP-C -------D--   250

Lead-CeresClone482122   FVE--DDAEV SLWSFTV   255
CeresClone:1609048      DVDIFDDDEI SLWNFSI   226
gi|55824656             LDA--QDAEV SLWNFSI   234
CeresClone:481710       LDA--QDAEV SLWNFSI   234
gi|33304979             LDA--QDAEV SLWNFSI   234
CeresClone:1620272      LDA--QDAEV SLWSFSI   231
gi|23495458             DVE--TVDDL KLWSFSI   232
gi|49658405             DMG--TDADV KLWSFSI   240
gi|38683266             ID---GDDDV SLWSY--   219
CeresClone:1014380      VDG--DDDDV SLWSY--   207
gi|12003384             ME---ADVDM PLWSYSI   219
gi|37147896             VET--ADADT PLWSYSI   215
gi|40647095             VET--ADADT PLWSYSI   215

Consensus               ID----DADV SLWSFSI   267
```

```
gi|49658405                 ----MDMFFS QLSDSVDQPQ SSLLSDASVT TRGASCSDGD VILASSRPKK   46
Lead-CeresClone481710       MFTLNHSSDL YHVSPELSSS LDTSSPASEG SRGVAFSDEE VRLAVRHPKK   50
CeresClone:1620272          MYTLNHSSYL YHVSPELSSS LDSSSPASEG SRGVAFSDEE VRLAVRHPKK   50
gi|45826359                 ----MNIFET YYSDSLILTE SSSSSSSSS- ------FSEEE VILASNNPKK   40
gi|12003384                 ----MDIFRS YYSDPLAEYS -SISDSSSSS CNRANHSDEE VMLASNNPKK   45
gi|45826358                 ---------M FYSDPRIESC SSFSDSI--- --RANHSDEE VILASNNPKK   36
gi|37147896                 ----MNIFRS YYSDPLTESS SSFSDSSIYS PNRAIFSDEE VILASNNPKK   46
gi|40647095                 ----MNIFRS YYSDPLTESS SSFSDSSIYS PNRAIFSDEE VILASNNPKK   46
CeresClone:1608106          ---------- ---------- ---------- --------ME LKLASQNPKK   12
CeresClone:1604576          ---------- ---------- ---------- --------ME LKLASQNPKK   12
gi|10177734                 ----MNPFYS TFPDSFLSIS -DHRSPVSDS ------SECS PKLASSCPKK   39
gi|41351817                 ----MNSFSA FAE----MFG SEYESPVTVG ------GDYC PTLATSCPKK   36
CeresClone:1014380          ---------- -------MFG SDYESSVSSG ------GDYI PTLASSCPKK   27

Consensus                   ----MN-F-S YY-D------ S--SS-AS-- ------SDEE V-LASNNPKK   50

gi|49658405                 RAGRRVFKET RHPVYRGVRR RNNDKWVCEM REPNKKKSRI WLGTYPTAEM   96
Lead-CeresClone481710       RAGRKKFRET RHPVYRGVRR RNSDKWVCEV REPN-KKTRI WLGTFPTPEM   99
CeresClone:1620272          RAGRKKFRET RHPVYRGVRR RNTDKWVSEV REPN-KKTRI WLGTFPTPEM   99
gi|45826359                 PAGRKKFRET RHPIYRGIRK RNSGKWVCEV REPN-KKTRI WLGTFPTAEM   89
gi|12003384                 RAGRKKFRET RHPVYRGVRK RNSDKWVCEL REPN-KKSRI WLGTFPSAEM   94
gi|45826358                 PAGRKKFRET RHPVYRGVRK RNSGKWVCEV REPN-KKTRI WLGTFPTAEM   85
gi|37147896                 PAGRKKFRET RHPVYRGVRK RNSGKWVCEV REPN-KKSRI WLGTFPTAEM   95
gi|40647095                 PAGRKKFRET RHPVYRGVRK RNSGKWVCEV REPN-KKSRI WLGTFPTAEM   95
CeresClone:1608106          RAARKKFKET RHPVYRGVRR RNSGKWVCEV REPN-KQSRV WLGTYPTAEM   61
CeresClone:1604576          RAGRKKFKET RHPIYRGVRR RNSEKWVCEV REPN-KQSRV WLGTYPTAEM   61
gi|10177734                 RAGRKKFRET RHPIYRGVRQ RNSGKWVCEV REPN-KKSRI WLGTFPTVEM   88
gi|41351817                 PAGRKKFRET RHPIYRGVRR RNSGKWVCEV REPN-KKSRI WLGTFPTAEM   85
CeresClone:1014380          PAGRKKFRET RHPIYRGVRR RNSGKWVCEV REPN-KKTRI WLGTFQTAEM   76

Consensus                   RAGRKKFRET RHPVYRGVRR RNSGKWVCEV REPN-KKSRI WLGTFPTAEM  100
```

| | | | | | | |
|---|---|---|---|---|---|---|
| gi\|49658405 | AARAHDVAAL | AFRGKLACIN | FADSAWRLPV | PASMDTMDIR | RAAAEAAEGF | 146 |
| Lead-CeresClone481710 | AARAHDVAAM | ALRGRYACLN | FADSAWRLPV | PATAEAKDIQ | KAAAEAAQAF | 149 |
| CeresClone:1620272 | AARAHDVAAM | ALRGRYACLN | FADSTWRLPI | PATANAKDIQ | KAAAEAAEAF | 149 |
| gi\|45826359 | AARAHDVAAL | ALRGRSACLN | FSDSAWRLPI | PASSNSKDIQ | KAAAQAVEIF | 139 |
| gi\|12003384 | AARAHDVAAI | ALRGRSACLN | FADSAWKLPI | PASTDAKDIQ | KAAAEAAEAF | 144 |
| gi\|45826358 | AARAHDVAAI | ALRGRSACLN | FADSAWRLPI | PDSSDTKDIQ | KAAAQAAEIF | 135 |
| gi\|37147896 | AARAHDVAAI | ALRGRSACLN | FADSAWRLPV | PASSDTKDIQ | KAAAEAAEAF | 145 |
| gi\|40647095 | AARAHDVAAI | ALRGRSACLN | FADSAWRLPV | PASSDTKDIQ | KAAAEAAEAL | 145 |
| CeresClone:1608106 | AARAHDVAVL | AMRGRSACLN | FADSVWRLPV | PESSNVKDIQ | KAAAEAAEAF | 111 |
| CeresClone:1604576 | AARAHDVAVL | AMRGRSACLN | FADSVWRLPV | PESSNVKDIQ | KAAAEAAEAF | 111 |
| gi\|10177734 | AARAHDVAAL | ALRGRSACLN | FADSAWRLRI | PETTCPKEIQ | KAASEAAMAF | 138 |
| gi\|41351817 | AARAHDVAAI | ALRGRSACLN | FADSAWRLRI | PESTCAKDIQ | KAAAEAAVAF | 135 |
| CeresClone:1014380 | AARAHDVAAL | ALRGRSACLN | FADSAWRLRI | PESTCAKDIQ | KAAAEAALAF | 126 |
| Consensus | AARAHDVAAL | ALRGRSACLN | FADSAWRLP- | PASSD-KDIQ | KAAAEAAEAF | 150 |

| | | | | | | |
|---|---|---|---|---|---|---|
| gi\|49658405 | RPVEFGGVCS | GSSDEKERMV | VQVEEKNKKG | SVNLERSRSL | SLSYWDEEE- | 195 |
| Lead-CeresClone481710 | RPDQ----TL | KNANTRQECV | EAVAVAVAET | TTATAQ---- | GVFYMEEEEQ | 191 |
| CeresClone:1620272 | RPSQ----TL | ENTNTKQECV | KVVT---TTT | ITEQKR---- | GMFYMEEEEQ | 188 |
| gi\|45826359 | RSEE----VS | GESPETSENV | QESS------ | ---------- | --DFVDEEA- | 166 |
| gi\|12003384 | RSSE----AE | NMPEYSGEDT | KEVN------ | --STPE---- | NMFYMDEEA- | 177 |
| gi\|45826358 | RPLKSE--EE | ESVVKDQSTT | PDDM------ | ---------- | --FFMDEEA- | 164 |
| gi\|37147896 | RPLK----LE | GISKESSSST | PESM------ | ---------- | --FFMDEEA- | 172 |
| gi\|40647095 | RPLK----LE | GISKESSSST | PESM------ | ---------- | --FFMDEEA- | 172 |
| CeresClone:1608106 | RE------TE | DIAMETKEMP | ESVV------ | ---------- | ---YADEEE- | 135 |
| CeresClone:1604576 | RE------TE | DIAVETNEVP | EVVV------ | ---------- | ---YADEEE- | 135 |
| gi\|10177734 | QNETTTE-GS | KTAAEAEEAA | GEGVREGERR | AEEQNG---- | GVFYMDDEA- | 182 |
| gi\|41351817 | QAEMSDTMTS | DHGLDMEETT | VEVI-----V | TEEEQS---- | EGFYMDEEA- | 175 |
| CeresClone:1014380 | QDEMCDA-TT | DHGFDMEETL | VEAI-----Y | TAEQSE---- | NAFYMHDEA- | 165 |
| Consensus | R--------- | ----E-EE-- | -EV------- | ---------- | --FYMDEEA- | 200 |

```
gi|49658405                 VFHMPRLLHD MAEGLLLSPS QCLG-GYMNL DDMGTDADVK LWSFSI--  240
Leod-CeresClone481710       VLDMPELLRN M---VLMSPT HCLGYEYEDA DLDAQDAEVS LWNFSI--  234
CeresClone:1620272          VLDMPELLRN M---VLMSPT HCI GYEYEDA DLDAQDAEVS LWSFSI--  231
gi|45826359                 I FFMPGLLAN MAEGLMLPPP QCAE--MGDH CVETDAYMI T LWNYSI--  210
gi|12003384                 LFFMPGLLVN MAEGLMLPPP QCSQ--I GDH -MEA-DVDMP LWSYSI--  219
gi|45826358                 LFCMPGLLTN MAEGLMVPPP QCTE--MGDH ---VEADDMP LWSYSI--  205
gi|37147896                 LFCMPGLLTN MAEGLMLPPP QCAE--I GDH -VETADADTP LWSYSI--  215
gi|40647095                 LFCMPGLLTN MAEGLMLPPP QCAE--I GDH -VETADADTP LWSYSI--  215
CeresClone:1608106          MFGMPELIAS MAEGMMLPXX QMVG--YANF ------CGNVG FWEDLC--  174
CeresClone:1604576          MFGMPEFLDS MAEGMMLPPP QMVG--DANF ------VDNVD FWGDLSLW  176
gi|10177734                 LLGMPNFFEN MAEGMLLPPP EVGW--NHN- DFDG-VGDVS LWSFDE--  224
gi|41351817                 MFGMPRLLAN MAEGMLLPPP SVQW--GHNY DCDG-DADVS LWSY----  216
CeresClone:1014380          MFEMPSLLAN MAEGMLLPLP SVQW--NHNH EVDGDDDDVS LWSY----  207

Consensus                   MF-MP-LL-N MAEGMMLPPP QC------D- -VD--D-DV- LWSYSI--  248
```

```
Lead-CeresClone270555   MRRKFWWLFI NYNI I HI KSL TRYQLKEEEE EAALI FPKDP PWFKAWMVPV   50
CeresClone:1087479      MGRNI WWLFL NNEI RHI KSF TRYEVK--DE EAALI FPKDP PWFKLWMVPV   48

Consensus               M-R--WWLF- N--I -HI KS- TRY--KEE-E EAALI FPKDP PWFK-WMVPV   50

Lead-CeresClone270555   MMLFVFFVFS I VGI CRRCRN CRRGENSPSI HPI N---   84
CeresClone:1087479      MMLFI FFI VV VI LI CRRCQN CRRGENSPSI HPI SQNT   85

Consensus               MMLF-FF--- ---I CRRC-N CRRGENSPSI HPI -QNT   87
```

```
gi|1841475                MDKKPCNS-- ----SQDPEV RKGPWTMEED LILINYIANH GEGVWNSLAK   44
CeresClone:549651         ---------- ---------- ------MEED LILITYXAXH GEGVWNSLAK   24
CeresClone:544897         MDKKLGNT-- ----SHDPEV RKGPWTMEED LILITYIANH GEGVWNSLAK   44
Lead-CeresClone262460     ---------- ---------- ------MEED LILINYIANH GEGVWNSLAK   24
gi|26451911               MEKRGGGSSG GSGSSAEAEV RKGPWTMEED LILINYIANH GDGVWNSLAK   50
gi|2280528                MEKRGGGSSG GSGSSAEAEV RKGPWTMEED LILINYIANH GDGVWNSLAK   50

Consensus                 M-K--G-S-- ----S---EV RKGPWTMEED LILINYIANH GEGVWNSLAK   50

gi|1841475                AAGLKRTGKS CRLRWLNYLR PDVRRGNITP EEQLLIMELH SKWGNRWSKI   94
CeresClone:549651         AAGLKRTGKS CRLRWLNYLR PDVRRGNITP EEQLLIMELH AKWGNRWSKI   74
CeresClone:544897         AAGLKRTGKS CRLRWLNYLR PDVRRGNITP EEQLLIMELH AKWGNRWSKI   94
Lead-CeresClone262460     SAGLKRTGKS CRLRWLNYLR PDVRRGNITP EEQLFIMELH AKWGNRWSKI   74
gi|26451911               SAGLKRTGKS CRLRWLNYLR PDVRRGNITP EEQLIIMELH AKWGNRWSKI  100
gi|2280528                SAGLKRTGKS CRLRWLNYLR PDVRRGNITP EEQLIIMELH AKWGNRWSKI  100

Consensus                 -AGLKRTGKS CRLRWLNYLR PDVRRGNITP EEQLLIMELH AKWGNRWSKI  100

gi|1841475                AKHLPGRTDN EIKNFWRTRI QKHIKQVDNP NQQNFQQKMS LEINDHHHHH  144
CeresClone:549651         AKHLPGRTDN EIKNYWRTRI QKHLMQAXSS ----FQQQSS ---NSEIIYH  117
CeresClone:544897         AKHLPGRTDN EIKNYWRTRI QKHLKQASSS ----FQQQSS ---NSEIIYH  137
Lead-CeresClone262460     AKHLPGRTDN EIKNFWRTKI QKYIIKSGET TT--VGSQSS -----EFINHH  118
gi|26451911               AKHLPGRTDN EIKNFWRTRI QKYIKQSDVT TTSSVGSHHS -----SEINDQ  146
gi|2280528                AKHLPGRTDN EIKNFCRTRI QKYIKQSDVT TTSSVGSHHS -----SEINDQ  146

Consensus                 AKHLPGRTDN EIKNFWRTRI QK-IKQSDST TT-S---QSS ---NSEIN-H  150

gi|1841475                PHQPSSSQV- SNLVEPMETY SP--TSYQGT --------LE PFPTQFPTIN  183
CeresClone:549651         PQACTS-QV- STMAQPIETY SP--PSYQGM --------LD PFSIQXPT--  153
CeresClone:544897         PQACTS-QV- STMAQPIETY SP--PSYQGM --------LD PFSIQFPT--  173
Lead-CeresClone262460     ATTS---HVM NDTQEFMDMY SPT-TSYQHA SNINQQLNYG NYVPESSSIM  164
gi|26451911               AASTSSHNVF CTQDQAMETY SPTPTSYQHT ---NMEFNYG NYSAAAVTAT  193
gi|2280528                AASTSSHNVF CTQDQAMETY SPTPTSYQHT ---NMEFNYG NYSAAAVTAT  193

Consensus                 ---TSS--V- STM-QPMETY SPT-TSYQ-T ---N-E-N-- --S-QAPT--  200
```

| | | | | | | |
|---|---|---|---|---|---|---|
| gi\|1841475 | NDHHQNSNCC | ANDNNNNNYW | SMEDI W-SMQ | LLNGD | 217 |
| CeresClone:549651 | NPHH--SSCC | --PMTTTTLL | LEHGXY-LXC | ISHY- | 182 |
| CeresClone:544897 | NPHH--SSCC | TNDDDNNNYW | SMEDI W-SMQ | LANY- | 204 |
| Leod-CeresClone262460 | M------PLS | V-DQSEQNYW | SVDDLW-PMN | IYNGN | 191 |
| gi\|26451911 | VDYP--VPMT | VDDQTGENYW | GMDDI WSSMH | LLNGN | 226 |
| gi\|2280528 | VDYP--VPMT | VDDQTGENYW | GMDDI WSSMH | LLNGN | 226 |
| Consensus | -DHH--S--- | V-DQT-ENYW | SMDDI W-SMH | LLNGN | 235 |

```
CeresClone:1334990        --MFPALPSD LTSCPKG--- AARVRIPNNM IPALKQSCSS EALSGINSTP   45
CeresClone:18857          MDMFPTLPSD LTSCGSGMAK APRVDIQRN- IPALKQSYSS EALS---STL   46
Lead-CeresClone241131     MDVRPANAAD DSSLGDLFPH QPAGLESDES NTEWLSGYVE DCFSSSTSYT   50
CeresClone:674257         ---------- ---------- ---------- ---------- ----------    0
CeresClone:621746         ---------- ---------- MAKEDEEKVI ---------- ----------   10

Consensus                 --M-P---SD -TS------- --R------- ---------- E--S---S--   50

CeresClone:1334990        HQSSA----- --------PP DIKVSYLFQS LTPVSVLENS YGSLST----   78
CeresClone:18857          HQSSA----- --------PP EIKVSKLFQS LSPVSVLENS YGSLST----   79
Lead-CeresClone241131     NPVSAMASEG VGKPKLPPPP SSNGRRKKRS LASV-MTNGD YQQFVLPLYV   99
CeresClone:674257         ---------- ---------- ---------- -----MSKES FGDXEL----   11
CeresClone:621746         ---------- ---------- -INVSK---- -------EIS FGDSEL----   24

Consensus                 H--SA----- --------PP -I-VSK--QS L--V---E-S YG---L----  100

CeresClone:1334990        ---------- ---------- -QNSGSQRLA FPVKGMRSKR RRPTTVRLSY  107
CeresClone:18857          ---------- ---------- -HNNGSQRLA FPVKGMRSKR KRPTTLRLSY  108
Lead-CeresClone241131     EPPLILIDQK HWMAESELIH PKKDDDDREV CQQQGQEQEK GVPRLVKMCS  149
CeresClone:674257         ---------- ---------- ---------- ---------- ----------   11
CeresClone:621746         ---------- ---------- ---------- ---------- ----------   24

Consensus.                ---------- ---------- -------R-- ---KG---KR --P--VRL--  150

CeresClone:1334990        LFPFEPR--- KSTPGESVTE GY-------- ---------Y SSEQHAK---  134
CeresClone:18857          LFPSEPRKPE KSTPGKPESE CY-------- ---------F SSEQHAK---  138
Lead-CeresClone241131     NCLSSQTPRW RDGPSGRQMM CSACGMRLKP ETRLSAEQQY GQEEPTRKEQ  199
CeresClone:674257         ---------- --------EE GS-------- ---------- NGQQPMP---   22
CeresClone:621746         ---------- --------DE GS-------- ---------N GQQQPMP---   36

Consensus                 ---------- K--P-----E GS-------- ---------Y S-EQP-K---  200
```

| | | | | | | |
|---|---|---|---|---|---|---|
| CeresClone:1334990 | ---KKRKI HL | I THTESSTLE | SSKSDGI VRI | CTHCETI TTP | QWRQGPSGPK | 181 |
| CeresClone:18857 | ---KKRKI HL | TTRTVSSTLE | ASNSDGI VRK | CTHCETI KTP | QWREGPSGPK | 185 |
| Lead-CeresClone241131 | EPDRKRKKAA | KKTCYESSDA | PPSSDQQEKR | CAHCLSSKTP | QWRAGPLGPK | 249 |
| CeresClone:674257 | ---------- | ---------- | -------TRR | CSHCLAQRTP | QWRAGPLGPK | 45 |
| CeresClone:621746 | ---------- | ---------- | --------RR | CTHCLAQRTP | QWRAGPLGPK | 58 |
| Consensus | ---KKRK--- | -------ST-- | ---SD---RR | CTHCL---TP | QWRAGPLGPK | 250 |
| CeresClone:1334990 | TLCNACGVRF | KSGRLVPEYR | PASSPTFIPS | VHSNSHRKI I | EMRKKDDE-F | 230 |
| CeresClone:18857 | TLCNACGVRF | RSGRLVPEYR | PASSPTFIPA | VHSNSHRKI I | EMRRKDDEQF | 235 |
| Lead-CeresClone241131 | TLCNACGVRF | KSGRLLPEYR | PANSPTFVSC | LHSNSHKKVM | QMRQA----V | 295 |
| CeresClone:674257 | XLCNACGVRY | KXGRLLPEYR | PAKSPTFVSY | LHSNSHKKVM | EMRMAVFSXI | 95 |
| CeresClone:621746 | TLCNACGVRY | KSGRLLPEYR | PAKSPTFVSY | LHSNSHKKVM | EMRMSVYS-I | 107 |
| Consensus | TLCNACGVRF | KSGRLLPEYR | PASSPTFVS- | LHSNSHKKVM | EMR-A----I | 300 |
| CeresClone:1334990 | DTSMI RSDI Q | KVKQGRKKMV | 250 | | | |
| CeresClone:18857 | DSSMI RAVI S | RG-------- | 247 | | | |
| Lead-CeresClone241131 | AQQQ------ | ---------- | 299 | | | |
| CeresClone:674257 | SSEQ------ | ---------- | 99 | | | |
| CeresClone:621746 | SSEQ------ | ---------- | 111 | | | |
| Consensus | SSEQ------ | ---------- | 320 | | | |

| | | | | | | |
|---|---|---|---|---|---|---|
| Lead-CeresClone235672 | MEPKKSSAQH | QPHAMEPKKS | SPR---GAGA | VAATATEAES | PLSSLFYPPA | 47 |
| CeresClone:235672 | MEPKKSSAQH | QPHAMEPKKS | SPR---GAGA | VAATATEAES | PLSSLFYPPA | 47 |
| gi\|56784045 | MEPKRSPALP | QPN-VETKKS | PPRAAAGGGG | GGTAAVGGES | PLSSLFHQPS | 49 |
| Consensus | MEPKKSSAQH | QPHAMEPKKS | SPR---GAGA | VAATATEAES | PLSSLFYPPA | 50 |
| Lead-CeresClone235672 | PAANGKDQEL | YSIIYKGQSG | SXTS------ | ---------- | ---------- | 71 |
| CeresClone:235672 | PAANGKDQEL | YSIIYKGQSG | SXTS------ | ---------- | ---------- | 71 |
| gi\|56784045 | HGAKGKE-DI | YSIFYKGQNG | TAQAGTADGK | SQWTPPKSRT | VYTKDNKQSN | 98 |
| Consensus | PAANGKDQEL | YSIIYKGQSG | S-TS------ | ---------- | ---------- | 100 |
| Lead-CeresClone235672 | ---------- | ---------- | ---------- | ---------- | ---------- | 71 |
| CeresClone:235672 | ---------- | ---------- | ---------- | ---------- | ---------- | 71 |
| gi\|56784045 | QYDSVDTSCF | GSSVNYGGRD | YYGISGHKQS | TESNDYKADK | KDPSTDSHGD | 148 |
| Consensus | ---------- | ---------- | ---------- | ---------- | ---------- | 150 |
| Lead-CeresClone235672 | -WRDR--- | 75 | | | | |
| CeresClone:235672 | -WRDR--- | 75 | | | | |
| gi\|56784045 | WWQGSFYY | 156 | | | | |
| Consensus | -WRDR--- | 158 | | | | |

```
Lead-CeresClone227651   MAAAAVYGGF KGKLGVEDAP ELQLNRI RI T LSSKNVKNLE KVCADLVKGA  50
CeresClone:761484       ---------MK SGKLGFE-GT QEVQHRI RI T LSSKSVKNLE KVCSDLVKGA  41
CeresClone:628769       ---------MK PTKPGLE-ES QEQI HKI RI T LSSKNVKNLE KVCADLVRGA  41
CeresClone:1387338      ---------MK QGKTGFE-AP QEQI HKI RI T LSSKNVKNLE KVCTDLVRGA  41
CeresClone:1068506      ----MAYAAMK PTKAGLE-EP LEQI HKI RI T LSSKNVKNLE KVCADLVRGA  46
CeresClone:8700         ---------MK PTKAGLE-AP LEQI HKI RI T LSSKNVKNLE KVCTDLVRGA  41

Consensus               ---------MK P-K-GLE-AP QEQI HKI RI T LSSKNVKNLE KVCADLVRGA  50

Lead-CeresClone227651   KDKHLRVKGP VRI PTKVLHI TTRKSPCGEG TNTWDRFEFR I HKRVI DLIS  100
CeresClone:761484       KEKQLKVKGP VRMPTKVLNI TTRKSPCGEG TNTWDRFEMR VHKRVI DLVS  91
CeresClone:628769       KDKHLRVKGP VRMPTKVLNI TTRKSPCGEG TNTWDRFELR VHKRVI DLYS  91
CeresClone:1387338      KDKRLRVKGP VRMPTKVLKI TTRKAPCGEG TNTWDRFELR VHKRVI DLFS  91
CeresClone:1068506      KDKRLRTKGP VRMPTKVLKI TTRKAPCGEG TNTWDRFELR VHKRVI DLFS  96
CeresClone:8700         KDKRLRVKGP VRMPTKVLKI TTRKAPCGEG TNTWDRFELR VHKRVI DLFS  91

Consensus               KDKRLRVKGP VRMPTKVL-I TTRK-PCGEG TNTWDRFELR VHKRVI DLFS  100

Lead-CeresClone227651   SPDVVKQI TS I TI EPGVEVE VTI ADV  126
CeresClone:761484       SPDVVKQI TS I TI EPGVEVE VTI SDQ  117
CeresClone:628769       SPDVVKQI TS I TI EPGVEVK VTI ADA  117
CeresClone:1387338      SPDVVKQI TS I TI EPGVEVE VTI ADS  117
CeresClone:1068506      SPDVVKQI TS I TI EPGVEVE VTI ADS  122
CeresClone:8700         SPDVVKQI TS I TI EPGVEVE VTI ADS  117

Consensus               SPDVVKQI TS I TI EPGVEVE VTI ADS  126
```

```
gi|62319965                 ---------- -------MAT QDSQGI KLFG KTI AFNI--- ---RTI KNEE  27
CeresClone:1118660          KKLSYNSLFS IYI SLI FMAT KDSPGI KLFG KTI TFNADXN NI I QTI KKEE  50
Lead-CeresClone158333       ---------- -------MAT QDSQGI KLFG KTI TFNA--- NI T QTI KKEE  30

Consensus                   ---------- -------MAT QDSQGI KLFG KTI TFNA--- NI -QTI KKEE  50

gi|62319965                 --ETHPPEQE ATI AVRSSSS SDLTAEKRPD KI I ACPRCKS METKFCYFNN  75
CeresClone:1118660          -GQEQQPELQ TKT AVRSPSS SDLMAEKRPD KI I ACPRCKS METKFCYFNN  99
Lead-CeresClone158333       QQQQQQPELQ ATTAVRSPS- SDLTAEKRPD KI I PCPRCKS METKFCYFNN  79

Consensus                   --Q-QQPELQ ATTAVRSPSS SDLTAEKRPD KI I ACPRCKS METKFCYFNN  100

gi|62319965                 YNVNQPRHFC KGCHRYWTAG GALRNVPVGA GRRKSKPPGR V--VVGMLGD  123
CeresClone:1118660          YNVNQPRHFC KGCQRYWTAG GALRNVPVGA GRRRSKPPGR AGGFSELLGA  149
Lead-CeresClone158333       YNVNQPRHFC KGCQRYWTAG GALRNVPVGA GRRKSKPPGR VGGFAELLGA  129

Consensus                   YNVNQPRHFC KGCQRYWTAG GALRNVPVGA GRRKSKPPGR VGGF-ELLGA  150

gi|62319965                 GNGVRQVELI NGLLVEEWQH AAAAAHGSFR HDFPMKRLRC YSDGQSC  170
CeresClone:1118660          ATG------- ---------- ---------- ---------- -------  152
Lead-CeresClone158333       ATGAVDQVEL DALLVEEWR- AATASHGGFR HDFPVKRLRC YTDGQSC  175

Consensus                   ATG------- --LLVEEW-- AA-A-HG-FR HDFP-KRLRC Y-DGQSC  197
```

| | | | | | | |
|---|---|---|---|---|---|---|
| CeresClone:302607 | ---------M | GAA-VKEEEV | PRRQAAPLGL | LGSPRSGTRC | S--RGGVWLG | 38 |
| gi\|28950721 | ---------M | VQT-KKFRGV | RQRH------ | WGSWVAEI RH | PLLKRRI WLG | 34 |
| CeresClone:17356 | ---------M | VQT-KKFRGV | RQRH------ | WGSWVAEI RH | PLLKRRI WLG | 34 |
| gi\|21553845 | ---------M | VQT-KKFRGV | RQRH------ | WGSWVAEI RH | PLLKRRI WLG | 34 |
| Lead-CeresClone1043081 | ---------M | VQS-RKFRGV | RQRN------ | WGSWVSEI RH | PLLKRRVWLG | 34 |
| CeresClone:556472 | ---------M | VQS-RKFRGV | RQRH------ | WGSWVSEI RH | PLLKRRVWLG | 34 |
| CeresClone:224679 | MTENLHSRKM | VQP-KKFRGV | RQRH------ | WGSWVSEI RH | PLLKRRVWLG | 43 |
| gi\|50906071 | ---------M | VQPKKKFRGV | RQRH------ | WGSWVSEI RH | PLLKRRVWLG | 35 |
| Consensus | ---------M | VQ--KKFRGV | RQRH------ | WGSWVSEI RH | PLLKRRVWLG | 50 |

| | | | | | | |
|---|---|---|---|---|---|---|
| CeresClone:302607 | TFETAEEAAR | AYDEAAVLMS | GRNAKTNFPV | LPCGRTRGGG | GGGGSS-GNN | 87 |
| gi\|28950721 | TFETAEEAAR | AYDEAAVLMS | GRNAKTNFPL | -NNNNTGETS | EGKTDI-SAS | 82 |
| CeresClone:17356 | TFETAEEAAR | AYHEAAVLMS | GRNAKTNFPL | -NNNNTGETS | EGKTDI-SAS | 82 |
| gi\|21553845 | TFETAEEAAR | AYHEAAVLMS | GRNAKTNFPL | -NNNNTGETS | EGKTDI-SAS | 82 |
| Lead-CeresClone1043081 | TFETADEAAR | AYDEAAI LMS | GRNAKTNFPV | ---------- | -GENQM-GNH | 72 |
| CeresClone:556472 | TFETAEEAAR | AYDEAAI LMS | GRNAKTNFPV | ---------- | -GENQI VGNH | 73 |
| CeresClone:224679 | TFETAEEAAR | AYDEAAVLMS | GRNAKTNFPI | -QRSSTGEPT | PAAGRD--AR | 90 |
| gi\|50906071 | TFETAEEAAR | AYDEAAVLMS | GRNAKTNFPV | -QRNSTGDLA | TAADQD-ARS | 83 |
| Consensus | TFETAEEAAR | AYDEAAVLMS | GRNAKTNFPV | ---NNTGE-S | -GK-QI -SAS | 100 |

| | | | | | | |
|---|---|---|---|---|---|---|
| CeresClone:302607 | TNASASTSTS | NLSQVLSAKL | RRCCKAPSPS | LTCLRLDPER | SHI GVWHKGA | 137 |
| gi\|28950721 | STMSSSTSSS | SLSSI LSAKL | RKCCKSPSPS | LTCLRLDTAS | SHI GVWQKRA | 132 |
| CeresClone:17356 | STMSSSTSSS | SLSSI LSAKL | RKCCKSPSPS | LTCLRLDTAS | SHI GVWQKRA | 132 |
| gi\|21553845 | STMSSSTSSS | SLSSI LSAKL | RKCCKSPSPS | LTCLRLDTAS | SHI GVWQKRA | 132 |
| Lead-CeresClone1043081 | SSSTSSSSTT | TLSAVLSAKL | RKCCKSPSPS | LTCLRLDTEN | SHI GVWQKRA | 122 |
| CeresClone:556472 | SSNTSSSSTT | TLSAVLSAKL | RKCCKSPSPS | LTCLRLDTEN | SHI GVWQKRA | 123 |
| CeresClone:224679 | SNFSSGSSTT | NLSQI LSAKL | RKCCKAPSPS | LTCLRLDPEK | SHI GVWQKRA | 140 |
| gi\|50906071 | NGGSRNSSAG | NLSQI LSAKL | RKCCKAPSPS | LTCLRLDPEK | SHI GVWQKRA | 133 |
| Consensus | S--SSS-STS | -LSSI LSAKL | RKCCKSPSPS | LTCLRLDTEN | SHI GVWQKRA | 150 |

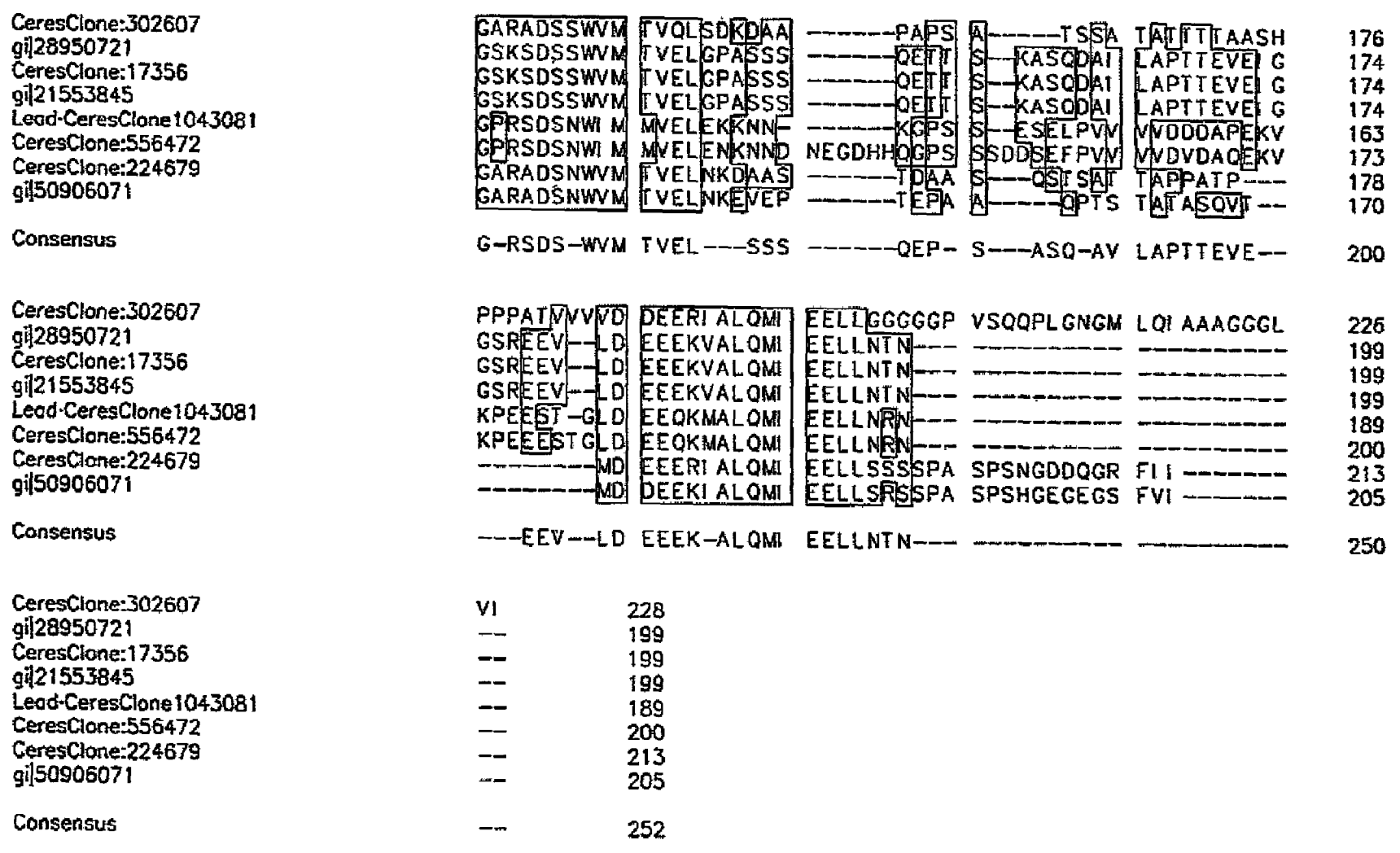

```
CeresClone:302607          GARADSSWVM TVQLSDKDAA -------PAPS A------TSSA TATTTTAASH 176
gi|28950721                GSKSDSSWVM TVELGPASSS -------QETT S--KASQDAI LAPTTEVEI G 174
CeresClone:17356           GSKSDSSWVM TVELGPASSS -------QETT S--KASQDAI LAPTTEVEI G 174
gi|21553845                GSKSDSSWVM TVELGPASSS -------QETT S--KASQDAI LAPTTEVEI G 174
Lead-CeresClone1043081     GPRSDSNWI M MVELEKKNN- -------KGPS S--ESELPVV VVDDDAPEKV 163
CeresClone:556472          GPRSDSNWI M MVELENKNND NEGDHHQGPS SSDDSEFPVV VVDVDAQEKV 173
CeresClone:224679          GARADSNWVM TVELNKDAAS -------TDAA S---QSTSAT TAPPATP--- 178
gi|50906071                GARADSNWVM TVELNKEVEP -------TEPA A-----QPTS TATASQVT-- 170

Consensus                  G-RSDS-WVM TVEL---SSS ------QEP- S---ASQ-AV LAPTTEVE-- 200

CeresClone:302607          PPPATVVVVD DEERI ALQMI EELLGGGGGP VSQQPLGNGM LQI AAAGGGL 226
gi|28950721                GSREEV--LD EEEKVALQMI EELLNTN--- ---------- ---------- 199
CeresClone:17356           GSREEV--LD EEEKVALQMI EELLNTN--- ---------- ---------- 199
gi|21553845                GSREEV--LD EEEKVALQMI EELLNTN--- ---------- ---------- 199
Lead-CeresClone1043081     KPEEST-GLD EEQKMALQMI EELLNRN--- ---------- ---------- 189
CeresClone:556472          KPEEESTGLD EEQKMALQMI EELLNRN--- ---------- ---------- 200
CeresClone:224679          --------MD EEERI ALQMI EELLSSSSPA SPSNGDDQGR FII ------- 213
gi|50906071                --------MD DEEKI ALQMI EELLSRSSPA SPSHGEGEGS FVI ------- 205

Consensus                  ---EEV--LD EEEK-ALQMI EELLNTN--- ---------- ---------- 250

CeresClone:302607          VI 228
gi|28950721                -- 199
CeresClone:17356           -- 199
gi|21553845                -- 199
Lead-CeresClone1043081     -- 189
CeresClone:556472          -- 200
CeresClone:224679          -- 213
gi|50906071                -- 205

Consensus                  -- 252
```

| | | | | | | |
|---|---|---|---|---|---|---|
| gi\|5732912 | MSLIPSFFDG | RRSNIFDPFS | LNIWDPFEGF | PFSGTVAN P | TSTRETAAFS | 50 |
| gi\|56606538 | MALIPSIFGG | RRSNVFDPFS | HDIWDPFQGL | S--SALANAR | --DQETAAIA | 46 |
| gi\|46359518 | MAL--SLFGG | RRSNVFDPFS | LDIWDPFEGF | ---SAVANVP | PSARETIAFA | 45 |
| gi\|21689719 | MSLIPSIFGG | RRSNVFDPFS | QDLWDPFEGF | FTPSSALANA | STARDVAAFT | 50 |
| Lead-CeresClone1007549 | MSLIPSIFGG | RRTNVFDPFS | LDVFDPFEGF | LTPSGLANAP | --AKDVAAFT | 48 |
| gi\|2465461 | MSLIPSFFGG | RRTNVFDPFS | LDLYDPFEGF | LTPSGMTNAT | --SKDVAAFT | 48 |
| gi\|8250119 | MSLIPSFFGG | RRTNVFDPFS | LDLYDPFEGF | LTPSGMTNTT | --SKDVAAFT | 48 |
| gi\|18073562 | MSIIPSLFAG | RRSSVFDPFS | LDVWDPFRDF | PISSSSDV-- | --SRETSALV | 46 |
| CeresClone:1609909 | MSIIPSIFGG | RRTNVFDPFS | LDIWDPF--- | FNTSISNIIP | AGARETSAFA | 47 |
| gi\|71495 | MSIIPSFFGG | RRSNVFDPFS | LDVWDPFKDF | PLVTSSASEF | --GKETAAFV | 48 |
| Consensus | MSLIPSIFGG | RRSNVFDPFS | LDIWDPFEGF | ---SS-AN-- | ---RETAAF- | 50 |

| | | | | | | |
|---|---|---|---|---|---|---|
| gi\|5732912 | SARIDWKETP | ESHVFKVDLP | GIKKEEVKVE | VEEGRVLQIS | GERSREQEEK | 100 |
| gi\|56606538 | NTRIDWKETP | EAHVFKADLP | GLKKEEIKVE | VEDGRVLQIS | GERSKEQEEK | 96 |
| gi\|46359518 | TARIDWKETP | EAHIFKADLP | GLKKEEVKVE | VEDGNVLQIS | GERSKEHEEK | 95 |
| gi\|21689719 | NARVDWKETP | EAHVFKADLP | GLKKEEVKVE | VEDKNVLQIS | GERSKENEEK | 100 |
| Lead-CeresClone1007549 | NAKVDWRETP | EAHVFKADLP | GLRKEEVKVE | VEDGNILQIS | GERSNENEEK | 98 |
| gi\|2465461 | NAKVDWRETP | EAHVFKADLP | GLKKEEVKVE | VEDGNILQIS | GERSSENEEK | 98 |
| gi\|8250119 | NAKVDWRETA | EAHVFKADLP | GLKKEEVKVE | VEDGNILKIS | GERSSENEEK | 98 |
| gi\|18073562 | NARVDWKETP | EAHVFKADLP | GIKKEEVKVE | VEDGNILQIT | GERNVEKEDK | 96 |
| CeresClone:1609909 | NAQIDWKETP | EAHVFKADLP | GLKKEEVKVE | LQEDRILQIS | GERSREKEEK | 97 |
| gi\|71495 | NFHIDWKETP | QAHVFKADLP | GLKKEEVKVE | LEEGKVLQIS | GERNKEKEEK | 98 |
| Consensus | NAR-DWKETP | EAHVFKADLP | GLKKEEVKVE | VEDGN-LQIS | GERSKE-EEK | 100 |

| | | | | | | |
|---|---|---|---|---|---|---|
| gi\|5732912 | NDKWHSMERS | SGKFLRRFRL | PENIKMEEIK | ATMENGVLTV | TVPKMEEKKP | 150 |
| gi\|56606538 | TDTWHRVERS | VGKFHRRFRL | PENAKVDQVT | ASMENGVLTV | TVPKKEEKEP | 146 |
| gi\|46359518 | NDKWHRVERS | CGKFLRRFRL | PENAKVEQVK | ANMENGVLTV | IVPKEEQKKT | 145 |
| gi\|21689719 | NDKWHRVERA | SGKFMRRFRL | PENAKMEEVK | ATMENGVLTV | VVPKAPEKKP | 150 |
| Lead-CeresClone1007549 | NDKWHRVERS | SGKFTRRFRL | PENAKMEEIK | ASMENGVLSV | TVPKVPEKKP | 148 |
| gi\|2465461 | SDRWHRVERS | SGKFMRRFKL | PENAKVDEVK | ASMENGVLSV | TVPKMAERKP | 148 |
| gi\|8250119 | SDKWHRVERS | SGKFMRRFKL | PENAKVDEVK | ASMENGVLSV | TVPKMPERKP | 148 |
| gi\|18073562 | NDKWHRVERS | SGKFTRRFRL | PENAKMDQVK | AAMENGVLTI | TVPKEEVKKP | 146 |
| CeresClone:1609909 | NDKWHRVERS | SGKFLRRFRL | PENAKVDEVK | AKMENGVLTV | TVPKKEVKKP | 147 |
| gi\|71495 | NDKWHRVERS | SGKFLRRFRL | PENAKVDEVK | AAMANGVLTV | TVPKVEIKKP | 148 |
| Consensus | NDKWHRVERS | SGKFMRRFRL | PENAKVDEVK | ASMENGVLTV | TVPKMEEKKP | 150 |

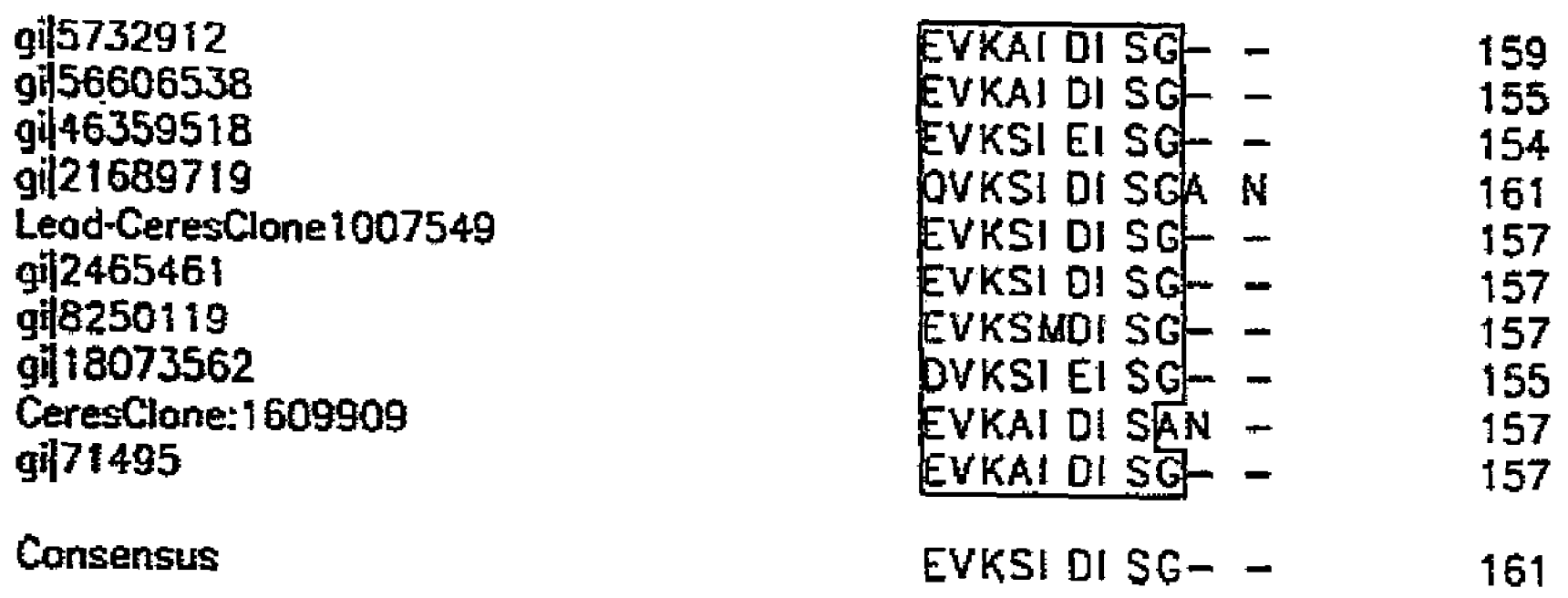

| | | |
|---|---|---|
| gi\|5732912 | EVKAIDISG-- | 159 |
| gi\|56606538 | EVKAIDISG-- | 155 |
| gi\|46359518 | EVKSIEISG-- | 154 |
| gi\|21689719 | QVKSIDISGAN | 161 |
| Lead-CeresClone1007549 | EVKSIDISG-- | 157 |
| gi\|2465461 | EVKSIDISG-- | 157 |
| gi\|8250119 | EVKSMDISG-- | 157 |
| gi\|18073562 | DVKSIEISG-- | 155 |
| CeresClone:1609909 | EVKAIDISAN- | 157 |
| gi\|71495 | EVKAIDISG-- | 157 |
| Consensus | EVKSIDISG-- | 161 |

```
Lead-CeresClone1002819  MKPVFCGNFE YDARESDLER LFRKYGKVER VDMKAGFAFV YMEDERDAED  50
CeresClone:113457       MKPVFCGNFE YDAREGDLER LFRKYGKVER VDMKAGFAFV YMEDERDAED  50
Consensus               MKPVFCGNFE YDARE-DLER LFRKYGKVER VDMKAGFAFV YMEDERDAED  50

Lead-CeresClone1002819  AIRALDRFEY GRTGRRLRVE WTKNDRGGAG RS-GGSRRSS SGLRPSKTLF  99
CeresClone:113457       AIRALDRFEF GRKGRRLRVE WTKSERGGDK RSGGGSRRSS SSMRPSKTLF  100
Consensus               AIRALDRFE- GR-GRRLRVE WTK--RGG-- RSGGGSRRSS S--RPSKTLF  100

Lead-CeresClone1002819  VINFDAQNTR TRDLERHFEP YGKIVNVRIR RNFAFIQYEA QEDATRALDA  149
CeresClone:113457       VINFDADNTR TRDLEKHFEP YGKIVNVRIR RNFAFIQYEA QEDATRALDA  150
Consensus               VINFDA-NTR TRDLE-HFEP YGKIVNVRIR RNFAFIQYEA QEDATRALDA  150

Lead-CeresClone1002819  TNSSKLMDKV ISVEYAVKDD DSRGNGYSPE RRRDRSPDRR RRSPSPYRRE  199
CeresClone:113457       SNNSKLMDKV ISVEYAVKDD DARGNGHSPE RRRDRSPERR RRSPSPYKRE  200
Consensus               -N-SKLMDKV ISVEYAVKDD D-RGNG-SPE RRRDRSP-RR RRSPSPY-RE  200

Lead-CeresClone1002819  RGSPDYGRGA SPV-AHKRER TSPDYGRGRR SPSPYKRARL -SPDYKRD--  245
CeresClone:113457       RGSPDYGRGA SPVAAYRKER TSPDYGR-RR SPSPYKKSRR GSPEYGRDRR  249
Consensus               RGSPDYGRGA SPVAA---ER TSPDYGRGRR SPSPYK--R- GSP-Y-RDRR  250

Lead-CeresClone1002819  ----DRRRER VASPENGAVR NRSPRKGRGE SRSPPPYEKR RESRSPPPYE  291
CeresClone:113457       GNDSPRRRER VASPTK---Y SRSPNN---- -------KRE RMSPNHSPFK  285
Consensus               GNDS-RRRER VASP--GAV- -RSP--GRGE SRSPPPY--- R-S----P--  300

Lead-CeresClone1002819  KRRESRSPPP YEKRRERSRS RSKSSPENGQ VESPGQIMEV EAGRGYDGAD  341
CeresClone:113457       KESPRNGVGE VESPIER-RE RSRSSPENGQ VESPGSIGRR DSDGGYDGAE  334
Consensus               K--------- -E---ERSR- RS-SSPENGQ VESPG-I--- ----GYDGA-  350
```

| | | | |
|---|---|---|---|
| Lead-CeresClone1002819 | SPI RESSPSR | SPPAEE | 357 |
| CeresClone:113457 | SPMQKSRSPR | SPPADE | 350 |
| Consensus | SP---S---R | SPPA-E | 366 |

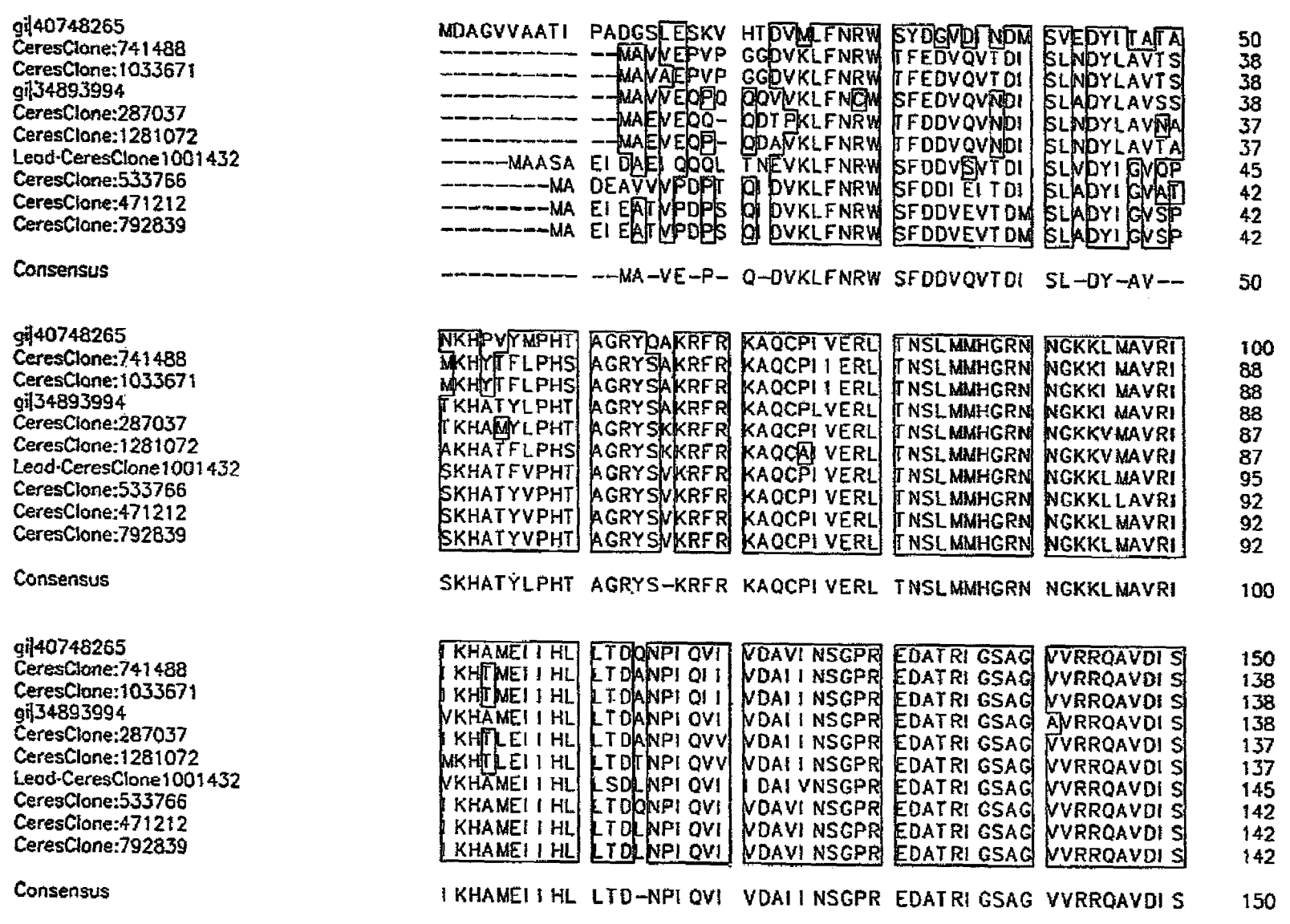

| | | | | | | |
|---|---|---|---|---|---|---|
| gi\|40748265 | MDAGVVAATI | PADGSLESKV | HTDVMLFNRW | SYDGVDINDM | SVEDYITATA | 50 |
| CeresClone:741488 | ---------- | --MAVVEPVP | GGDVKLFNRW | TFEDVQVTDI | SLNDYLAVTS | 38 |
| CeresClone:1033671 | ---------- | --MAVAEPVP | GGDVKLFNRW | TFEDVQVTDI | SLNDYLAVTS | 38 |
| gi\|34893994 | ---------- | --MAVVEQPQ | QQVVKLFNCW | SFEDVQVNDI | SLADYLAVSS | 38 |
| CeresClone:287037 | ---------- | --MAEVEQQ- | QDTPKLFNRW | TFDDVQVNDI | SLNDYLAVNA | 37 |
| CeresClone:1281072 | ---------- | --MAEVEQP- | QDAVKLFNRW | TFDDVQVNDI | SLNDYLAVTA | 37 |
| Lead-CeresClone1001432 | -----MAASA | EIDAEIQQQL | TNEVKLFNRW | SFDDVSVTDI | SLVDYIGVQP | 45 |
| CeresClone:533766 | --------MA | DEAVVVPDPT | QIDVKLFNRW | SFDDIEITDI | SLADYIGVAT | 42 |
| CeresClone:471212 | --------MA | EIEATVPDPS | QIDVKLFNRW | SFDDVEVTDM | SLADYIGVSP | 42 |
| CeresClone:792839 | --------MA | EIEATVPDPS | QIDVKLFNRW | SFDDVEVTDM | SLADYIGVSP | 42 |
| Consensus | ---------- | --MA-VE-P- | Q-DVKLFNRW | SFDDVQVTDI | SL-DY-AV-- | 50 |

| | | | | | | |
|---|---|---|---|---|---|---|
| gi\|40748265 | NKHPVYMPHT | AGRYQAKRFR | KAQCPIVERL | TNSLMMHGRN | NGKKLMAVRI | 100 |
| CeresClone:741488 | MKHYTFLPHS | AGRYSAKRFR | KAQCPIIERL | TNSLMMHGRN | NGKKIMAVRI | 88 |
| CeresClone:1033671 | MKHYTFLPHS | AGRYSAKRFR | KAQCPIIERL | TNSLMMHGRN | NGKKIMAVRI | 88 |
| gi\|34893994 | TKHATYLPHT | AGRYSAKRFR | KAQCPLVERL | TNSLMMHGRN | NGKKIMAVRI | 88 |
| CeresClone:287037 | TKHAMYLPHT | AGRYSKKRFR | KAQCPIVERL | TNSLMMHGRN | NGKKVMAVRI | 87 |
| CeresClone:1281072 | AKHATFLPHS | AGRYSKKRFR | KAQCAIVERL | TNSLMMHGRN | NGKKVMAVRI | 87 |
| Lead-CeresClone1001432 | SKHATFVPHT | AGRYSVKRFR | KAQCPIVERL | TNSLMMHGRN | NGKKLMAVRI | 95 |
| CeresClone:533766 | SKHATYVPHT | AGRYSVKRFR | KAQCPIVERL | TNSLMMHGRN | NGKKLLAVRI | 92 |
| CeresClone:471212 | SKHATYVPHT | AGRYSVKRFR | KAQCPIVERL | TNSLMMHGRN | NGKKLMAVRI | 92 |
| CeresClone:792839 | SKHATYVPHT | AGRYSVKRFR | KAQCPIVERL | TNSLMMHGRN | NGKKLMAVRI | 92 |
| Consensus | SKHATYLPHT | AGRYS-KRFR | KAQCPIVERL | TNSLMMHGRN | NGKKLMAVRI | 100 |

| | | | | | | |
|---|---|---|---|---|---|---|
| gi\|40748265 | IKHAMEIIHL | LTDQNPIQVI | VDAVINSGPR | EDATRIGSAG | VVRRQAVDIS | 150 |
| CeresClone:741488 | IKHTMEIIHL | LTDANPIQII | VDAIINSGPR | EDATRIGSAG | VVRRQAVDIS | 138 |
| CeresClone:1033671 | IKHTMEIIHL | LTDANPIQII | VDAIINSGPR | EDATRIGSAG | VVRRQAVDIS | 138 |
| gi\|34893994 | VKHAMEIIHL | LTDANPIQVI | VDAIINSGPR | EDATRIGSAG | AVRRQAVDIS | 138 |
| CeresClone:287037 | IKHTLEIIHL | LTDANPIQVV | VDAIINSGPR | EDATRIGSAG | VVRRQAVDIS | 137 |
| CeresClone:1281072 | MKHTLEIIHL | LTDTNPIQVV | VDAIINSGPR | EDATRIGSAG | VVRRQAVDIS | 137 |
| Lead-CeresClone1001432 | VKHAMEIIHL | LSDLNPIQVI | IDAIVNSGPR | EDATRIGSAG | VVRRQAVDIS | 145 |
| CeresClone:533766 | IKHAMEIIHL | LTDQNPIQVI | VDAVINSGPR | EDATRIGSAG | VVRRQAVDIS | 142 |
| CeresClone:471212 | IKHAMEIIHL | LTDLNPIQVI | VDAVINSGPR | EDATRIGSAG | VVRRQAVDIS | 142 |
| CeresClone:792839 | IKHAMEIIHL | LTDLNPIQVI | VDAVINSGPR | EDATRIGSAG | VVRRQAVDIS | 142 |
| Consensus | IKHAMEIIHL | LTD-NPIQVI | VDAIINSGPR | EDATRIGSAG | VVRRQAVDIS | 150 |

| | | |
|---|---|---|
| gi\|40748265 | PLRRVNQAI Y LLTTGARESA FRNI KTI AEC LADELI NAAK GSSNSYAI KK | 200 |
| CeresClone:741488 | PLRRVNQAI Y LLTTGARESA FRNVKTI AEC LADELI NAAK GSSNSYAI KK | 188 |
| CeresClone:1033671 | PLRRVNQAI Y LLTTGARESA FRNVKTI AEC LADELI NAAK GSSNSYAI KK | 188 |
| gi\|34893994 | PLRRVNQAI Y LLTTGARESA FRNI KTI AEC LADELI NAAK GSSNSYAI KK | 188 |
| CeresClone:287037 | PLRRVNQAI Y LLTTGARESA FRNI KTI AEC LADELI NAAK GSSNSYAI KK | 187 |
| CeresClone:1281072 | PLRRVNQAI Y LLTTGARESA FRNI KTI AEC LADELI NAAK GSSNSYAI KK | 187 |
| Lead-CeresClone1001432 | PLRRVNQAI F LLTTGAREAA FRNI KTI AEC LADELI NAAK GSSNSYAI KK | 195 |
| CeresClone:533766 | PLRRVNQAI Y LLTTGAREAA FRNI KTI AEC LADELI NAAK GSSNSYAI KK | 192 |
| CeresClone:471212 | PLRRVNQAI Y LLTTGAREAA FRNI KTI AEC LADELI NAAK GSSNSYAI KK | 192 |
| CeresClone:792839 | PLRRVNQAI Y LLTTGAREAA FRNI KTI AEC LADELI NAAK GSSNSYAI KK | 192 |
| Consensus | PLRRVNQAI Y LLTTGARESA FRNI KTI AEC LADELI NAAK GSSNSYAI KK | 200 |

| | | |
|---|---|---|
| gi\|40748265 | KDEI ERVAKA NR | 212 |
| CeresClone:741488 | KDEI ERVAKA NR | 200 |
| CeresClone:1033671 | KDEI ERVAKA NR | 200 |
| gi\|34893994 | KDEI ERVAKA NR | 200 |
| CeresClone:287037 | KDEI ERVAKA NR | 199 |
| CeresClone:1281072 | KDEI ERVAKA NR | 199 |
| Lead-CeresClone1001432 | KDEI ERVAKA NR | 207 |
| CeresClone:533766 | KDEI ERVAKA NR | 204 |
| CeresClone:471212 | KDEI ERVAKA NR | 204 |
| CeresClone:792839 | KDEI ERVAKA NR | 204 |
| Consensus | KDEI ERVAKA NR | 212 |

```
Lead-CeresClone969750   MDYLDNTVET Q------SKY KGIRRRKWGK WVSEIRVPGT RDRLWLGSFS   44
CeresClone:26867        MDYRESTGES Q------SKY KGIRRRKWGK WVSEIRVPGT RDRLWLGSFS   44
gi|21555003             MDYRESTGES Q------SKY KGIRRRKWGK WVSEIRVPGT RDRLWLGSFS   44
CeresClone:1469452      MRRAEPVGEQ ADAERRMSGY KGVRRRRWGK WVSEIRVPGS RERLWLGSYA   50

Consensus               MDYRESTGES Q------SKY KGIRRRKWGK WVSEIRVPGT RDRLWLGSFS   50

Lead-CeresClone969750   TAEGAAVAHD VAFYCLH--- -QPNSLESLN FPHLLPPSIV S--KTSPRSI   88
CeresClone:26867        TAEGAAVAHD VAFFCLH--- -QPDSLESLN FPHLLNPSLV S--RTSPRSI   88
gi|21555003             TAEGAAVAHD VAFFCLH--- -QPDSLESLN FPHLLNPSLV S--RTSPRSI   88
CeresClone:1469452      TPEAAAVAHD TAVYFLRGGG GGPGDVAALN FPERAAAAYG AGGRLSPRSV  100

Consensus               TAEGAAVAHD VAF-CLH--- -QPDSLESLN FPHLLNPSLV S--RTSPRSI  100

Lead-CeresClone969750   QQAASNAGMA VDAGIVNSCD HASGNS---G NGDTTTAYCE NGG------A  129
CeresClone:26867        QQAASNAGMA IDAGIVHS-- -TSVNS---G CGDTTT-YYE NGADQVE--P  129
gi|21555003             QQAASNAGMA IDAGIVHS-- -TSVNS---G CGDTTT-YYE NGADQVE--P  129
CeresClone:1469452      QRVASDAGMA ADAQLVAARE DTRAHRTGIG GGASARPRDR DAGDACAGRA  150

Consensus               QQAASNAGMA VDAGIVHS-- -TSVNS---G CGDTTT-YYE NG-DQVE---  150

Lead-CeresClone969750   LNISVYDYLD GHDH------ ---------V  144
CeresClone:26867        LNISVYDYLG GHDH------ ---------V  144
gi|21555003             LNISVYDYLG GHDH------ ---------V  144
CeresClone:1469452      HNASLHSTGA GREQPVSGEI SVDDMDILL   179

Consensus               LNISVYDYLG GHDH------ ---------V  179
```

```
gi|50946411            MDHICISGGG EGGVVSPAQP SSPERRYKGV RLRKWGRWVS EIRMPNSRER  50
CeresClone:1609832     -----MMKPK SSE---GSSS STHEPKYKGV RLRKWGKWVS EIRLPNSRER  42
Lead-CeresClone708342  -----MVKPK SVEKPAEEQQ QRSVSSYRGV RKRKWGKYVS EIRLPNSROR  45
gi|29893536            ---------- -----MEGSS SSMQSKYKGV RKRKWGKWVS EIRLPNSRER  35
gi|12083252            ---------- ---------- --MQSKYKGV RKRKWGKWVS EIRLPNSRER  28

Consensus              -----M---- ---------- SS--SKYKGV RKRKWGKWVS EIRLPNSRER  50

gi|50946411            IWLGSYESAE KAARAFDAAA VCLRGSRGAG SLNFPESPPP DVRRRFPGAA 100
CeresClone:1609832     IWLGSYDSPE KAARAFDAAA FCLRGH--AA KFNFPDQPP- ---NIPGGRS  86
Lead-CeresClone708342  IWLGSYDSAE KAARAFDAAM FCLRGS--GA KFNFPSDPP- ---NIACGCN  89
gi|29893536            IWLGSYDTPE KAARAFDAAL YCLRGN--NA KFNFPDNPP- ---VISGGRN  79
gi|12083252            IWLGSYDTPE KAARAFDAAL YCLRGN--NA KFNFPDNPP- ---VISGGRN  72

Consensus              IWLGSYDSPE KAARAFDAAL -CLRG----A KFNFPDNPP- ----ISGGRN 100

gi|50946411            LTVEQIQAEA ARHANRPFPA NTAAAGGSSS SYSISQRQEA AAPARSTSND 150
CeresClone:1609832     LSSAQIQDAA ARYAN---SV PDE------- ---------T VIPM-----E 112
Lead-CeresClone708342  MTSSQIQIAA ARFAN---SE PRNERSDQPV ESLTSDEETA SFPVI----S 132
gi|29893536            LSRSEIREAA ARFAN---SA EDDSSGG--- ---------A GYEIR----Q 110
gi|12083252            LSRSEIREAA ARFAN---SA EDDSSGG--- ---------A GYEIR----Q 103

Consensus              LS-SQIQEAA ARFAN---SA -DDSSGG--- ---------A -YPVR----- 150

gi|50946411            DTAMSSVPST DGGAADYDGG DDVIDMSFMD TLPAMSSSAA STNADLVPAM 200
CeresClone:1609832     DSTSSSIMLN D--------- ----DSNYNN NSSSSNNNNN VIDYDIFPGF 149
Lead-CeresClone708342  DTDTSSPPLS D---VTFQND AELVTGSFPD MFSDFGSGDF VPDFSDFPSF 179
gi|29893536            ESASTSMDV- ---------- ----DSEFLS MLPTVGSGNF ASEFGLFPGF 145
gi|12083252            ESASTSMDV- ---------- ----DSEFLS MLPTVGSGNF ASEFGLFPGF 138

Consensus              DSASSSM--- D--------- ----DSSFM- MLP-MGSGNF A--F-LFPGF 200
```

```
gi|50946411                DDFMYG---- -FLHTMPPSP CE--DGGEDV MIDGNCNMDQ TFFSVDLWRF 243
CeresClone:1609832         DDY------- -FMQPPPMVS PQFADYDEGN SSDGDISQGP SF----LWNY 187
Leod-CeresClone708342      DDFSRDF--- -FLHELPG-- --F-NFGEEN L-DGLI QD- SF----LWNF 214
gi|29893536                DDFSDEYSGD RFREQLSPTQ DYY-QLGEET YADGSM---- -F----LWNF 185
gi|12083252                DDFSDEYSGD RFREQLSPTQ DYY-QLGEET YADGSM---- -F----LWNF 178

Consensus                  DDFS-EY--- -FMEQLPPT- ----D-GEE- -ADG------ SF----LWNF 250
```

```
gi|23452024            ---------- -MDSSSSSSQ FF-YSMNSDL NSSDSSYEWS NFNTQSYLPF  38
gi|57012702            ---------- -MDPFLIQSP FSGFSPEYSI GSSPDSFSSS SSNN-YSLPF  38
CeresClone:21068       QSSQETEYFF YMDPLLIQSP FSGFSPEYSI GSSPESFSSS SSNN-YSLPF  49
gi|21554205            ---------- -MDPLLIQSP FSGFSPEYSI GSSPESFSSS SSNN-YSLPF  38
Lead-CeresClone664365  ---------- -MDCSSVL-- ---------- ---------H SSNS-SFFPF  17
CeresClone:664365      ---------- -MDCSSVL-- ---------- ---------H SSNS-SFFPF  17
gi|50920293            ---------- -MDA------ ---------- ---------- ----------   3

Consensus              ---------- -MD---I-S-. F--FS----I -SS--SF--S SSN----LPF  50

gi|23452024            NVNDSEEMLL FGVLNAAHEE TTSETVTSHR VKEEEVTSES EVIEAIPAK-  87
gi|57012702            NENDSEEMFL YGLIEQSTQQ T--------- YIDSD--SQD LPIKSVSSRK  77
CeresClone:21068       NENDSEEMFL YGLIEQSTQQ T--------- YIDSE--LQD LPIKSVSSRK  88
gi|21554205            NENDSEEMFL YGLIEQSTQQ T--------- YIDSE--LQD LPIKSVSSRK  77
Lead-CeresClone664365  NENDPEEMLL YGMITSYQEK V--------- IIKEEEVNSE ENXNKNKKXX  58
CeresClone:664365      NENDPEEMLL YGMITSYQEK V--------- IIKEEEVNSE ENXNKNKKXX  58
gi|50920293            ---------- ---------- ---------- HGQEE---EE EPMQ----VQ  16

Consensus              NENDSEEM-L YGLI--S--Q T--------- YI-EE---Q- EPIKSV-SRK 100

gi|23452024            -EKSYRGVRR RPWGKFAAEI RDSTRNGVRV WLGTFDSAED AALAYDQAAF 136
gi|57012702            SEKSYRGVRR RPWGKFAAEI RDSTRNGIRV WLGTFESAEE AALAYDQAAF 127
CeresClone:21068       SEKSYRGVRR RPWGKFAAEI RDSTRNGIRV WLGTFESAEE AALAYDQAAF 138
gi|21554205            SEKSYRGVRR RPWGKFAAEI RDSTRNGIRV WLGTFESAEE AALAYDQAAF 127
Lead-CeresClone664365  NKSSFRGVRS RPWGKFAAEI RDSTRHGVRV WLGTFDSAEA AALAYDQAAF 108
CeresClone:664365      NKSSFRGVRS RPWGKFAAEI RDSTRHGVRV WLGTFDSAEA AALAYDQAAF 108
gi|50920293            QQQAFRGVRK RPWGKFAAEI RDSTRNGVRV WLGTFDSAEE AALAYDQAAF  66

Consensus              NEKSYRGVRR RPWGKFAAEI RDSTRNGVRV WLGTFDSAEE AALAYDQAAF 150

gi|23452024            SMRGNSAILN FPVETVRDSL RDMKCHVD-- DDCSPVVALK KRHSMRKRST 184
gi|57012702            SMRGSSAILN FSAERVQESL SEIKYTYE-- DGCSPVVALK RKHSMRRRMT 175
CeresClone:21068       SMRGSSAILN FSAERVQESL SEIKCTYE-- DGCSPVVALK RKHSMRRRMT 186
gi|21554205            SMRGSSAILN FSAERVQESL SEIKCTYE-- DGCSPVVALK RKHSMRRRMT 175
Lead-CeresClone664365  SMRGSAAVLN FPVEKVKESL RDMNCTLSQL DGSSPVVALK RRHSLGRKMA 158
CeresClone:664365      SMRGSAAVLN FPVEKVKESL RDMNCTLSQL DGSSPVVALK RRHSLGRKMA 158
gi|50920293            AMRGSAAVLN FPMEQVRRSM D--MSLLQ-- EGASPVVALK RRHSMRAAAA 112

Consensus              SMRGSSAILN FPVERVQESL ---KCTLE-- DGCSPVVALK RRHSMRRRMT 200
```

```
gi|23452024              NSKKVNSI SK VVREVKMENV NNVVVFEDLG ADYLEOLLSS S-SSDOSSCD 233
gi|57012702              NKKTKDS-DF DHRSVKLD-- -NVVVFEDLG EQYLEELLGS S----ENSGT 217
CeresClone:21068         NKKTKDS-DF DHRSVKLD-- -NVVVFEDLG EQYLEELLGS S----ENSGT 228
gi|21554205              NKKTKDS-DF DHRSVKLD-- -NVVVFEDLG EQYLEELLGS S----ENSGT 217
Lead-CeresClone664365    AKKKKVE-E- THGDVRLE-- -NVVVLEDLG AEYLEHLLMM S-SHDTTSCS 202
CeresClone:664365        AKKKKVE-E- THGDVRLE-- -NVVVLEDLG AEYLEHLLMM S-SHDTTSCS 202
gi|50920293              GRRRKSA--- APAPADQEGG GGVMELEDLG PDYLEELLAA SQPI DI TCCT 159

Consensus                NKKKK-S-D- -HR-VKLE-- -NVVVFEDLG --YLEELL-S S---DE-SCT 250

gi|23452024              ATYFSPW  240
gi|57012702              ------W  218
CeresClone:21068         ------W  229
gi|21554205              ------W  218
Lead-CeresClone664365    ------W  203
CeresClone:664365        ------W  203
gi|50920293              SPSHHSI  166

Consensus                ------W  257
```

```
CeresClone:763852        M-AMNPLSQE -HPNAWPMGV AMYTNLHYQQ YH-------- ----------  30
Lead-CeresClone660003    MSSI HHYSPE ---TTLYWTS DHQQQQQQQQ QQQQQAATWL SNSHTPRFNL  47
gi|26450255              M-SI NQYSSD FHYHSLMW-- --QQQQQQQQ HQ-------- ----------  27

Consensus                M-SI N-YS-E -H---L-W-- --QQQQQQQQ -Q-------- ----------  50

CeresClone:763852        ---------- ---------- ---YEKEHLF EKALTPSDVG KLNRLVI PKQ  57
Lead-CeresClone660003    NEDDDEEDDV VVSDKATNNL AQEQEKEAMF EKPLTPSDVG KLNRLVI PKQ  97
gi|26450255              --------NDV V--------- ---EEKEALF EKPLTPSDVG KLNRLVI PKQ  58

Consensus                --------DV V--------- ----EKEALF EKPLTPSDVG KLNRLVI PKQ  100

CeresClone:763852        HAERCFPL-- -GGD-SGEKG LLLSFDDEAG KPWRFRYSYW TSSQSYVLTK  103
Lead-CeresClone660003    HAEKYFPLDS SGGDSAAAKG LLLSFEDESG KCWRFRYSYW NSSQSYVLTK  147
gi|26450255              HAERYFPLAA AAAD-AVEKG LLLCFEDEFG KPWRFRYSYW NSSQSYVLTK  107

Consensus                HAERYFPL-- -GGD-A-EKG LLLSFEDE-G KPWRFRYSYW NSSQSYVLTK  150

CeresClone:763852        GWSRYVKEKH LEAGDVVHFE RVRGLGTGDR LFI GCRRRGD VSAPTAVAPP  153
Lead-CeresClone660003    GWSRYVKDKR LHAGDVVLFH RHR--AHPQR FFI SCTRHQP --------NPN  188
gi|26450255              GWSRYVKEKH LDAGDVVLFH RHR--SDGGR FFI GWRRRGD ----------  145

Consensus                GWSRYVKEKH L-AGDVVLFH RHR-----G-R FFI GCRRRGD --------P-  200

CeresClone:763852        PAVHVVPASG QSPREQQQHQ QPWSPMCYST SITSYPITSPAT SHAYRRSAEH  203
Lead-CeresClone660003    PPAHVSI RSS ---------- -------SYSA LPAYP----T HHHHHLPFPY  218
gi|26450255              ---------- ---------- -------SSSS SDSY-----R HVQSNASLDY  164

Consensus                P--HV---S- ---------- ------SYS- S-SYP----T HH----S--Y  250

CeresClone:763852        DHSDMHHAGE SQWDADTRSC SPASAPTRRL RLFGVNLDCA PEPEAEAVPA  253
Lead-CeresClone660003    QPHSLHAPGG GSQGQNETTP XGNSSSGRVL RLFGVNMECQ PDNDNDS-QN  267
gi|26450255              YPH------- -----AGAQAV ESQRGNSKTL RLFGVNMECQ LDSDWSE-PS  202

Consensus                -PH--H--G- ----A----- ---S---R-L RLFGVNMECQ PD-D----P-  300
```

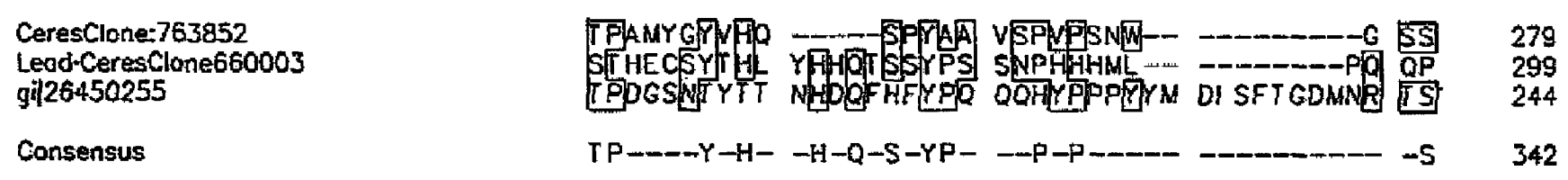

```
CeresClone:763852         TPAMYGYVHQ -----SPYAA VSPVPSNW-- ---------G SS   279
Lead-CeresClone660003     STHECSYTHL YHHQTSSYPS SNPHHHML-- --------PQ QP   299
gi|26450255               TPDGSNTYTT NHDQFHFYPQ QQHYPPPYYM DISFTGDMNR TS   244

Consensus                 TP----Y-H- -H-Q-S-YP- --P-P----- ---------- -S   342
```

```
Lead-CeresClone641355   ----MEEESK EKKKDTKEEP RYRGVRRRPW GKFAAEI RDP ARHGARVWLG   46
gi|34221729             --MESSNRSS NNQSQDDKQA RFRGVRRRPW GKFAAEI RDP SRNGARLWLG   48
gi|48479286             ---------- ---------M KYRGVRKRPW GKYAAEI RDS ARHGARVWLG   31
gi|62632035             --------ME RI ESYNTNEM KYRGVRKRPW GKYAAEI RDS ARHGARVWLG   42
gi|57012753             --MDQGGRSS GSGGGAEQG  KYRGVRRRPW GKYAAEI RDS RKHGERVWLG   48
gi|48479320             --MDQGGR-- ---GVGAEHG KYRGVRRRPW GKYAAEI RDS RKHGERVWLG   43
gi|8843894              --MDQGGR-- ---GVGAEHG KYRGVRRRPW GKYAAEI RDS RKHGERVWLG   43
gi|50948573             MDGDGGGGWD DQGNGGGETT KYRGVRRRPS GKFAAEI RDS SRQSVRVWLG   50
gi|50921987             ---------- MEDDKKEAAS KYRGVRRRPW GKFAAEI RDP ERGGSRVWLG   40
gi|52076099             -----MDHHHQ QQQQEGELVA KYRGVRRRPW GKFAAEI RDS SRHGVRVWLG   46
gi|31432356             ---------M EDNRSKDTAT KYRGVRRRPW GKFAAEI RDP ERGGARVWLG   41

Consensus               ---------- -------E-- KYRGVRRRPW GKYAAEI RDS -RHGARVWLG   50

Lead-CeresClone641355   TFLTAEEAAR AYDRAAYEMR GALAVLNFPN EYPSCSSMNS ------SSTL   90
gi|34221729             TFETAEEAAR AYDRAAFNLR GHLAI LNFPN EYYPRMDDYS LRPPYASSSS   98
gi|48479286             TFNTAEDAAR AYDRAAFGMR GQRAI LNFPH EYQMMKDGPN ---GSHENAV   78
gi|62632035             TFNTAEDAAR AYDRAAFGMR GQRAI LNFPH EYQMMKDGPN ---GSHENAV   89
gi|57012753             TFDTAEDAAR AYDRAAYSMR GKAAI LNFPH EYNMGT---- ----------   84
gi|48479320             TFDTAEEAAR AYDQAAYSMR GQAAI LNFPH EYNMGSGGSS ---------ST   85
gi|8843894              TFDTAEEAAR AYDQAAYSMR GQAAI LNFPH EYNMGSGVSS ---------ST   85
gi|50948573             TFDTAEEAAR AYDRAAYAMR GHLAVLNFPA EARNYVR--- ----------   87
gi|50921987             TFDTAEEAAR AYDRAAFAMK GAMAVLNFPG RTSSTGSSSS ---------SS   82
gi|52076099             TFDTAEEAAR AYDRSAYSMR GANAVLNFPA DAHLYARQLH -------NNNA   90
gi|31432356             TFDTAEEAAR AYDRAAYAQR GAAAVLNFPA AAAAGRGGGA ---------G   82

Consensus               TFDTAEEAAR AYDRAAYSMR G--AI LNFPH EY-M-----S ---------S-   100
```

| | | |
|---|---|---|
| Lead-CeresClone641355 | APSSSSSNSM LKSDHGKQVI EFECLDDKLL EDLLDCDDYA YEKDLPKN-- | 138 |
| gi\|34221729 | SSSSGSTSTN VSRQNQREVF EFEYLDDKVL EELLDSEERK R--------- | 139 |
| gi\|48479286 | ASSSSGYRGG GGGDDGREVI EFEYLDDSLL EELLDYGERS NQDNCNDANR | 128 |
| gi\|62632035 | ASSSSGYRGG GGGDDGREVI EFEYLDDSLL EELLDYGERS NQDNCNDANR | 139 |
| gi\|57012753 | ---GSSSTAA NSSSSSQQVF EFEYLDDSVL DELLEYGENY NKTHNINMGK | 131 |
| gi\|48479320 | AMAGSSSSSA SASSSSRQVF EFEYLDDSVL EELLEEGEKP NK------GK | 129 |
| gi\|8843894 | AMAGSSSASA SASSSSRQVF EFEYLDDSVL EELLEEGEKP NK------GK | 129 |
| gi\|50948573 | ---GSGSSSS SRQHQQRQVI ELECLDDQVL QEMLKGGDDQ YRSAAGSKRN | 134 |
| gi\|50921987 | STPPAPVTTS RHCADTTEKV ELVYLDDKVL DELL-AEDYS YRN-----NN | 126 |
| gi\|52076099 | AAGSSSSSSA AAAAARPPPI EFEYLDDHVL QEMLRDHTTN K--------- | 131 |
| gi\|31432356 | GAASGSSSSS SAQRGRGDKI EFEYLDDKVL DDLLDDEKYR GK-------- | 124 |
| Consensus | ASSSSSSSS- SA----R-VI EFEYLDD-VL EELL--GE-- -K-------- | 150 |

| | | |
|---|---|---|
| Lead-CeresClone641355 | -- | 138 |
| gi\|34221729 | -- | 139 |
| gi\|48479286 | -- | 128 |
| gi\|62632035 | -- | 139 |
| gi\|57012753 | RQ | 133 |
| gi\|48479320 | KK | 131 |
| gi\|8843894 | KK | 131 |
| gi\|50948573 | NY | 136 |
| gi\|50921987 | NY | 128 |
| gi\|52076099 | -- | 131 |
| gi\|31432356 | -- | 124 |
| Consensus | -- | 152 |

```
Lead-CeresClone572121   MRVSTEKLET EPESKKI KRI RGGGGGDSSN KHPLYRGVRM RNWGKWVSEI   50
CeresClone:1169111      M--------- ---------- ---------- ---------- RNWGKWVSEI   11
Consensus               MRVSTEKLET EPESKKI KRI RGGGGGDSSN KHPLYRGVRM RNWGKWVSEI   50

Lead-CeresClone572121   REPRKKSRI W LGTFPTPEMA ARAHDVAALS I KGSAAI LNF PHFANSLPRP   100
CeresClone:1169111      REPRKKSRI W LGTFPTPEMA ARAHDVAALS I KGPAAI LNF PHLANSLPRP   61
Consensus               REPRKKSRI W LGTFPTPEMA ARAHDVAALS I KG-AAI LNF PH-ANSLPRP   100

Lead-CeresClone572121   ASLAPRDVQA AAAKAAHMDP SSLSSLVSAM DLSSASDELS QI I ELPSLES   150
CeresClone:1169111      ASLAPRDVQA AAAKAAHMDP SSLSSLVSAM DLSSASDELS QI I ELPSLES   111
Consensus               ASLAPRDVQA AAAKAAHMDP SSLSSLVSAM DLSSASDELS QI I ELPSLES   150

Lead-CeresClone572121   TDDGSVVLEK EFVFVDSLDA WMYQPPFGFD TEQDTGFEGL MWNY   194
CeresClone:1169111      TDDGSVDLKK EFVFVDSLDA WMYQPPFGFD TEQDTGFEGL MWNY   155
Consensus               TDDGSV-L-K EFVFVDSLDA WMYQPPFGFD TEQDTGFEGL MWNY   194
```

```
CeresClone:973892          MKLSPPPLTN NEQPAADTAV KSCGGGGRET FSATRHPVY- HGVRKRRWGK  49
CeresClone:1081780         ---------M SSPSSSSSSL STSSSIS--- -KSNLAKKY- KGVRMRSWGS  36
CeresClone:1609832         ---------- -------MKP KSSEGSS--- -SSTHEPKY- KGVRLRKWGK  28
Lead-CeresClone536796      ---------- -------MMV KPSSEKP--- -EEHRDSKYY KGVRKRKWGK  29
gi|29893536                ---------- ---------- ---MEGS--- -SSSMQSKY- KGVRKRKWGK  22

Consensus                  ---------- ---------V KSS---S--- -SS----KY- KGVRKRKWGK  50

CeresClone:973892          WVSEIREPRK KSRIWLGSFP IPEMAAKAYD VAALCLKGRK A-QLNFPD--  96
CeresClone:1081780         WVSEIRAPNQ KTRIWLGSYS TAEAAARAYD AALLCLKGSS ASNLNFPEIS  86
CeresClone:1609832         WVSEIRLPNS RERIWLGSYD SPEKAARAFD AAAFCLRGHA A-KFNFPD--  75
Lead-CeresClone536796      WVSEIRLPNS RQRIWLGSFD TPEKAARAFD AAMFCLRGRN A-KFNFPD--  76
gi|29893536                WVSEIRLPNS RERIWLGSYD TPEKAARAFD AALYCLRGNN A-KFNFPD--  69

Consensus                  WVSEIRLPNS RERIWLGSYD TPEKAARAFD AALFCLRG-- A-KFNFPD-- 100

CeresClone:973892          ------EIDD LPRPSTCTAR DIQVAAAKAA NA-------- ----VKIIKT 128
CeresClone:1081780         SSLYNTNNGD NKNNINMSPK YIQRVAAAAA NADPSSSSVS TS--SPLLSS 134
CeresClone:1609832         ------QPPN IPGGRSLSSA QIQDAAARYA NSVPDETV-- ----IPMEDS 113
Lead-CeresClone536796      ------NPPD IAGGESMTPS QIQVAAAQFA NAGPHEGHSG RPEHSPMQSL 120
gi|29893536                ------NPPV ISGGRNLSRS EIREAAARFA NSAEDDSSGG AGYEIRQESA 113

Consensus                  ------NPPD I-GG---S-S -IQ-AAARFA NA-P-ES--- ----IPMESS 150

CeresClone:973892          GDDV------ ---------- ------ANIG DGDDFWEGIE LPELMMTRCG 156
CeresClone:1081780         SPSE------ ---------- ---------- ---DLYDVVS MSQY------ 149
CeresClone:1609832         TSSSI----- ----MLNDDS NYNNNSSSSN NNNNVTDYDI FPGFDDYF-- 152
Lead-CeresClone536796      SPSVSEGTVL TDSDVTTLNG SLTDLFTPVG SSGYASDYGI FPGVDDFSGG 170
gi|29893536                STSM------ ------DVDS EFLSMLPTVG SGNFASEFGL FPGFDDFSDE 151

Consensus                  S-SV------ --------D- --------VG --ND-SDY-I FPGFDDF--- 200
```

```
CeresClone:973892          MSPEPFV--- --AGDDATWL VDEDSYQYQF MACL  185
CeresClone:1081780         ---------- ---------- ---------- ----  149
CeresClone:1609832         MQPPPMVSPQ FADYDEGNSS DGDISQGPSF LWNY  186
Leod-CeresClone536796      FYVPEML--- ---------- ---------- ----  177
gi|29893536                YSGDRFREQL SPTQDYYQLG EETYADGSMF LWNF  185

Consensus                  ------V--- ----D----- ----S----F L---  234
```

```
CeresClone:703819          ---------- ---------- MCAGQPAD-- --------GS KLFVGGLAWA   20
CeresClone:1070258         ----MAVCTR F------RVL QNRNVAATSM L---RYM-ST KLFIGGLSPG   36
CeresClone:954739          ---------- ---------- ---------- --MLRYM-ST KLFIGGLSPG   17
CeresClone:971630          MHLQMAVCTK L------GVL QNRNVPVTSM L---RYM-ST KLFIGGLSPG   40
Lead-CeresClone536457      ----MAFCNK VGNVLRQGAA RSTHAPVASM LNYIRCMSSS KLFIGGLSYG   46
CeresClone:744170          ---------- ---------- ---------M LNYIRCMSSS KLFIGGLSYG   21
CeresClone:7191            ----MAFCNK LGGLLRQNIS SNGNVPVTSM LGSLRLM-ST KLFIGGLSWG   45
CeresClone:16314           ----MAFCNK LGGLLRQNIS SNGNVPVTSM LGSLRLM-ST KLFIGGLSWG   45
CeresClone:40714           ----MAFCNK LSGILRQGVS QSSNGPVTSM LGSLRYM-SS KLFVGGLSWG   45
CeresClone:18903           ----MAFCNK LSGILRQGVS HSSNGPVTSM LGSLRYM-SS KLFVGGLSWG   45

Consensus                  ----MAFCNK L---LRQ-VS -N-N-PVTSM L--LRYM-S- KLFIGGLSWG   50

CeresClone:703819          TDDHSLKEAF QCFGEVVEAR VITDRETGRS RGFGFVSFAS GEDAKSAAEN   70
CeresClone:1070258         TDDNSLKDAF STFNGVTEAR VMTNEVTGRS RGYGFVNFKI EESAKSAISA   86
CeresClone:954739          TDDQSLKDAF STFNGVTEAR VMTNKVTGRS RGYGFVNFTS EDSAKSAISA   67
CeresClone:971630          TDDQSLKDAF STFNGVTEAR VMTNKVTGRS RGYGFVNFTS EDSAKSAISA   90
Lead-CeresClone536457      VDDQSLKDAF SGFGDVVDAK VITDRDSGRS RGFGFVNFSN DESASSALSA   96
CeresClone:744170          VDDQSLKDAF SGFGDVVDAK VITDRDSGRS RGFGFVNFSN DESASSALSA   71
CeresClone:7191            TDDASLRDAF AHFGDVVDAK VIVDRETGRS RGFGFVNFND EGAATAAISE   95
CeresClone:16314           TDDASLRDAF AHFGDVVDAK VIVDRETGRS RGFGFVNFND EGAATAAISE   95
CeresClone:40714           TDDSSLKQAF TSFGEVTEAT VIADRETGRS RGFGFVSFSC EDSANNAIKE   95
CeresClone:18903           TDDSSLKQAF TSFGEVTEAT VIADRETGRS RGFGFVSFSC EDSANNAIKE   95

Consensus                  TDD-SLKDAF STFGDV-EA- VITDRETGRS RGFGFVNFS- E-SA-SAISA  100

CeresClone:703819          MDGKELAGRN VRVNSAEEEE EQTRR----- ----AKMKTI LAS----ETM  107
CeresClone:1070258         MDGQELNGCN IRVDAAKEWP SLPLSLG--- ----EGTEDE KKG----NKM  125
CeresClone:954739          MDGQELNGRN IRVDVAKEWP SLPFSSV--- ----EGTEDE KKG----NKM  106
CeresClone:971630          MDGQELNGRN IRVDVAKEWP SLPFSSV--- ----EGTEDE KKG----NKM  129
Lead-CeresClone536457      MDGKDLNGRS IRVSYANDKP SAPRP----- ----GGGGGY RGGDYDGDFA  137
CeresClone:744170          MDGKDLDGRS IRVSYANDRP SGPQSGG--- ----GGGGGY RSG-------  107
CeresClone:7191            MDGKELNGRH IRVNPANDRP SAPRAYGGGG GYSGGGGGGY GGG-GGSYGG  144
CeresClone:16314           MDGKELNGRH IRVNPANDRP SAPRAYGGGG GYS-GGGGGY GGG--GGGYG  142
CeresClone:40714           MDGKELNGRQ IRVNLATERS SAPRSSF--- ----GGGGGY GGG-------  131
CeresClone:18903           MDGKELNGRQ IRVNLATERS SAPRSSF--- ----GGGGGY GGG-------  131

Consensus                  MDGKELNGRN IRVN-A-ERP SAPRS----- ----GGGGGY KGG-------  150
```

| | | | |
|---|---|---|---|
| CeresClone:703819 | EI PEEV---- | ------- | 113 |
| CeresClone:1070258 | VSRSVWKDPF | VDAFLM | 141 |
| CeresClone:954739 | VSRSVW---- | ------- | 112 |
| CeresClone:971630 | VSRSVWKDPF | ------- | 139 |
| Lead-CeresClone536457 | SRSGGW---- | ------- | 143 |
| CeresClone:744170 | GFGGGW---- | ------- | 113 |
| CeresClone:7191 | GDGGGY---- | ------- | 150 |
| CeresClone:16314 | GGGGGYGGGG | DGGGGF | 158 |
| CeresClone:40714 | -GGGGY---- | ------- | 136 |
| CeresClone:18903 | -GGGGY---- | ------- | 136 |
| | | | |
| Consensus | --GGGW---- | ------- | 166 |

```
Lead-CeresClone157547   ---------- ---------- ---------- ---------- ----------    0
CeresClone:520302       ---------- ------MSSI K LNVKQQGEPT RVLPAEETEK G-LYFLSNLD   34
CeresClone:922101       ---------- ---MAGSKVQ LMSVKRGEPT LVSPAEATPT GEQYYLSNLD   37
CeresClone:265717       ----MKENGG AVLAAGEKAP QVVVKRGEPT LVPPAEATPT GGQYYLSNLD   46
CeresClone:298205       MVVEMKENGV AAMAAGEKAP QLGVKRGEPT LVPPAEATPT GGQYYLSNLD   50

Consensus               ---------- -----AG-K-- ---VKRGEPT LV-PAEATPT G-QYYLSNLD   50

Lead-CeresClone157547   ---------- ---------- ---------- ---------- ----------    0
CeresClone:520302       QNI AVPVRTV YCFK-SGSRG NE-----DAA QVI KESLSKI LVPYYPMAGT   78
CeresClone:922101       QNI AVI VQTV YCFKCPSGRG NE-----GAA DALRAALARV LVHYHPLAGR   82
CeresClone:265717       QNI AVI VQTV YCYKPSG--G GG-----DVA AALRDALARV LVHYYPLAGR   89
CeresClone:298205       QNI AVI VQTV YCYKPSSPPG GGEGKDVDVA AALRDALARV LVHYHPLAGR  100

Consensus               QNI AVI VQTV YC-K-S---G -------D-A -ALRDALARV LVHY-PLAGR  100

Lead-CeresClone157547   ---------- ---------- ---------- ---------- ----------    0
CeresClone:520302       LRI SEEEKLI VDNPGEGAVF VEAEADFDI E EI GDLTKPDP DALGKLVYYV  128
CeresClone:922101       LGI SPEMKLI VECTGEGVPF VEAEAACDLA LI GDLSTPDP AALGQLVYSV  132
CeresClone:265717       LGVSPEMKLT VELTGEGAVF VEADAACELA TVGDLTKPDP AALGQLVYSV  139
CeresClone:298205       LGVSPEMKLT VELTGEGAVF VEADAACDLA AVGDLTKPDP AALGQLVYSV  150

Consensus               LG-SPEMKL- VE-TGEGAVF VEA-AACDLA --GDLTKPDP AALGQLVYSV  150

Lead-CeresClone157547   ---------- ---------- ---------M NHNMFDGI AA MEFLNSWAET   21
CeresClone:520302       PGAPSI LEMP LMTVQVTKFK CGGFTLGLCM IHCMKDGLCA MEFVNAWSQT  178
CeresClone:922101       PGAKSI LEMP PMTAQVTRFE CGGFSI GLAM NHCMFDGLGA MEFVNSWXEM  182
CeresClone:265717       PGAKHI LEMP PMTAQVTRFK CGGFALGLAM NHCMFDGI GA MEFVNSWAET  189
CeresClone:298205       PGAKHI LEMP PMTAQVTRFK CGGFALGLAM NHCMFDGI GA MEFVNSWAET  200

Consensus               PGAK-I LEMP PMTAQVTRFK CGGF-LGLAM NHCMFDGI GA MEFVNSWAET  200
```

```
Lead-CeresClone157547  ARGL-PLSVP PFLDRTLLRP RTPPKIEFPH NEFEDLEDIS GTGKLYSDEK   70
CeresClone:520302      ARGL-NLKTP PFLDRTIIKA RDPPKIEFQH TEFAEIEDIS NTKKLYEEEN  227
CeresClone:922101      ARGATELTVP PFLDRSVLRA RDPPVISNPH HEFEEIADVS EMAALYGGQE  232
CeresClone:265717      ARGVAELTVP PFLDRSVLKA RDPPVHTFPH HEFAEIPDVS DTAALYGAQE  239
CeresClone:298205      ARGVAELTVP PFLDRSVLKA RDPPVPTFPH HEFAEIPDVS DTAALYGAQE  250

Consensus              ARG--ELTVP PFLDRSVLKA RDPPVITFPH HEFAEI-DVS DTAALYG-QE  250

Lead-CeresClone157547  LVYKSFLFGP EKLERLKIMA ET-----RST TFQILTGFLW RARCQALGLK  115
CeresClone:520302      MLYRSVCFDT EKLDMLKKKA TEDGVLEKCS TFEALSGFVW RARTAALGMQ  277
CeresClone:922101      LVYRSFCFDP DRLERVRGLA LADGDLERCT TFEALSGLVW RARTRALGLA  282
CeresClone:265717      LQYRSFCFDP DRLERVRGLA LADGALGRCT TFEALSGLVW RARTKALGLA  289
CeresClone:298205      LLYRSFCFDP DRLERVRGLA LADGALGRCT TFEALSGLVW RARTKALGLA  300

Consensus              L-YRSFCFDP DRLERVRGLA LADG-L-RCT TFEALSGLVW RARTKALGLA  300

Lead-CeresClone157547  PDQRLKLLFA ADGRSRFVPE LPKGYSGNGI VFTYCVITAG EVTLNPLSHS  165
CeresClone:520302      PDQQTKLLFA VDGRKRFVPP IPKGYFGNAI VLTNSLCNAG ELLKNPLSFS  327
CeresClone:922101      PEQQTKLLFA VDGRRRFVPP LPKGYFGNGI VLTNALATAG DLLSAPVSRA  332
CeresClone:265717      PGQRTKLLFA VDGRRRFVPP LPRGYFGNGI VLTNALATAG ELLSAPVSRA  339
CeresClone:298205      PEQRTKLLFA VDGRRRFAPP LPRGYFGNGI VLTNALATAG ELLSAPVSRA  350

Consensus              P-QRTKLLFA VDGRRRFVPP LPKGYFGNGI VLTNALATAG ELLSAPVSRA  350

Lead-CeresClone157547  VCLVKRAVEM VNDGFMRSAI DYFEVTRARP SLTATLLITS WAKLSFHTKD  215
CeresClone:520302      VGLIREAIDM VTDSYMRSAI DYFEVTRARP SLTATLLITT WTKLSFHTAD  377
CeresClone:922101      AGKVQEAVRM VTDEYMRSAV DYFEATRSRP SLASTLLITT WSRLAFNGAD  382
CeresClone:265717      AGLVQEAVRM VTDDYMRSAV DYFEATRARP SLASTLLITT WSRLEFHGAD  389
CeresClone:298205      AGLVQDAVRM VTDDYMRSAV DYFEATRARP SLASTLLITT WSRLEFHGAD  400

Consensus              AGLVQEAVRM VTDDYMRSAV DYFEATRARP SLASTLLITT WSRLSFHGAD  400
```

| | | |
|---|---|---|
| Lead-CeresClone148943 | M--------- ---------- ---------- ---------- ---------- | 1 |
| CeresClone:294527 | MALP------ PGAGAVAPAT PF--AANPCR LRRASGPPAA ALRLGPLFWP | 42 |
| gi\|37536088 | MALPVT---- TRAAPAMPFA PQPRTAGGGL LRRPSPPAAA LRI APPLFWP | 46 |
| gi\|50882170 | MAAAMALQVV AGGGCCCQRP VLGAGRRRLA AARAVASDAA AAKVS---EE | 47 |
| gi\|24111265 | MAMATH---- -FTFPFNYVV SEGSHGRRSF VRKLVRAVAS GDSVAPAI SE | 45 |
| gi\|34899608 | MAGTLQ---- VAGGCLAPLL PSRRAAAAVR PPRASGASAS AAAAAAAVEE | 46 |
| CeresClone:338088 | M TALQ---- VSGGGL-PLL FARRRRRAFR PPQAVASDAA AAAEGTARED | 45 |
| Consensus | MA--L----- ---G---P-- ---------- --RA----AA A--------E | 50 |
| Lead-CeresClone148943 | ------G--P LSVSPMGFGT WAWGNQLLWG YQTSMDDQLQ Q---AFELAL | 40 |
| CeresClone:294527 | WEKVKI G--P LSVSPMGFGT WAWGNQLLWG YQESMDNELQ D---CFNLAL | 87 |
| gi\|37536088 | WQKVKVC--P LSVSPMGFGT WAWGNQLLWG YQESMDTELQ E---CFNLAL | 91 |
| gi\|50882170 | EGKVRLGGSE VAVSKLGI GA WSWGDTTYWN DSEWDDRRLQ EAKAAFDTSI | 97 |
| gi\|24111265 | ESKVKLGGSD LKVTKLGI GV WSWGDNSYWN DFQWDDRKLK AAKGAFDTSL | 95 |
| gi\|34899608 | DGKVRLGGSD VAVTKLGI GA WSWGDTTYWN EFQWDDRKLK AAKGAFDASV | 96 |
| CeresClone:338088 | GGKVALGGSG VSVTKLGVGA WSWGDTTYWN EFRWDDTKLK AAKGAFDASI | 95 |
| Consensus | --KVKLGGS- LSVSKMGI G- WSWGD-TYWN ---WDD-KLQ EAK-AFD-SL | 100 |
| Lead-CeresClone148943 | ENGI NLFDTA DSYGTGRLNG --QSERLLGK FI KESQGLKG KQNEVVVATK | 88 |
| CeresClone:294527 | RNGI NLFDTA DSYGTGRLNG --QSERLLGK FI LEFEGRI K SPDDVVI ATK | 135 |
| gi\|37536088 | KNGI NLFDTA DSYGTGRLNG --QSERLLGK FI REYEGPMK SPDDVI I ATK | 139 |
| gi\|50882170 | DNGMTLFDTA EVYGTALM-G AVNSESLLGG FI KERQ-EK- EQ DVAVATK | 144 |
| gi\|24111265 | DNGI DFFDTA EVYGSKFSLG AI SSETLLGR FI RERK-ERY PGAEVSVATK | 144 |
| gi\|34899608 | DCGI TFFDTA EVYGAGI S-G AI NSESLLGR FI KERQ-QK- EQVEVAI ATK | 143 |
| CeresClone:338088 | DCGI TFFDTA EVYGAGVS-G AI NSESLLGR FI KERQ-RK- EQVDVAVATK | 142 |
| Consensus | DNGI NLFDTA DVYGTG-L-G AI NSESLLG- FI KERQ--K- EQ-DVAVATK | 150 |
| Lead-CeresClone148943 | FAAYPWRLTS GQFVNACRAS LDRLQI DQLG I GQLHWSTAN YAPLQELVLW | 138 |
| CeresClone:294527 | FAAYPWRLTS GQFVSACKSS LERLQLDRLG I GQLHWSTAN YAPLQERALW | 185 |
| gi\|37536088 | FAAYPWRLTS GQFVSACKSS LERLQLDRLG I GQLHWSTAN YAPLQERALW | 189 |
| gi\|50882170 | FAALPWRFGR GSVLSALKKS LDRLGLSSVE LYQLHWP--- -GLWGNEGYL | 190 |
| gi\|24111265 | FAALPWRFGR ESVVTALKDS LSRLELSSVD LYQLHWP--- -GLWGNEGYL | 190 |
| gi\|34899608 | FAALPWRLGR GSVI SALKDS LSRLGVSSVE LYQLHWP--- -GI WGNEGYL | 189 |
| CeresClone:338088 | FAALPWRFGR GSVI CALKAS LDRLGVSSVE LYQLHWP--- -GI WGNEDYL | 188 |
| Consensus | FAALPWRLGR GSVVSALK-S LDRLQLSSVE LYQLHWP--- -G-WGNE-YL | 200 |

| | | | | | | | |
|---|---|---|---|---|---|---|---|
| Lead-CeresClone157547 | FGWGEPVVSG | PVGLPEKEVI | LFLPCGSDTN | YQCAAWTSWL | GYESVPRDYG | 265 |
| CeresClone:520302 | FGWGEPLCSG | PVTLPEKEVI | LFLSHGQERK | SVNVLLGLPS | SAMVI FEALM | 427 |
| CeresClone:922101 | FGWGEPTMSG | PVTLPEKEVI | LFLAHGKERK | SI NVLLGLPA | SAMDTFQEL– | 431 |
| CeresClone:265717 | FGWGEPVMSG | PVTLPEKEVI | LFLAHGKERK | SI NVLLGLPA | TAMDAFQEL– | 438 |
| CeresClone:298205 | FGWGEPVMSG | PVTLPEKEVI | LFLAHGKERK | SI NVLLGLPA | TAMDAFQEL– | 449 |
| Consensus | FGWGEPVMSG | PVTLPEKEVI | LFLAHGKERK | SI NVLLGLPA | –AMD–FQEL– | 450 |

| | | |
|---|---|---|
| Lead-CeresClone157547 | YMNH | 269 |
| CeresClone:520302 | MMQV | 431 |
| CeresClone:922101 | MDEI | 435 |
| CeresClone:265717 | VDEI | 442 |
| CeresClone:298205 | MDEI | 453 |
| Consensus | MDEI | 454 |

```
Lead-CeresClone148943   DGLVQMYEKG LVRAVGVSNY GPQQLVKIHD YLKTRGVPLC SAQVQFSLLS  188
CeresClone:294527       DGLVEMYEKG LVSAVGVSNY GPKQLLKIHS YLASRGVPLS SAQVQFSLLS  235
gi|37536088             DGLVEMYEKG LVRAVGVSNY GPKQLLKIHS HLSSRGVPLS SAQVQFSLLS  239
gi|50882170             DGLADAYEQG LVKAVGVSNY NEKRLRDAYA RMKKRGVPLA ANQVNYSLIY  240
gi|24111265             DGLGDAVEQG LVKAVGVSNY SEKRLRDAYE RLKKRGIPLA SNQVNYSLIY  240
gi|34899608             DGLGDAYEQG LVKAVGVSNY SEKRLRDAYE RLKKRGVPLA SNQVNYSLIY  239
CeresClone:338088       DGLGDAVEQG LVKAVGVSNY SEKRLRDAYE RLRKRGVPLA SNQVNYSLIY  238

Consensus               DGL-DAYEQG LVKAVGVSNY SEKRLRDAYE RLKKRGVPLA SNQVNYSLIY  250

Lead-CeresClone148943   MGKEQLEIKS ICDELGIRLI SYSPLGLGML TGKYSSSKLP TGPRSLLF-R  237
CeresClone:294527       MGDDQMELKS VCDSLGIRII AYSPLGLGML TGKYGASNLP KGPRSVLF-R  284
gi|37536088             MGDEQMELKT VCDSLGIRLI AYSPLGLGML TGKYTTSNLP SGPRSVLF-R  288
gi|50882170             RTPELNGVKA ACDELGITLI AYSPIAQGVL SGKYTPEKPP TGPRANTYTP  290
gi|24111265             RAPEQTGVKA ACDELGVTLI AYSPIAQGAL TGKYTPENPP SGPRGRIYTR  290
gi|34899608             RNPEENGVKA ACDELGITLI AYSPIAQGVL TGKYTPNNPP TGPRGRIYTP  289
CeresClone:338088       RNPEENGVKA ACDELGVTLI AYSPIAQDAL TGKYTPESPP KGPRGRIYTP  288

Consensus               R-PEQ-GVKA ACDELGITLI AYSPIAQGML TGKYTPSNPP TGPRS--YTR  300

Lead-CeresClone148943   QILPGLEPLL LALSEIAKKR GKTMPQVAIN WCICKGT-VP IPGIKSVRHV  286
CeresClone:294527       QILPGLEPLL SCLRRIAEKK GKTMPQVAIN WCMCKGT-VP IPGVKTVRHV  333
gi|37536088             QILPGLESLL TCLKRIAERK GKTMSQVAIN WCICKGT-IP IPGVKTVRHV  337
gi|50882170             EFLTKLQPLM NRIKEIGESY GKNPTQVSLN WLITCQGNVVP IPGAKNAGQA  340
gi|24111265             EFLTKLQPLL NRIKQIGENY SKTPTQIALN WLVAQGNVIP IPGAKNAEQA  340
gi|34899608             EFLTKLQPLI NRIKEIGGSY EKTPTQVVLN WLICQGNVVP IPGAKNAEQA  339
CeresClone:338088       EFLTKLQPLI NRIKEIGGSY GRTSTQVVLN WLVCQGNVVP IPGAKNAEQA  338

Consensus               EFLTKLQPLL NRIKEIGESY GKT-TQVALN WLICQGNVVP IPGAKNA-QA  350

Lead-CeresClone148943   ---------- ---------- ---------- ---------              286
CeresClone:294527       QENLGALGWR LSSAEISELE SAAMAAPRKM IQNVFQTA               371
gi|37536088             EDNLGALGWR LSPAEVSELE AAAMESPKRM VQNIFQTA               375
gi|50882170             QEFAGALGWS LTGDEVEELR SLAREI-KG- IKMPIEES               376
gi|24111265             KEFAGAIGWS LTDNEVSELR SLASEI-KPV VGFPVEYL               377
gi|34899608             REFAGALGWS LTDQEVEELR SMAREI-KPV IGFPVEKL               376
CeresClone:338088       REFAGALGWS LAPDEVEELR SMARQV-KPV IGFPVEKL               375

Consensus               -EFAGALGWS L---EV-ELR S-A-EI-K-V I--PIE--               388
```

| | | |
|---|---|---|
| Lead-CeresClone147358 | M---------- ---------- ---------- ---------- ---------- | 1 |
| CeresClone:1064362 | M---------- ---------- ---------- ---------- ---------- | 1 |
| CeresClone:1073419 | M---------- ---------- ---------- ---------- ---------- | 1 |
| CeresClone:685838 | M---------- ---------- ---------- ---------- ---------- | 1 |
| gi\|50941651 | M---------- ---------- ---------- ---------- ---------- | 1 |
| CeresClone:226155 | MYGQGPALFL GEFFPLPPLR PCRAAAAAST VRAKI RSSLS AI FGRRRQQD | 50 |
| CeresClone:1452131 | M---------- ---------- ---------- ---------- ---------- | 1 |
| CeresClone:606064 | M---------- ---------- ---------- ---------- ---------- | 1 |
| CeresClone:1502051 | M---------- ---------- ---------- ---------- ---------- | 1 |
| CeresClone:1018838 | M---------- ---------- ---------- ---------- ---------- | 1 |
| CeresClone:462970 | M---------- ---------- ---------- ---------- ---------- | 1 |
| CeresClone:393073 | M---------- ---------- ---------- ---------- ---------- | 1 |
| Consensus | M---------- ---------- ---------- ---------- ---------- | 50 |

| | | |
|---|---|---|
| Lead-CeresClone147358 | ---------S GRKETVLDLA KFVDKGVQVK LTGGRQVTGT LKGYDQLLNL | 42 |
| CeresClone:1064362 | ---------S GRKETVLDLA KFVDKGVQVK LTGGRQVTGT LKGYDQLLNL | 42 |
| CeresClone:1073419 | ---------S GRKETVLDLA KFVDKGVQVK LTGGRQVTGT LKGYDQLLNL | 42 |
| CeresClone:685838 | ---------S GRKETVLDLA KFVDKGI QVK LTGGRQVTGT LKGYDQLLNL | 42 |
| gi\|50941651 | ---------S GRKETVLDLA KFVDKGVQVK LTGGRQVTGT LKGYDQLLNL | 42 |
| CeresClone:226155 | LREGFRVEMA GRKETALDLA KFVDKGVQVK LTGGRQVTGT LKGYDQLLNL | 100 |
| CeresClone:1452131 | ---------A GRKETALDLA KFVDKGVQVK LTGGRQVTGT LKGYDQLLNL | 42 |
| CeresClone:606064 | ---------A GRKETALDLA KFVDKGVQVK LTGGRQVTGT LKGYDQLLNL | 42 |
| CeresClone:1502051 | ---------A GRKETALDLA KFVDKGVQVK LTGGRQVTGT LKGYDQLLNL | 42 |
| CeresClone:1018838 | ---------A GRKETALDLA KFVDKGVQVK LTGGRQVTGT LKGYDQLLNL | 42 |
| CeresClone:462970 | ---------A GRKETALDLA KFVDKGVQVK LTGGRQVTGT LKGYDQLLNL | 42 |
| CeresClone:393073 | ---------A GRKETALDLA KFVDKGVQVK LTGGRQVTGT LKGYDQLLNL | 42 |
| Consensus | ---------A GRKETALDLA KFVDKGVQVK LTGGRQVTGT LKGYDQLLNL | 100 |

| | | | | | | |
|---|---|---|---|---|---|---|
| Lead-CeresClone147358 | VLDEAVEFVR | DHDDPLKITD | QTRRLGLIVC | RGTAVMLVSP | TDGTEEIANP | 92 |
| CeresClone:1064362 | VLDGALESVR | DHDDPLKTTD | QTRRLGLIVC | RGTAVMLVSP | TDGTEEIANP | 92 |
| CeresClone:1073419 | VLDGALESVR | DHDDPLKTTD | QTRRLGLIVC | RGTAVMLVSP | TDGTEEIANP | 92 |
| CeresClone:685838 | VLDEAIEFER | EQDDPLKLST | KTRQLGLIVC | RGTAVMLVSP | TEGTEEIKNP | 92 |
| gi\|50941651 | VLDEAVEFER | EQDDPLKLSG | KTRQLGLIVC | RGTAVMLVSP | TDGTDEIANP | 92 |
| CeresClone:226155 | VLDEAVENER | EQDDPLKLSG | KTRQLGLIVC | RGTAVMLVSP | TDGTDEIANP | 150 |
| CeresClone:1452131 | VLDEAVENER | EQDDPLKLSG | KTRQLGLIVC | RGTAVMLVSP | TDGTDEIANP | 92 |
| CeresClone:606064 | VLDEAVESER | EQDDPLKLST | KTRQLGLIVC | RGTAVMLVSP | TDGTDEIANP | 92 |
| CeresClone:1502051 | VLDEAVESER | EQDDPLKLST | KTRQLGLIVC | RGTAVMLVSP | TDGTDEIANP | 92 |
| CeresClone:1018838 | VLDEAVESER | EQDDPLKLST | KTRQLGLIVC | RGTAVMLVSP | TDGTDEIANP | 92 |
| CeresClone:462970 | VLDEAVEYER | EQDDPLKLSG | KTRQLGLIVC | RGTAVMLVSP | TDGTDEIANP | 92 |
| CeresClone:393073 | VLDEAVEYER | EQDDPLKLSG | KTRQLGLIVC | RGTAVMLVSP | TDGTDEIANP | 92 |
| Consensus | VLDEAVESER | EQDDPLKLS- | KTRQLGLIVC | RGTAVMLVSP | TDGTDEIANP | 150 |

| | | | |
|---|---|---|---|
| Lead-CeresClone147358 | FVTAEAV--- | -- | 99 |
| CeresClone:1064362 | FNQPEAV--- | -- | 99 |
| CeresClone:1073419 | FNQPEAL--- | -- | 99 |
| CeresClone:685838 | FQEADGEQTA | HS | 104 |
| gi\|50941651 | FQS-DGA--- | -- | 98 |
| CeresClone:226155 | FLA-DGA--- | -- | 156 |
| CeresClone:1452131 | FLA-DGA--- | -- | 98 |
| CeresClone:606064 | FLAAEGAS-- | -- | 100 |
| CeresClone:1502051 | FLAAEGAS-- | -- | 100 |
| CeresClone:1018838 | FLAAEGAS-- | -- | 100 |
| CeresClone:462970 | FLA-EGA--- | -- | 98 |
| CeresClone:393073 | FLA-EGA--- | -- | 98 |
| Consensus | FLA-EGA--- | -- | 162 |

```
Lead-CeresClone141890  MNTRYSNQPE LSSSNITITI SSSALLSSSP RGDNSHVAAA NGQERSPSSF  50
gi|34911538            ---------- ---------- ---------M RPPSSSATPG TGR---VSAF  18
Consensus              MNTRYSNQPE LSSSNITITI SSSALLSSS- R---S----- -G-ERS-S-F  50

Lead-CeresClone141890  YIRLAMKVSR ARWFIFLRRV FHYQNGSRSD LGSNPFNSST WMMSELIALL  100
gi|34911538            TMRAVARMSR ARWFIFLRRV YQYQNGPRSD LGSNPFNSPG WLALELGVIM  68
Consensus              --R-----SR ARWFIFLRRV --YQNG-RSD LGSNPFNS-- W---EL----  100

Lead-CeresClone141890  VQLTVITFTL AISKEERPIW PVRLWITGYD VGCLLNLMLL YGRYRQLDIN  150
gi|34911538            AQMVVTTAVV ATSPKERPAW PLRVWVAAYN VGNVLSLPLL YWRHRHSSSG  118
Consensus              -Q--V-T--- A-S--ERP-W P-R-W---Y- VG--L-L-LL Y-R-R-----  150

Lead-CeresClone141890  QGNGFVLGDV EQQQRGREET RSSHLMNKCR TSLELFFAIW FVIGNVWVFD  200
gi|34911538            ARGGTLSDDP EMHGANDPLR NRSYLMNKAR AFLELFFAMW FVMGNVWVFD  168
Consensus              ---G----D- E--------- --S-LMNK-R --LELFFA-W FV-GNVWVFD  200

Lead-CeresClone141890  SRFGSFHHAP KLHVLCVSLL AWNAICYSFP FLLFLFLCCL VPLISSLLGY  250
gi|34911538            ARLGSFHRAP RLYALCIGLL AWNAVVYSLP FLLFLLLCCF VPAVGYALGY  218
Consensus              -R-GSFH-AP -L--LC--LL AWNA--YS-P FLLFL-LCC- VP-----LGY  250

Lead-CeresClone141890  NMNMGSSDRA ASDDQISSLP SWKFKRIDDS ASDSDSDSAT VTDDPECCIC  300
gi|34911538            NMNSASVGRG ASDEQLAALP QWRFKEPADA PRDRDH---- --DDQECCIC  262
Consensus              NMN--S--R- ASD-Q---LP -W-FK---D- --D-D-DSAT VTDD-ECCIC  300

Lead-CeresClone141890  LAKYKDKEEV RKLPCSHKFH SKCVDQWLRI ISCCPLCKQD LPR  343
gi|34911538            LAQYKEKEEV RQLPCTHMFH LKCVDRWLRI ISSCPLCKQE LS-  304
Consensus              LA-YK-KEEV R-LPC-H-FH -KCVD-WLRI IS-CPLCKQ- L-R  343
```

```
gi|50921411             MAAASSFTAA AKFL-APVSA RSAGDYKPPL PLPASAS--- ----------  36
CeresClone:616282       -MAAASFTAA -KFL-APAAA RSGGDRAP-F PAPSAFS--- ----------  33
Lead-CeresClone141805   --MATAFAPT -KLT-ATVPL HGSHENRLLL PIRLAPPSS- ------FLGS  39
CeresClone:524063       ----MSFTAT -KFSPSPLPL TSTIPRSNDK PLSFSFDHSK PNPSSSFLGS  45
CeresClone:482085       ----MSLSVP -KLA-RPLPL HHHSSYGS-- -LTMSFHTFT P-----FLGS  36

Consensus               ---A-SFTA- -KF--AP-PL -S--D----- PL--SF---- ------FLGS  50

gi|50921411             -------LRP GR-KPAPRLR TALAVSSDVL PGNKAAPAAA AHSAVTREEA  78
CeresClone:616282       -------MRS LRHRPARRLS SVLAVSSDVL ---KAAPAAA AYPAVTREEA  73
Lead-CeresClone141805   TRS-LSLRRL NHSNATRR-- SPVVSVQEVV --KEKQSTNN TSLLITKEEG  84
CeresClone:524063       TRKLLRFNAL ARPHAHPRAS SSPAAAVLL- -------ERT SNLLVTKEEG  87
CeresClone:482085       THK-LRFLSP IKLNA-PRFN SSVVSVSDLF --KNNKPKST TNLLITKEEG  82

Consensus               T---L---R- -R-NA-PR-S SS-AAASDVL ---K--P--- -NLLVTKEEG  100

gi|50921411             LELYEDMVLG RLFEDMCAQM YYRGKMFGFV HLYNGQEAVS TGFIKLLNQA  128
CeresClone:616282       LELYEDMILG RNFEDMCAQM YYRGKMFGFV HLYNGQEAVS TGFIKQLNQP  123
Lead-CeresClone141805   LELYEDMILG RSFEDMCAQM YYRGKMFGFV HLYNGQEAVS TGFIKLLTKS  134
CeresClone:524063       LELYEDMILG RFFEDKCAEM YYRGKMFGFV HLYNGQEAVS TGFIKLLKKE  137
CeresClone:482085       LQLYEDMVLG RSFEDMCAQM YYRGKMFGFV HLYNGQEAVS TGFINFLKKE  132

Consensus               LELYEDMILG RSFEDMCAQM YYRGKMFGFV HLYNGQEAVS TGFIKLL-K-  150

gi|50921411             DCVVSTYRDH VHALSKGVPA RSVMAELFGK ATGCCRGQGG SMHMFSEPHN  178
CeresClone:616282       DCVVSTYRDH VHALSKGVPA RAVMAELFGK ATGCCRGQGG XMHMFSEPHN  173
Lead-CeresClone141805   DSVVSTYRDH VHALSKGVSA RAVMSELFGK VTGCCRGQGG SMHMFSKEHN  184
CeresClone:524063       DSVVSTYRDH VHALSKGVPS RQVMSELFGK ATGCCRGQGG SMHMFSKEHN  187
CeresClone:482085       DCVVSTYRDH VHALSKGVPA RAVMSELFGK ATGCSRGQGG SMHMFSKEHN  182

Consensus               DCVVSTYRDH VHALSKGVPA RAVMSELFGK ATGCCRGQGG SMHMFSKEHN  200
```

```
gi|50921411                 LLGGFAFI GE  GI PVATGAAF  AAKYRHEVLK  QSSPDGLDVT  LAFFGDGTCN   228
CeresClone:616282           LLGGFAFI GE  GI PVATGAAF  AAKYRHEVLK  QSSPDGLDVT  LAFXXXGTCN   223
Lead-CeresClone141805       MLGGFAFI GE  GI PVATGAAF  SSKYRREVLK  Q-DCD--DVT  VAFFGDGTCN   231
CeresClone:524063           LLGGFAFI GE  GI PVATGAAF  SSKYRREVLK  QADCD--HVT  LAFFGDGTCN   235
CeresClone:482085           LI GGFAFI AE  GI PVATGAAF  SSKYRREVLK  EADCD--HVT  LAFFGDGTCN   230

Consensus                   LLGGFAFI GE  GI PVATGAAF  SSKYRREVLK  Q-DCD--DVT  LAFFGDGTCN   250

gi|50921411                 NGQFFECLNM  AQLWKLPI VF  VVENNLWAI G  MSHLRATSDP  EI YKKGPAFG   278
CeresClone:616282           NGQFFECLNM  AQLWKLPI I F  VVENNLWAI G  MSHLRSTSDP  EI WKKGPAFG   273
Lead-CeresClone141805       NGQFFECLNM  AALYKLPI I F  VVENNLWAI G  MSHLRATSDP  EI WKKGPAFG   281
CeresClone:524063           NGQFYECLNM  AALWKLPI VF  VVENNLWAI G  MSHLRATSDP  QI WKKGPAFG   285
CeresClone:482085           NGQFYECLNM  AALWKLPI VF  VVENNLWAI G  MSHLRATSDP  QI WKKGPAFG   280

Consensus                   NGQFFECLNM  AALWKLPI VF  VVENNLWAI G  MSHLRATSDP  EI WKKGPAFG   300

gi|50921411                 MPGVHVDGMD  VLKVREVAKE  AI ERARRGEG  PTLVECETYR  FRGHSLADPD   328
CeresClone:616282           MPGVHVDGMD  VLKVREVAKE  AI DRARRGEG  PTLVECETYR  FRGHSLADPD   323
Lead-CeresClone141805       MPGVHVDGMD  VLKVREVAKE  AVTRARRGEG  PTLVECETYR  FRGHSLADPD   331
CeresClone:524063           MPGVHVDGMD  VLKVREVAKE  AVERARRGDG  PTLVECETYR  FRGHSLADPD   335
CeresClone:482085           MPGVHVDGMD  VLKVREVAKE  AI ERARRGEG  PTLVECETYR  FRGHSLADPD   330

Consensus                   MPGVHVDGMD  VLKVREVAKE  AI ERARRGEG  PTLVECETYR  FRGHSLADPD   350

gi|50921411                 ELRRPDEKSH  YAARDPI TAL  KKYI I EQNLA  TESELKSI EK  KI DDVVEEAV   378
CeresClone:616282           ELRRPDEKSH  YAARDPI TSL  KKYI I EQNLA  SEAELKNI EK  KI DDVVEEAV   373
Lead-CeresClone141805       ELRDAAEKAK  YAARDPI AAL  KKYLI ENKLA  KEAELKSI EK  KI DELVEEAV   381
CeresClone:524063           ELRDPAEKEH  YAGRDPI TAL  KQYLI ENNLA  NEQELKAI EK  KI DEI LEDAV   385
CeresClone:482085           ELRDPAEKAH  YAGRDPI SAL  KKYMI ENKLA  SEQELKTI DK  KI EEVVEDAV   380

Consensus                   ELRDPAEK-H  YAARDPI TAL  KKY-I ENNLA  SEAELKSI EK  KI DEVVEEAV   400
```

```
gi|50921411               EFADASPLPP RSQLLENVFS DPKGFGI GPD GKYRCEDPLF TQGTAQV   425
CeresClone:616282         EFADASPLPP RSQLLENVFA DPKGFGI GPD GKYRCEDPKF TQGTAQV   420
Lead-CeresClone141805     EFADASPQPG RSQLLENVFA DPKGFGI GPD GRYRCEDPKF TEGTAQV   428
CeresClone:524063         EFADSSPLPP RSQLLENVFA DPKGFGI GPD GRYRCEDPKF TEGTAHV   432
CeresClone:482085         EFADFSPHPP RSQLLENVFA DPKGFGI GPD GKYRCEDPKF TEGTAHV   427

Consensus                 EFADASPLPP RSQLLENVFA DPKGFGI GPD GKYRCEDPKF TEGTAQV   447
```

```
Lead-CeresClone123905   MHYPN-NRTE FVGAPAPTRY QKEQLSPEQE LSVIVSALQH VISGENETAP   49
CeresClone:1446523      -MTSRLES-- -GGFQLP--- -----NTEQE NALLLRALIS VVSGDTASAS   38
CeresClone:392659       MAAPRLER-- -GGFQLP--- -----NTEQE NSLFLRALIS VVSGDT--AA   37
CeresClone:461977       MAAPRLER-- -GGFQLP--- -----NTEQE NSLFLRALIS VVSGDT--AA   37
CeresClone:901326       -MVPRLERGG GGGFQLP--- -----NSEQE NSLFLRALIS VVSGDTAAPA   41
gi|50913081             -MVPRVERGG -GGFHLP--- -----NSERE DSLFIRALIS VVSGDTTVPT   40

Consensus               MM-PRLER-- -GGFQLP--- -----NTEQE NSLFLRALIS VVSGDT--AA   50

Lead-CeresClone123905   CQGFSSDSTV ISAGMPRLDS DTCQVCRIEG C--LGCNYFF APNQRIEKNH   97
CeresClone:1446523      LVPEAAAAEA PAA------- -AASAC---G C--PG-GCEL AA-------A   67
CeresClone:392659       LLPEAAAVEA PAA--PVA-- --CARCGADG CAAAGC-CEL VA-------G   73
CeresClone:461977       LLPEAAAVEA PAA--PVA-- --CARCGADG CAAAGC-CEL VA-------G   73
CeresClone:901326       LHPEPSNPPF AAA--AAAPV PACGRCGADG C--PG--CEF AAAAAAATTG   85
gi|50913081             LLPEPTMATV VAG--AAT-- --CARCGVDG C--IGVDCEV VVLAAAACSS   82

Consensus               LLPEAAAAEA PAA--P-A-- --CARCGADG C---GC-CEL -A-------G   100

Lead-CeresClone123905   QQEEEITSSS NRRRESSPVA KKAEGGGK-- -IRKRKNKKN GYRGVRQRPW   144
CeresClone:1446523      SSSDSDGAEC SAS------- --GGGAGK-- -RRRRRSRAS SYMGVRRRPW   105
CeresClone:392659       SSSDSDG--- ---------- GLGLAAGK-- -RRGRGRKVI QYRGVRRRPW   107
CeresClone:461977       SSSDSDDAGC SGTRANGGGL GLGLGASK-- -RRGRGRKVI QYRGVRRRPW   120
CeresClone:901326       SSSEGE--EC SAASFVR--- --NGGVGK-- --RRAGGGGS KFRGVRQRPW   124
gi|50913081             CSDEEDEGEC TTGAVASG-- GVTGGVGKRR PRRRSGGEGS RYRGVRRRPW   130

Consensus               SSS-SD-AEC S--------- GLGGGAGK-- -RRRRG-K-S QYRGVRRRPW   150

Lead-CeresClone123905   GKFAAEIRDP KRATRVWLGT FETAEDAARA YDRAAIGFRG PRAKLNFPF-   193
CeresClone:1446523      GKWAAEIRDP RRAARKWLGT FDTAEDAARA YDAAAVELRG RRAKLNFPDA   155
CeresClone:392659       GKWAAEIRDP RRAARKWLGT FDTAEDAARA YDVAAVELRG QRAKLNFPA-   156
CeresClone:461977       GKWAAEIRDP RRAARKWLGT FDTAEDAARA YDVAAVELRG QRAKLNFPAR   170
CeresClone:901326       GKWAAEIRDP HRAVRKWLGT FDTAAEAARA YDVAALEFRG HRAKLNFPAS   174
gi|50913081             GKWAAEIRDP RRAVCKWLGT FDTAEDAARA YDVAALEFRG QRAKLNFPAS   180

Consensus               GKWAAEIRDP RRAARKWLGT FDTAEDAARA YDVAAIE-RG QRAKLNFPAS   200
```

```
Lead-CeresClone123905   ---------- -----VDYTS SVSSPVAA-- ---DDLGANA SASASVSAT-   222
CeresClone:1446523      AAAAAA---- -----RDVQP --RRPLPG-Q SLRENCGSNA ASPLHVAVAR   193
CeresClone:392659       ---------- --------QP PHHRPLPDQQ SLRENSGSNA ASPVHVALA-   187
CeresClone:461977       AAAAAP---- -----AAVQP PHHRPLPD-R SLRENCGSNA ASPVHVALA-   209
CeresClone:901326       SSAASASASA SASSWAAAQP HPQRQQRP-E SPREKCGSNA SSPAHVPEQ-   222
gi|50913081             T--------- -----AAQQP ---RPLLH-H NLRENCGSNA SSPVHAPEH-   211

Consensus               -AAAA----- -----AA-QP ---RPLP--Q SLRENCGSNA -SPVHVAVA-   250

Lead-CeresClone123905   ---------- -DSVEAEQWN GGGGDCNMEW MNMMMMMDFG NGDSSDSGNT   261
CeresClone:1446523      APTTLQGTGP APPKDQDIWD G--------- LNEIMTM--- -----DDG-S   225
CeresClone:392659       ---------- -PTTQQDIWE G--------- LNEIMMM--- -----EEERS   209
CeresClone:461977       ---------- -PTTQQNIWE G--------- LNEIMMM--- -----EEERS   231
CeresClone:901326       -------GR- PVAREQEIWD G--------- LHEIMMM--- -----DDG-S   246
gi|50913081             ------ARTA AAAKDQEIWD G--------- LREIMML--- -----DDG-S   237

Consensus               ---------- -P-K-QEIWD G--------- LNEIMMM--- -----DDG-S   300

Lead-CeresClone123905   IADMFQ-   267
CeresClone:1446523      FWSMP--   230
CeresClone:392659       FWSMR--   214
CeresClone:461977       FWSMR--   236
CeresClone:901326       FWSNPKP   253
gi|50913081             FWSMP--   242

Consensus               FWSMP--   307
```

```
CeresClone:847500       MAAPYSPSPS PSHPTAAALV LLLLLLHVAL LGKCAAAAN- -------VTF   42
Lead-CeresClone119256   -------MEV NVLASKRSLL LFLLIVSLSL SQKVRHISA- ----FNDTKP   38
CeresClone:473726       ---------- -MGSSCGCGV TLVLVFCLWG VLISLSSAA- ----------   28
gi|50938543             -------MAA AAAARRGCLV ALLAVLFLAC AAEGGAAAA- SAAQQQQLR    42
CeresClone:403558       ---------- -MAAARACFV ALALVAALFV AGSAAAAAGN AGGRSQLTLR   39
CeresClone:324710       ---------- ---------- ---------- ---------- ----------    0
gi|50935081             ---------- ---MAAAWVL AAAAALALWA AAAEGARSP- ----------   26

Consensus               ---------- ---A----LV -LLLVL-L-- A----AAA-- ----------   50

CeresClone:847500       RPGEELRRYR RVQALLTRLN KPSLRTIQSP DGDLIDCVPA HLQPAFDYPR   92
Lead-CeresClone119256   YRQVSSLRLA RIQKHLNKIN KSPVFTIQSP DGDVIDCVPK RKQPALDHPL   88
CeresClone:473726       -RLSASRQKL EVAKHLNRLN KPPVKTIQSP DGDTIDCVPT SKQPAFDHPF   77
gi|50938543             RRRHLLRRQR QVHSHLRRLN KAPLASIESP DGDIIDCVHI SNQPAFDHPF   92
CeresClone:403558       QRRRQLLRQR QVRSHLKRLN KAPLATIESP DGDIIDCVHI SNQPALDHPF   89
CeresClone:324710       ---------- ---------- ---------- ---------- ----------    0
gi|50935081             --------AA RVHRHLKRLN KPAVKSIESP DGDIIDCVHL SHQPAFDHPL   68

Consensus               -R-----R-- -V--HL-RLN K-P--TI-SP DGDIIDCV-I S-QPAFDHP-  100

CeresClone:847500       LRGQR-PLGP PVRPSGHHRR PNHTA----- --DVGVQLWA VSGASCPEGS  134
Lead-CeresClone119256   LKHHKIQKAP KKMPKMKGKD DDVKEAENVL --EGAWQMWH VNGTRCPKGT  136
CeresClone:473726       LKDHKIQTRP SFHPEGLFEE NKLSEKPDAK THTPITQLWH ANG-RCPEDT  126
gi|50938543             LKNHTIQMRP DYHPEGLYDE SKVASQQNT- --QTITQMWH KNG-VCPENT  138
CeresClone:403558       LKNHTVQMRP AYHPEGLYDD ESKVASQRNA --QTITQMWH QNG-RCPEGT  136
CeresClone:324710       ---------- ---------- ---------- ----MLQMWH RNG-RCPEGT   15
gi|50935081             LKNHTLQMRP AYHPEGLYDD DKRSVASDNA GEKPMLQLWH QKG-RCPEGT  117

Consensus               LKNH-IQMRP -YHPEGLY-D D--S------ ----I-QMWH QNG-RCPEGT  150

CeresClone:847500       VPVRRFTEAD VLRASSVRRF GRV------- PMARVRRDTV AGGHEHAVGY  177
Lead-CeresClone119256   VPIRRNTMND VLRAKSLFDF GKKRRSIYLD QRTEKPDALG TNGHEHAIAY  186
CeresClone:473726       IPVRRAKEED VLRASSVKRY GRKKHRAIPK PRSAEPDLIN QSGHQHAIAY  176
gi|50938543             IPIRRTKKED VLRASSIRRY GKKKHKSTPN PMSVDPDMLN ESGHQHAIAY  188
CeresClone:403558       IPIRRTKEED VLRASSVRRY GKKKRRSAPN PMSVDPDMLN ESGHQHAIAY  186
CeresClone:324710       VPIRRTKKDD LLRASSVRRY GRKRHTA-PN PLSVDPNMLS EGGHQHAIAY   64
gi|50935081             VPIRRTKKDD LLRASSLRRY GRKRHTA-VN PLSIDPNMLN EGGHQHAIAY  166

Consensus               VPIRRTK--D VLRASSVRRY GRK-H-A-PN PMSVDPDMLN ESGHQHAIAY  200
```

```
CeresClone:847500          VA-GDEYYGA  RASI NVWAPK  VSTPIEFSLS  QI WVI GGTF-  GNDLNTI EAG   225
Lead-CeresClone119256      TESSSEIYGA  KATI NVWDPK  I EEVNEFSLS  QI WI LSGSFV  GPDLNSI EAG   236
CeresClone:473726          VE-GDKYYGA  KATLNVWEPR  I QQPNEFSLS  QLWI LGGSF-  GQDLNSI EAG   224
gi|50938543                VE-GDKYYGA  KATI NVWQPR  I EQANEFSLS  QLWI LGGSF-  GQDLNSI EAG   236
CeresClone:403558          VE-GDKYYGA  KATI NVWQPK  I EQANEFSLS  QLWI LGGSF-  GQDLNSI EAG   234
CeresClone:324710          VQ-GDKYYGA  KATI NVWEPK  I QQANEFSLS  QLWI LGGSF-  GEDLNSI EAG   112
gi|50935081                VE-GDKYYGA  KATI NVWEPK  LQQPNEFSLS  QLWI LGGSF-  GEDLNSI EAG   214

Consensus                  VE-GDKYYGA  KATI NVWEPK  I -Q-NEFSLS  QLWI LGGSF-  GQDLNSI EAG   250

CeresClone:847500          WQVSPQLYGD  NSPRFFTYWT  TDAYQITGCY  NLLCSGFVQT  NSRI AMGAAI   275
Lead-CeresClone119256      WQVSPELYGD  NRPRLFTYWT  SDSYQATGCY  NLLCSGFI QT  NNKI AI GAAI  286
CeresClone:473726          WQVSPDLYGD  NNTRLFTYWT  SDAYQATGCY  NLLCSGFI QV  NSEI AMGATI   274
gi|50938543                WQVSPDLYGD  NNTRLFTYWT  SDAYQATGCY  NLLCSGFI QI  NNQI AMGASI   286
CeresClone:403558          WQVSPDLYGD  NNTRLFTYWT  SDAYQATGCY  NLLCSGFI QI  NNQI AMGASI   284
CeresClone:324710          WQVSPDLYGD  NNTRLFTYWT  SDAYQATGCY  NMLCSGFI QI  NSEVAMGASI   162
gi|50935081                WQVSPDLYGD  NNTRLFTYWT  SDAYQATGCY  NI LCSGFI QI  NSEI AMGASI  264

Consensus                  WQVSPDLYGD  NNTRLFTYWT  SDAYQATGCY  NLLCSGFI QI  NN-I AMGASI   300

CeresClone:847500          SPITSGYKGQ  FDI SLLI WKD  PNHGNWWLEF  GSGELVGYWP  SFLFSHLASH   325
Lead-CeresClone119256      SPLSTFKGNQ  FDI TI LI WKD  PKMGNWWMGL  GDSTLVGYWP  AELFTHLADH  336
CeresClone:473726          SPVSAYRNSQ  FDI SI LI WKD  PKEGHWWMQF  GNDYVLGYWP  SFLFSYLADS  324
gi|50938543                SPLSNYGGSQ  YDI NI LVWKD  PKEGNWWLQF  GNDYVLGYWP  SFLFSYLADS   336
CeresClone:403558          FPI SNYGGSQ  YDI NI LVWKD  PKEGNWWLQF  GNDYVLGYWP  SFLFSYLADS  334
CeresClone:324710          FPI SNYAGSQ  YDI SI LI WKD  PKEGNWWMQF  GKEYVLGYWP  SFLFSYLADS  212
gi|50935081                FPI SN AGSQ  YDI SI LI WKD  PKEGNWWMQF  GREYVLGYWP  SFLFSYLVDS  314

Consensus                  SPI SNY-GSQ  YDI SI LI WKD  PKEGNWWMQF  GNDYVLGYWP  SFLFSYLADS  350

CeresClone:847500          ASMVQFGGKV  VDTRAEGSHT  ATQMGSGHFP  GEGFGRSSYF  RNLEVVQWDN   375
Lead-CeresClone119256      ATIVEWGGEV  VNTRASGRHT  TTQMGSGHFP  DEGFGKASYF  RNLEVVDSDN   386
CeresClone:473726          ASMI EWGGEV  VNSEPDGQHT  STQMGSGHFP  EEGFGKASYF  RNI QVVDSSN  374
gi|50938543                ASMI EWGGEV  VNSEPDGSHT  STQMGSGHFP  EEGFGKSSYF  KNI QVVDSSN  386
CeresClone:403558          ASMI EWGGEV  VNSEPDGSHT  STQMGSGHFP  EEGFGKASYF  RNVQVVDSTN   384
CeresClone:324710          ASMI EWGGEV  VNSEPDGTHT  STQMGSGHFP  EEGFSKASYF  KNVQVVYSSN   262
gi|50935081                ASMVEWGGEV  VNSEPDGTHT  STQMGSGRFP  EEGFGKASYF  KNI QVVDSSN   364

Consensus                  ASMI EWGGEV  VNSEPDGSHT  STQMGSGHFP  EEGFGKASYF  RNI QVVDSSN  400
```

| | | | | | | |
|---|---|---|---|---|---|---|
| CeresClone:847500 | SLI PLTTFHV | TADHPNCYDI | QGGVNAVWGN | YFYYGGPGRN | VRCT | 419 |
| Lead-CeresClone119256 | SLVPVHDVKI | LAENTECYDI | KSSYSNEWGT | YFYYGGPGFN | PRCN | 430 |
| CeresClone:473726 | NLKAPKGI GT | FTEQSNCYDV | QTGSNGDWGH | YFYYGGPGKN | PNCQ | 418 |
| gi\|50938543 | NLRAPSGI GS | FTEQSNCYDV | QNGNNGDWGT | YFYYGGPGKN | PNCP | 430 |
| CeresClone:403558 | NLKAPRGVGT | FTEQSSCYDV | QDGSNADWGT | YFYYGGPGKN | SNCP | 428 |
| CeresClone:324710 | QLSAPKGVGT | FTEQSNCYDV | QNGNNGDWGT | YFYYGGPGKN | SNCP | 306 |
| gi\|50935081 | QLKAPKGVGT | YTEQSNCYDV | QNGNNGDWGT | YFYYGGPGKN | SNCP | 408 |
| Consensus | NLKAPKGVGT | FTEQSNCYDV | QNGNNGDWGT | YFYYGGPGKN | -NCP | 444 |

```
CeresClone:949174        MKVVAAFLLA VLSGKASPTS ADI KDI LGSV GAEIEDADI E LLLKEVKGKD  50
Lead-CeresClone97434     MKVAAAFLLA VLGGNANPSA ENI KDI I GAV GADVDGESI E LLLKEVSGKD  50
gi|551267                MKVI AAFLLA LLGGNTSPTD EDLKSI LASV GADADDDKI E LLLSQVKGKD  50
CeresClone:415601        MKEVAAYLLA VLAGNSSPSA EDLTSI LESV GCEVDNEKME LLLSQLSGKD  50
CeresClone:524682        MKVVAAYLLA VLGGNNSPSA DVI KEI LGSV GVEADEDRI E SFLSEVKGKD  50
gi|24473796              MKVVAAYLLA VLGGNTTPSA EDLKDI LGSV GAETDDDRI Q LLLSEVKGKD  50
gi|42565379              MKVVAAYLLA VLGGNTTPSA EVI KDI LGSV GADAEDDRI E LLLSEVKGKD  50

Consensus                MKVVAAYLLA VLGGN-SPSA EDI KDI LGSV GAE-DDDRI E LLLSEVKGKD  50

CeresClone:949174        CAELI ALGRE KLASVPCGGG GVAMASAPSA GGGGGAAPAE EAKKEEKKEE  100
Lead-CeresClone97434     I AELI ASGRE KLASVPSGGG VAVSAAPSSG GGGAAAAAPA E-KKEAKKEE  99
gi|551267                I TELI ASGRE RLASVPSGGG VAVAAAACGG GGDAPAAAAE EPKKEEKSE-  99
CeresClone:415601        I TELI AAGRE KFASVPCGGG GVAVAAAAPA AGGG-GAPAA EAKKEEKVEE  99
CeresClone:524682        I VELI AAGRE KLATVPSGCG GAVAVAAAPG GGAAAAAPAA EAKKEEKVEE  100
gi|24473796              I TELI ASGRE KLASVPSGGG AVAVAAPGAG AGAA-APAAA EPKKEEKVEE  99
gi|42565379              I TELI ASGRE KFASVPSGGA AI AVSAPAAG GGAAPAAAAA ETKKEEKVEE  100

Consensus                I TELI ASGRE KLASVPSGGG -VAVAAAA-G GG-A-AAAAA E-KKEEKVEE  100

CeresClone:949174        KEESDDDMGF SLFE--  114
Lead-CeresClone97434     KEESDDDMGF SLFE--  113
gi|551267                -EESDEELGF SLFDDN  114
CeresClone:415601        KEESDDDMGF SLFD--  113
CeresClone:524682        KEESDDDMGF SLFD--  114
gi|24473796              KEDTDDDMGF SLFD--  113
gi|42565379              KEESDEDMGF SLFD--  114

Consensus                KEESDDDMGF SLFD--  116
```

```
CeresClone:463936        MNLLNRLGFG SARAPENMDS SI PQGPDDD PAPGQQFAEF GAGCFWGVEL  50
Lead-CeresClone95135     MNILNKLGIG SSRQTNMDPS PIAQVIDDEA PAPGNQFAQF GAGCFWSVEL  50
gi|38196010              MNILNRFGLG SGGQTSTDPS PIAQGPDDDS PAPGNHFAQF AAGCFWGVEL  50
CeresClone:958836        MNILNRFGLG SGGQTSTDPS PIAQGSDDDS PAPGNHFAQF AAGCFWGVEL  50
gi|38260639              MNILNRLGLG SSGQSNMDPS PIAQGKDDDA PSPGNQFAQF GAGCFWGVEL  50
gi|38260657              MNILNRLGLG SSGQSNMDPS PIAQGNDDDA PSPGNQFAQF GAGCFWGVEL  50
gi|38260672              MNILNRLGLG SSGQTNMNPS PIAQGNDGDA PSPGNQFAQF GAGCFWGVEL  50
gi|4884035               MNILNRLGLG SSGQTNMDPS PIAQGNDDDT PAPGNQFAQF GAGCFWGVEL  50
CeresClone:31014         MNILNRLGLG SSGQTNMDPS PIAQGNDDDT PAPGNQFAQF GAGCFWGVEL  50
gi|21592658              MNILNRLGLG SSGQTNMDPS PIAQGNDDDT PAPGNQFAQF GAGCFWGVEL  50
gi|7576185               MNILNRLGLG SSGQTNMDPS PIAQGNDDDT PAPGNQFAQF GAGCFWGVEL  50

Consensus                MNILNRLGLG SSGQTNMDPS PIAQGNDDD- PAPGNQFAQF GAGCFWGVEL  50

CeresClone:463936        AFQRVPGVTK TEVGYTQGLV HNPTYEDVCT GTTNHSEVVR VQYDPKI CSY 100
Lead-CeresClone95135     AYQRVPGVTQ TEVGYSQGIT HDPSYKDVCS GTTNHAEI VR VQYDPKECSY 100
gi|38196010              AFQRLPGVTQ TEVGYAQGIT HNPSYEDVCS ETTGHAEVVR VQYDPKGCTF 100
CeresClone:958836        AFQRLPGVTQ TEVGYTQGIT HNPSYEDVCS ETTRHAEVVR VQYDPKGCTF 100
gi|38260639              AYQRVPGVTQ TEVGYTQGIV HNPSYEDICK GTTNHTEVVR VQYDPNDCSY 100
gi|38260657              AFQRVPGVTQ TEVGYTQGII DNPSYEDVCS GTTNHSEVVR VQYDPNDCSY 100
gi|38260672              AFQRVPGVTQ TEVGYTQGIV DKPSYEDVCS GTTGHAEVVR VQYDLNDCSY 100
gi|4884035               AFQRVPGVTQ TEAGYTQGTV DNPSYGDVCS GTTGHSEVVR VQYDLNDCTY 100
CeresClone:31014         AFQRVPGVTQ TEAGYTQGTV HNPSYGDVCS GTTGHSEVVR VQYDLNDCTY 100
gi|21592658              AFQRVPGVTQ TEAGYTQGTV HNPSYGDVCS GTTGHSEVVR VQYDLNDCTY 100
gi|7576185               AFQRVPGVTQ TEAGYTQGTV DNPSYGDVCS GTTGHSEVVR VQYDLNDCTY 100

Consensus                AFQRVPGVTQ TEVGYTQGIV HNPSYEDVCS GTTGHSEVVR VQYDPNDCTY 100
```

```
CeresClone:463936         ETLLDVFWAR HDPTTLNRQG NDVGTQYRSG IYYYTPEQEK AAKESLEQ--  148
Lead-CeresClone95135      QSLLDLFWSK HDPTTLNRQG NDVGTQYRSG IYFYNPEQEK LARESLER--  148
gi|38196010               ESLLDLFWSR HDPTTLNRQG NDVGTRYRSG IYFYTPEQEK LARESLER--  148
CeresClone:958836         ESLLDLFWSR HDPTTLNRQG NDVGTRYRSG IYXYXPEQEK LARESLER--  148
gi|38260639               ESLLDLFWSR HDPTTLNRQG NDVGTQYRSG IYFYTPEQEK LARASLER--  148
gi|38260657               ETLLDMFWSR HDPTTLNRQG NDVGTQYRSG IYFYTPEQEK LAHESLER--  148
gi|38260672               ESLLDLFWSR HDPTTLNRQG NDVGTQYRSG IYFYTPEQEK LARESLER--  148
gi|4884035                ESLLDLFWSR HDPTTLNRQV NDVGTHYRSG IYFYTPEQEK LARESLERHQ  150
CeresClone:31014          ESLLDLFWSR HDPTTLNRQG NDVGTQYRSG IYFYTPEQEK LARESLER--  148
gi|21592658               ESLLDLFWSR HDPTTLNRQG NDVGTQYRSG IYFYTPEQEK LARESLER--  148
gi|7576185                ESLLDLFWSR HDPTTLNRQG NDVGTQYRSG IYFYTPEQEK LARESLER--  148

Consensus                 ESLLDLFWSR HDPTTLNRQG NDVGTQYRSG IYFYTPEQEK LARESLER--  150

CeresClone:463936         QQKQLNRKIV TEILPAKKFY RAEEYHQQYL EKGGRSGFKQ SASKGCNDPI  198
Lead-CeresClone95135      HQQQVDRKVV TEILPAKKFY RAEEHHQQYL SK-------- ----------  180
gi|38196010               HQQRMERKIM TQILPAKKFY RAEEQQQQYL SKGGRYGMGQ SCAKGCTDPI  198
CeresClone:958836         HQQRMERKIM TEXLPAKXXY RAEEQQQQYX SKGGRYGMGQ SCAKGCTDPI  198
gi|38260639               HQEQLDRKIM SEILPAKKFY RAEDHQQQYL SKGGRFGLGQ STAKGCNDPI  198
gi|38260657               HQQQMERKIM TEILPAKKFY RAEEHHQQYL SKGGRFGLGQ STAKGCNDPI  198
gi|38260672               HQQQMERKIM TEILPAKKFY RAEEHHQQYL SKGGRFGLGQ STAKGCNDPI  198
gi|4884035                HQQQMERKIM TEILPAKKFY RAEEHHQQYL SKGGRFGQGQ STAKGCNDPI  200
CeresClone:31014          HQQQMERKIM TEILPAKKFY RAEEHHQQYL SKGGRFGQGQ STAKGCNDPI  198
gi|21592658               HQQQMERKIM TEILPAKKFY RAEEHHQQYL SKGGRFGQGQ STAKGCNDPI  198
gi|7576185                HQQQMERKIM TEILPAKKFY RAEEHHQQYL SKGGRFGQGQ STAKGCNDPI  198

Consensus                 HQQQMERKIM TEILPAKKFY RAEEHHQQYL SKGGRFG-GQ STAKGCNDPI  200
```

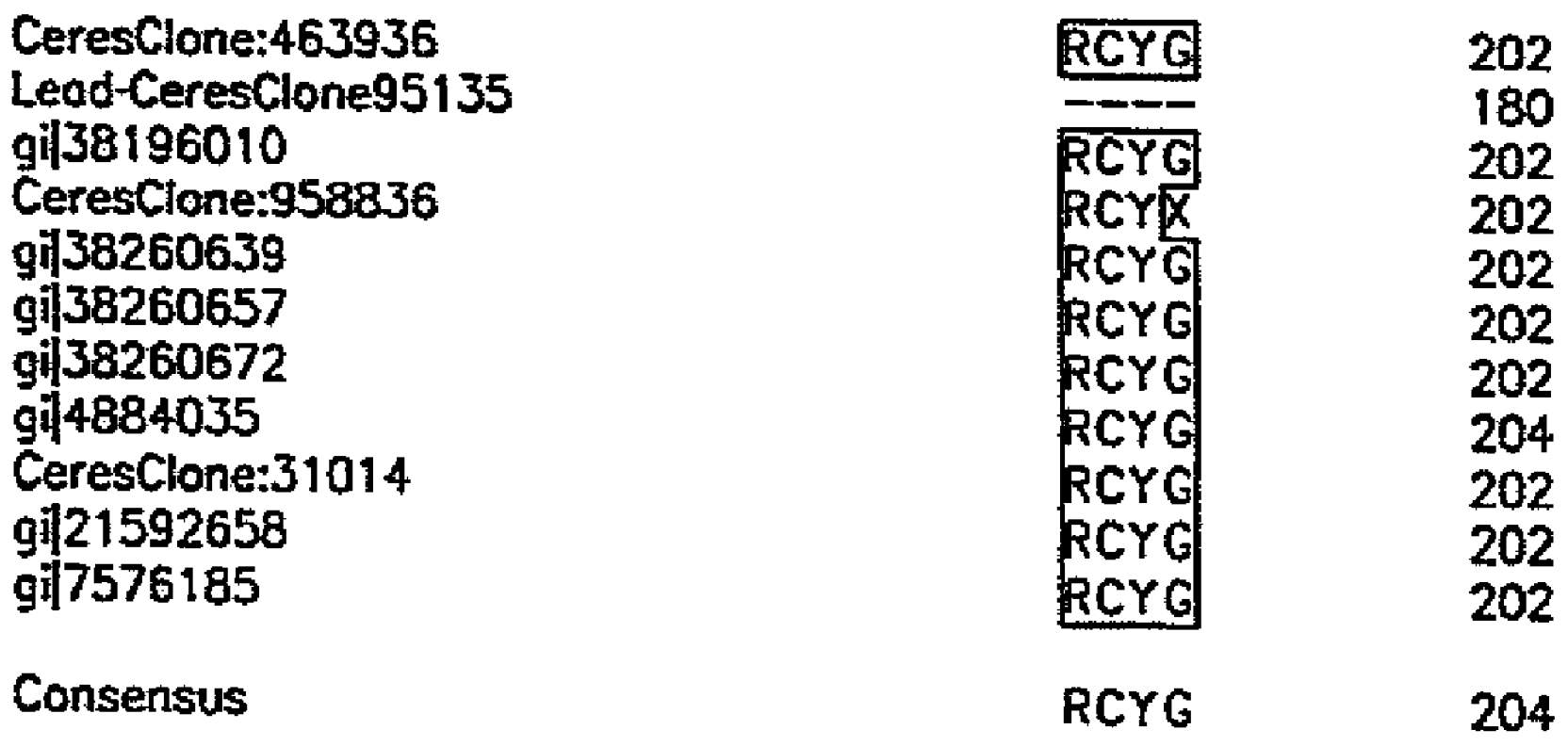

| | | |
|---|---|---|
| CeresClone:463936 | RCYG | 202 |
| Lead-CeresClone95135 | ---- | 180 |
| gi\|38196010 | RCYG | 202 |
| CeresClone:958836 | RCYX | 202 |
| gi\|38260639 | RCYG | 202 |
| gi\|38260657 | RCYG | 202 |
| gi\|38260672 | RCYG | 202 |
| gi\|4884035 | RCYG | 204 |
| CeresClone:31014 | RCYG | 202 |
| gi\|21592658 | RCYG | 202 |
| gi\|7576185 | RCYG | 202 |
| Consensus | RCYG | 204 |

```
gi|22531416           MSSENGKRLL ETDAGGLNFE A-TELTLGLP G------EPRV TSDCGAKLGS  44
gi|4887018            ------MERT ATYEKDLNLK A-TELRLGLP GI DEPEKQSS SASTSAKYSK  43
gi|4887016            ------MERT ATYEKDLNLE A-TELRLGLP GI NEPEKQSS SASTSAKYSK  43
CeresClone:612705     ------MEK- ----EAVGLE ITTELRLGLP G--------G ELPDKNEKIK  31
gi|414178             ------MAR- ----EGLGLE I-TELRLGLS C--------- ---GEPKKNEK  27
gi|416640             ------MAK- ----EGLGLE I-TELRLGLP D----AEHVA VANKNGEKKN  34
CeresClone:707989     ------MAK- ----EGLGLE I-TELRLGLP D-------AE HVTVVNKNEK  31
CeresClone:471171     ------MAK- ----EGLGLE I-TELRLGLP D-----AEHQ VSVVNKKNEK  33
gi|114733             ------MAK- ----EGLGLE I-TELRLGLP D-----AEHQ VSVVNKKNEK  33
CeresClone:121353     ------MEK- ----EGLGLE I-TELRLGLP G--------- -RDVAEKMMK  28
CeresClone:981738     ---------- ---------- ---------- ---------- -------MMK   3
Lead-CeresClone94231  ------MEK- ----EGLGLE I-TELRLGLP G--------- -RDVAEKMMK  28

Consensus             ------M-K- ----EGLGLE I-TELRLGLP G--------- ------K--K  50

gi|22531416           KRGFSETVDL KLGDNNQE-- ---VKLGHSL QEAAKSPVSK TQVVGWPPVR  89
gi|4887018            KRTSSEMDN- ---------- ----SSSGKE NEQDSAPAPK AQVVGWPPVR  78
gi|4887016            KRTSSEMDN- ---------- ----SSSGKE NEQDSAPAPK AQVVGWPPVR  78
CeresClone:612705     KRVFSEIQAH DDDEN----- ----SSSEQD RKIQT----K NQVVGWPPVC  68
gi|414178             KRMFSEIDGG VEE------- ----NGGSGD RKSVDK---K NQVVGWPPVC  63
gi|416640             KRVFSEIDDV GDENSS---- ----SGCGGD RKMEN----K NQVVGWPPVC  72
CeresClone:707989     KRAFSQIDDE N--------- ----SSSGGD RKIKTN---K SQVVGWPPVC  65
CeresClone:471171     KRAFSEIDDG VGDENS---- ----SSGGGD RKMETN---K SQVVGWPPVC  72
gi|114733             KRAFSEIDDG VGDENS---- ----SSGGGD RKMETN---K SQVVGWPPVC  72
CeresClone:121353     KMFFVQ---- ---------- ---------- ---------- ----------  34
CeresClone:981738     KRGFTEMIMT SSGSHSEQCE SSVVSSGVDV EKVNETPAVK TQVVGWPPVC  53
Lead-CeresClone94231  KRAFTEMNMT SSGSNSDQCE SGVVSSGGDA EKVNDSPAAK SQVVGWPPVC  78

Consensus             KR-FSEIDD- ----NS---- ----SSGG-D RKME-----K SQVVGWPPVC 100
```

```
gi|22531416           GFAK---RGK KSCK------ -----YVKVAV DGAPYLRKVD LEIYNSYQQL   126
gi|4887018            SYRKNVLQIK KSESDNSSGM -----YLKVSM DGGTYLRKID LKVYNSYPEL   124
gi|4887016            SYRKNVLQVK KSESDNSSGM -----YLKVSM DGGTYLRKID LKVYKSYPEL   124
CeresClone:612705     SYRK-----K NTVNE--TKM -----YVKVSM DGAPFLRKID LAMHKGYSEL   107
gi|414178             SYR------K KNMNEG-SKM -----YMKVSM DGAPYLRKID LCLHKGYLEL   102
gi|416640             SYRK-----K NSVNEA-SKM -----YVKVSM DGAPFLRKMD LGMHKGYSDL   112
CeresClone:707989     SYRK-----K NSMNEG-SKM -----YVKVSM DGAPFLRKID LGLHKGYSDL   105
CeresClone:471171     SYRK-----K NSMNEGASKM -----YVKVSM DGAPFLRKID LGLHKGYSDL   113
gi|114733             SYRK-----K NSMNEGASKM -----YVKVSM DGAPFLRKID LGLHKGYSDL   113
CeresClone:121353     ---------A STVTEH---- ----------- ---------- ----------   41
CeresClone:981738     SYRR-----K NSCKEVSTTK VGLGYVKVSM  DGVPYLRKMD LGSSQGYDDL   98
Lead-CeresClone94231  SYRK-----K NSCKEASTTK ----------- ---------- ----------   93

Consensus             SYRK-----K NSMNE-SSKM -----YVKVSM DGAP-LRKID L-LHKGY--L   150

gi|22531416           LTSLEDMFSC F-TIRNYLNE KKIDQVNGIE  YMPTYEDKDG DWMLVGDVPW   175
gi|4887018            LKALQNMFKC TIGVYTEREG ------YNGSD YAPTYEDKDG DWMLVGDVPW   169
gi|4887016            LKALQNMFKC TIGVYTEREG ------YNGSE YAPTYEDKDR DWMLVGDVPW   169
CeresClone:612705     VLALEKFFGC Y-GIREALKD ------AENAE HVPIYEDKDG DWMLVGDVPW   151
gi|414178             ALALEKLFDC C-GIEEALKD ------AENCE HVPIYEDKDG DWMLVGDVPW   146
gi|416640             AFALEKLFGC Y-GMVEALKN ------VENGE HVPIYEDKDG DWMLVGDVPW   156
CeresClone:707989     ALALDKLFGS Y-GMVEALKN ------ADNSE HVPF------ ----------   133
CeresClone:471171     ALALDKLFGC Y-GMVEALKN ------ADNSE HVPIYEDKDG DWMLVGDVPW   157
gi|114733             ALALDKLFGC Y-GMVEALKN ------ADNSE HVPIYEDKDG DWMLVGDVPW   157
CeresClone:121353     ---------- ---------- ----------- ---------- ----------   41
CeresClone:981738     AFALDKLFGF H-GIGVALKD ------GDNCE YVTIYEDKDG DWMLAGDVPW   142
Lead-CeresClone94231  ---------- ---------- ----------- ---------- ----VG----   95

Consensus             A-AL-KLFGC Y-G--EALK- ------DNSE  HVPIYEDKDG DWMLVGDVPW   200
```

| | | | | | |
|---|---|---|---|---|---|
| gi\|22531416 | QMFVESCKRL | RLMKSSEAVG | LGLKTAPKYS | STN------ | 208 |
| gi\|4887018 | DMFLNSCRRL | RIMKGSEAKG | LHAYRL---- | -------- | 195 |
| gi\|4887016 | DMFINSCRRL | RIMKGSEAKG | LHAYRLWTYR | PSN------ | 202 |
| CeresClone:612705 | EMFIESCKRL | RIMKRSDAKG | FDLQPKGSLK | GFIEGVTK | 189 |
| gi\|414178 | EMFIESCKRL | RIMKRSDAKG | FDLQPKGSLK | RFI----- | 179 |
| gi\|416640 | EMFMESCKRL | RIMKRADAKG | FGLQPKGSLK | GFIESVGK | 194 |
| CeresClone:707989 | ---------- | ---------- | ---------- | -------- | 133 |
| CeresClone:471171 | EMFMESCKRL | RIMKKSDAKG | FGLQPKGSLK | GFIESAAK | 195 |
| gi\|114733 | EMFMESCKRL | RIMKKSDAKG | FGLQPKGSLK | GFIESAAK | 195 |
| CeresClone:121353 | ---------- | ---------- | ---------- | -------H | 42 |
| CeresClone:981738 | GMFIESCRRV | RIMKRSEXTG | FGLXPXGLDE | -------- | 172 |
| Lead-CeresClone94231 | ---------- | ---------- | ---------- | -------- | 95 |
| Consensus | EMFIESCKRL | RIMKRSDAKG | F-LQP-GS-K | -------- | 238 |

| | | | | | | |
|---|---|---|---|---|---|---|
| CeresClone:599515 | ------MFLF | KPHIRKEAVM | DLVVRVGKHV | CRRNGVVTDI | KSLGKVQLGY | 44 |
| CeresClone:1074266 | MPPYDCMFLF | KPHIRKEAVM | DLVVRVGKHV | CRRNGVVLDI | KSLGRVQLGY | 50 |
| Lead-CeresClone92670 | MPLYDCMLLF | KPIIRKEGLI | DLVARIGKHV | YSRNGVLTEI | KSFGKVELGY | 50 |
| CeresClone:1259129 | ------MLLF | KPVIRKEGLI | ELVARIGKHV | YSRNGVLTEV | KSFGKVELGY | 44 |
| CeresClone:1067750 | MPLYDCMLLF | KPIIRKEGLI | DLVARIGKHV | YSKNGVLTEV | KSFGKVELGY | 50 |
| CeresClone:981652 | ------MLLF | KPVIRKEGLI | DLVARIGKHV | YSKNGVLTEV | KSFGKVELGY | 44 |
| CeresClone:260168 | MPLYDCMLLL | KITVTREVLA | ELVTRVARRA | CQRNGVVTDV | KSFGKVSLAY | 50 |
| gi\|34904072 | MPLYDCMLLV | KPLVTREAMA | ELVGRVARRA | YQRNGVVTDV | KSFGTLCLGY | 50 |
| CeresClone:894996 | M--------- | ---------- | ---------- | ---------- | ---------- | 1 |
| CeresClone:1466424 | M--------- | ---------- | ---------- | ---------- | ---------- | 1 |
| CeresClone:937515 | MPLYDCMLMV | KKLVTKEAIA | EKVARVAARA | YQRNGVVTEL | KSFGKVQLGY | 50 |
| CeresClone:685681 | MPLYDCMLMV | KPMVTKEAIA | ELVARVAARA | YQRNGVVTEL | KSFGKVHLGY | 50 |
| Consensus | MPLYDCMLLF | KP-IRKE-LI | -LVARVGKHV | YQRNGVVTEI | KSFGKVELGY | 50 |

| | | | | | | |
|---|---|---|---|---|---|---|
| CeresClone:599515 | GVKKLDGRYY | QGLLMQMSMM | ATPEINKELH | YLNKEDRLLR | --WLLVKQRN | 92 |
| CeresClone:1074266 | GVKKLDGRYY | QGLLMQMSMM | ATPEINKELH | YLNKEDRLLR | --WLLVKQRN | 98 |
| Lead-CeresClone92670 | GIRKLDGRHY | QGQLMQITMM | TTPNMNKELH | YLNKEDKLLR | --WLLVKHRD | 98 |
| CeresClone:1259129 | GIRKLDGRHY | QGQLMQITMM | ATPNMNKELH | YLNKEDKLLR | --WLLVKHRH | 92 |
| CeresClone:1067750 | GIKKLDGRHY | QGQLMQITMM | ATPNINKELH | YLNKEDKLLR | --WLLVKHRD | 98 |
| CeresClone:981652 | GIKKLDGRHY | QGQLMQITMM | ATPNINKELH | YLNKEDKLLR | --WLLVKHRD | 92 |
| CeresClone:260168 | GIRKLDGRHF | QGHLMQMTMM | VPPSFPQELH | YLNKEDRLLR | --WLVVKHRD | 98 |
| gi\|34904072 | GIKKLDGRHF | KGQLMQMTMM | VPPSFTQELH | YLNKEDRLLR | --WLVVKHRD | 98 |
| CeresClone:894996 | ---------- | -----QMTMM | VPPSLPRE-H | SLNKEDRLLR | FCWLVVKHRD | 35 |
| CeresClone:1466424 | ---------- | -----QMTMM | VPPSLPRE-H | SLNKEDRLLR | FCWLVVKHRD | 35 |
| CeresClone:937515 | GIRKLDGRHF | QGQLLQMTMM | VPPSFTQELH | YLNKEDRLLR | --WLVVKHXD | 98 |
| CeresClone:685681 | GIRKLDGRHF | QGQLLQMTMM | VPPSFTQELH | YLNKEDRLLR | --WLVVKHRD | 98 |
| Consensus | GI-KLDGRHY | QGQLMQMTMM | V-PNINKELH | YLNKEDRLLR | --WL-VKHRD | 100 |

```
CeresClone:599515        TKFGLDSYG- DEGRYELSKL SQI GK----- ------HGDE DEDEDDEEYE   130
CeresClone:1074266       TKFGLDSYG- DEGRYELSKF SQI GK----- ------HGDE DEDEDDEEYE   136
Lead-CeresClone92670     IKIGQSEK-- EDSLTVPNRL TSGSL----- ------YDGS SSDEDDNNIL   135
CeresClone:1259129       IKIGASEM-- EDRQDESSRV TNNRS----- ------L--- ----------   116
CeresClone:1067750       IKIGSSEM-- EDRLDESNRV TNRSL----- ------YDES S---------   126
CeresClone:981652        IKIGSSEM-- EDRLDESNRV TNRSL----- ------YDES STDEDDDVLG   129
CeresClone:260168        TVYGLEFLNA DGGRDELRSF SHGHTKGDYD IEIDS-DDED SDDSDDEEYA   147
gi|34904072              AVYGVEFINE DDGRREMTDF RYRTKDEASD -------VDEY DDDDDDYEYE   142
CeresClone:894996        AVYGLEFVNE DGGRNELSGF SLAHRKDDYD TELAS-DDED SDSDSDTTSM   84
CeresClone:1466424       AVYGLEFVNE DGGRNELSGF SLAHRKDDYD TELAS-DDED SDSDSDTTSM   84
CeresClone:937515        AVYGL----- ---------- ---------- ---------- ----------   103
CeresClone:685681        AVYGLEFINE DDGRYEMDSF RRKSTTTQDD EDVDEYDDDD DDDDDDDEYD   148

Consensus                --YGLE-M-- DDGRDELNRF T--------- -------DED SDD-DD----   150

CeresClone:599515        VNEEETVN-- ---------- ---------- ---------- --   138
CeresClone:1074266       VNEEETVN-- ---------- ---------- ---------- --   144
Lead-CeresClone92670     GLSR------ ---------- ---------- ---------- --   139
CeresClone:1259129       ---------- ---------- ---------- ---------- --   116
CeresClone:1067750       ---------- ---------- ---------- ---------- --   126
CeresClone:981652        LSR------- ---------- ---------- ---------- --   132
CeresClone:260168        IEEEEEEEAA NDEEKK---- ---------- ---------- --   163
gi|34904072              IDEE------ ---------- ---------- ---------- --   146
CeresClone:894996        RSRRRSRTAW LGFCSLICXG RCFS------ ---------- --   108
CeresClone:1466424       RSRRRSRTAW PGFCSFICVG RCXFWGLIEY VDFFYYYNLV VA   126
CeresClone:937515        ---------- ---------- ---------- ---------- --   103
CeresClone:685681        VQEE------ ---------- ---------- ---------- --   152

Consensus                V--------- ---------- ---------- ---------- --   192
```

```
CeresClone:963001        -------MGR KKLEIKRIEN KSSRQVTFSK RRSGLIEKAR QLSVLCDASV   43
gi|51968502              MCRKSEAMGR RRVEIKRIEN KSSRQVTFCK RRNGLMEKAR QLSILCGSSV   50
gi|2829920               -------MGR RKIEIKRIEN KSSRQVTFSK RRNGLIDKAR QLSILCESSV   43
Lead-CeresClone92459     -------MGR RKIEIKRIEN KSSRQVTFSK RRNGLIDKAR QLSILCESSV   43
CeresClone:98850         -------MGR RKIEIKRIEN KSSRQVTFSK RRNGLIDKAR QLSILCESSV   43
gi|11545547              -------MGR RKIEIKRIEN KSSRQVTFSK RRNGLIDKAR QLSILCESSV   43

Consensus                -------MGR RKIEIKRIEN KSSRQVTFSK RRNGLIDKAR QLSILCESSV   50

CeresClone:963001        ALLVVSSSGK LYSFSAGDNL VRILDRYGK- QHADDLKALN LQSKALSYGS   92
gi|51968502              ALFIVSSTGK LYNSSSGDSM AKIISRFKI- QQADDPETLD LEDKTQDYLS   99
gi|2829920               AVVVVSASGK LYDSSSVIVS TGKYKNFTIF LTIPFLHVQD LEEKIQNYLP   93
Lead-CeresClone92459     AVVVVSASGK LYDSSSGDDI SKILDRYEI- QHADELRALD LEEKIQNYLP   92
CeresClone:98850         AVVVVSASGK LYDSSSGDEI EALFKPEKP- QCFE----LD LEEKIQNYLP   88
gi|11545547              AVVVVSASGK LYDSSSGDEI EALFKPEKP- QCFE----LD LEEKIQNYLP   88

Consensus                AVVVVSASGK LYDSSSGD-I -KI-KR-KI- Q-ADDL--LD LEEKIQNYLP   100

CeresClone:963001        HNELLELVDS KLVESNVGGV SVDTLVQLEG VLENALSLTR ARKTELMLKL   142
gi|51968502              HKELLELVQR KIEEAKGDNV SIESLISMEE QLKSALSVLR ARKTELLMEL   149
gi|2829920               HKELLETVQS KLEEPNVDNV SVDSLISLEE QLETALSVSR ARKAELMMEY   143
Lead-CeresClone92459     HKELLETVQS KLEEPNVDNV SVDSLISLEE QLETALSVSR ARKAELMMEY   142
CeresClone:98850         HKELLETVQS KLEEPNVDNV SVDSLISLEE QLETALSVSR ARKAELMMEY   138
gi|11545547              HKELLETVQS KLEEPNVDNV SVDSLISLEE QLETALSVSR ARKAELMMEY   138

Consensus                HKELLETVQS KLEEPNVDNV SVDSLISLEE QLETALSVSR ARKAELMMEY   150

CeresClone:963001        VDSLKEKEKL LKEENQALAG QKEK-KNLAG AEADNMEMSP GQISDINLPV   191
gi|51968502              VKNLQDKEKL LKEKNKVLAS EVGKLKKLLE TGDERAVMSP ENSSGHSPPE   199
gi|2829920               IESLKEKEKL LREENQVLAS QMGK-NTLLA TDDERG-MFP GSSSGNKIPE   191
Lead-CeresClone92459     IESLKEKEKL LREENQVLAS QMGK-NTLLA TDDERG-MFP GSSSGNKIPE   190
CeresClone:98850         IESLKEKEKL LREENQVLAS QMGK-NTLLA TDDERG-MFP GSSSGNKIPE   186
gi|11545547              IESLKEKEKL LREENQVLAS QMGK-NTLLA TDDERG-MFP GSSSGNKIPE   186

Consensus                IESLKEKEKL LREENQVLAS QMGK-NTLLA TDDERG-MFP GSSSGNKIPE   200
```

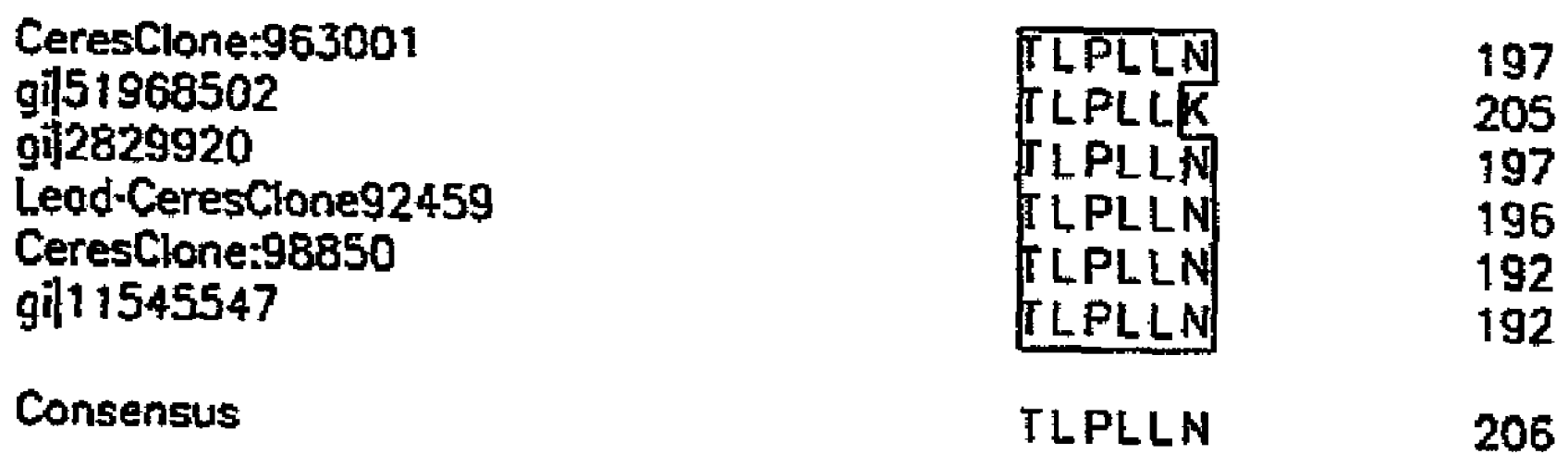

| | | |
|---|---|---|
| CeresClone:963001 | TLPLLN | 197 |
| gi\|51968502 | TLPLLK | 205 |
| gi\|2829920 | TLPLLN | 197 |
| Lead-CeresClone92459 | TLPLLN | 196 |
| CeresClone:98850 | TLPLLN | 192 |
| gi\|11545547 | TLPLLN | 192 |
| Consensus | TLPLLN | 206 |

```
gi|50934355               ---------- ---------- ---------- ---------- ----MKRSGR    6
CeresClone:297520         ---------- ---------- ---MALVKSD AEEEWSDSDF DDASDSEVAE   27
CeresClone:1197765        --------ME EVVLVTEPPP TIPPVVEYEE EHDDDDDDDL SLSSDSDIAE   42
gi|4559353                --------ME EVVLVTEPPP TIPPVVEYEE EHDDDDDDDL SLSSDSDIAE   42
Lead-CeresClone42141      -------MEE VVVVVADPPP KITTVVEYEE EL-EDDDDDL SLSSDSDIAE   42
gi|51970844               --------ME EVVVVAEPPP KITPFVEYEE EL-EDDDDDL SLSSDSDIAE   41
gi|45476407               MAEPADKLEK PQNAENEKEA AVVDEELEEE EEEEDEEGEL SMSSDSEIGE   50
CeresClone:512325         ---------- ---------- ---------- ---------- ----------    0

Consensus                 ---------E -VV-V-EPPP -I---VEYEE E--EDDDDDL SLSSDSDIAE   50

gi|50934355               TPTMP----- ---------- --MRSTGSTP RRPNAHGGVL SRP----FQP   35
CeresClone:297520         ALDWLDAVEG PDGSARPHVA FSASGGAAAA RRPNAHGGVL SRP----LQP   73
CeresClone:1197765        ALDWLDGKDD DELI------ --GGGFSLHA RRPNAHGGHG SRPNSSSLQP   84
gi|4559353                ALDWLDGKDD DELI------ --GGGFSLHA RRPNAHGGHG SRPNSSSLQP   84
Lead-CeresClone42141      ALDWLDGKDD DELI------ --GGGFSLHA RRPNAHGGHG SRPNSSALQP   84
gi|51970844               ALDWLDGKDD DELI------ --CGGFSLHA RRPNAHGGHG SRPNSSALQP   83
gi|45476407               ALDYLDTKDD SESL------ --NGAFSLQT RRPNAHGGLH SRPNSSALQP   92
CeresClone:512325         ---------- ---------- ---------- ---------- ----------    0

Consensus                 ALDWLDGKDD DELI------ --GGGFSLHA RRPNAHGGHG SRPNSSALQP  100

gi|50934355               ISNRTQKLAS HIRATPLEEW EGRMNVGMSN SVTTAIRDSI RETAIGKTRN   85
CeresClone:297520         LSNRTQKLAS HISATPLEEW EGRMNVAMSN SVTTAIRDSI RDTAIGKTRN  123
CeresClone:1197765        ISNKAQKLTS HVRASPLEGW EGRVKVGMSN SVTTAIRGSL RDTEIGRSRN  134
gi|4559353                ISNKAQKLTS HVRASPLEGW EGRVKVGMSN SVTTAIRGSL RDTEIGRSRN  134
Lead-CeresClone42141      ISNKAQKLTS HVRASPLEGW EGRVKVGMSN SVTTAIRGSL RDTEIGRSRN  134
gi|51970844               ISNKAQKLTS HVRASPLEGW EGRVKVGMSN SVTTAIRGSL RDTEIGRSRN  133
gi|45476407               LSNRTQKFSN HIRASPLEEW EGRIKVGMSN SVTTAIRGSV RDMAIGKTKT  142
CeresClone:512325         ---------- ---------- ---MNVGMSN SVTTAIRGSV RDMAIGKTKT   27

Consensus                 ISNKAQKLTS HVRASPLEGW EGRVKVGMSN SVTTAIRGSI RDT-IG-TRN  150
```

```
gi|50934355               TEKADRATVE QAI DPRTRMV LFKMLNRGVF NII NGCI STG KEANVYHASK 135
CeresClone:297520         TEKADRATVE QAI DPRTRMV LFKMLNRGVF NNI NGCI STG KEANVYHATK 173
CeresClone:1197765        TDKADRATVE QALDPRTRMV LFRMLNRGVF NDVNGCI STG KEANVYHATK 184
gi|4559353                TDKADRATVE QALDPRTRMV LFRMLNRGVF NDVNGCI STG KEANVYHATK 184
Lead-CeresClone42141      TDKADRATVE QALDPRTRMV LFRMLNRGVF NDVNGCI STG KEANVYHATK 184
gi|51970844               TDKADRATVE QALDPRTRMV LFRMLNRGVF NDVNGCI STG KEANVYHATK 183
gi|45476407               TEKADRATVE QAI DPRTRMV LFKMLNRGVF HDI NGCI STG KEANVYHATK 192
CeresClone:512325         TEKADRATVE QAI DPRTRMV LFKMLNRGVF HDI NGCI STG KEANVYHATK 77

Consensus                 T-KADRATVE QA-DPRTRMV LF-MLNRGVF ND-NGCI STG KEANVYHATK 200

gi|50934355               ADGQELAI KV YKTSVLVFKD RDRYVHGDYR FRHGYCKHNP RKMVKTWAEK 185
CeresClone:297520         TDGQELAI KV YKTSVLVFKD RDRYVQGDYR FRHGYCKHNP RKMVKTWAEK 223
CeresClone:1197765        SDGSELAI KV YKTSVLVFKD RDRYVQGDYR FRYGYCRHNP RKMVKTWAEK 234
gi|4559353                SDGSELAI KV YKTSVLVFKD RDRYVQGDYR FRYGYCRHNP RKMVKTWAEK 234
Lead-CeresClone42141      SDGSELAI KV YKTSVLVFKD RDRYVQGDYR FRYGYCRHNP RKMVKTWAEK 234
gi|51970844               SDGSELAI KV YKTSVLVFKD RDRYVQGDYR FRYGYCRHNP RKMVKTWAEK 233
gi|45476407               ADGQELAI KV YKTSVLVFKD RDRYVQGDYR FRYGYCKHNP RKMVKTWAEK 242
CeresClone:512325         SDXQELAI KV YKTSVLVXKD RDRYVQGDFX FRNGYCKHNP RKMVKTWXEK 127

Consensus                 SDG-ELAI KV YKTSVLVFKD RDRYVQGDYR FRYGYC-HNP RKMVKTWAEK 250

gi|50934355               EMRNLLRVGA AGI RCPKPLL LRLHVLVMEF I GKGGWAAPR LKDAALSDDK 235
CeresClone:297520         EMRNLLRVRA AGI RCPAPLL LRLHVLVMEF I GKGGWAAPR LKDAALSDDK 273
CeresClone:1197765        EQRNLKRLHA AGI RCPAVI L LRLHVLVMEF I GRDGWAAPR LKDAALSLDK 284
gi|4559353                EQRNLKRLHA AGI RCPAVI L LRLHVLVMEF I GRDGWAAPR LKDAALSLDK 284
Lead-CeresClone42141      EQRNLKRLHA AGI RCPAVI L LRLHVLVMEF I GRDGWAAPR LKDAALSLDK 284
gi|51970844               EQRNLKRLHA AGI RCPAVI L LRLHVLVMEF I GRDGWAAPR LKDAALSLDK 283
gi|45476407               EMRNLMRLRA AGI RCPAPLL LRLHVLVMEF I GKGGWAAPR LKDAALSLDK 292
CeresClone:512325         EMRNLMRLKA AGI RCPTPYL LRLHVLVMEF I GKSGWAAPR LKDAALSLDK 177

Consensus                 E-RNL-RLHA AGI RCPA-I L LRLHVLVMEF I G-DGWAAPR LKDAALSLDK 300
```

```
gi|50934355              LRESYFELII TMRTLYQKCK LVHGDLSEYN ILYFEGHLYI IDVSQSVDLD  285
CeresClone:297520        LHESYFEIIT TMRTLYQTCK LVHGDLSEYN ILYFEGHLYI IDVSQSVDLD  323
CeresClone:1197765       LRECYLELII QMRVLYQKCK LVHGDLSEYN ILYFEGHLYI IDVSQSVDLD  334
gi|4559353               LRECYLELII QMRVLYQKCK LVHGDLSEYN ILYFEGHLYI IDVSQSVDLD  334
Lead-CeresClone42141     LRECYLELII QMRVLYQKCK LVHGDLSEYN ILYFEGHLYI IDVSQSVDLD  334
gi|51970844              LRECYLKLII QMRVLYQKCK LVHGDLSEYN ILYFEGHLYI IDVSQSVDLD  333
gi|45476407              LRECYVEIIM AMRTLYQKCK LVHGDLSEYN ILYYEGHLYV IDVSQSVDLD  342
CeresClone:512325        LREGYVEIII AMRTLYQKCK LVHGDLSEYN ILYFEGHLYI IDVSQAVDPE  227

Consensus                LRECYLELII QMR-LYQKCK LVHGDLSEYN ILYFEGHLYI IDVSQSVDLD  350

gi|50934355              HPSALEFLKE DCLHVTDFFK KRGVAVMSVT ELFNFVIDQN IADEDVDHYL  335
CeresClone:297520        HPSALDFLKE DCLHVSDFFK KRGVPVMTVT DLFNFVIDQS ISDEDVDDYL  373
CeresClone:1197765       HPLALNFLRE DCDHVSDFFK KHGVAVMTIR ELFDFIVDPA ITDENVDSYL  384
gi|4559353               HPLALNFLRE DCDHVSDFFK KHGVAVMTIR ELFDFIVDPA ITDENVDSYL  384
Lead-CeresClone42141     HPLALNFLRE DCDHVSDFFK KHGVAVMTIR ELFDFIVDPT ISDENVDSYL  384
gi|51970844              HPLALNFLRE DCDHVSDFFK KHGVAVMTIR ELFDFIVDPT ISDENVDSYL  383
gi|45476407              HPHALDFLRE DCVHVSDFFK KHGVAVMTIR ELFDFIVDPT IDDDSVDSYL  392
CeresClone:512325        HPHALDFLRE DCVHVSDFFK KHGVAVMTIR ELFEFIVDAS ITDDAVDSYL  277

Consensus                HPLALNFLRE DC-HVSDFFK KHGVAVMTIR ELFDFIVDP- I-DENVDSYL  400

gi|50934355              EKIQQKMLEN GDMVANDDEI TPTVLVQ--- --TLDYVKQC EADIVNMSLM  380
CeresClone:297520        EKAQQKILEN GGAVPNDDEI TPTVMVQ--- --TLDYVKQC EADIVNMSIM  418
CeresClone:1197765       EEVQRKVIER GE-ISVEDEI ADSVFMKSYI PKSLDAVNNP EADVAKITSG  433
gi|4559353               EEVQRKVIER GE-ISVEDEI ADSVFMKSYI PKSLDAVNNP EADVAKITSG  433
Lead-CeresClone42141     EEVQRKVIER GE-ISVEDEI ADSVFMKSYI PKSLDAVNNP EADVAKITSG  433
gi|51970844              EEVQRKVIER GE-ISVEDEI ADSVFMKSYI PKSLDAVNNP EADVAKITSG  432
gi|45476407              EKVQEKIMAR GE-MTAEEEI ADSVFIQSFI PKTLDHVKDA EADVQRIISG  441
CeresClone:512325        EEMQQKILTR GD-ISAEDEI ADSVFVQSYI PKTLEDVKNA EFDVQRITSG  326

Consensus                EEVQRKVIER GE-ISVEDEI ADSVFM-SYI PK-LDAV-NP EADVAKITSG  450
```

```
gi|50934355              QRPSFANEPT ADKLYNQ--- --PLLGFVRN KNEPTKNQQV QSEEP---LD  422
CeresClone:297520        QRSSSGYEPT ADKLYDQ--- --PLLGFVRT KNTNTEKEQG QPA------R  457
CeresClone:1197765       QDTGDMLYQT ITGLKDAL-- --PKI EEQKI EVNDEEKEEE GEE------E  473
gi|4559353               QDTGDMLYQT ITGLKDAL-- --PKI EEQKI EVNDEEKEEE GEE------E  473
Lead-CeresClone42141     QDTGDMLYQT ITGLKDAL-- --PKVDEQQI EVNAEEEE-- ---------E  468
gi|51970844              QDTGDMLYQT ITGLKDAL-- --PKVGEQQI EVNAEEEE-- ---------E  467
gi|45476407              EDTGDMYYKT ITGLKQALSG TNPSAENQQH EQNGERGPEA AAEI D---KE  488
CeresClone:512325        KDTKDLYYQT ITGLKHALSL TQPSQQKTQQ KSSPTKDSPA VSDDKSKLLE  376

Consensus                QDTGDMLYQT ITGLKDAL-- --PK-EEQQI EVN-EE-EE- --E------E  500

gi|50934355              LQNKCSSEHS ESCTSSDEDG SWHEI L-KVG PEERKAARKE NKKKVKAEKR  471
CeresClone:297520        NLVEVEEDES ESCLSSDEDD SWHEDDPKVG PEERKAARKE NKKKVKEEKR  507
CeresClone:1197765       EDGESE-EGS EEEESEEELG ---------- HEDKKAARKE HKKKVKEEKR  512
gi|4559353               EDGESE-EGS EEEESEEELG ---------- HEDKKAARKE HKKKVKEEKR  512
Lead-CeresClone42141     EEEEGSGEES EE-ESEEELG ---------- PEDKKAARKE HKKKVKEEKR  507
gi|51970844              EEEEGSGEES EE-ESEKELG ---------- PEDKKAARKE HKKKVKEEKR  506
gi|45476407              SDGELETESD DDDESDSSEG FSSDGE-KQT AAEKKTARKE NKKKVKEEKR  537
CeresClone:512325        DDAEGQSDED EDDESNXEED SPSESE-VDD PADKKAARKE VRKEN-----  420

Consensus                ED-E-E-EES EE-ESEEE-G ---E------ PEDKKAARKE HKKKVKEEKR  550

gi|50934355              EARKDKI PKA EKKKRKKMAK AKCKR  496
CeresClone:297520        EARKTKL PKA EKKKRKKMAK AKCKR  532
CeresClone:1197765       ESRKTKTPKS VKKRKKKVSK PHKTR  537
gi|4559353               ESRKTKTPKS VKKRKKKVSK PHKTR  537
Lead-CeresClone42141     ESRKTKTPKS VKKRKKKVSK PHKTR  532
gi|51970844              ESRKTKTPKS VKKRKKKVSK PHKTR  531
gi|45476407              EARKHKVPKA VKKKKKKLAK AKKYR  562
CeresClone:512325        ---------- ---------- -----  420

Consensus                ESRKTKTPKS VKKRKKKVSK PHKTR  575
```

```
CeresClone:701379      MAVEAVLEAA TMIPSPPSKE MEASSSTSEE ASALLGQAEG -WSKRKRSRR  49
gi|28849865            MAVEAVLEAS RS-SSEEEAE VIVTHGGGGG GGGGGGQVEG -WGKRKRSRR  48
gi|2058504             MALETLNSPT SATASARPLL RY-------RE EM-EPENLEQ -WAKRKRTKR  42
gi|2058506             MALETLNSPT SATASARPLL RY-------RE EM-EPENLEQ -WAKRKRTKR  42
Lead-CeresClone41439   MALEAMNTPT SSFTRIETKE DL-------MN DA---VFIEP -WLKRKRSKR  40
gi|2981169             MFLEALKSP- -TAATPTLPP RY-------ED DD-EIHNLDS -WAKGKRSKR  40
gi|7228329             MAMEALNSP- -TTATPFTP- -F-------EE PN--LSYLET PWTKGKRSKR  38
gi|55734108            MALEALNSP- -TTPTPVFQ- -Y-------EN AA-TLRYLDQ PWAKGKRSKR  39
gi|439493              MALEALNSPT -TTTPPSFQ- -F-------EN NG--LKYLES -WTKGKRSKR  38
gi|33771374            MALEALNSPT -TTTPPTFQ- -F-------EN NG-PLRYLEN -WTKGKRSKR  39
gi|33331578            MALEALNSPT GTPTPPPFQ- -F-------ES DGQQLRYIEN -WRKGKRSKR  41
gi|4666360             MALEALNSP- -TTATPVFH- -Y-------DD PS--LNYLEP -WTKRKRSKR  37
gi|7488707             MALEALNSP- -TTTAPSFP- -F-------DD PT--I----P -WAKRKRSKR  33
CeresClone:638614      MALETLNSP- -TTTAPSFP- -F-------DD PT--I----P -WAKRKRSKR  33

Consensus              MALEALNSP- -TT--P-F-- -Y------E- D---L-YLE- -W-KRKRSKR  50

CeresClone:701379      -QR------- ---------- --ALDPSEEE YLALCLLMLA HG--------  71
gi|28849865            -RR------- P--------- --QLPPSEEE YLALCLLMLA RGRRDGDD--  77
gi|2058504             -QR------- FDQSRLNQ-- --ETAPSEEE YLALCLLMLA RGSAV-----  75
gi|2058506             -QR------- FDQSRLNQ-- --ETAPSEEE YLALCLLMLA RGSAV-----  75
Lead-CeresClone41439   -QRSHSPSSS SSSPPRSRPK SQNQDLTEEE YLALCLLMLA KDQPSQTRFH  89
gi|2981169             -PR------- I--------- --DAPPTEEE YLALCLIMLA RSGTGTRTGL  71
gi|7228329             -SR------- MDQ------- --SSC-TEEE YLALCLIMLA RSGNNNDK--  68
gi|55734108            -PR------- SVEPPPPQHQ QQQQP-TEEE YLALCLIMLA RGGAPSTT--  78
gi|439493              -QR------- SME------- --RQC-TEEE YLALCLIMLA RSDGSVNN--  68
gi|33771374            -PR------- SME------- --RQP-TEEE YLALCLIMLA RSDGSANR--  69
gi|33331578            -SR------- SME------- --HQP-TEEE YLALCLIMLA RSGGSVNH--  71
gi|4666360             -TR------- L--------- --DSPHTEEE YLAFCLIMLA RGRVASANRR  68
gi|7488707             -SR------- ---------- --DHP-SEEE YLALCLIMLA RGGTITVN--  60
CeresClone:638614      CSR------- ---------- --DHP-SEEE YLALCLIMLA RGGTI-----  58

Consensus              --R------- --E------- ----P-TEEE YLALCLIMLA RG--S-----  100
```

```
CeresClone:701379      --HRDSAPAA ---------- ---------AP EQQHGCSVCG KVFASYQALG  101
gi|28849865            --VAASASAA ---------- ---------AA AVEHRCSVCG KAFASYQALG  107
gi|2058504             --QSPLPPSS S--------- ---------SD HRGYKCTVCG KSFSSYQALG  106
gi|2058506             --QSPLPPSS S--------- ---------SD HRGYKCTVCG KSFSSYQALG  106
Lead-CeresClone41439   QQSQSLTPPP E--------- ---------SK NLPYKCNVCE KAFPSYQALG  122
gi|2981169             TDATTSQQPA DKKTAELPPV HKKEVATEQA EQSYKCSVCD KAFSSYQALG  121
gi|7228329             --KSDSVATP LT-------- --------TV KLSHKCSVCN KAFSSYQALG  100
gi|55734108            --TLPLPPPP QQHNIPSSSS SD------PP KLLYKCSVCD KAFSSYQALG  120
gi|439493              --SRSLPPPP LPPSVPVTSQ INATLL--EQ KNLYKCSVCG KGFGSYQALG  114
gi|33771374            --EQSLPPPP VPVMKIHAPP --------EE KMVYKCSVCG KGFGSYQALG  109
gi|33331578            --QRSL-PPP APVMKLHAPS SSSAAEEEKE KMVYKCSVCG KGFGSYQALG  118
gi|4666360             DSQSSIQIQP EATTS----- --------AT KVSYKCSVCD KAFSSYQALG  105
gi|7488707             --NRHVSPPP LQPQPQPTPD P-------ST KLSYKCSVCD KSFPSYQALG  101
CeresClone:638614      --RRVSTPPP QPTPDP---- --------ST KLSYKCSVCN KSFPSYQALG   94

Consensus              --QRSL-PPP ---------- --------S- KM-YKCSVC- KAFSSYQALG  150

CeresClone:701379      GHKASHRKPT AAPAGA--ED QKPL-----A AVAAASSSGS GEAAVSAGG-  143
gi|28849865            GHKASHRKPP PPPPPAMVDD DEVVVETKPA AIATPSSSAS GVSG--GGG-  154
gi|2058504             GHKTSHRKPA SNVNVP--IN QE-------Q SNNSHSNSNG GSVVINGNGV  147
gi|2058506             GHKTSHRKPA SNVNVP--IN QE-------Q SNNSHSNSNG GSVAINGNGV  147
Lead-CeresClone41439   GHKASHRIKP PTVIST--TA DD-------S TAPTISIVAG EKHPIAAS--  161
gi|2981169             GHKASHRKTT TTATAA--SD DN-------N PSTSTSTGAV NISALNPT--  160
gi|7228329             GHKASHRKAV MSATTA--ED QI-------T TTSSAVTTSS ASNGK-----  136
gi|55734108            GHKASHRKLS TASAGG--GD DQ-------S TTSTSTTTAA AAT-------  154
gi|439493              GHKASHRKL- --VSMG--GD EQ-------S TTSTTTNVTG TSSANVNGN-  151
gi|33771374            GHKASHRKL- VAGGGG--GD DQ-------S TTSTTTNATG TTSSANGNG-  148
gi|33331578            GHKASHRKL- ---VPG--GD DQ-------S TTSITTNATG TTTSVNGNG-  154
gi|4666360             GHKASHRKL- ---AGG--ED QS-------T SFATTNSATV TTTTASGGG-  141
gi|7488707             GHKASHRKL- ---AGA--AE DQ-------P PSTTTSSAAA TSSAS---G-  134
CeresClone:638614      GHKASHRKL- -AASGG--ED QP-------T TTSSAASSAN TASG------  127

Consensus              GHKASHRKL- ---------D D--------S T-ST-S-S-- -SS-----G-  200
```

```
CeresClone:701379     ---GKVHECN VCRKTFPTGQ ALGGHKRCHY DGTI GSA--- --------AAG  180
gi|28849865           ---GRAHECN VCGKAFPTGQ ALGGHKRCHY DGTI GSA--- --------AGA  191
gi|2058504            SQSGKI HTCS ICFKSFSSGQ ALGGHKRCHY DAGNNGNGNG SSSNSVEVVG  197
gi|2058506            SQSGKI HTCS ICFKSFSSGQ ALGGHKRCHY DAGINGNGNG SSSNSVEVVG  197
Lead-CeresClone41439  ---GKLHECS ICHKVFPTGQ ALGGHKRCHY EGNLGGG--- --------GGG  198
gi|2981169            ---GRSHVCS ICHKAFPTGQ ALGGHKRRHY EGKLGGN--- SRDLGGGGGG  204
gi|7228329            ---NKTHECS ICHKSFPTGQ ALGGHKRCHY EGSVGAG--- --------AGA  173
gi|55734108           ---GRTHECS ICHKCFPSGQ ALGGHKRCHY EGGAGAV--- ------GSTGN  193
gi|439493             ---GRTHECS ICHKCFPTGQ ALGGHKRCHY DGGNGNG--- --------NGS  188
gi|33771374           NGSGKTHECS ICHKRFPTGQ ALGGHKRCHY DGGNSNG--- ------GVSVS  190
gi|33331578           NRSGRTHECS ICHKCFPTGQ ALGGHKRCHY DGGI GNG--- ---NANSGVS  198
gi|4666360            ---GRSHECS ICHKSFPTGQ ALGGHKRCHY EGSI GGN-SI HHHNNTTNSG  187
gi|7488707            ---GKAHECS ICHKSFPTGQ ALGGHKRCHY EGNGNGN--- --------NNNS  172
CeresClone:638614     ---GRTHECS ICHKSFPTGQ ALGGHKRCHY EGNSNGN--- --------NNNS  165

Consensus             ---G--HECS ICHKSFPTGQ ALGGHKRCHY -G-I G----- ---------S  250

CeresClone:701379     PTQKLAAKAA AASATAA--- -SQGF-DLNL PALPDI PERC AVTEDG----  221
gi|28849865           GASKPAAKTT VAVAAS---- --RGF-DLNL PALPDVAAAA DQRCAAED--  232
gi|2058504            GSDGSYVDDE RSSEQSAT-G DNRGF-DLNL PA-------- ----------  227
gi|2058506            GSDGNYVDDE RSSEQSAT-G DNRGF-DLNL PA-------- ----------  227
Lead-CeresClone41439  GSKSI SHSGS VSSTVSEE-R SHRGFI DLNL PALPELSLHH NPI VD-----  242
gi|2981169            GHSGSVLTTS DGCASTHT-- -LRDF-DLNM PASPELQLGL SI DCGRKSQL  250
gi|7228329            GSNAVTASEG VGLSHSH--- -HRDF-DLNL PAFPDFSKKF --FVD-----  211
gi|55734108           AASGVTSSEG MGSTNTHS-- -NRDF-DLNL PALPEFWLAA -AAGD-----  233
gi|439493             VSVGVTSSEG VGSTISH--- -HRDF-DLNI PALPEFWPGF -GSGE-----  227
gi|33771374           ASVGLTSSEG VGSTVS---- -HRDF-DLNI PALPEFWPGF -GSGE-----  228
gi|33331578           ASVGVTSSEG VGSTVS---- -HRDF-DLNI PALPEFWLGF -GSGE-----  236
gi|4666360            SNGGMSMTSE VGSTHTVS-H SHRDF-DLNI PALPEFRSNF FI SGD-----  230
gi|7488707            NSVVTVASEG VGSTHTVSHG HHRDF-DLNI PAFPDFSTKV ---GE-----  213
CeresClone:638614     NSSVTAASEG VGSTHTVSHG HHRDF-DLNI PAFPDFSTKV ---GE-----  206

Consensus             -S-GV-ASEG VGST-S-S-- -HRDF-DLNL PALPEF---- ---G------  300
```

| | | |
|---|---|---|
| CeresClone:701379 | ----EEVLSP ASF-KKPRLM ------LAA-- ------ | 239 |
| gi\|28849865 | ----DEVLSP LAF-KKPRLM ------IPA-- ------ | 250 |
| gi\|2058504 | ----DQVAVV IS-------- ---------- ------ | 235 |
| gi\|2058506 | ----DQVAVV ISK-R----- ---------- ------ | 237 |
| Lead-CeresClone41439 | ----EEILSP LTG-KKPLLL TDHDQVKKE DLSLKI | 273 |
| gi\|2981169 | LPMVQEVESP MPA-KKPRLL ---------- --FSLG | 273 |
| gi\|7228329 | ----DEVFSP LPAAKKPCLF --------KL EIPSHY | 235 |
| gi\|55734108 | ----DEVSSP HPA-KRSRFA ------LPIKV ENHQIN | 259 |
| gi\|439493 | ----DEVESP HPA-KKSRLS ------LPPKL ELFKGL | 253 |
| gi\|33771374 | ----DEVESP HPT-KKSRLS ------LPPKF ELFRE- | 253 |
| gi\|33331578 | ----DEVESP HPA-KKSRLC ------LPPKY ELFQH- | 261 |
| gi\|4666360 | ----DEVESP HPA-KKPRIL ------MK--- ------ | 247 |
| gi\|7488707 | ----DEVESP HPVMKKPRLF ------VIPKI EIPQFQ | 240 |
| CeresClone:638614 | ----DEVESP HPVMKKPRPF ------VIPKI EIPQYQ | 233 |
| Consensus | ----DEVESP HP--KKPRL- -----L--K- EL---- | 336 |

```
Lead-CeresClone41306   MAVFKTLAFL FVLS-VIYQ  SVAVTDVNSS FSFNGFVKAP SFDNNVALFG  49
CeresClone:578942      MAPFSTSPHF TAFTFLILFL KTQAFDPLSF FSFTDFEKDP NFKSSVGLYG  50
Consensus              MA-F-T---- ----F----- -----D--S- FSF--F-K-P -F---V-L-G  50

Lead-CeresClone41306   DSKLVHGGPS  QLTDSVSRS EGRVIYKKPI RLFQGKERNF SGSFSTSFSF  99
CeresClone:578942      NAKVVNNGSE VLLSG----N GGRVIYKKPV KLVHGGAREL V-SFSTYFGF  95
Consensus              --K-V--G-- --L--SVSR- -GRVIYKKP- -L--G--R-- -GSFST-F-F  100

Lead-CeresClone41306   SMS-DEIGSV LAFIMVPRGL DLRLFGRKGN NSSSGLGFLL K----HKVVAV  145
CeresClone:578942      SMSLDSEKSG LAFVMVPSGV EGEVFG---- NSSYGLSFGL KEREFKVVGV  141
Consensus              SMSLD---S- LAF-MVP-G- ----FGRKGN NSS-GL-F-L KERE-KVV-V  150

Lead-CeresClone41306   EFGISKRGNH VG-----LV GRPESGKVRK LSSFGHHFNE EKRLNCWIDY  190
CeresClone:578942      QFSAYGRNGG SGSCIVSINV GSSVPVKTIN ASSVIMGLKS EGKLHAWIDY  191
Consensus              -F----R--- -GSCIVSI-V G------K--- -SS------- E--L--WIDY  200

Lead-CeresClone41306   EASSKRIEVR LSLSAALKPV DPFVSYSVDL AKLWKDGKFM VGLTSA-NGN  239
CeresClone:578942      EASSKRLEVR LNQYGQSRPV DPLLWHSMDL SNVWGTEEMF AGFSTVKENN  241
Consensus              EASSKR-EVR L-------PV DP----S-DL ---W------- -G----K--N  250

Lead-CeresClone41306   TSKPVYLHSW SFKLIHPSMR  HSQPLDPND VSKTVKEGEK TVEVKGKGKC  289
CeresClone:578942      TSQTCFLYSW SFIVRHFPHW MHSEPLNP-- --KVLAKKTE TPAVKSRSDC  287
Consensus              TS----L-SW SF---H---- -HS-PL-PND VSK------- T--VK----C  300

Lead-CeresClone41306    WRILGALVL GAVCGTLGAM FALYLWTICG NRQSMAIVPE ECADEKADIL  339
CeresClone:578942      LLRVLAAMIF GAGCGALTAF IVLYLWTIFG NKRP--VVPE EYAMQPVDFE  335
Consensus              --R-L-A--- GA-CG-L-A- --LYLWTI-G N---MA-VPE E-A----D--  350
```

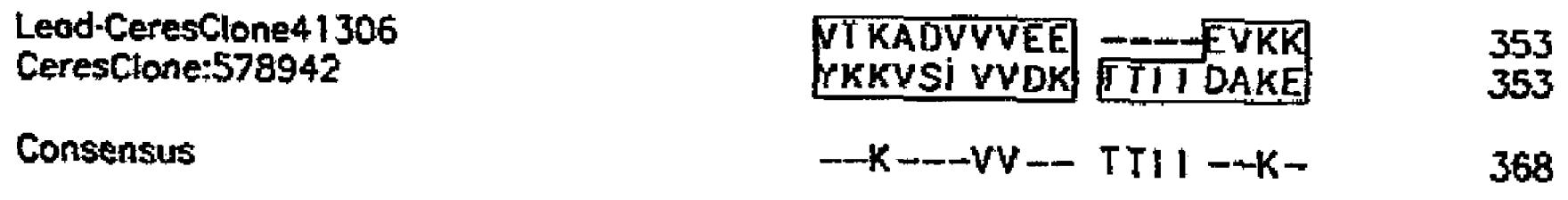

| | | |
|---|---|---|
| Lead-CeresClone41306 | VIKADVVVEE -----EVKK | 353 |
| CeresClone:578942 | YKKVSI VVDK TTII DAKE | 353 |
| Consensus | --K---VV-- TTII --K- | 368 |

```
Lead-CeresClone37288  MGRGRIEIKK IENINSRQVT FSKRRNGLIK KAKELSILCD AEVALIIFSS   50
CeresClone:523628     MGRGKIEIKK IENLNSRQVT FSKRRNGLLK KAKELSVLCD AEVAVIIFSS   50
gi|38326712           MGRGKIEIKR IDNASSRQVT FSKRRTGLFK KAQELSILCD AEVAVIVFSN   50
gi|34452081           MGRGKIDIKL IENVNNRQVT FSKRRAGLLK KANELSVLCD AEVAVIIFSS   50
gi|52789958           MGRGKIEIKR IENANSRQVT FSKRRAGLLK KAKELAILCD AEVAVIIFSN   50

Consensus             MGRGKIEIK- IEN-NSRQVT FSKRR-GLLK KAKELSILCD AEVAVIIFSN   50

Lead-CeresClone37288  TGKIYDFSSV CMEQILSRYG YTTASTEHKQ QREHQLL--- ---ICASHGN   94
CeresClone:523628     TGKLYEFSNT SMEHTLSRYS K----GAESDS A-EQPID--- -----VPPTDV   89
gi|38326712           TGKLFEFSSS GMKRTLSRYN KCLGSTDAAV A-EIKTQ--- ----------   86
gi|34452081           TGKLFEFSST SMKQTLSRYN RCLASTETSA I-EKKLEDNE QPQPLQTYVP   99
gi|52789958           TGKLFEFSSS GMNKTISRYK SAQGSPEIAQ V-EHKAE--- ----------   86

Consensus             TGKLFEFSS- -M-QTLSRYN K---STE-A- --E-KLE--- ----------  100

Lead-CeresClone37288  EAVLRNDDSM KVELERLQLA IERLKGKELE GMSFPDLISF ENQLNESLHS  144
CeresClone:523628     MAVEPDTNLL MEEITKLRSA YERMMGKELD GLSLKELQQL ENQLSEGMQS  139
gi|38326712           KEDSKMVEIL REEIAKLETK QLQLVGKDLT GLGLKELQNL EQQLNEGLLS  136
gi|34452081           KQEQKEMDIL KDELSKLKMD QLRLLGKDLS GMGLNELRLL EHQLNEGLLA  149
gi|52789958           KQDSKEADHL KDEIAKLQMK QLQLLGKNLT SMSLKELQLL EQQLNEGLLS  136

Consensus             KQD-K--DIL K-EI-KLQM- QLRLMGK-LT GMSLKELQ-L ENQLNEGLLS  150

Lead-CeresClone37288  VKDQKTQILL NQIERSRIQE KKALEENQIL RKQVEMLG-- ----RGSCPK  188
CeresClone:523628     VKDKKEQVLV EQLRKSRIQE QKAMLENEVL RKQLEEIQ-- ----NKTKSQ  183
gi|38326712           VKARK----- --LEQSRVQE QRVMLENETL RRQIEELRCL FPQSESMVP-  178
gi|34452081           IKDRKEELLI QQLEQSRRQE ERAALESETL RRQLEELRGL FPLSISLPPP  199
gi|52789958           VKEKKEQLLM QQLEQSRLQE QRAMLENETL RRQVEELRGF FPTTDHPIQP  186

Consensus             VKD-KEQIL- QQLEQSRIQE QRAMLENETL RRQ-EELR-- FP-S-----P-  200
```

```
Leod-CeresClone37288   VLNERPDDSS PEADPESSSS EEDEN----D NEEHH-SDTS LQLGLSSTGY   233
CeresClone:523628      FLEFSSLDR- -IFSKNGSKS ---LFNC--A SEENDLSDTS LQLGLSTDYG   226
gi|38326712            -FQYQHTEGK NTFVDTGARY LNLANNC--G NEKGS-SDTS FHLGLPAGV-   223
gi|34452081            YLEYHPLEQK YPILKEGEES LDSDTACEDG VDDED-SNTT LQLGLPLVGR   248
gi|52789958            YLECYPVERK NSLMSHSIPS PDLTCNC--T VEKGD-SDTT LYLGLPSDYH   233

Consensus              YLEY-PLERK -T----GS-S -D---NC--- NE--D-SDTS LQLGLPS---   250

Leod-CeresClone37288   CTKRKKPKLE LVCDNSGSQV ASD   256
CeresClone:523628      --RQRKALKM EPCNDSGSQV ASH   247
gi|38326712            --QEEGPQER NLFK------ ---   235
gi|34452081            --KRKKPEQD SPSSNSENQV GSK   269
gi|52789958            --KRKKPETE SHSNESESQL GLL   254

Consensus              --KRKKPE-E S--N-S-SQV -S-   273
```

```
Lead-CeresClone36904   -MRGLVNKLV SRSLSISGKW QNQQLRRLNI HEYQGAELMG KYGVNVPKGV   49
gi|27803873            ----MLRKLA NQSLSVAGKW QQQQLRRLNI HEYQGAELMS KYGINVPKGV   46
CeresClone:476815      ---------- ---------- ---------- ---------MS KHGVNVPRGV   12
gi|50910635            MVRGSLGKLA SRALSVAGKW QHQQLRRLNI HEYQGAELMG KYGINVPRGA   50
CeresClone:336060      ---------- ---------- ---------- ---------MG KYGINVPRGA   12
CeresClone:306053      ---------- ---------- ---------- ---------MG KYGINVPRGA   12

Consensus              -----L-KL- SRSLSVAGKW Q-QQLRRLNI HEYQGAELMG KYGINVPRG-   50

Lead-CeresClone36904   AASSLEEVKK AIQDVFPNES ELVVKSQILA GGRGLGTFKS GLKGGVHIVK   99
gi|27803873            AVASLDEVKK AIQDVFPNQS EVVVKSQVLA GGRGLGTFKN GFQGGVHIVK   96
CeresClone:476815      AVSSVEEARK VIKDLFPNEN ELVVKSQILA GGRGLGTFKS GLKGGVHIVK   62
gi|50910635            AAGSVEEVKN TLKNVFPSEK EIVVKSQILA GGRGLGTFKS GLQGGVHIVK  100
CeresClone:336060      AAGSVHEVKD ALKNMFPSEK EIVVKSQILA GGRGLGTFKS GLQGGVHIVK   62
CeresClone:306053      AAGSVQEVND ALKNMFPSEK EIVVKSQILA GGRGLGTFKS GLQGGVHIVK   62

Consensus              AA-SVEEVK- A-K-VFP-E- EIVVKSQILA GGRGLGTFKS GLQGGVHIVK  100

Lead-CeresClone36904   RDEAEEIAGK MLGQVLVTKQ TGPQGKVVSK VYLCEKLSLV NEMYFSIILD  149
gi|27803873            ADQAEDIASK MLGQILVTKQ TGAQGKVVSK VYLCEKMSLV NEMYFSIILD  146
CeresClone:476815      TDQVEDIAGK MLGQILVTKQ TGPQGKIVSK VYLCEKLSLV NEMYFAITLD  112
gi|50910635            AEEAESLAAK MLGQILVTKQ TGPQGKIVSK VYLCEKLSLV NEMYFAITLD  150
CeresClone:336060      AEEAELIASK MLGQILITKQ TGPEGKIVSK VYLCEKLSLT NEMYFAITLD  112
CeresClone:306053      AEEAESIARK MLGQILVTKQ TGPEGKIVSK VYLCEKLSLT NEMYFAITLD  112

Consensus              A-EAEDIASK MLGQILVTKQ TGPQGKIVSK VYLCEKLSLV NEMYFAITLD  150

Lead-CeresClone36904   RKSAGPLIIA CKKGGTSIED LAEKFPDMII KVPIDVFAGI TDEDAAKVVD  199
gi|27803873            RATAGPLIIA CRKGGTSIED LAEKFPDMII KVPIDVFKGI SDADAAKVVD  196
CeresClone:476815      RTSAGPIIIA CSKGGTSIED LAEKFPDMII KVPVDVFEGI TDEGAAKVVD  162
gi|50910635            RNTAGPLIIA CSKGGTSIED LAEKYPDMII KVPIDVFKGI TDDDAAKVVD  200
CeresClone:336060      RKTAGPLIIA CSKGGTSIED LAEKYPDMII KVPIDVFKGI TDEDAAKVVD  162
CeresClone:306053      RKTAGPLIIA CSKGGTSIED LAEKYPDMII KVPVDVFKGI TDEDAAKVVD  162

Consensus              RKTAGPLIIA CSKGGTSIED LAEK-PDMII KVPIDVFKGI TDEDAAKVVD  200
```

| | | |
|---|---|---|
| Lead-CeresClone36904 | GLAPKAADRK DSI EQVKKLY ELFRKTDCTM LEI NPLAETS TNQLVAADAK | 249 |
| gi\|27803873 | GLAPKVADRN DSI EQVKKLY KLFCETDCTM LEI NPLAETS DNKLVAADAK | 246 |
| CeresClone:476815 | GLALKVADRN KSI EQVKNLY KLFVDCDCTL LEI NPI AETA DNQLVAADAK | 212 |
| gi\|50910635 | GLAPKTADRQ SSI EQI KKLY ELFCKSDCTL LEI NPLAETA DNKLVAADAK | 250 |
| CeresClone:336060 | GLALKAADRQ SSI EQI KKLY ELFCKCDCTL LEI NPLAETA DNKLVAADAK | 212 |
| CeresClone:306053 | GLALKSADRQ SSI EQI KKLY ELFCKSDCTL LEI NPLAETA DNKLVAADAK | 212 |
| Consensus | GLA-K-ADRQ SSI EQ-KKLY ELFCK-DCTL LEI NPLAETA DNKLVAADAK | 250 |

| | | |
|---|---|---|
| Lead-CeresClone36904 | LNFDDNAAFR QKEVFAMRDP TQEDPREVAA AKVDLNYI GL DGEI GCMVNG | 299 |
| gi\|27803873 | LNFDDNAAYR QKEI FSLRDS SQEDPREVAA AKADLNYI GL DGEI GCMVNG | 296 |
| CeresClone:476815 | LNFDDNAAYR QKEI FSLRDT TQEDPREVEA AKADLNYI GL DGEI GCMVNG | 262 |
| gi\|50910635 | LNFDDNAAFR QKEI FAMRDT TQEDPREVAA AKADLNYI GL DGEI GCMVNG | 300 |
| CeresClone:336060 | LNFDDNAAFR QKEI FALRDT TQEDPREVAA AKADLNYI GL DGEI GCMVNG | 262 |
| CeresClone:306053 | LNFDDNAAFR QKEI FALRDT TQEDPREVAA AKADLNYI GL DGEI GCMVNG | 262 |
| Consensus | LNFDDNAAFR QKEI FALRDT TQEDPREVAA AKADLNYI GL DGEI GCMVNG | 300 |

| | | |
|---|---|---|
| Lead-CeresClone36904 | AGLAMATMDI I KLHGGTPAN FLDVGGNASE HQVVEAFKI L TSDDKVKAI L | 349 |
| gi\|27803873 | AGLAMATMDI I KLHGGTPAN FLDVGGNATE GQVVEAFKI L TADEKVKAI L | 346 |
| CeresClone:476815 | AGLAMATMDI I KLHGGTPAN FLDVGGNASE NQVVEAFKI L TADDKVKAI L | 312 |
| gi\|50910635 | AGLAMATMDI I KLHGGTPAN FLDVGGSASE GQVVEAFKI L TSDDRVKAI L | 350 |
| CeresClone:336060 | AGLAMATMDI I KLHGGTPAN FLDVGGSASE GQVVEAFKI L TSDDRVKAI L | 312 |
| CeresClone:306053 | AGLAMATMDI I KLHGGTPAN FLDVGGSASE GQVVEAFKI L TSDDRVKAI L | 312 |
| Consensus | AGLAMATMDI I KLHGGTPAN FLDVGG-ASE GQVVEAFKI L TSDD-VKAI L | 350 |

| | | |
|---|---|---|
| Lead-CeresClone36904 | VNI FGGI MKC DVI ASGI VNA AKEVALKVPV VVSLEGTNVE QGKRI LKESG | 399 |
| gi\|27803873 | VNI FGGI MKC DVI ASGI VNA AKQVQLKVPV I VRLEGTNVE QGKRI LKESG | 396 |
| CeresClone:476815 | VNI FGGI MKC DVI ASGI VNA AKEVALKVPV VVRLEGTNVD QGKRI LKESG | 362 |
| gi\|50910635 | VNI FGGI MKC DVI ASGI VNA AKQVDLKVPV VVRLEGTNVD QGKRI LKESG | 400 |
| CeresClone:336060 | VNI FGGI MKC DVI ASGI VNA AKQVDLKVPV VVRLEGTNVD QGKRI LKESG | 362 |
| CeresClone:306053 | VNI FGGI MKC DVI ASGI VNA AKQVDLKVPV VVRLEGTNVD QGKRI LKESG | 362 |
| Consensus | VNI FGGI MKC DVI ASGI VNA AKQVDLKVPV VVRLEGTNVD QGKRI LKESG | 400 |

| | | | | |
|---|---|---|---|---|
| Lead-CeresClone36904 | MKLITADDLD | DAAEKAVKAL | AH | 421 |
| gi\|27803873 | MKLITAEDLD | DAAEKAVKAL | A- | 417 |
| CeresClone:476815 | MALITAEDLD | DAAQKAVKAA | YK | 384 |
| gi\|50910635 | MTLITAEDLD | DAAEKAVKAS | VK | 422 |
| CeresClone:336060 | MTLITAEDLD | DAAEKAVKAS | VK | 384 |
| CeresClone:306053 | MTLITAEDLD | DAAEKAVKAS | VK | 384 |
| Consensus | MTLITAEDLD | DAAEKAVKAS | VK | 422 |

| | | | | | | |
|---|---|---|---|---|---|---|
| CeresClone:256068 | MREILHVQGG | QCGNQIGSKF | WEVICDEHGV | DPTGRYNGDS | A-DLQLERIN | 49 |
| Lead-CeresClone36891 | MREILHIQGG | QCGNQIGAKF | WEVICGEHGI | DQTGQSCGDT | --DLQLERIN | 48 |
| CeresClone:725504 | MREILHIQGG | QCGNQIGAKF | WEVVCDEHGI | DPTGRYTGTS | --DLQLERVN | 48 |
| CeresClone:773962 | MREILHIQGG | QCGNQIGSKF | WEVVCDEHGI | DPTGRYVGTS | --DLQLERVN | 48 |
| CeresClone:705622 | MREILHIQGG | QCGNQIGSKF | WEVVCDEHGI | DPTGRYVGTS | --DLQLERVN | 48 |
| CeresClone:914491 | MREILHIQGG | QCGNQIGSKF | WEVVCDEHGI | DPTGRYVGTS | --DLQLERVN | 48 |
| CeresClone:686137 | MREILHIQGG | QCGNQIGAKF | WEVICDEHGI | DGTGRYAGDS | --DLQLERIN | 48 |
| CeresClone:1315179 | MREILHIQGG | QCGNQIGAKF | WEVICDEHGI | DGTGRYAGDS | --DLQLERIN | 48 |
| CeresClone:861902 | MREILHIQGG | QCGNQIGAKF | WEVICDEHGI | DQTGKYAGDS | --DLQLERIN | 48 |
| CeresClone:471579 | MREILHIQGG | QCGNQIGAKF | WEVICDEHGI | DHTGKYSGDS | --ELQLERIN | 48 |
| CeresClone:422618 | MREILHIQGG | QCGNQIGAKF | WEVICDEHGI | DHTGKYAGDS | --DLQLERIN | 48 |
| CeresClone:726433 | MREILHIQGG | QCGNQIGAKF | WEVICGEHGV | DPTGQYTGSA | --PEQLERMD | 48 |
| CeresClone:264576 | MREILHIQGG | QCGNQIGAKF | WEVICGEHGV | DSTGCYSGVS | --PQQLERIN | 48 |
| CeresClone:1412402 | MREILHIQGG | QCGNQIGAKF | WEVICGEHCV | DSTGRYSGTS | SQQLELERIN | 50 |
| Consensus | MREILHIQGG | QCGNQIGAKF | WEVICDEHGI | D-TGRY-GDS | --DLQLERIN | 50 |

| | | | | | | |
|---|---|---|---|---|---|---|
| CeresClone:256068 | VYYNEASGGR | YVPRAVLMDL | EPGTMDSIRS | GPYGQIFRPD | NFVFGQSGAG | 99 |
| Lead-CeresClone36891 | VYFNEASGGK | YVPRAVLMDL | EPGTMDSLRS | GPFGQIFRPD | NFVFGQSGAG | 98 |
| CeresClone:725504 | VYYNEASCGR | FVPRAVLMDL | EPGTMDSVRT | GPYGQIFRPD | NFVFGQSGAG | 98 |
| CeresClone:773962 | VYYNEASCGR | FVPRAVLMDL | EPGTMDSVRT | GPYGQIFRPD | NFVFGQSGAG | 98 |
| CeresClone:705622 | VYYNEASCGR | FVPRAVLMDL | EPGTMDSVRT | GPYGQIFRPD | NFVFGQSGAG | 98 |
| CeresClone:914491 | VYYNEASCGR | FVPRAVLMDL | EPGTMDSVRT | GPYGQIFRPD | NFVFGQSGAG | 98 |
| CeresClone:686137 | VYYNEASGGR | FVPRAVLMDL | EPGTMDSVRS | GPFGQIFRPD | NFVFGQSGAG | 98 |
| CeresClone:1315179 | VYYNEASGGR | FVPRAVLMDL | EPGTMDSVRS | GPFGQIFRPD | NFVFGQSGAG | 98 |
| CeresClone:861902 | VYYNEASGGR | FVPRAVLMDL | EPGTMDSLRS | GPYGQIFRPD | NFVFGQSGAG | 98 |
| CeresClone:471579 | VYYNEASGGR | YVPRAVLMDL | EPGTMDSVRS | GPFGQIFRPD | NFVFGQSGAG | 98 |
| CeresClone:422618 | VYYNEASGGR | FVPRAVLMDL | EPGTMDSVRS | GPFGQIFRPD | NFVFGQSGAG | 98 |
| CeresClone:726433 | VYFNEAGGNR | YVPRAVLMDL | EPGTMDSLRS | GPIGAIFRPD | NFVYGQSGAG | 98 |
| CeresClone:264576 | VYYNEAGGGR | YVPRAVLMDL | EPGTMESIRA | GPFGGIFRPD | NFVYGQSGAG | 98 |
| CeresClone:1412402 | VYYNEAGGGR | YVPRAVLMDL | EPGTMESIRA | GPFGGIFRPD | NFVYGQSGAG | 100 |
| Consensus | VYYNEASGGR | YVPRAVLMDL | EPGTMDSVRS | GPYGQIFRPD | NFVFGQSGAG | 100 |

| | | | | | | |
|---|---|---|---|---|---|---|
| CeresClone:256068 | NNWAKGHYTE | GAELI DAVLD | VVRKEAENCD | CLQGFQVCHS | LGGGTGSGMG | 149 |
| Lead-CeresClone36891 | NNWAKGHYTE | GAELI DSVLD | VVRKEAENCD | CLQGFQVCHS | LGGGTGSGMG | 148 |
| CeresClone:725504 | NNWAKGHYTE | GAELI DSVLD | VVRKEAENCD | CLQGFQVCHS | LGGGTGSGMG | 148 |
| CeresClone:773962 | NNWAKGHYTE | GAELI DSVLD | VVRKEAENCD | CLQGFQVCHS | LGGGTGSGMG | 148 |
| CeresClone:705622 | NNWAKGHYTE | GAELI DSVLD | VVRKEAENCD | CLQGFQVCHS | LGGGTGSGMG | 148 |
| CeresClone:914491 | NNWAKGHYTE | GAELI DSVLD | VVRKEAENCD | CLQGFQVCHS | LGGGTGSGMG | 148 |
| CeresClone:686137 | NNWAKGHYTE | GAELI DSVLD | VVRKEAENCD | CLQGFQVCHS | LGGGTGSGMG | 148 |
| CeresClone:1315179 | NNWAKGHYTE | GAELI DSVLD | VVRKEAENCD | CLQGFQVCHS | LGGGTGSGMG | 148 |
| CeresClone:861902 | NNWAKGHYTE | GAELI DSVLD | VVRKEAENCD | CLQGFQVCHS | LGGGTGSGMG | 148 |
| CeresClone:471579 | NNWAKGHYTE | GAELI DSVLD | VVRKEAENCD | CLQGFQVCHS | LGGGTGSGMG | 148 |
| CeresClone:422618 | NNWAKGHYTE | GAELI DSVLD | VVRKEAENCD | CLQGFQVCHS | LGGGTGSGMG | 148 |
| CeresClone:726433 | NNWAKGHYTE | GAELI DSVLD | VVRKEAENSD | CLQGFQVCHS | LGGGTGSGMD | 148 |
| CeresClone:264576 | NNWAKGHYTE | GAELI DSVLD | VVRKEAENCD | CLQGFQVCHS | LGGGTGSGMG | 148 |
| CeresClone:1412402 | NNWAKGHYTE | GAELI DSVLD | VVRKEAENCD | CLQGFQVCHS | LGGGTGSGMG | 150 |
| Consensus | NNWAKGHYTE | GAELI DSVLD | VVRKEAENCD | CLQGFQVCHS | LGGGTGSGMG | 150 |

| | | | | | | |
|---|---|---|---|---|---|---|
| CeresClone:256068 | TLLI SKI REE | YPDRMMLTFS | VFPSPKVSDT | VVEPYNATLS | VHQLVENADE | 199 |
| Lead-CeresClone36891 | TLLI SKI REE | YPDRMMMTFS | VFPSPKVSDT | VVEPYNATLS | VHQLVENADE | 198 |
| CeresClone:725504 | TLLI SKI REE | YPDRMMLTFS | VFPSPKVSDT | VVEPYNATLS | VHQLVENADE | 198 |
| CeresClone:773962 | TLLI SKI REE | YPDRMMLTFS | VFPSPKVSDT | VVEPYNATLS | VHQLVENADE | 198 |
| CeresClone:705622 | TLLI SKI REE | YPDRMMLTFS | VFPSPKVSDT | VVEPYNATLS | VHQLVENADE | 198 |
| CeresClone:914491 | TLLI SKI REE | YPDRMMLTFS | VFPSPKVSDT | VVEPYNATLS | VHQLVENADE | 198 |
| CeresClone:686137 | TLLI SKI REE | YPDRMMLTFS | VFPSPKVSDT | VVEPYNATLS | VHQLVENADE | 198 |
| CeresClone:1315179 | TLLI SKI REE | YPDRMMLTFS | VFPSPKVSDT | VVEPYNATLS | VHQLVENADE | 198 |
| CeresClone:861902 | TLLI SKI REE | YPDRMMLTFS | VFPSPKVSDT | VVEPYNATLS | VHQLVENADE | 198 |
| CeresClone:471579 | TLLI SKI REE | YPDRMMLTFS | VFPSPKVSDT | VVEPYNATLS | VHQLVENADE | 198 |
| CeresClone:422618 | TLLI SKI REE | YPDRMMLTFS | VFPSPKVSDT | VVEPYNATLS | VHQLVENADE | 198 |
| CeresClone:726433 | TLLI SKI REE | YPDRMMLTFS | VFPSPKVSDT | VVEPYNATLS | VHQLVENADE | 198 |
| CeresClone:264576 | TLLI SKI REE | YPDRMMLTFS | VFPSPKVSDT | VVEPYNATLS | VHQLVENADE | 198 |
| CeresClone:1412402 | TLLI SKI REE | YPDRMMLTFS | VFPSPKVSDT | VVEPYNATLS | VHQLVENADE | 200 |
| Consensus | TLLI SKI REE | YPDRMMLTFS | VFPSPKVSDT | VVEPYNATLS | VHQLVENADE | 200 |

| | | | | | | |
|---|---|---|---|---|---|---|
| CeresClone:256068 | CMVLDNEALY | DICFRTLKLS | TPSFGDLNHL | ISATMSGVTC | SLRFPGQLNS | 249 |
| Lead-CeresClone36891 | CMVLDNEALY | DICFRTLKLA | NPTFGDLNHL | ISATMSGVTC | CLRFPGQLNS | 248 |
| CeresClone:725504 | CMVLDNEALY | DICFRTLKLT | TPSFGDLNHL | ISATMSGVTC | CLRFPGQLNS | 248 |
| CeresClone:773962 | CMVLDNEALY | DICFRTLKLT | TPSFGDLNHL | ISATMSGVTC | CLRFPGQLNS | 248 |
| CeresClone:705622 | CMVLDNEALY | DICFRTLKLT | TPSFGDLNHL | ISATMSGVTC | CLRFPGQLNS | 248 |
| CeresClone:914491 | CMVLDNEALY | DICFRTLKLT | TPSFGDLNHL | ISATMSGVTC | CLRFPGQLNS | 248 |
| CeresClone:686137 | CMVLDNEALY | DICFRTLKLA | TPSFGDLNHL | ISATMSGVTC | CLRFPGQLNS | 248 |
| CeresClone:1315179 | CMVLDNEALY | DICFRTLKLA | TPSFGELNHL | ISATMSGVTC | CLRFPGQLNS | 248 |
| CeresClone:861902 | CMVLDNEALY | DICFRTLKLA | TPTFGDLNHL | ISATMSGVTC | CLRFPGQLNS | 248 |
| CeresClone:471579 | CMVLDNEALY | DICFRTLKLA | TPTFGDLNHL | ISATMSGVTC | CLRFPGQLNS | 248 |
| CeresClone:422618 | CMVLDNEALY | DICFRTLKLS | TPTFGDLNHL | ISATMSGVTC | CLRFPGQLNS | 248 |
| CeresClone:726433 | CMVLDNEALY | DICFRTLKLT | NPSFGDLNHL | ISATMSGVTC | CLRFPGQLNS | 248 |
| CeresClone:264576 | CMVLDNEALY | DICFRTLKLT | NPSFGDLNHL | ISATMSGVTC | CLRFPGQLNS | 248 |
| CeresClone:1412402 | CMVLDNEALY | DICFRTLKLT | NPSFGDLNHL | ISATMSGVTC | CLRFPGQLNS | 250 |
| Consensus | CMVLDNEALY | DICFRTLKLT | TPSFGDLNHL | ISATMSGVTC | CLRFPGQLNS | 250 |

| | | | | | | |
|---|---|---|---|---|---|---|
| CeresClone:256068 | DLRKLAVNLI | PFPRLHFFMV | GFAPLTSRGS | QQYISLTVPE | LTQQMWDAKN | 299 |
| Lead-CeresClone36891 | DLRKLAVNLI | PFPRLHFFMV | GFAPLTSRGS | QQYSALSVPE | LTQQMWDAKN | 298 |
| CeresClone:725504 | DLRKLAVNLI | PFPRLHFFMV | GFAPLTSRGS | QQYRALTVPE | LTQQMWDAKN | 298 |
| CeresClone:773962 | DLRKLAVNLI | PFPRLHFFMV | GFAPLTSRGS | QMYRSLTVPE | LTQQMWDSKN | 298 |
| CeresClone:705622 | DLRKLAVNLI | PFPRLHFFMV | GFAPLTSRGS | QQYRALTVPE | LTQQMWDAKN | 298 |
| CeresClone:914491 | DLRKLAVNLI | PFPRLHFFMV | GFAPLTSRGS | QMYRPLTVPE | LTQQMWDSKN | 298 |
| CeresClone:686137 | DLRKLAVNLI | PFPRLHFFMV | GFAPLTSRGS | QMYRALTVPE | LTQQMWDAKN | 298 |
| CeresClone:1315179 | DLRKLAVNLI | PFPRLHFFMV | GFAPLTSRGS | QMYRALTVPE | LTQQMWDAKN | 298 |
| CeresClone:861902 | DLRKLAVNLI | PFPRLHFFMV | GFAPLTSRGS | QQYRALTVPE | LTQQMWDSKN | 298 |
| CeresClone:471579 | DLRKLAVNLI | PFPRLHFFMV | GFAPLTSRGS | QQYRNLTVPE | LTQQMWDSKN | 298 |
| CeresClone:422618 | DLRKLAVNLI | PFPRLHFFMV | GFAPLTSRGS | QQYRALTVPE | LTQQMWDSKN | 298 |
| CeresClone:726433 | DLRKLAVNLI | PFPRLHFFMV | GFAPLTSRGS | QQYRALTVPE | LTQQMWDAKN | 298 |
| CeresClone:264576 | DLRKLAVNLI | PFPRLHFFMV | GFAPLTSRGS | QQYRALTVPE | LTQQMWDAKN | 298 |
| CeresClone:1412402 | DLRKLAVNLI | PFPRLHFFMV | GFAPLTSRGS | QQYRALTVPE | LTQQMWDAKN | 300 |
| Consensus | DLRKLAVNLI | PFPRLHFFMV | GFAPLTSRGS | QQYRALTVPE | LTQQMWDAKN | 300 |

```
CeresClone:256068         MMCAADPRHG RYLTASAMFR GKMSTKEVDE QI LNVQNKNS SYFVEWI PNN 349
Lead-CeresClone36891      MMCAADPRHG RYLTASAVFR GKMSTKEVDE QMMNVQNKNS SYFVEWI PNN 348
CeresClone:725504         MMCAADPRHG RYLTASAMFR GKMSTKEVDE QMI NVQNKNS SYFVEWI PNN 348
CeresClone:773962         MMCAADPRHG RYLTASAMFR GKMSTKEVDE QMI NVQNKNS SYFVEWI PNN 348
CeresClone:705622         MMCAADPRHG RYLTASAMFR GKMSTKEVDE QMI NVQNKNS SYFVEWI PNN 348
CeresClone:914491         MMCAADPRHG RYLTASAMFR GKMSTKEVDE QMI NVQNKNS SYFVEWI PNN 348
CeresClone:686137         MMCAADPRHG RYLTASACFR GKMSTKEVDE QMLNVQNKNS SYFVEWI PNN 348
CeresClone:1315179        MMCAADPRHG RYLTASACFR GKMSTKEVDE QMLNVQNKNS SYFVEWI PNN 348
CeresClone:861902         MMCAADPRHG RYLTASAMFR GKMSTKEVDE QMLNVQNKNS SYFVEWI PNN 348
CeresClone:471579         MMCAADPRHG RYLTASAMFR GKMSTKEVDE QMI NVQNKNS SYFVEWI PNN 348
CeresClone:422618         MMCAADPRHG RYLTASAMFR GKMSTKEVDE QMLNVQNKNS SYFVEWI PNN 348
CeresClone:726433         MMCAADPRHG RYLTASAMFR GKMSTKEVDE QMMNVQNKNS SYFVEWI PNN 348
CeresClone:264576         MMCAADPRHG RYLTASAMFR GKMSTKEVDE QMI NVQNKNS SYFVEWI PNN 348
CeresClone:1412402        MMCSADPRHG RYLTASAMFR GKMSTKEVDE QMI NVQNKNS SYFVEWI PNN 350

Consensus                 MMCAADPRHG RYLTASAMFR GKMSTKEVDE QMI NVQNKNS SYFVEWI PNN 350

CeresClone:256068         VKSSVCDI PP TGI KMASTFV GNSTSI QEMF RRVSEQFTAM FRRKAFLHWY 399
Lead-CeresClone36891      VKSSVCDI AP TGLKMASTFI GNSTSI QEMF RRVSEQFTAM FRRKAFLHWY 398
CeresClone:725504         VKSSVCDI PP TGLSMASTFV GNSTSI QEMF RRVSEQFTSM FRRKAFLHWY 398
CeresClone:773962         VKSSVCDI AP RGLSMASTFI GNSTSI QEMF RRVSEQFTAM FRRKAFLHWY 398
CeresClone:705622         VKSSVCDI PP RGLSMASTFI GNSTSI QEMF RRVSEQFTAM FRRKAFLHWY 398
CeresClone:914491         VKSSVCDI PP RGLSMASTFI GNSTSI QEMF RRVSEQFTAM FRRKAFLHWY 398
CeresClone:686137         VKSSVCDMPP RGLKMAGTFV GNSTSI QEMF RRVSEQFTAM FRRKAFLHWY 398
CeresClone:1315179        VKSSVCDMPP RGLKMAGTFV GNSTSI QEMF RRVSEQFTAM FRRKAFLHWY 398
CeresClone:861902         VKSSVCDI PP TGLSMSSTFV GNSTSI QEMF RRVSEQFTAM FRRKAFLHWY 398
CeresClone:471579         VKSSVCDI PP KGLKMSSTFI GNSTSI QEMF RRVSEQFTAM FRRKAFLHWY 398
CeresClone:422618         VKSSVCDI PP IGLKMSSTFV GNSTSI QEMF RRVSEQFTAM FRRKAFLHWY 398
CeresClone:726433         VKSSVCDI PP VGLAMSSTFV GNSTSI QEMF RRVSEQFTAM FRRKAFLHWY 398
CeresClone:264576         VKSSVCDI PP VGLSMSSTFV GNSTSI QEMF RRVSEQFTAM FRRKAFLHWY 398
CeresClone:1412402        VKSSVCDI PP VGLPMASTFV GNSTSI QEMF RRVSEQFTAM FRRKAFLHWY 400

Consensus                 VKSSVCDI PP -GLSMASTFV GNSTSI QEMF RRVSEQFTAM FRRKAFLHWY 400
```

| | | | | | | |
|---|---|---|---|---|---|---|
| CeresClone:256068 | TGEGMDEMEF | TEAESNMNDL | VSEYQQYQDA | TADEEDE-YD | EEEEQVYES- | 447 |
| Lead-CeresClone36891 | TGEGMDEMEF | TEAESNMNDL | VAEYQQYQDA | TVGEEE--YE | EDEEEEEEA-- | 444 |
| CeresClone:725504 | TGEGMDEMEF | TEAESNMNDL | VSEYQQYQDA | TSDEEGE-YE | DEDQEPEEDM | 447 |
| CeresClone:773962 | TGEGMDEMEF | TEAESNMNDL | VAEYQQYQDA | TADEEEELYE | DEDDADLQE- | 447 |
| CeresClone:705622 | TGEGMDEMEF | TEAESNMNDL | VSEYQQYQDA | TADEEAE-YE | DEEAIQDE-- | 445 |
| CeresClone:914491 | TGEGMDEMEF | TEAESNMNDL | VSEYQQYQDA | TADEEGE-YE | EEEELEQE-- | 445 |
| CeresClone:686137 | TGEGMDEMEF | TEAESNMNDL | VAEYQQYQDA | TAEEE---YD | EEEEEERDA- | 444 |
| CeresClone:1315179 | TGEGMDEMEF | TEAESNMNDL | VAEYQQYQDA | TADEE---YD | EEEEEERDAE | 445 |
| CeresClone:861902 | TGEGMDEMEF | TEAESNMNDL | VAEYQQYQDA | TADEEEE-YD | EEEEEEAA-- | 445 |
| CeresClone:471579 | TGEGMDEMEF | TEAESNMNDL | VAEYQQYQDA | TADEEE--YE | DEEEEA---- | 442 |
| CeresClone:422618 | TGEGMDEMEF | TEAESNMNDL | VAEYQQYQDA | TAEDEE--YE | EEEEEEEET- | 445 |
| CeresClone:726433 | TSEGMDEMEF | TEAESNMNDL | VAEYQQYQDA | TAEED---YE | EEEEPAADQP | 445 |
| CeresClone:264576 | TSEGMDEMEF | TEAESNMNDL | VAEYQQYQDA | TAEE----YD | EEEQDGEEEH | 444 |
| CeresClone:1412402 | TSEGMDEMEF | TEAESNMNDL | VAEYQQYQDA | TAEE----YE | EEEHDGEEEH | 446 |
| Consensus | TGEGMDEMEF | TEAESNMNDL | VAEYQQYQDA | TADEE---YE | EEEEEE-E-- | 450 |

| | | |
|---|---|---|
| CeresClone:256068 | - | 447 |
| Lead-CeresClone36891 | - | 444 |
| CeresClone:725504 | - | 447 |
| CeresClone:773962 | - | 447 |
| CeresClone:705622 | - | 445 |
| CeresClone:914491 | - | 445 |
| CeresClone:686137 | - | 444 |
| CeresClone:1315179 | - | 445 |
| CeresClone:861902 | - | 445 |
| CeresClone:471579 | - | 442 |
| CeresClone:422618 | - | 445 |
| CeresClone:726433 | - | 445 |
| CeresClone:264576 | A | 445 |
| CeresClone:1412402 | A | 447 |
| Consensus | - | 451 |

```
Lead-CeresClone36518   ---------- ---------- ---------- ---------- MQSLMPALSK   10
CeresClone:326         ---------- ---------- ---------- ---------- ----------    0
CeresClone:37800       ---------- ---------- ---------- ---------- ----------    0
CeresClone:564011      ---------- ---------- ---------- ---------- ----------    0
CeresClone:225429      ---------- ---------- ---------- ---------- ----------    0
CeresClone:450648      MAAVDTFLFT SESVNEGHPD KLCDQVSDAV LDACLAEDPD SKVACETCTK   50

Consensus              ---------- ---------- ---------- ---------- ----------   50

Lead-CeresClone36518   TLIAKLLVRH APRPTWSWFS VRSPPRLRLI TRRLS-VTLA VPLDSSLTML   59
CeresClone:326         --MVMVFGEI TTKANVDYEQ I------VRKT CREI GFVSAD VGLDAD----   39
CeresClone:37800       --MVMVFGEI TTKATVDYEK I------VRDT CRAI GFVSDD VGLDAD----   39
CeresClone:564011      ----MVFGEI TTKANVDYEK I------VRDT CRNI GFVSND VGLDAD----   37
CeresClone:225429      --MVMVFGEI TTKASVDYEK I------VRDT CREI GFFSDD VGLDAD----   39
CeresClone:450648      TNMVMVFGEI TTKANVDYEK I------VRET CRNI GFVSND VGLDAD----   91

Consensus              --MVMVFGEI TTKANVDYEK I------VRDT CR-I GFVS-D VGLDAD----  100

Lead-CeresClone36518   VLMHKCKVLV NIEQQSPDIA QGVHGHFTKR PEDIGAGDQG HMFGYATDET  109
CeresClone:326         ----NCKVLV NIEQQSPDIA QGVHGHLTKK PEEVGAGDQG HMFGYATDET   85
CeresClone:37800       ----KCKVLV NIEQQSPDIA QGVHGHFTKC PEEIGAGDQG HMFGYATDET   85
CeresClone:564011      ----NCKVLV NIEQQSPDIA QGVHGHLTKK PEEIGAGDQG HMFGYATDET   83
CeresClone:225429      ----RCKVLV NIEQQSPDIA QGVHGHFTKR PEEIGAGDQG HMFGYATDET   85
CeresClone:450648      ----HCKVLV NIEQQSPDIA QGVHGHFTKR PEEIGAGDQG HMFGYATDET  137

Consensus              -----CKVLV NIEQQSPDIA QGVHGHFTKR PEEIGAGDQG HMFGYATDET  150

Lead-CeresClone36518   PELMPLSHVL ATKIGARLTE VRKNGTCRWL RPDGKTQVTV EYYNDNGAMV  159
CeresClone:326         PELMPLTHVL ATKLGAKLTE VRKNGTCPWL RPDGKTQVTI EYINESGAMV  135
CeresClone:37800       PELMPLSHVL ATKLGARLTE VRKNGTCAWL RPDGKTQVTV EYYNDKGAMV  135
CeresClone:564011      PELMPLSHVL ATKLGARLTE VRKNGTCPWL RPDGKTQVTV EYYNDNGAMV  133
CeresClone:225429      PELMPLSHVL ATKLGARLTE VRKDGTCAWL RPDSKTQVTV EYVNEGGAMV  135
CeresClone:450648      PELMPLSHVL ATKLGARLTE VRKNGTCPWL RPDGKTQVTV EYRNEGGAMV  187

Consensus              PELMPLSHVL ATKLGARLTE VRKNGTCPWL RPDGKTQVTV EYYN-NGAMV  200
```

```
Lead-CeresClone36518  PVRVHTVLIS TQHDETVTND EIARDLKEHV IKPIIPEKYL DQKTIFHLNP  209
CeresClone:326        PVRVHTVLIS TQHDETVTND EIAADLKEHV IKPVIPEKYL DEKTIFHLNP  185
CeresClone:37800      PIRVHTVLIS TQHDETVTND EIARDLKEHV IKPVIPEKYL DEKTIFHLNP  185
CeresClone:564011     PVRVHTVLIS TQHDETVSND QIAADLKEHV IKPVIPEKYL DEKTIFHLNP  183
CeresClone:225429     PVRVHTVLIS TQHDETVTND EIAADLKEHV IKPVIPERYL DEKTIFHLNP  185
CeresClone:450648     PIRVHTVLIS TQHDETVTND EIAADLKEHV IKPVIPEQYL DEKTIFHLNP  237

Consensus             PVRVHTVLIS TQHDETVTND EIAADLKEHV IKPVIPEKYL DEKTIFHLNP  250

Lead-CeresClone36518  SGRFVIGGPH GDAGLTGRKI IIDTYGGWGA HGGGAFSGKD PTKVDRSGAY  259
CeresClone:326        SGRFVIGGPH GDAGLTGRKI IIDTYGGWGA HGGGAFSGKD PTKVDRSGAY  235
CeresClone:37800      SGRFVIGGPH GDAGLTGRKI IIDTYGGWGA HGGGAFSGKD PTKVDRSGAY  235
CeresClone:564011     SGRFVIGGPH GDAGLTGRKI IIDTYGGWGA HGGGAFSGKD PTKVDRSGAY  233
CeresClone:225429     SGRFVIGGPH GDAGLTGRKI IIDTYGGWGA HGGGAFSGKD PTKVDRSGAY  235
CeresClone:450648     SGRFVIGGPH GDAGLTGRKI IIDTYGGWGA HGGGAFSGKD PTKVDRSGAY  287

Consensus             SGRFVIGGPH GDAGLTGRKI IIDTYGGWGA HGGGAFSGKD PTKVDRSGAY  300

Lead-CeresClone36518  IVRQAAKSVV ANGMARRALV QVSYAIGVPE PLSVXVDTYG TGLIPDKEIL  309
CeresClone:326        IVRQAAKSIV ASGLARRVIV QVSYAIGVPE PLSVFVDSYG TGKIPDKEIL  285
CeresClone:37800      IVRQAAKSVV ANGMARRALV QVSYAIGVPE PLSVFVDTYE TGLIPDKEIL  285
CeresClone:564011     IVRQAAKSVV ANGLARRCIV QVSYAIGVPE PLSVFVDTYG TGKIPDKEIL  283
CeresClone:225429     VARQAAKSIV ASGLARRCLV QVSYAIGVPE PLSVFVDSYG TGTIPDKEIL  285
CeresClone:450648     VARQAAKSIV ASGLARRAIV QVSYAIGVPE PLSVFVDTYG TGAIPDKEIL  337

Consensus             IVRQAAKS-V A-GLARRA-V QVSYAIGVPE PLSVFVDTYG TG-IPDKEIL  350

Lead-CeresClone36518  KIVKETFDFR PGMMTINLDL KRGGNGRFQK TAAYGHFGRD DPDFTWEVVK  359
CeresClone:326        EIVKESFDFR PGMISINLDL KRGGNGRFLK TAAYGHFGRD DADFTWEVVK  335
CeresClone:37800      KIVKESFDFR PGMMTINLDL KRGGNGRFLK TAAYGHFGRD DPDFTWEVVK  335
CeresClone:564011     QIVKENFDFR PGMITINLDL KRGGH-RFLK TAAYGHFGRD DPDFTWEVVK  332
CeresClone:225429     KIVKENFDFR PGMVTINLDL KKGGN-RFIK TAAYGHFGRD DADFTWEVVK  334
CeresClone:450648     KIVKENFDFR PGMI--NLDL KKGGNGRYLK TAAYGHFGRD DPDFTWEVVK  387

Consensus             KIVKENFDFR PGMITINLDL KRGGNGRFLK TAAYGHFGRD DPDFTWEVVK  400
```

| | | |
|---|---|---|
| Lead-CeresClone36518 | PLKWDKPQA | 368 |
| CeresClone:326 | PLKSNKVQA | 344 |
| CeresClone:37800 | PLKWDKPQA | 344 |
| CeresClone:564011 | PLKSEKPQA | 341 |
| CeresClone:225429 | PLK--KASA | 341 |
| CeresClone:450648 | PLKSEKPSA | 396 |
| Consensus | PLKS-KPQA | 409 |

```
gi|50923675               ----------  ----------  ----------  ----------  ----------    0
CeresClone:246601         INWFRTSCSL  LSPADKKTLE  FPAAALLSLD  ----PFLQAR  THPHASAPPP   46
CeresClone:222358         --NCTXPALC  YSRSQPENPN  FPAAAFLSLD  PQLAPFLQVR  THRPAYALPP   48
CeresClone:1213577        ----------  ----------  ----------  ----------  ----------    0
Lead-CeresClone34385      ----------  ----------  ----------  ----------  ----------    0
CeresClone:463738         ----------  ----------  ----------  ----------  ----------    0

Consensus                 ----------  ----------  ----------  ----------  ----------   50

gi|50923675               --MANPAAAA  GPSGCARSFL  QAVSTVTEEA  PSPLRVVQME  GLAVLKIIKH   48
CeresClone:246601         NDLRAAMANS  AAPGGVRSFL  QAVSTVTEET  RTPLRVVQME  GLAVLKIIKH   96
CeresClone:222358         NDLRAAMANS  AAPGGMRSFL  QAVSTVTEEA  PTPLRVVQME  GLAVLKIIKH   98
CeresClone:1213577        ------MANS  AAPGGMRSFL  QAVSTVTEEA  PTPLRVVQME  GLAVLKIIKH   44
Lead-CeresClone34385      ----------  -MATMARSFL  QAISKDEAVA  P-PLRVVQIE  GLAVLKIIKH   38
CeresClone:463738         ----------  MATTPARSFL  Q-VAATEEAA  P-PLRVVQIE  GLV-LKIIKH   38

Consensus                 --L---MANS  AA-GG-RSFL  QAVSTVTEEA  PTPLRVVQME  GLAVLKIIKH  100

gi|50923675               CEEFAPALVT  GQLLGLDVGS  VLEVTNCFPF  PMREDDEEAD  ADGANYQLEM   98
CeresClone:246601         CEEFAPALVT  GQLLGLDVGS  VLEVTNCFPF  PMREEDDEAD  ADGANYQLEM  146
CeresClone:222358         CEEFAPALVT  GQLLGLDVGS  VLEVTNCFPF  PIREEDDEAD  ADGANYQLEM  148
CeresClone:1213577        CEEFAPALVT  GQLLGLDVGS  VLEVTNCFPF  PIREEDDEAD  ADGANYQLEM   94
Lead-CeresClone34385      CKEFSPTLVT  GQLLGLDVGS  VLEVTNCFPF  PVRDDDEE-E  ADGANYQLEM   88
CeresClone:463738         CKDFSPSLVT  GQLLGLDVGS  VLEVTNCFPF  PMREEDEE-E  ADGANYQLEM   88

Consensus                 CEEFAPALVT  GQLLGLDVGS  VLEVTNCFPF  PMREED-EAD  ADGANYQLEM  150

gi|50923675               MRCLREVNVD  NNTVGWYQSC  LLGSFQTVEL  IETFMNYQEN  IRRCVCIVYD  148
CeresClone:246601         MRCLREVNVD  NNTIGWYQSC  LLGSFQTVEL  IETFMNYQES  IRRCVCIVYD  196
CeresClone:222358         MRCLREVNVD  NNTIGWYQSC  LLGSFQTVEL  IETFMNYQES  IRRCVCIVYD  198
CeresClone:1213577        MRCLREVNVD  NNTIGWYQSC  LLGSFQTVEL  IETFMNYQES  IRRCVCIVYD  144
Lead-CeresClone34385      MRCLREVNVD  NNTVGWYQST  VLGSYQTVEL  IETFMNYQEN  IKRCVCIIYD  138
CeresClone:463738         MRCLREVNVD  NNTVGWYQST  LLGSFQTVEL  IETFMNYQEN  IRRCVCIIYD  138

Consensus                 MRCLREVNVD  NNT-GWYQSC  LLGSFQTVEL  IETFMNYQE-  IRRCVCIVYD  200
```

| | | | | | | |
|---|---|---|---|---|---|---|
| gi\|50923675 | PSRSNQGVLA | LKALKLTDSF | MDLYRNNGLT | GEKLREKKLS | WVDI FEEI PI | 198 |
| CeresClone:246601 | PSRSSQGVLA | LKALKLTDSF | MDLYRNNGLT | GEKLREKKLS | WVDI FEEI PI | 246 |
| CeresClone:222358 | PSRSSQGVLA | LKALKLTDSF | MDLYRNNGLT | GEKLREKKLS | WVDI FEEI PI | 248 |
| CeresClone:1213577 | PSRSSQGVLA | LKALKLTDSF | MDLYRNNGLT | GEKLREKKLS | WVDI FEEI PI | 194 |
| Lead-CeresClone34385 | PSKADLGVLA | LKALKLSDSF | MELYRCGNFT | GEKLREKNFS | WMDI FEEI PI | 188 |
| CeresClone:463738 | PSRSDQGVLA | LKALKLSDSF | MELYRSNNFT | GEKLREKNLS | WVDI FEEI PI | 188 |
| Consensus | PSRSSQGVLA | LKALKLTDSF | MDLYRNNGLT | GEKLREKKLS | WVDI FEEI PI | 250 |
| gi\|50923675 | KVSNSALVSA | FMTELEPESP | VSQCDFDRLK | LSTAPFMERN | LEFLI GCMDD | 248 |
| CeresClone:246601 | KVSNSALVSA | FMKELEPESP | VTQCDLDRLK | LSTAPFMERN | LEFLI GCMDD | 296 |
| CeresClone:222358 | KVSNSALVSA | FMKELEPESP | VTQCDLDRLK | LSTAPFMERN | LEFLI GCMDD | 298 |
| CeresClone:1213577 | KVSNSALVSA | FMKELEPESP | VTQCDLDRLK | LSTAPFMERN | LEFLI GCMDD | 244 |
| Lead-CeresClone34385 | KVSNSALVSA | FMTELEIDTP | VSQGDYDRLH | SSTITPFLENN | MEFLI KCMDD | 238 |
| CeresClone:463738 | KVSNSALI SA | FMTELEPDTP | VTQCDYDRLQ | LSTSSLMERN | TEFLI ECMDD | 238 |
| Consensus | KVSNSALVSA | FM-ELEPESP | VTQCD-DRLK | LSTAPFMERN | LEFLI GCMDD | 300 |
| gi\|50923675 | LSSEQNKFQY | YYRNVSRQQS | QQQAWLQKRR | QENMARKAAG | EEPLPEEDPS | 298 |
| CeresClone:246601 | LSSEQNKFQY | YNRNLSRQQS | QQQAWLQKRR | QENMARKAAG | EEPLPEEDPS | 346 |
| CeresClone:222358 | LSSEQNKFQY | YNRNLSRQQS | QQQAWLQKRR | QENMARKAAG | EEPLPEEDPS | 348 |
| CeresClone:1213577 | LSSEQNKFQY | YNRNLSRQQS | QQQAWLQKRR | QENMARKAAG | EEPLPEEDPS | 294 |
| Lead-CeresClone34385 | LSMEQQKFQY | YYRNLSRQQA | QQQAWLQKRR | TENMARKSAG | EEPLPEEDPS | 288 |
| CeresClone:463738 | LSLEQQKFQF | YYRSLSRQQA | QQQAWLQKRR | TENMARKAAG | EEPLPEEDPS | 288 |
| Consensus | LSSEQNKFQY | Y-RNLSRQQS | QQQAWLQKRR | QENMARKAAG | EEPLPEEDPS | 350 |
| gi\|50923675 | NPI FKPI PEP | SRLEGYLVTN | QI SSYCNHI N | GVAGQNFNRL | YLMKALQED | 347 |
| CeresClone:246601 | NPI FKPI PEP | SRLEGYLVTN | QI SSYCNHI N | GVAGQNFDRL | YLMKALHED | 395 |
| CeresClone:222358 | NPI FKPI PEP | SRLEGYLVTN | QI CSYCNHI N | GVAGQNFDRL | YLMKALHED | 397 |
| CeresClone:1213577 | NPI FKPI PEP | SRLEGYLVTN | QI CSYCNHI N | GVAGQNFDRL | YLMKALHED | 343 |
| Lead-CeresClone34385 | NPI FKAI PEP | SRLESFLI TN | QVSNFCGQ N | GVAGQNFSRL | YLIKALHDN | 337 |
| CeresClone:463738 | NPI FKPLPEP | SRLESFLI TN | QI SNYCNQ N | GVSGQSFNRL | YLMKALHED | 337 |
| Consensus | NPI FKPI PEP | SRLEGYLVTN | QI SSYCNHI N | GVAGQNFDRL | YLMKALHED | 399 |

```
gi|992598              MSSEKEDGLG LSLSLGIMSC P----QNNH  KTTPSLP--- ------LNLLP  37
Lead-CeresClone34167   MMMGKED-LG LSLSLGFAQN H---PLQLNL KPTSSPMSN- ------LQMFP  40
gi|18857720            MMMGKED-LG LSLSLGFSQN H--NPLQMNL NPNSSLSNN- ------LQRLP  41
CeresClone:1014844     -MMGKED-LG LSLSLGFSQN H--NPLQMNL NPNSSLSNN- ------LQRLP  40
gi|8919876             MMLEKDD-LG LSLGLNYPKK Q----MNLNS NPSVSVTPSS SSFGLLRRSS  45
CeresClone:527278      -MVQKED-LG LSLSLNFPHH STPNPQHLSL MSSSTHSSSP SGFN-PQKPS  47
CeresClone:514259      MTVEKED-LG LSLSLSFPQN P-PTHLHLNL VSSSPSSHN- ------PQKPS  42

Consensus              MMMEKED-LG LSLSLGF-QN ----PLQLNL -PSSSLS-N- ------LQR-P  50

gi|992598              FMHHHQVSSG R-------KDE GGERVRGGI D MNEPARMI E CDDEEDEEED  81
Lead-CeresClone34167   WNQTLVSSSD Q---------Q KQQFLR-KI D VNSLPTTVD- LEEEIG----  76
gi|18857720            WNQTFDPTSD ---------- ----LR-KI D VNSFPSTVN- CEEDTG----  71
CeresClone:1014844     WNQTFDPTSD ---------- ----LR-KI D VNSFPSTVN- CEEDTG----  70
gi|8919876             LNESFTSSVP N--SDSSQKE TRTFIR-GI D VNRPPSTAEY GEEDAG----  88
CeresClone:527278      WNEAFASSDP DRNSDTCRGE TRSFLR-GI D VNRLPSAVD- AEEEAG----  91
CeresClone:514259      WNDPFTSSAG S--------- --SFLR-GI D VNRLPSVVD- CEEEAG----  75

Consensus              WN--F-SSS- ---------E ---FLR-GI D VN--PSTVD- CEEE-G---- 100

gi|992598              QVLMVSSPNS TVSS-VSGKR -SHDREENEG ---------- ---------ER 111
Lead-CeresClone34167   ----VSSPNS TI SSTVSGKR RSTEREGTSG GGCGDDLDIT L---DRSSSR 119
gi|18857720            ----VSSPNS TI SSTI SGKR --SEREGISG TGVGSGDDHD EITPDRGYSR 115
CeresClone:1014844     ----VSSPNS TI SSTI SGKR --SEREGISG TGVGSGDDHD EITPDRGYSR 114
gi|8919876             ----VSSPNS TVSS-STCKR --SER----- -------EED T---DPQGSR 116
CeresClone:527278      ----VSSPNS TVSC-VSGKR --SER-EPNG -------EEHD M---DRACSR 124
CeresClone:514259      ----VSSPNS TVSS-VSGKR --SEREEANG -------EEND T---DRACSR 109

Consensus              ----VSSPNS TVSS-VSGKR --SERE--NG --------HD ----DR--SR 150

gi|992598              AFSSLEDDGG DAAARKKLRL SKEQAAVLEE TFKEHNTLNP KQKLALSKQL 161
Lead-CeresClone34167   GTSDEEEDYG GETCRKKLRL SKDQSAVLED TFKEHNTLNP KQKLALAKKL 169
gi|18857720            GTSDEEED-G GETSRKKLRL SKDQSAFLEE TFKEHNTLNP KQKLALAKKL 164
CeresClone:1014844     GTSDEEED-G GETSRKKLRL SKDQSAFLEE TFKEHNTLNP KQKLALAKKL 163
gi|8919876             GGISDDED-- GDNSRKKLRL SKDQSAILEE TFKDHSTLNP KQKQALAKQL 164
CeresClone:527278      G-ISDEED-- AETSRKKLRL SKDQSSILEE SFKEHNTLNP KQKLALAKQL 171
CeresClone:514259      G ISDEED-- AETSRKKLRL SKDQSI LEE SFKEHNTLNP KQKLALAKQL 157

Consensus              GTSS-EED-G GETSRKKLRL SKDQSAILEE TFKEHNTLNP KQKLALAKQL 200
```

```
gi|992598                 NLRPROVEVW FONRRARTKL KOTEVDCEYL KRCCENLTDE NRRLOKEVSE  211
Lead-CeresClone34167      GLTAROVEVW FONRRARTKL KOTEVDCEYL KRCVEKLTEE NRRLEKEAAE  219
gi|18857720               NLTAROVEVW FONRRARTKL KOTEVDCEYL KRCVEKLTEE NRRLOKEAME  214
CeresClone:1014844        NLTAROVEVW FONRRARTKL KOTEVDCEYL KRCVEKLTEE NRRLOKEAME  213
gi|8919876                GLRAROVEVW FONRRARTKL KOTEVDCEFL RRCCENLTEE NRRLOKEVTE  214
CeresClone:527278         GLRPROVEVW FONRRARTKL KOTEVDCEVL KRCCENLTEE NRRLOKEVQE  221
CeresClone:514259         GLRAROVEVW FONRRARTKL KOTEVDCEFL KRCCENLTVE NRRLOKEVQE  207

Consensus                 GLRAROVEVW FONRRARTKL KOTEVDCEYL KRCCENLTEE NRRLOKEV-E  250

gi|992598                 LRALKLSPQF YMNMSPPTTL TMCPQCERVA VSSSSSSSSV VNATRAQ---  258
Lead-CeresClone34167      LRALKLSPRL YGQMSPPTTL LMCPSCERVA GPSSSN---- ----------  255
gi|18857720               LRTLKLSPQF YGQMTPPTTL IMCPSCERVG GPSSSN---- ------HH---  252
CeresClone:1014844        LRTLKLSPQF YGQMTPPTTL IMCPSCERVG GPSSSN---- -----HH---  251
gi|8919876                LRALKLSPQF YMHMSPPTTL TMCPSCEHVS APPPQQPPQA --ATSAQ---  259
CeresClone:527278         LRALKLSPQF YMQMSPPTTL TMCPSCERVA VXSSAXGS-- --ATRHHPMA  267
CeresClone:514259         LRALKLSPQF YMHMTPPTTL TMCPSCERVA VPPSSAVDP- --AMRHHHVP  254

Consensus                 LRALKLSPQF YMQMSPPTTL TMCPSCERVA -PSSS----- --A--HH---  300

gi|992598                 ---NHQAPVP MNKPWA---- AMFASKTLDV QRSQM  286
Lead-CeresClone34167      ---HNQRSVS LS-PWL---- QMAHGSTFDV MRPRS  282
gi|18857720               ---HNHRPVS IN-PWVACAG QVAHGLNFEA LRPRS  283
CeresClone:1014844        ---HNHRPVS IN-PWVACAG QVAHGLNFEA LRPRS  282
gi|8919876                ---HHRGSLP VN-AWAQGT- RISHGLTFDA LRPRS  289
CeresClone:527278         HAHAHARPMP NG-PWASAA- PIPH-RPFDA FHQ--  297
CeresClone:514259         P--TQPRAFP IG-PWATAAA TIPH-RPFDA LRRRS  285

Consensus                 ---H--RPVP IN-PWA--A- QIAHG--FDA LRPRS  335
```

```
gi|32165470               ---------- ---------- --MVSGTSST EEVVQVEARR LWNATTKDSH  28
gi|32165466               ---------- ---------- --MVSGTSST EEVVQVEARR LWNATTKDSH  28
gi|32165478               ---------- ---------- --MVSGTSST EEVVQVEARR LWNATAKDSH  28
gi|32165476               ---------- ---------- --MVSGTSST EEVVQVEARR LWNATTKDSH  28
gi|256141                 ---------- ---------- -MGLKGKLIA QIEMKCAGDL LHEHFKSNPH  29
CeresClone:464464         ---LSSLLIS LFHFLLLNFL IMSLAGKISL EIGVHASAAK WFNLFATQLH  47
CeresClone:476943         SPIFVCSISC FLLLLLASFF TMSLAGKITT EIGVHATAAK WFNLFATQLH  50
CeresClone:641520         ---------- ---------- -MSLAGKITT EIGVHATAIK WFNLFATQLH  29
Lead-CeresClone3858       ---------- ---------- -MAMSGTYVI DVPLKGSAEK HYKRWRSENH  29
gi|16191591               ---------- ---------- -MAMSGKYVA EVPLKGSAEK HYRRWRSQNN  29
CeresClone:1115030        STITTQNKQV EALKQREGER EMATSGTYVI EXPLKGTAEK HYKRWKSENH  50
CeresClone:1079413        ---------- ---------- -MATSGTYVI EVPLKGTAEK HYKRWKSENH  29
gi|31559433               ---------- ---------- -MVLAGKLEA EIDINAPADK YYRIFKGQAH  29
gi|33323059               ---------- ---------- MSNLKGKAEI VIEIEASPEQ YYNIWK-QAH  29

Consensus                 ---------- ---------- -M-LSG--ST EV-VQ--AEK -YN--KS--H  50

gi|32165470               NFLPKVLPEA FTSVTLLQG- D-GGVGTVKQ LNFTPGKKDF SFIKERVDEL  76
gi|32165466               NFLPKVLPGV FTSVTLLQG- D-GGVGTVKQ LNFTPGKKDF SFIKERVDEL  76
gi|32165478               NFLPKVLPEV FTSVTLLQG- D-GGVGTVKQ LNFTPGKKDF SFIKERVDEL  76
gi|32165476               NFLPKVLPEV FTSVTLLQG- D-GGVGTVKQ LNFTPGKKDF SFIKERVDEL  76
gi|256141                 QT-STMSPNK ITNFTLHEG- QLGSTGSVVS WKFVLGGKE- RHAKQVLH-I  75
CeresClone:464464         HV--QNLTER VHETKLHHGD DWHHNESIKH WTCTIDGKV- ITYHESIESV  94
CeresClone:476943         HV--QNLTDR VHGTKLHQGE DWHHNETVKH WIYTIDGKA- ITCLESIESI  97
CeresClone:641520         HV--QNLTDR VHGTKLHQGE DWHHNETVKH WIYTIDGKV- ITCLESIESI  76
Lead-CeresClone3858       LV-PEAIGHL IQGVTVHDG- DWDSHGTIKI WNYTRDGKE- EVLKERIE-M  75
gi|16191591               LF-PDAIGHH VQGVTVHDG- DWDSHGSIKS WNYTLDGKP- EVIKEKRE-I  75
CeresClone:1115030        VF-PDAIGHH IQNVTVHEG- EHDSHGSIRS WNYTWDGKE- EMFKEKRE-V  96
CeresClone:1079413        VF-PDAIGHH IQNVTVHEG- EHDSHGSIRS WNYTWDGKE- EMFKEKRE-V  75
gi|31559433               HV-PNISPGI IDEVNVHEG- DWDTHGSIKI WNYTVDGKI- EVFKERVE-F  75
gi|33323059               HI-PNVAGDH IQGVDVHEG- DWHSHGGVKS WKYTVDGIS- GVFKEKVE-F  75

Consensus                 HF-P-VL--- I-SVTLH-G- DW-SHGTVK- WNYTVDGK-- S--KERVE--  100
```

```
gi|32165470            DEENFVYKYT AI EGGPLGKK LSSACFEVKL VPRKE-GGCV AKWTCNYETL 125
gi|32165466            DEENFVYKYT AI EGGPLGKK LSSACFEVKL VPRKE-GGCV AKWTCNYETL 125
gi|32165478            DEENFVYKYT AI EGGPLGKK LSSACFEVKL VPRKE-GGCV AKWTCNYETL 125
gi|32165476            DEENFVYKYT AI EGGPLGKK LSSACFEVKL VPRKE-GGCV AKWTCNYETL 125
gi|256141              DDAKKSI TFN FVEGD-MNEL YKSMTATLTA -------EGNW MTWTFVYEKL 118
CeresClone:464464      DEPNKTI TYK I FGED-I DHQ YKVFKVI FQA I HKDH-CCAF I KWTI EYERV 142
CeresClone:476943      DEQNKTI TYK LFSGD-I DHK YKKFKFTFQA I DKDD-GGAF I KWTVEYERL 145
CeresClone:641520      DEQSKTI TYK LFSGD-I DHN YKNFKFI FQA I DDNDHGGTI I KWTVEYERL 125
Lead-CeresClone3858    DDENMAVTI N GLDGH-VMEV LKVYVTTLHF I PESK-DGCV CKITMVWEKR 123
gi|16191591            DDEKMALTFR GLEGH-VMEK YKKYEVI LQF I PKSN-EGCV CKVTLI WENR 123
CeresClone:1115030     DDENLITLTLR GLEGH-VMEQ LKVYDVI YQF I PKTE-DTCA CKI TI VWEKR 144
CeresClone:1079413     DDENLITLTLR GLEGH-VMEQ LKVYDVI YQF I PKTE-DTCA CKI TMI WEKR 123
gi|31559433            DDEKRAATLT GVEGSTVLNH -SKTFKGTYQV TPKG--NGSL AKLTLVYEKV 123
gi|33323059            DDENKAVI LN GLEGD-VFKE YKSYKPVYHV LPNPKGKGSL VKLSI EYEKL 124

Consensus              D-EN--I TY- -I EG--I --K LKSY----Q- I PK-E-GGCV -KWTI -YEKL 150

gi|32165470            PGVQPDEGKF KEI KEDSFGM LKKVEQYLLS NPNLYF 161
gi|32165466            PGVQPDEGKF KEI KEDSFGM LKKVEQYLLS NPNLYC 161
gi|32165478            PGVQPDEGKF KEI KEDSFGM LKKVEQYLLS NPNLYC 161
gi|32165476            PGVQPDEGKF KEI KEDSFGM LKKVEQYLLS NPNLYC 161
gi|256141              NENI PEPLDI FELAI C---L LKDLEPHHVG K----- 146
CeresClone:464464      GEEVDLPFGF I EYLNK---G SRDVDGHLLK A----- 170
CeresClone:476943      AEEVDPPYGY I EYLHK---C TKDI DVHLLK A----- 173
CeresClone:641520      REEVDPPYGH I EYLHK---C TKDI DGHLLK A----- 153
Lead-CeresClone3858    TEDSPEPI EF MKFVEQ---M I AHNDDHI LQ NQE--- 153
gi|16191591            NEDSPEPI NY MKFVKS---L VADMDDHI LK GQNKA- 155
CeresClone:1115030     NDDSPEPSTY MKFVK----- ---------- ------ 159
CeresClone:1079413     NDEVPEPSSY MKLVKS---M VSEMQEHVHK A----- 151
gi|31559433            KEDVPDPVKY LALD------ -----DMYY-- ------ 141
gi|33323059            HEGVSPPDI Y VKLMVN---I SKDLDVHLNK A----- 152

Consensus              -E-VP-P--- ME-VE----M LK-VD-HLLK ------ 186
```

```
CeresClone:297802     ---------- ---------M AGAAAAAVAS GVSARPA--- --APMRASAG  26
CeresClone:523191     ---------- ---------- ---------- ---------- ----MSLSSS   6
gi|642911             ---------- ---------M AAVNGVGLSW ----PSKLTK NQTPKWGFSP  27
gi|19875              ---------- ---------M AAVNGVGISW ----PSKLTQ SQRPKLVFSP  27
gi|19873              ---------- ---------M AAVNGVGISW ----PSKLTQ GQRPKLVFSP  27
Lead-CeresClone3699   PTSITNSDRQ RQRVSDQRCR RRLQDRELLW GFRVPRRSRK EFLLHQLLTD  50
gi|498914             ---------- --------MA ATLTGSGIAL GFSSSAK--- --FSKRASSS  27
CeresClone:1354315    ---------- ---------- ---------- ---------- ----------   0
gi|6523104            ---------- --------MA ATLTGSGIAL GFSCSAK--- --FSKRASSS  27
gi|28972461           ---------- --------MS ATLTGSGTAL GFSCSSK--- --ISKRVSSS  27
CeresClone:1039319    ---------- --------MS ATLTGSGTAL GFSCSSK--- --IPKRVSPS  27
gi|28972463           ---------- --------MS ATLTGSCTAL GFSCSSK--- --IPKRVSPS  27

Consensus             ---------- ---------- A-L-GSGIA- GFS--SK--- ---PKRVSSS  50

CeresClone:297802     RRARLS---- ---VVRAAIS LEKGE-KAYT VQKSEELFNA -AKELMPGGV  67
CeresClone:523191     TRSRT----- ----VAMAVS IDPKTDNKLT LTKSEEAFAA -AKELMPGGV  46
gi|642911             SHRRCNPSSS SSATIRMTAS VDEKK-KTFT LEKSEEAFSK -AKELMPGGV  75
gi|19875              SPRRCTPSSS ---TIKMTAS VDEKK-KTFT LQKSEEAFSK -AKELMPGGV  72
gi|19873              SPRRCTPSSS ---TIKMTAS VDEKK-KTFT LQKSEEAFSK -AKELMPGGV  72
Lead-CeresClone3699   AASRC----- --------LF PSTRR-RKVS VFRNLRKLSM LLKNLMPGGV  86
gi|498914             SNRRC----- ----IKMSVS VEEKT-KKFT LQKSEEAFNA -AKNLMPGGV  66
CeresClone:1354315    ---------- ------MSVS VEEKT-KKFT LQKSEEAFNA -AKNLMPGGV  32
gi|6523104            SNRRC----- ----IKMSVS VEEKT-KKFT LQKSEEAFNA -AKNLMPGGV  66
gi|28972461           PSTRC----- ---SIKMSVS VDEKK-KSFT LQKSEEAFNA -AKNLMPGGV  67
CeresClone:1039319    SSNRC----- ---SIKMSVS VDEKK-KSFT LQKSEEAFNA -AKDLMPGGV  67
gi|28972463           SSNRC----- ---SIKMSVS VDEKK-KSFT LQKSEEAFNA -AKDLMPGGV  67

Consensus             SN-RC----- ----IKMSVS VDEKK-K-FT LQKSEEAFNA -AK-LMPGGV 100
```

```
CeresClone:297802      NSPVRAFKSV GGQPVVEDSV KGSRMWDVDG NEYIDYVGSW GPAIIGHADD  117
CeresClone:523191      NSPVRAFKSV GGQPIVIDSV KGSRMWDIDG NEYIDYVGSW GPAIIGHADD  96
gi|642911              NSPVRAFKSV GGQPIIIDSV KGSRMRDIDG NEYIDYVGSW GPAIIGHADD  125
gi|19875               NSPVRAFKSV GGQPIIIDSV KGSRMRDIDG NDYIDYVGSW GPAIIGHADD  122
gi|19873               NSPVRAFKSV GGQPIIIDSV KGSRMRDIDG NEYIDYVGSW GPAIIGHADD  122
Lead-CeresClone3699    NSPVRAFKSV GGQPVLIDSV KGSKMWDIDG NEYIDYVGSW GPAIIGHADD  136
gi|498914              NSPVRAFKSV GGQPVVMDSA KGSRIRDIDG NEYIDYVGSW GPAIIGHADD  116
CeresClone:1354315     NSPVRAFKSV GGQPVVMDSA KGSRIRDIDG NEYIDYVGSW GPAIIGHADD  82
gi|6523104             NSPVRAFKSV GGQPVVMDSA KGSRIRDIDG NEYIDYVGSW GPAIIGHADD  116
gi|28972461            NSPVRAFKSV GGQPVLIDSV KGSKMWDIDG NEYIDYVGSW GPAIIGHADD  117
CeresClone:1039319     NSPVRAFKSV GGQPVLIDSV KGSKMWDIDG NEYIDYVGSW GPAIIGHADD  117
gi|28972463            NSPVRAFKSV GGQPVLIDSV KGSKMWDIDG NEYIDYVGSW GPAIIGHADD  117

Consensus              NSPVRAFKSV GGQPVIIDSV KGSRM-DIDG NEYIDYVGSW GPAIIGHADD  150

CeresClone:297802      KVNAAL ETL KKGTSFGAPC LLENVLAEMV ISAVPSIEMV RFVNSGTEAC  167
CeresClone:523191      QVLAALGETM KKGTSFGAPC LLENTLAELV IDAVPSIEMV RFVNSGTEAC  146
gi|642911              EVLAALAETM KKGTSFGAPC LLENTLAEMV ISAVPSIEMV RFVNSGTEAC  175
gi|19875               EVLAALAETM KKGTSFGAPC LLENTLAEMV ISAVPSIEMV RFVNSGTEAC  172
gi|19873               EVLAALAETM KKGTSFGAPC LLENTLAEMV ISAVPSIEMV RFVNSGTEAC  172
Lead-CeresClone3699    EVLAALAETM KKGTSFGAPC LLENVLAEMV ISAVPSIEMV RFVNSGTETC  186
gi|498914              EVLAALAETM KKGTSFGAPC LLENVLAEMV ISAVPSIEMV RFVNSGTEAC  166
CeresClone:1354315     EVLAALAETM KKGTSFGAPC LLENVLAEMV ISAVPSIEMV RFVNSGTEAC  132
gi|6523104             EVLAALAETM KKGTSFGAPC LLENVLAEMV ISAVPSIEMV RFVNSGTEAC  166
gi|28972461            EVLAALAETM KKGTSFGAPC LLENVLAEMV ISAVPSIEMV RFVNSGTEAC  167
CeresClone:1039319     EVLAALAETM KKGTSFGAPC LLENVLAEMV ISAVPSIEMV RFVNSGTEAC  167
gi|28972463            EVLAALAETM KKGTSFGAPC LLENVLAEMV ISAVPSIEMV RFVNSGTEAC  167

Consensus              EVLAALAETM KKGTSFGAPC LLENVLAEMV ISAVPSIEMV RFVNSGTEAC  200
```

```
CeresClone:297802        MGALRLVRAF TGREKI KFE GCYHGHADSF LVKAGSGVAT LGLPDSPGVP 217
CeresClone:523191        MGALRLARAY TGREKI KFE GCYHGHADPF LVKAGSGVAT LGLPDSPGVP 196
gi|642911                MGVLRLARAF TCRPKI KFE GCYHGHADPF LVKAGSGVAT LGLPDSPGVP 225
gi|19875                 MGVLRLARAF TGRPKI KFE GCYHGHADPF LVKAGSGVAT LGLPDSPGVP 222
gi|19873                 MGVLRLARAF TGRPKI KFE GCYHGHADPF LVKAGSGVAT LGLPDSPGGP 222
Lead-CeresClone3699      MGVLRLARAF TNKEKFIKFE GCYHGHANAF LVKAGSGVAT LGLPDSPGVP 236
gi|498914                MGVLRLARAF TGKQKFIKFE GCYHGHAKSF LVKAGSGVAT LGLPDSPGVP 216
CeresClone:1354315       MGVLRLARAF TGKQKFIKFE GCYHGHANSF LVKAGSGVAT LGLPDSPGVP 182
gi|6523104               MGVLRLARAF TGKQKFIKFE GCYHGHANSF LVKAGSGVAT LGLPDSPGVP 216
gi|28972461              MGVLRLARAF TNKEKFIKFE GCYHGHANAF LVKAGSGVAT LGLPDSPGVP 217
CeresClone:1039319       MGVLRLARAF TNKEKFIKFE GCYHGHANAF LVKAGSGVAT LGLPDSPGVP 217
gi|28972463              MGVLRLARAF TNKEKFIKFE GCYHGHANAF LVKAGSGVAT LGLPDSPGVP 217

Consensus                MGVLRLARAF TGKEKFIKFE GCYHGHAN-F LVKAGSGVAT LGLPDSPGVP 250

CeresClone:297802        KGATYETLTA PYNDVEAVKK LFEDNAGEIA AVFLEPVVGN AGFIPPQPGF 267
CeresClone:523191        KAATFETLTA PYNDTEAIEK LFEANKGEIA AVFLEPVVGN AGFIVPKPDF 246
gi|642911                KAATLDTLTA PYNDISAVES LFEEHKGEIA AVILEPVVGN AGFIPPKLEF 275
gi|19875                 KAATTDTLTA PYNDISAVES LFKEHKGEVA AIILEPVVGN AGFIQPNPDF 272
gi|19873                 KAATSDTLTA PYNDISAVES LFEEHKGEVA AIILEPVVGN AGFIQPNLDF 272
Lead-CeresClone3699      KAATSDTLTA PYNDLEAVEK LFAAHKGEIS AVILEPVVGN SGFIPPTPEF 286
gi|498914                KAATSDTLTA PYNDIAAVEK LFEANKGEIA AIILEPVVGN SGFITPKPEF 266
CeresClone:1354315       KAATSDTLTA PYNDIAAVEK LFEANKGEIA AIILEPVVGN SGFITPKPEF 232
gi|6523104               KAATSDTLTA PYNDIAAVEK LFEANKGEIA AIILEPVVGN SGFITPKPEF 266
gi|28972461              KAATSDTLTA PYNDIEAVAK LFEAHKGEIS AVILEPVVGN SGFITPTPEF 267
CeresClone:1039319       KAATSDTLTA PYNDIEAVAK LFEAHKGEIS AVILEPVVGN SGFITPTLEF 267
gi|28972463              KAATSDTLTA PYNDIEAVAK LFEAHKGEIS AVILEPVVGN SGFITPTLEF 267

Consensus                KAATSDTLTA PYNDI-AVEK LFEAHKGEIA AVILEPVVGN SGFITPKPEF 300
```

| | | | | | | |
|---|---|---|---|---|---|---|
| CeresClone:297802 | LNALRDLTKQ | DGALLVFDEV | MTGFRLSYGG | AQEYFGITPD | VTTLGKIIGG | 317 |
| CeresClone:523191 | HSFLRKITKE | NNTLLVFDEV | MTGFRLSYGG | AQEYFGITPD | ITTLGKIIGG | 296 |
| gi\|642911 | LAAIRKITKE | NDALLIFDEV | MTGFRLAYGG | AQEYFGITPD | LTTLGKIIGG | 325 |
| gi\|19875 | LAAIRKITKE | NDALLIFDEV | MTGFRLAYGG | AQEYFGITPD | LTTLGKIIGG | 322 |
| gi\|19873 | LAAIRKITKE | NDALLIFDEV | MTGFRLAYGG | AQEYFGITPD | LTTLGKIIGG | 322 |
| Lead-CeresClone3699 | INGLRQLTKD | NGVLLIFDEV | MTGFRLAYGG | AQEYFGITPD | LTTLGKIIGG | 336 |
| gi\|498914 | IEGIRRITKD | NGALLILDEV | MTGFRLAYGG | AQEYFGITPD | LTTLGKIIGG | 316 |
| CeresClone:1354315 | IEGIRRITKD | NGALLIFDEV | MTGFRLAYGG | AQEYFGITPD | LTTLGKIIGG | 282 |
| gi\|6523104 | IEGIRRITKD | NGALLIFDEV | MTGFRLAYGG | AQEYFGITPD | LTTLGKIIGG | 316 |
| gi\|28972461 | INGLRQLTKD | NGALLIFDEV | MTGFRLAYGG | AQEYFGITPD | LTTLGKIIGG | 317 |
| CeresClone:1039319 | INGLRQLSRD | NGALLIFDEV | MTGFRLAYGG | AQEYFGITPD | LTTLGKIIGG | 317 |
| gi\|28972463 | INGLRQLSRD | NGALLIFDEV | MTGFRLAYGG | AQEYFGITPD | LTTLGKIIGG | 317 |
| Consensus | I-G-R-ITKD | NGALLIFDEV | MTGFRLAYGG | AQEYFGITPD | LTTLGKIIGG | 350 |

| | | | | | | |
|---|---|---|---|---|---|---|
| CeresClone:297802 | GLPVGAYGGR | RDIMEMVAPA | GPMYQAGTLS | GNPLAMTAGI | HTLKRLIEPG | 367 |
| CeresClone:523191 | GLPVGAYGGR | RDIMEKVAPA | GPMYQAGTLS | GNPLAMTAGI | ETLQRIKEPG | 346 |
| gi\|642911 | GLPVGAYGGR | RDIMEMVAPA | GPMYQAGTLS | GNPLAMTAGI | HTLKRLQGQG | 375 |
| gi\|19875 | GLPVGAYGGR | RDIMEMVAPA | GPMYQAGTLS | GNPLAMTAGI | HTLKRLQGPG | 372 |
| gi\|19873 | GLPVGAYGGR | RDIMEMVAPA | GPMYQAGTLS | GNPLAMTAGI | HTLKRLQGPG | 372 |
| Lead-CeresClone3699 | GLPVGAYGGR | RDIMEMVAPA | GPMYQAGTLS | GNPLAMTAGI | HTLKRLKQAG | 386 |
| gi\|498914 | GLPVGAYGGR | RDIMEMVAPA | GPMYQAGTLS | GNPLAMTAGI | HTLKRLSQPG | 366 |
| CeresClone:1354315 | GLPVGAYGGR | RDIMEMVAPA | GPMYQAGTLS | GNPLAMTAGI | HTLKRLSQPG | 332 |
| gi\|6523104 | GLPVGAYGGR | RDIMEMVAPA | GPMYQAGTLS | GNPLAMTAGI | HTLKRLSQPG | 366 |
| gi\|28972461 | GLPVGAYGGR | RDIMEMVAPA | GPMYQAGTLS | GNPLAMTAGI | HTLKRLKQPG | 367 |
| CeresClone:1039319 | GLPVGAYGGR | RDIMEMVAPA | GPMYQAGTLS | GNPLAMTAGI | HTLKRLKQPG | 367 |
| gi\|28972463 | GLPVGAYGGR | RDIMEMVAPA | GPMYQAGTLS | GNPLAMTAGI | HTLKRLKQPG | 367 |
| Consensus | GLPVGAYGGR | RDIMEMVAPA | GPMYQAGTLS | GNPLAMTAGI | HTLKRLKQPG | 400 |

| | | | | | | |
|---|---|---|---|---|---|---|
| CeresClone:297802 | TYEYLDKITG | ELVRGILDVG | AKAGHDMCGG | HIRGMFGFFF | TGGPVHNFGD | 417 |
| CeresClone:523191 | TYEYLDKITG | ELVEGIIEAG | KRAGHAICGG | HIRGMFGFFF | TEGPVYNFAD | 396 |
| gi\|642911 | TYEHLDKITA | ELTQGILDAG | KKTGHAMCGG | SIRGMFGFFF | ADGPIYNFSD | 425 |
| gi\|19875 | TYDYLDKITG | ELTQGILDAG | KKTGHAMCGG | YIRGMFGFFF | VEGPVNNFSD | 422 |
| gi\|19873 | TYEYLDKITG | ELTQGILDAG | KKTGHAMCGG | YIRGMFGFLF | AEGPVNNFSD | 422 |
| Lead-CeresClone3699 | TYEYLDKITK | ELTNGILEAG | KKTGHPMCGG | YISGMFGFFF | TEGPVYNFAD | 436 |
| gi\|498914 | TYEYLDKITK | ELTNGILEAG | KKTGHAMCGG | YISGMFGFFF | TEGPVYDFSD | 416 |
| CeresClone:1354315 | TYEYLDKITK | ELTNGILEAG | KKTGHAMCGG | YISGMFGFFF | TEGPVYDFSD | 382 |
| gi\|6523104 | TYEYLDKITK | ELTNGILEAG | KKTGHAMCGG | YISGMFGFFF | TEGPVYDFSD | 416 |
| gi\|28972461 | TYEYLDKITK | ELTNGILEAG | KKTGHPMCGG | YISGMFGFFF | AEGPVYNFAD | 417 |
| CeresClone:1039319 | TYEYLDKITK | ELTNGILEAG | KKTGHAMCGG | YISGMFGFFF | TEGPVYNFAD | 417 |
| gi\|28972463 | TYEYLDKITK | ELTNGILEAG | KKTGHAMCGG | YISGMFGFFF | TEGPVYNFAD | 417 |
| Consensus | TYEYLDKITK | ELTNGILEAG | KKTGHAMCGG | YISGMFGFFF | TEGPVYNFSD | 450 |

| | | | | | | |
|---|---|---|---|---|---|---|
| CeresClone:297802 | AKKSDTEKFG | RFYRGMLEEG | VYFAPSQFEA | GFTSLAHTSQ | DIEKTVEAAE | 467 |
| CeresClone:523191 | AKKSDTAKFA | RFFWGMLAEG | VYLAPSQFEA | GFTSLAHTSD | DIKKTIAAAE | 446 |
| gi\|642911 | AKKSDTEKFG | RFYRGMLEEG | VYFAPSQFEA | GFTSLAHTPE | DIQRTVAAAE | 475 |
| gi\|19875 | AKKSDTEKFG | RFYRGMLEEG | VYFAPSQFEA | GFTSLAHTSE | DIQRTVAAAE | 472 |
| gi\|19873 | AKKSDTEKFG | RFYRGMLEEG | VYFAPSQFEA | GFTSLAHTSE | DIQKTVAAAE | 472 |
| Lead-CeresClone3699 | AKKSDTEKFG | RFFRGMLEEG | VYFAPSQFEA | GFTSLAHTPE | DIQLTIAAAE | 486 |
| gi\|498914 | AKKSDTEKFG | KFFRGMLEEG | VYLAPSQFEA | GFTSLAHTSE | DIQFTIAAAE | 466 |
| CeresClone:1354315 | AKKSDTEKFG | KFFRGMLEEG | VYLAPSQFEA | GFTSLAHTSE | DIQFTIAAAE | 432 |
| gi\|6523104 | AKKSDTEKFG | KFFRGMLEEG | VYLAPSQFEA | GFTSLAHTSE | DIQFTIAAAE | 466 |
| gi\|28972461 | AKKSDTEKFG | KFFRGMLEEG | VYFAPSQFEA | GFTSLAHTSE | DIQFTISAAE | 467 |
| CeresClone:1039319 | AKKSDTEKFG | RFFRGMLEEG | VYFAPSQFEA | GFTSLAHTTE | DVQFTIAAAE | 467 |
| gi\|28972463 | AKKSDTEKFG | RFFRGMLEEG | VYFAPSQFEA | GFTSLAHTTE | DVQFTIAAAE | 467 |
| Consensus | AKKSDTEKFG | RFFRGMLEEG | VYFAPSQFEA | GFTSLAHTSE | DIQFTIAAAE | 500 |

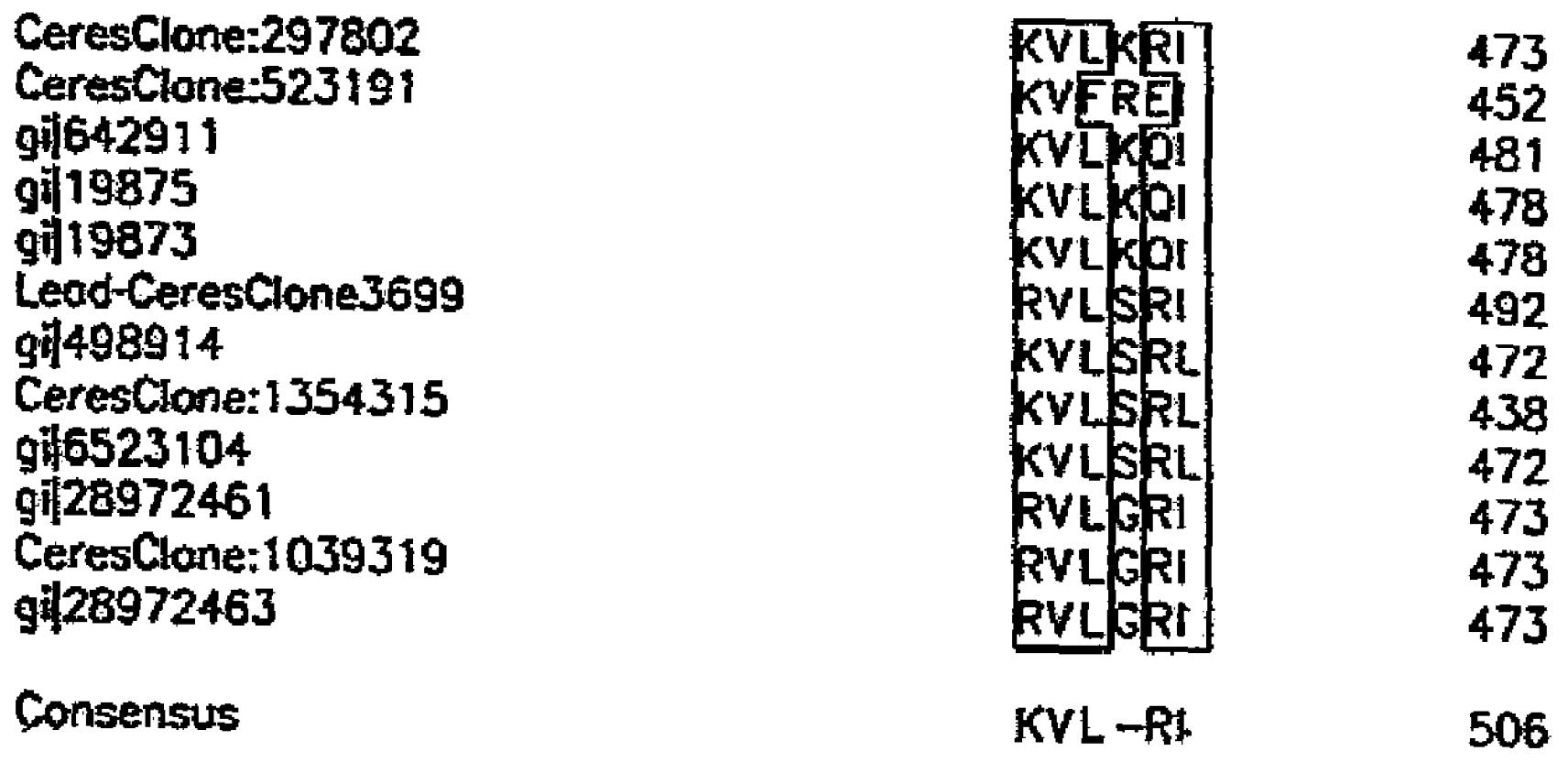

| | | |
|---|---|---|
| CeresClone:297802 | KVLKRI | 473 |
| CeresClone:523191 | KVFREI | 452 |
| gi\|642911 | KVLKQI | 481 |
| gi\|19875 | KVLKQI | 478 |
| gi\|19873 | KVLKQI | 478 |
| Lead-CeresClone3699 | RVLSRI | 492 |
| gi\|498914 | KVLSRL | 472 |
| CeresClone:1354315 | KVLSRL | 438 |
| gi\|6523104 | KVLSRL | 472 |
| gi\|28972461 | RVLGRI | 473 |
| CeresClone:1039319 | RVLGRI | 473 |
| gi\|28972463 | RVLGRI | 473 |
| Consensus | KVL -RI | 506 |

```
CeresClone:632635        MAPK-AEKKP AAKKPAEEEP AAE--KAPAA KKPKAEKRLP AGKSAAGKDG  47
CeresClone:1438404       MAPK-AEKKP AEKKPAEEKK STVGDKAPAE KKPKAGKKLP KEGGAGG-EG  48
CeresClone:652242        MAPK-AEKKP AEKKPAEEKK STVGDKAPAE KKPKAGKKLP KEGGAGG-EG  48
Lead-CeresClone3363      MAK--ADKKP AEKKPAEKTP AAE-PAAAAE KKPKAGKKLP KEP-AVA--G  44
CeresClone:1059204       MAK--ADKKP AEKKPAETTT -----AAAAE KKPKAGKKLP KDP-AVA--G  40
CeresClone:1123883       MAK--ADKKP AEKKPAAETT TA---AAAAE KKPKAGKKLP KDPSAVA--G  43
CeresClone:1379029       MAPKAAXKKP AEKKPAE--- -----KAPAE KKPKAGKKLP KDPSAVA--G  40
CeresClone:1032859       MAPKAAEKKP AEKKXAE--- -----KAPAE KKPKAGKKLP KDPSAVA--G  40
CeresClone:1053095       MAPKAAEKKP AEKKPAE--- -----KAPAE KKPKAGKKLP KDPSAVA--G  40
CeresClone:952003        MAPKAAEKKP AEKKTAE--- -----KAPAE KKPKAGKKLP KDPSAVA--G  40
CeresClone:1382087       MAPKAAEKKP AEKKTAE--- -----KAPAE KKPKAGKKLP KDPSAVA--G  40

Consensus                MAPK-AEKKP AEKKPAE--- -----KAPAE KKPKAGKKLP KDPSAVA--G  50

CeresClone:632635        DKKGKKKAKK SVETYKIYIF KVLKQVHPDI GISSKAMSIM NSFINDIFEK  97
CeresClone:1438404       GKK-KKRNKK SVETYKIYIF KVLKQVHPDI GISSKAMGIM NSFINDIFEK  97
CeresClone:652242        GKK-KKRXKK SVETYKIYIF KVLKQVHPDI GISSKAMGIM NSFINDIFEK  97
Lead-CeresClone3363      DKK-KKRSKK NVETYKIYIF KVLKQVHPDI GISSKAMGIM NSFINDIFEK  93
CeresClone:1059204       DKK-KKRTKK SVETYKIYIF KVLKQVHPDI GISSKAMGIM NSFINDIFEK  89
CeresClone:1123883       DKK-KKRSKK SVETYKIYIF KVLKQVHPDV GISSKAMGIM NSFINDIFEK  92
CeresClone:1379029       DKK-KKRSXK SVXTYKIYIF XVLKQVHPDI GISSKAMGIM NXFINDIFEK  89
CeresClone:1032859       DKK-KKRSKK SVETYKIYIF KVLKQVHPDI GISSKAMGIM NSFINDIFEK  89
CeresClone:1053095       DKK-KKRSKK SVETYKIYIF KVLKQVHPDI GISSKAMGIM NSFINDIFEK  89
CeresClone:952003        DKK-KKRSKK SVETYKIYIF KVLKQVHPDI GISSKAMGIM NSFINDIFEK  89
CeresClone:1382087       DKK-KKRSKK SVETYKIYIF KVLKQVHPDI GISSKAMGIM NSFINDIFEK  89

Consensus                DKK-KKRSKK SVETYKIYIF KVLKQVHPDI GISSKAMGIM NSFINDIFEK 100
```

```
CeresClone:632635        LAGEAAKLAR YNKKPTITSR EIQTSVRLVL PGELAKHAVS EGTKAVTKFT 147
CeresClone:1438404       LAQESSRLAR YNKKPTITSR EIQTAVRLVL PGELAKHAVS EGTKAVTKFT 147
CeresClone:652242        LAQESSRLAR YNKKPTITSR EIQTAVRLVL PGELAKHAVS EGTKAVTKFT 147
Lead-CeresClone3363      LAGESSKLAR YNKKPTITSR EIQTAVRLVL PGELAKHAVS EGTKAVTKFT 143
CeresClone:1059204       LAGESSKLAR YNKKPTITSR EIQTAVRLVL PGELAKHAVS EGTKAVTKFT 139
CeresClone:1123883       LAGESSKLAR YNKKPTITSR EIQTAVRLVL PGELAKHAVS EGTKAVTKFT 142
CeresClone:1379029       LAGESSKLAR YNKKPTITSR EIQTAXRLVL PGELAKHAVS EGTKAVTKFT 139
CeresClone:1032859       LAGESSKLAR YNKKPTITSR EIQTAVRLVL PGELAKHAVS EXTKAVTKFT 139
CeresClone:1053095       LAGESSKLAR YNKKPTITSR EIQTAVRLVL PGELAKHAVS EGTKAVTKFT 139
CeresClone:952003        LAGESSKLAR YNKKPTIXSR EIQTAVRLVL PGELAKHAVS EGTKAVTKFT 139
CeresClone:1382087       LAGESSKLAR YNKKPTITSR EIQTAVRLVL PGELAKHAVS EGTKAVTKFT 139

Consensus                LAGESSKLAR YNKKPTITSR EIQTAVRLVL PGELAKHAVS EGTKAVTKFT 150

CeresClone:632635        SS 149
CeresClone:1438404       SS 149
CeresClone:652242        SS 149
Lead-CeresClone3363      SS 145
CeresClone:1059204       SS 141
CeresClone:1123883       SS 144
CeresClone:1379029       SS 141
CeresClone:1032859       SS 141
CeresClone:1053095       S- 140
CeresClone:952003        SS 141
CeresClone:1382087       SS 141

Consensus                SS 152
```

```
CeresClone:1250120      ---------- ---------- ---------- ---------- ----------   0
CeresClone:276087       ---------- ---------- ---------- ---------- ----------   0
CeresClone:1060946      ---------- ---------- ---------- ---------- ----------   0
CeresClone:303119       ---------- ---------- ---------- ---------- ----------   0
CeresClone:537272       MDMTNMETNR KFLSLPLSNN NNSGDNRR-- --VPVTSNS ----------   35
Lead-CeresClone3000     MEI------- ---------- ---------- ---------- ----------   3
CeresClone:541719       MTMMPLVTSH HA-TNPSNPS NNTNNNENTN CLFIPNCSNS SGTPSIMLHN   49
CeresClone:524559       MTMMPLVTSH HAGHHPINPS NN--NNVNTN CLFIPNCSNS TGTPSIMLHN   48

Consensus               M-M------- ---------- ---------- ---------- ----------   50

CeresClone:1250120      ---------- ---------- ---------- ---------- ----------   0
CeresClone:276087       ---------- ---------- ---------- ---------- MSAAEADAIK   10
CeresClone:1060946      ---------- ---------- ---------- ---------- MSAAEADAIK   10
CeresClone:303119       ---------- ---------- ---------- ---------- MSAAEAEAIK   10
CeresClone:537272       ---------- ---------- --IAQEHHYS HHHN------ --PTDTCSVR   55
Lead-CeresClone3000     ---------- ---------- --------HHN EIVAGGINPC SSSSSSASVK   26
CeresClone:541719       N--NNTDDDNN KTSTNTGLGY YFMESDHHHR ---NNNNNGS SSSSSSSAVK   95
CeresClone:524559       NHNNNKTDDD DNNNNTGLGY YFMESDHHHH HHGNNNNNGS SSSSSSSAVK   98

Consensus               ---------- ---------- --------HH- ---------- -S--E--AVK   100

CeresClone:1250120      ---------- ---------- ---------- ---------- ----------   0
CeresClone:276087       AKIVAHPQYS ALLAAYLDCQ KVGAPPDLLE RL-------T AMAAKLDARP   53
CeresClone:1060946      AKIVAHPQYS ALLAAYLDCQ KVGAPPDLLE RL-------T AMAAKLDARP   53
CeresClone:303119       AKIVAHPQYS ALLAAYLDCQ KVGAPPDVLE RL-------T AMAAKLDASA   53
CeresClone:537272       DKIMAHPLFP RLLSSYLNCL KVGAPPEVVA SLEESYAKYE SFNA-SSGRI   104
Lead-CeresClone3000     AKIMAHPHYH RLLAAYVNCQ KVGAPPEVVA RLEEACSSAA AAAA---SMG   73
CeresClone:541719       AKIMAHPHYH RLLAAYVNCQ KVGAPPEVVA RLEEACASAA TMAGDAAAAA   145
CeresClone:524559       AKIMAHPHYH RLLAAYVNCQ KVGAPPEVVA RLEEACASAA TMAG-GDAAA   147

Consensus               AKIMAHP-Y- RLLAAYLNCQ KVGAPPDVVA RLEEA-A--- AMAA--DA--   150
```

```
CeresClone:1250120      ----------- -----MEAYHE MLVKYREELT RPLQEAMEFL RRVETQLNSL   36
CeresClone:276087       PGRHGPRDPE LDQFMEAYCN MLVKYREELT RPIDEAMEFL KRVEAQLDSI  103
CeresClone:1060946      PGRHGPRDPE LDQFMEAYCN MLVKYREELT RPIDEAMEFL KRVEAQLDSI  103
CeresClone:303119       AGRHEPRDPE LDQFMEAYCN MLVKYREELT RPIDEAMEFL KRVEAQLDCI  103
CeresClone:537272       GGGSI GEDPA LDQFMEAYCE MLI KYEQELT KPFKEAMLFF SRI ECQLKAL  154
Lead-CeresClone3000     PTGCLGEDPG LDQFMEAYCE MLVKYEQELS KPFKEAMVFL QRVECQFKSL  123
CeresClone:541719       GSSCI GEDPA LDQFMEAYCE MLFKYEQELS KPLKEAMLFL QRI ECQFKNL  195
CeresClone:524559       GSSCI GEDPA LDQFMEAYCE MLFKYEQELS KPLKEAMLFL QRI ECQFKNL  197

Consensus               -G--I GEDP- LDQFMEAYCE MLVKY--ELT -P-KEAM-FL -RVECQL-SL  200

CeresClone:1250120      SI SGRSLRNI LS-------- -SGSSE-EDQ EGSGGETELP EI DAHGVDQE   76
CeresClone:276087       AGGGSSSSAR LSLADGKSSE GAGSSEDDDM DPSGRENEPP EI DPRAEDKE  153
CeresClone:1060946      AGGGSSSSAR LSLADGKSSE GAGSSEDDDM DPSGRENEPP EI DPRAEDKE  153
CeresClone:303119       SGGGGSSSAR LSLADGK-SE GVGSSE-DDM DPNGRENDPP EI DPRAEDKE  151
CeresClone:537272       AVSS-----D FG-------Q SETSSK-NEV DVHEN----- NLDSQAEDRE  186
Lead-CeresClone3000     SLSSPSSFSG YGETAI D-RN NNGSSE-EEV DMNNE----- FVDPQAEDRE  166
CeresClone:541719       FI SSTDFACN EG------AE RNGSSE-EDV DLHN------ MI DPQAEDRE  232
CeresClone:524559       TI SSSDFASN EG------GD RNGSSE-EDV DLHN------ MI DPQAEDRD  234

Consensus               -I S-SSSS-- L-------SE --GSSE-EDM DL-G-E-E-P. EI DPQAEDRE  250

CeresClone:1250120      LKHHLLKKYS GYLSSLKQEL SKKKKKGKLP KDARQQLLSW WEMHYKWPYP  126
CeresClone:276087       LKYQLLKKYS GYLSSLRQEF SKKKKKGKLP KEARQKLLHW WELHYKWPYP  203
CeresClone:1060946      LKYQLLKKYS GYLSSLRQEF SKKKKKGKLP KEARQKLLHW WELHYKWPYP  203
CeresClone:303119       LKYQLLKKYS GYLSSLRQEF SKKKKKGKLP KEARQKLLHW WELHYKWPYP  201
CeresClone:537272       LKVQLLRKYS GYLGSLKKEF LKKKKNGKLP KEARQQLLDW WNRHYKWPYP  236
Lead-CeresClone3000     LKGQLLRKYS GYLGSLKQEF MKKRKKGKLP KEARQQLLDW WSRHYKWPYP  216
CeresClone:541719       LKGQLLRKYS GYLGSLKQEF MKKRKKGKLP KEARQQLLEW WSRHYKWPYP  282
CeresClone:524559       LKGQLLRKYS GYLGSLKQEF MKKRKKGKLP KEARQQLLEW WNRHYKWPYP  284

Consensus               LKYQLL-KYS GYL-SLKQEF -KKKKKGKLP KEARQQLL-W W--HYKWPYP  300
```

| | | | | | | |
|---|---|---|---|---|---|---|
| CeresClone:1250120 | SESQKVALAE | STGLDLKQIN | NWFINQRKRH | WKPSDEMQFV | MMDAYHPPNA | 176 |
| CeresClone:276087 | SETEKIALAE | ATGLDQKQIN | NWFINQRKRH | WKPSEDMPFV | MMEGFHPQTA | 253 |
| CeresClone:1060946 | SETEKIALAE | ATGLDQKQIN | NWFINQRKRH | WKPSEDMPFV | MMEGFHPQTA | 253 |
| CeresClone:303119 | SETEKIALAE | STGLDQKQIN | NWFINQRKRH | WKPSEDMPFV | MMEGFHPQNA | 251 |
| CeresClone:537272 | SESQKQALAE | STGLDMKQIN | NWFINQRKRH | WKPSEDMQFA | VMDATN---- | 282 |
| Lead-CeresClone3000 | SEQQKLALAE | STGLDQKQIN | NWFINQRKRH | WKPSEDMQFV | VMDATHPHH- | 265 |
| CeresClone:541719 | SESQKLALAE | STGLDQKQIN | NWFINQRKRH | WKPSEDMQFV | VMDPSHPH-- | 330 |
| CeresClone:524559 | SESQKLALAE | STGLDQKQIN | NWFINQRKRH | WKPSEDMQFV | VMDPSHPH-- | 332 |
| Consensus | SESQK-ALAE | STGLDQKQIN | NWFINQRKRH | WKPSEDMQFV | -MD--HP--A | 350 |

| | | | | |
|---|---|---|---|---|
| CeresClone:1250120 | A-FYMD---- | GHFVNDSG-L | YRFG- | 194 |
| CeresClone:276087 | AALYLD---G | GAFMADGMTT | YRLGS | 275 |
| CeresClone:1060946 | AALYLD---G | GAFMADGMTT | YRLGS | 275 |
| CeresClone:303119 | AALYMD---- | GPFMRDGM-- | YRLGS | 270 |
| CeresClone:537272 | --YYMENVMC | KPFPMDSM-- | -PMLL | 302 |
| Lead-CeresClone3000 | --YFMDNVLG | NPFPMDHI-S | STML- | 286 |
| CeresClone:541719 | --YYMDNVLG | NPFPMDLS-- | HPML- | 350 |
| CeresClone:524559 | --YYMDNVLG | NPFPMDLS-- | HPML- | 352 |
| Consensus | A-YYMDNVLG | GPF-MD-M-- | YRM-- | 375 |

```
CeresClone:1464066       M---------  ----------  ----------  ----------  ----------   1
CeresClone:1453619       M---------  ----------  ----------  ----------  ----------   1
CeresClone:1036726       MQI FVKTLTG KTI TLEVESS DTI DNVKAKI QDKEGI PPDQ QRLI FAGKQL  50
CeresClone:513071        MQI FVKTLTG KTI TLEVESS DTVDNVKAKI QDKEGI PPDQ QRLI FAGKQL  50
CeresClone:273687        MQI FVKTLTG KTI TLEVESS DTVDNVKAKI QDKEGI PPDQ QRLI FAGKQL  50
CeresClone:522921        M---------  ----------  ----------  ----------  ----------   1
Lead-CeresClone2403      M---------  ----------  ----------  ----------  ----------   1
CeresClone:1439969       MQI FVKTLTG KTI TLEVESS NTI DNVKSKI QDKEGI PPDQ QRLI FAGKQL  50
CeresClone:1482731       MQI FVKTLTG KTI TLEVESS DTI DNVKSKI QDKEGI PPDQ QRLI FAGKQL  50
CeresClone:1123804       MQI FVKTLTG KTI TLEVEGS DTI DNVKSKI QDKEGI PPDQ QRLI FAGKQL  50
CeresClone:1005253       M---------  ----------  ----------  ----------  ----------   1

Consensus                MQI FVKTLTG KTI TLEVE-S DTI DNVK-KI QDKEGI PPDQ QRLI FAGKQL  50

CeresClone:1464066       ----------  ----------  ---------K   VKTLTGKEI E I NI EPNDTI D  23
CeresClone:1453619       ----------  ----------  ---------K   VKTLTGKEI E I DI EPTDTI D  23
CeresClone:1036726       EDGRTLADYN  I QKESTLHLV LRLRGGTMI K VKTLTGKEI E I DI EPTDTI D 100
CeresClone:513071        EDGRTLADYN  I QKESTLHLV LRLRGGTMI K VKTLTGKEI E I DI EPTDSI D 100
CeresClone:273687        EDGRTLADYN  I QKESTLHLV LRLRGGTMI K VKTLTGKEI E I DI EPTDSI D 100
CeresClone:522921        ----------  ----------  ---------K   VKTLTGKEI E I DI EPTDTI D  23
Lead-CeresClone2403      ----------  ----------  ---------K   VKTLTGKEI E I DI EPTDTI D  23
CeresClone:1439969       EDGRTLADYN  I QKESTLHLV LRLRGGTMI K VKTLTGKEI E I DI EPTDTI D 100
CeresClone:1482731       EDGRTLADYN  I QKESTLHLV LRLRGGTMI K VKTLTGKEI E I DI EPTDTI D 100
CeresClone:1123804       EDGRTLADYN  I QKESTLHLV LRLRGGTMI K VKTLTGKEI E I DI EPTDTI D 100
CeresClone:1005253       ----------  ----------  ---------K   VKTLTGKEI E I DI EPTDTI D  23

Consensus                EDGRTLADYN  I QKESTLHLV LRLRGGTMI K VKTLTGKEI E I DI EPTDTI D 100
```

```
CeresClone:1464066      RI KERVEERE GI PPVQQRLI YAGKQLADDK TVKDYNI EGG SVLHLVLALR  73
CeresClone:1453619      RI KERVEEKE GI PPVQQRLI YAGEALADDK TXXDYNI EGG SVLHLVLALR  73
CeresClone:1036726      RI KERVEEKE GI PPVQQRLI YAGKQLADDK TXKDYNI EGG SVSA------ 144
CeresClone:513071       RI KERVEEKE GI PPVQQRLI YAGKQLADDK TAKDYNI EGG SVLHLXLALR 150
CeresClone:273687       RI KERVEEKE GI PPVQQRLI YAGKQLADDK TAKDYNI EGG SVLHLVLALR 150
CeresClone:522921       RI KERVEEKE GI PPVQQRLI YAGKQLADDK TAKEYNI EGG SVLHLVLALR  73
Lead-CeresClone2403     RI KERVEEKE GI PPVQQRLI YAGKQLADDK TAKDYA EGG SVLHLVLALR  73
CeresClone:1439969      RI KERVEEKE GI PPVQQRLI YAGKQLADDK TAKDYNI EGG SVLHLVLALR 150
CeresClone:1482731      RI KERVEEKE GI PPVQQRLI YAGKQLADDK TAKDYNI EGG SVLHLVLALR 150
CeresClone:1123804      RI KERVEEKE GI PPVQQRLI YAGKQLADDK TAKDYNI EGG SVLHL----- 145
CeresClone:1005253      RI KERVEEKE GI PPVQQRLI YAGKQLADDK TAKDYNI EGG SVLHLVLALR  73

Consensus               RI KERVEEKE GI PPVQQRLI YAGKQLADDK TAKDYNI EGG SVLHLVLALR 150

CeresClone:1464066      GGC-   76
CeresClone:1453619      GGQ-   76
CeresClone:1036726      SGS-  147
CeresClone:513071       GGY-  153
CeresClone:273687       GGY-  153
CeresClone:522921       GGTY   77
Lead-CeresClone2403     GGLL   77
CeresClone:1439969      XGSD  154
CeresClone:1482731      GGSD  154
CeresClone:1123804      ----  145
CeresClone:1005253      GGQ-   76

Consensus               GG--  154
```

```
gi|50940339         MASPAVVRQR PTVGKQAGEG ESAAAAGDGG GGRPPAARRP S------LLSQ   45
gi|52354409         ---------- ------MEETK QSLIAS---- --LPSAPRKP KSKVERVVRK   29
Lead-CeresClone907  --MEIKVDEG HQKGTKEDLT RPLLEE---D KDFPDIERTT W--IQKAIGQ   43
gi|9757729          --MEINVDE- -EAGIKEET VPLLDDQNRN RDLPDIERNT M--MQKAIGK   44

Consensus           --MEI-VDE- ---G--EEET --LL------ -DLPD-ER-- ----QK-IG-   50

gi|50940339         ALASTASLAN LLPTGTVMAF DLLAPTFTNN GAC-DAFTSL LTAALLALLA   94
gi|52354409         TFKGTAHLSN LLPTGSVMSF DIMCPVLTHQ GQCPTITSRW LTCFLVSLCA   79
Lead-CeresClone907  TFQTTAHLAN LLPTGTVLAF DLLSPIFSNG GQC-DLVSKI MTSTLVAICG   92
gi|9757729          TFQTTANLAN LLPTGTVLAF DILSPICTNV GRC-DLTSRF MTALLVSICG   93

Consensus           TFQTTAHLAN LLPTGTV-AF Q-LSPVFTN- GQC-DLTSR- -TA-LV--C-  100

gi|50940339         LSCVLASFTD SVRGPDGRVY YGLATPRGLW LLDYPPAGAG APPQPDTSRY  144
gi|52354409         ISCFLFSFTD SIRDPNGKVR YGLATWSGLL VMD----GSI TLTEEEKEKY  125
Lead-CeresClone907  FSCFILSFTD SYKDKNGTIC YGLATIHGFW IID----GST TLPQELSKRY  138
gi|9757729          FSCFILSFTD SYKDLNGSVC YGFATIHGFW IID----GSA TLPQELSKSY  139

Consensus           -SCF-LSFTD S--DPNG-VC YGLATIHG-W IID----GS- TLPQE-SKRY  150

gi|50940339         RMRAIDGVHA LLSVGVFGVV AARDKNVVGC FWPSPAKGTE EVLGIVPLGV  194
gi|52354409         KLKILDFIHA IMSMLVFFAV SMFDQNVTRC LFPVPSEETK EILTSLPFVI  175
Lead-CeresClone907  KLRFIDFVHA FMSLFVFGAV VLFDRNAVNC FFPSPSAEAL EVLTALPVGV  188
gi|9757729          KLRFIDFVHA IMSFLVFGAV VLFDQNVVNC FYPEPSAEVV ELLTTLPVAV  189

Consensus           KLRFIDFVHA IMS-LVFGAV -LFDQNVVNC FFPSPS-ET- EVLT-LPVGV  200

gi|50940339         GVMCSLLFVV FPTTRHGIGY PVTNNTTSSS  224
gi|52354409         GVICGAFFLA FPTRRHGIGS PLTKE-----  200
Lead-CeresClone907  GVFSSMLFAT FPTTRNGIGF PLSSK-----  213
gi|9757729          GVFCSMVFAK FPTTRHGIGF PLSAK-----  214

Consensus           GV-CSMLF-- FPTTRHGIGF PL--K-----  230
```

```
gi|54303968              ---------- ---------- -------MNKI KQSLTRI SNS NKKKLFFSLF  24
gi|2098711               ---------- -----MTHI KE FFTKLSESSS NQNI SNI PKK -KKKLFLALF  35
gi|57014097              ---------- -----MTRI KE FFTKLSESST NQNI SNI PKK -KKKLFLALF  35
gi|6689892               ---------- ---------- -------MLDS GKQI -DFSKR -KKKI YLAI V  22
gi|8671350               ---------- ---------- -------MLDS GKNV-NFSKG -KKKLFLTVV  22
gi|29602797              ---------- ---------- -------MLDS GKNV-NFSKG -KKKLFLTVV  22
Lead-CeresClone99298     MGYERLGPSG ATGSVTTSTT TAPI LNQVSI SEQPENNNRR SKKKLVVSSI  50
gi|15293287              MGYDRLGPSG PSNP------ ------NQKDP AISLPELDKK TKTKLI LFTL  39

Consensus                ---------- ---------- -------LDS --NI -NI SKK -KKKLFL-LV  50

gi|54303968              TALLI TASI I AI SASVTSSQ KTKTKNNI VS SSLSLSHHSH TI I KTACTIT  74
gi|2098711               ATLLVVAAVI GI VAGVNSRK NSGDNGN--- -------EPHH AI LKSSCSST  76
gi|57014097              ATLLVVAAVI GI VAGVNSRK NSGDNGN--- -------EPHH AI LKSSCSST  76
gi|6689892               ASVLLVAAVI GVVAGVKSRS NNSDDDA--- DI MAI SSSAH AI VKSACSNT  69
gi|8671350               ASVLLVAAVI GVVVGVKFRS NNSDDHA--- DI QAI TSAAH AI VKSACENT  69
gi|29602797              ASVLLVAAVI GVVVGVKFRS NNSDDHA--- DI QAI TSAAH AI VKSACENT  69
Lead-CeresClone99298     VLAI SLI LAA AI FAGVRSRL KLNQSVP--- ---GLARKPS QAI SKACELT  94
gi|15293287              AVLVVGVVCF GI FAGI RA-V DSGKTEP--- ---KLTRKPT QAI SRTCSKS  82

Consensus                ATLL-VAAVI GI VAGVKSR- N-SD------ ---A----AH AI -KSACS-T  100

gi|54303968              LYPDLCFSAI SSEPNI THKI NNHKDVI SLS LNI TTRAVEH NFFTVENLLR  124
gi|2098711               RYPDLCFSAI AAVPEASKKV TSQKDVI EMS LNI TTTAVEH NYFGI QKLLK  126
gi|57014097              RYPDLCFSAI AAVPEASKKV TSQKDVI EMS LNI TTTAVEH NYFGI QKLLK  126
gi|6689892               LHPELCYSAI VNVITDFSKKV TSQKDVI ELS LNI TVKAVRR NYYAVKELI K  119
gi|8671350               LHPELCYSTI ASVSDFSKKV TSQKDVI ELS LNI TCRAVQH NFFKVEKLI K  119
gi|29602797              LHPELCYSTI ASVSDFSKKV TSQKDVI ELS LNI TCRAVQH NFFKVEKLI K  119
Lead-CeresClone99298     RFPELCVDSL MDFPG-SLAA SSSKDLI HVT VNMTLHHFSH ALYSSASLS-  142
gi|15293287              LYPNLCI DTL LDFPG--SLT ADENELI HI S FNATLQKFSK ALYTSSTIT-  129

Consensus                LYPELC-SAI ASVPD-SKKV TSQKDVI ELS LNI T-RAV-H N-F-VEKL-K  150
```

```
gi|54303968           -RKNLSEREK IALHDCLETI DDTLDELKEA QRDLVLYPNK KTLYQHADDL  173
gi|2098711            -RTNLTKREK VALHDCLETI DETLDELHKA VEDLEEYPNK KSLSQHADDL  175
gi|57014097           -RTNLTKREK VALHDCLETI DETLDELHKA VEDLEEYPNK KSLSQHADDL  175
gi|6689892            TRKGLTPREK VALHDCLETM DETLDELHTA VADLELYPNK KSLKEHAEDL  169
gi|8671350            TRKGLKPREK VALHDCLETI DETLDELHTA IKDLELYPNK KSLKAHADDL  169
gi|29602797           TRKGLKPREK VALHDCLETI DETLDELHTA IKDLELYPNK KSLKAHADGL  169
Lead-CeresClone99298  -FVDMPPRAR SAYDSCVELL DDSVDALSRA LSSVVSSSAK ------PQDV  185
gi|15293287           -YTQMPPRVR SAYDSCLELL DDSVDALTRA LSSVVVVSGD ES----HSDV  174

Consensus             -RKNLTPREK VALHDCLETI DETLDELH-A V-DLELYPNK KSL-QHADDL  200

gi|54303968           KTLISAAITN QVTCLDGFSH -DGADKQVRK VLEQGQVHVE HMCSNALAMT  222
gi|2098711            KTLMSAAMTN QGTCLDGFSH -DDANKHVRD ALSDGQVHVE KMCSNALAMI  224
gi|57014097           KTLMSAAMTN QGTCLDGFSH -DDANKHVRD ALSDGQVHVE KMCSNALAMI  224
gi|6689892            KTLISSAITN QETCLDGFSH -DEADKKVRK VLLKGQKHVE KMCSNALAMI  218
gi|8671350            KTLISSAITN QETCLDGFSH -DDADKKVRK ALLKGQKHVE KMCSNALAMI  218
gi|29602797           KTLISSAITN QETCLDGFSH -DDADKKVRK ALLKGQKHVE KMCSNALAMI  218
Lead-CeresClone99298  TTMLSAALTN HDTCTEGFDG VDDGG--VKD HMTAALQNLS ELVSNCLAIF  233
gi|15293287           MTMLSSAMTN HDTCTDGFDE IEGQGGEVKD QVIGAVKDLS EMVSNCLAIF  224

Consensus             KTLIS-AITN QETCLDGFSH -DDADKKVR- ALLKGQKHVE KMCSNALAMI  250

gi|54303968           KNMTDKDIA- KFEENNNKKN RKLLEEENGV N-WPEWISAG DRRLLQ--GA  268
gi|2098711            KNMTDT---- DMM MRTSNN RKLTEETSTV DGWPAWLSPG DRRLLQ--SS  268
gi|57014097           KNMTDT---- DMM MRTSNN RKLTEETSTV DGWPAWLSTG DRRLLQ--SS  268
gi|6689892            CNMTNTDIAN EMKLSG---S RKLVEDNGE- --WPEWLSAG DRRLLQ--SS  260
gi|8671350            CNMTDTDIAN EQKLKGTTTN RKLREDNSE- --WPEWLSAG DRRLLQ--SS  263
gi|29602797           CNMTDTDIAN EQKLKGTTTN RKLREDNSE- --WPEWLPAG DRRLLQ--SS  263
Lead-CeresClone99298  SASHDGD--- DFAGVP-IQN RRLLGVEERE EKEPRWMRPK EREILEMPVS  279
gi|15293287           AGKVK----- DLSGVPVVNN RKLLGTEETE E-LPNWLKRE DRELLGTPTS  268

Consensus             -NMTDTDIA- DMKL--T--N RKLLE--S-- --WPEWLSAG DRRLLQ--SS  300
```

```
gi|54303968            AVKADVVVAA DGSGNFKTVS EAVAGAPLKS SKRYVI KI KA GVYKE-NVEV  317
gi|2098711             SVTPNAVVAA DGSGNFKTVA AAVAAAPQGG TKRYI I RI KA GVYRE-NVEV  317
gi|57014097            SVTPNVVVAA DGSGNFKTVA ASVAAAPQGG TKRYI I RI KA GVYRE-NVEV  317
gi|6689892             TVTPDVVVAA DGSGDYKTVS EAVAKAPEKS SKRYVI RI KA GVYRE-NVDV  309
gi|8671350             TVRPDVVVAA DGSGNFKTVS EAVAKAPEKS SKRYVI RI KA GVYRE-NVDV  312
gi|29602797            TVRPDVVVAA DGSGNFKTVS EAVAKAPEKS SKRYVI RI KA GVYRE-NVDV  312
Lead-CeresClone99298   QI QADI I VSK DGNGTCKTI S EAI KKAPQNS TRRI I I YVKA GRYEENNLKV  329
gi|15293287            AI QADI TVSK DGSGTFKTI A EAI KKAPEHS SRRFVI YVKA GRYEEENLKV  318

Consensus              -V-PDVVVAA DGSGNFKTVS EAVAKAPEKS SKRYVI RI KA GVYRE-NV-V  350

gi|54303968            PKKKSNI MFL GDGKKNTI I T ASRNVVDGST TFHSATVAVV GGNFLARDI T  367
gi|2098711             TKKHKNI MFI GDGRTRTI I T GSRNVVDGST TFKSATVAVV GEGFLARDI T  367
gi|57014097            TKKHKNI MFI GDGRTRTI I T GSRNVVDGST TFKSATVAVV GEGFLARDI T  367
gi|6689892             PKKKTNI MFM GDGRSNTI I T ASRNVQDGST TFHSATVAAV GEKFLARDI T  359
gi|8671350             PKKKTNI MFM GDGRSNTI I T GSRNVKDGST TFHSATVAAV GEKFLARDI T  362
gi|29602797            PKKKTNI MFM GDGRSNTI I T GSRNVKDGST TFHSATVAAV GEKFLARDI T  362
Lead-CeresClone99298   GRKKI NLMFV GDGKGKTVI S GGKSI FDNI T TFHTASFAAI GAGFI ARDI T  379
gi|15293287            GRKKTNLMFI GDGKGKTVI T GGKSI ADDLT TFHTATFAAI GAGFI VRDMT  368

Consensus              PKKKTNI MF- GDGRS-TI I T GSRNV-DGST TFHSATVAAV GEGFLARDI T  400

gi|54303968            FQNTAGPSKH QAVALRVGGD LSAFYNCDI I AYQDTLYVHN NRQFFVNCFI  417
gi|2098711             FQNTAGPSKH QAVALRVGAD LSAFYNCDML AYQDTLYVHS NRQFFVNCLI  417
gi|57014097            FQNTAGPSKH QAVALRVGAD LSAFYNCDML AYQDTLYVHS NRQFFVNCLI  417
gi|6689892             FQNTAGASKH QAVALRVGSD LSAFYKCDI L AYQDTLYVHS NRQFFVQCLV  409
gi|8671350             FQNTAGAAKH QAVALRVGSD LSAFYRCDI L AYQDSLYVHS NRQYFVQCLI  412
gi|29602797            FQNTAGAAKH QAVALRVGSD LSAFYRCDI L AYQDSLYVHS NRQYFVQCLI  412
Lead-CeresClone99298   FENWAGPAKH QAVALRI GAD HAVI YRCNI I GYQDTLYVHS NRQFFRECDI  429
gi|15293287            FENYAGPAKH QAVALRVGCD HAVVYRCNI I GYQDALYVHS NRQFFRECEI  418

Consensus              FQNTAGP-KH QAVALRVG-D LSAFYRCDI L AYQDTLYVHS NRQFFVQCLI  450
```

| | | | | | | |
|---|---|---|---|---|---|---|
| gi\|54303968 | SGTVDFIFGN | SAVVFQNCDI | HARKPDSGQK | NMVTAQGRVD | PNQNTGIVIQ | 467 |
| gi\|2098711 | AGTVDFIFGN | AAAVLQNCDI | HARKPNSGQK | NMVTAQGRTD | PNQNTGIVIQ | 467 |
| gi\|57014097 | AGTVDFIFGN | AAAVLQNCDI | HARKPNSGQK | NMVTAQGRAD | PNQNTGIVIQ | 467 |
| gi\|6689892 | AGTVDFIFGN | GAAVLQDCDI | HARRPGSGQK | NMVTAQGRTD | PNQNTGIVIQ | 459 |
| gi\|8671350 | AGTVDFIFGN | AAAVLQNCDI | HARRPGSGQK | NMVTAQGRSD | PNQNTGIVIQ | 462 |
| gi\|29602797 | AGTVDFIFGN | AAAVLQDCDI | HARRPGSGQK | NMVTAQGRSD | PNQNTGIVIQ | 462 |
| Lead-CeresClone99298 | YGTVDFIFGN | AAVVLQNCSI | YARKPMDFQK | NFITAQNRKD | PNQNTGISIH | 479 |
| gi\|15293287 | YGTVDFIFGN | AAVILQSCNI | YARKPMAQQK | ITITAQNRKD | PNQNTGISIH | 468 |
| Consensus | AGTVDFIFGN | AAAVLQNCDI | HARKP-SGQK | NMVTAQGR-D | PNQNTGIVIQ | 500 |
| gi\|54303968 | KCRIGATKDL | EGLKGTFPTY | LGRPWKEYSR | TVIMQSSISD | VIDPLGWHEW | 517 |
| gi\|2098711 | KSRIGATSDL | KPVQGSFPTY | LGRPWKEYSR | TVIMQSSITD | LIHPAGWHEW | 517 |
| gi\|57014097 | KSRIGATSDL | KPVQGSFPTY | LGRPWKEYSR | TVIMQSSITD | VIHPAGWHEW | 517 |
| gi\|6689892 | KCRIGATSDL | RPVQKSFPTY | LGRPWKEYSR | TVIMQSSLTD | VIQPAGWHEW | 509 |
| gi\|8671350 | KCRIGATSDL | RPVQKSFPTY | LGRPWKEYSR | TVIMQSSITD | VINSAGWHEW | 512 |
| gi\|29602797 | KCRIGATSDL | RPVQKSFPMY | LGRPWKEYSR | TVIMQSSITD | VINSAGWHEW | 512 |
| Lead-CeresClone99298 | ASRVLAASDL | QATNGSTQTY | LGRPWKLFSR | TVYMMSYIGG | HVHTRGWLEW | 529 |
| gi\|15293287 | ACKLLATPDL | EASKGSYPTY | LGRPWKLYSR | VVYMMSDMGD | HLDPRGWLEW | 518 |
| Consensus | KCRIGATSDL | -PVQGSFPTY | LGRPWKEYSR | TVIMQSSITD | VI-PAGWHEW | 550 |
| gi\|54303968 | NGNFALNTLV | YREYQNTGPG | AGTSKRVNWK | GFKVITSASE | AQTFTPGNFI | 567 |
| gi\|2098711 | DGNFALNTLF | YGEHQNSGAG | AGTSGRVKWK | GFRVITSATE | AQAFTPGSFI | 567 |
| gi\|57014097 | DGNFALNTLF | YGEHQNAGAG | AGTSGRVKWK | GFRVITSATE | AQAFTPGSFI | 567 |
| gi\|6689892 | NGNFALNTLF | YGEYANTGAG | AATSGRVKWK | GHKVITSSTE | AQAYTPGSFI | 559 |
| gi\|8671350 | NGNFALNTLF | YGEYQNTGAG | AGTSGRVKWK | GFKVITSATE | AQAYTPGRFI | 562 |
| gi\|29602797 | NGNFALNTLF | YGEYQNTGAG | AGTSGRVKWK | GFKVITSATE | AQAYTPGRFI | 562 |
| Lead-CeresClone99298 | NTTFALDTLY | YGEYLNSGPG | SGLGQRVSWP | GYRVINSTAE | ANRFTVAEFI | 579 |
| gi\|15293287 | NGPFALDSLY | YGEYMNKGLG | SGIGQRVKWP | GYHVITSTVE | ASKFTVAQFI | 568 |
| Consensus | NGNFALNTLF | YGEYQNTGAG | AGTSGRVKWK | GFKVITSATE | AQAFTPG-FI | 600 |

| | | |
|---|---|---|
| gi\|54303968 | GGSTWLGSTG FPFSLGL-- | 584 |
| gi\|2098711 | AGSSWLGSTG FPFSLGL-- | 584 |
| gi\|57014097 | AGSSWLGSTG FPFSLGL-- | 584 |
| gi\|6689892 | AGGSWLSSTG FPFSLGL-- | 576 |
| gi\|8671350 | AGGSWLSSTG FPFSLGL-- | 579 |
| gi\|29602797 | AGGSWLSSTG FPFSLGL-- | 579 |
| Lead-CeresClone99298 | YGSSWLPSTG VSFLAGLSI | 598 |
| gi\|15293287 | SGSSWLPSTG VSFFSGLSQ | 587 |
| Consensus | AGSSWL-STG FPFSLGL-- | 619 |

```
CeresClone:679007         ---------- ---------- ---------- ---------- ----------   0
CeresClone:515236         MDERYETLKE LGSGNFGVAR LAKDKETGEL VAIKYIERGK KIDANVQREI  50
CeresClone:31041          ---------- ---------- ---------- --MKYIERGR KIDENVAREI  18
CeresClone:39888          ---------- ---------- ---------- --MKYIERGR KIDENVAREI  18
CeresClone:288489         -MEKYELLKD IGAGNFGVAR LMRNKETKEL VAMKYIPRGQ KIDENVAREI  49
CeresClone:240283         -MEKYELLKD IGAGNFGVAR LMRNKETKEL VAMKYIPRGQ KIDENVAREI  49
CeresClone:237589         ---------- ---------- -MRNKDTKEL VAMKYIPRGL KIDENVAREI  29
CeresClone:95559          ---------- ---------- -MRVKNSKEL VAMKYIERGP KIDENVAREI  29
CeresClone:260333         ---------- ---------- -MRVKNSKEL VAMKYIERGP KIDENVAREI  29
Lead-CeresClone100245     -MDKYELVKD IGAGNFGVAR LMKVKNSKEL VAMKYIERGP KIDENVAREI  49
CeresClone:1099630        ---------- ---------- -MKVKDSKEL VAMKYIERGP KIDENVAREI  29
CeresClone:623826         -MEKYELVKD IGSGNFGVAR LMRHKDTKEL VAMKYIERGH KIDENVAREI  49
CeresClone:591143         ---------- ---------- -MRNKETKEL VAMKYIERGQ KIDENVAREI  29
CeresClone:1100861        ---------- ---------- -MRNKVTKEL VAMKYIERGP KIDENVAREI  29

Consensus                 ---------- ---------- -MRNK-TKEL VAMKYIERG- KIDENVAREI  50

CeresClone:679007         ---------- ---------- ---------- ---------- ----------   0
CeresClone:515236         VNHRSLRHPN IIRFKEVFLT PTHLAIVLEY AAGGELFERI CNAGRLSEDE 100
CeresClone:31041          INHRSLKHPN IIRFKEVILT PTHLAIVMEY ASGGELFDRI CIAGRFSEAE  68
CeresClone:39888          INHRSLRHPN IIRFKEVILT PTHLAIVMEY ASGGELFERI CNAGRFSEAE  68
CeresClone:288489         INHRSLRHPN IIRFKEVVLT PTHLAIVMEY AAGGELFDRI CNAGRFSEDE  99
CeresClone:240283         INHRSLRHPN IIRFKEVVLT PTHLAIVMEY AAGGELFDRI CNAGRFSEDE  99
CeresClone:237589         INHRSLRHPN IIRFKEVVLT PTHLAIVMEY AAGGELFDRI CSAGRFSEDE  79
CeresClone:95559          INHRSLRHPN IIRFKEVVLT PTHIAIAMEY AAGGELFERI CSAGRFSEDE  79
CeresClone:260333         INHRSLRHPN IIRFKEVVLT PTHIAIAMEY AAGGELFERI CSAGRFSEDE  79
Lead-CeresClone100245     INHRSLRHPN IIRFKEVVLT PTHLAIAMEY AAGGELFERI CSAGRFSEDE  99
CeresClone:1099630        YNHRSLRHPN IIRFKEVVLT PTHLAIAMEY AAGGELFERI CGAGRFSEDE  79
CeresClone:623826         INHRSLRHPN IIRFKEVVLT PTHLGIVMEY AAGGELFERI CSAGRFSEDE  99
CeresClone:591143         INHRSLRHPN IIRFKEVVLT PTHLAIVMEY AAGGELFERI CNAGRFSEDE  79
CeresClone:1100861        MNHRSLRHPN IIRYKEVVLT PTHLAIVMEY AAGGELFERI CSAGRFSEDE  79

Consensus                 INHRSLRHPN IIRFKEVVLT PTHLAIVMEY AAGGELFERI CNAGRFSEDE 100
```

| | | | | | | |
|---|---|---|---|---|---|---|
| CeresClone:679007 | ---------- | -------MEI | CHRDLKLENT | LLDGSPTPRV | KI CDFGYSKS | 33 |
| CeresClone:515236 | ARFFFQQLI S | GVSYCHSMQI | CHRDLKLENT | LLDGNPAPRL | KI CDFGFSKS | 150 |
| CeresClone:31041 | ARYFFQQLI C | GVDYCHSLQI | CHRDLKLENT | LLDGSPAPLL | KI CDFGYSKS | 118 |
| CeresClone:39888 | ARYFFQQLI C | GVDYCHSLQI | CHRDLKLENT | LLDGSPAPLL | KI CDFGYSKS | 118 |
| CeresClone:288489 | ARYFFQQLI C | GVSYCHSMQI | CHRDLKLENT | LLDGSPAPRL | KI CDFGYSKS | 149 |
| CeresClone:240283 | ARYFFQQLI C | GVSYCHSMQI | CHRDLKLENT | LLDGSPAPRL | KI CDFGYSKS | 149 |
| CeresClone:237589 | ARYFFQQLI C | GVSYCHFMQI | CHRDLKLENT | LLDGSPAPRL | KI CDFGYSKS | 129 |
| CeresClone:95559 | ARYFFQQLI S | GVSYCHAMQI | CHRDLKLENT | LLDGSPAPRL | KI CDFGYSKS | 129 |
| CeresClone:260333 | ARYFFQQLI S | GVSYCHAMQI | CHRDLKLENT | LLDGSPAPRL | KI CDFGYSKS | 129 |
| Leod-CeresClone100245 | ARYFFQQLI S | GVSYCHAMQI | CHRDLKLENT | LLDGSPAPRL | KI CDFGYSKS | 149 |
| CeresClone:1099630 | ARYFFQQLI S | GVSYCHAMQI | CHRDLKLENT | LLDGSPAPRL | KI CDFGYSKS | 129 |
| CeresClone:623826 | ARYFFQQLI S | GVSYCHSMQI | CHRDLKLENT | LLDGSPAPRL | KI CDFGYSKS | 149 |
| CeresClone:591143 | ARYFFQQLI S | GVHYCHAMQI | CHRDLKLENT | LLDGSPAPRL | KI CDFGYSKS | 129 |
| CeresClone:1100861 | ARYFFQQLI S | GVHFCHTMQI | CHRDLKLENT | LLDGSPAPRL | KI CDFGYSKS | 129 |
| Consensus | ARYFFQQLI S | GVSYCHSMQI | CHRDLKLENT | LLDGSPAPRL | KI CDFGYSKS | 150 |

| | | | | | | |
|---|---|---|---|---|---|---|
| CeresClone:679007 | ALLHSKPKST | VGTPAYI APE | VLSRKEYDGK | VADVWSCGVT | LYVMLVGSYP | 83 |
| CeresClone:515236 | ALLHSQPKST | VGTPAYI APE | VLSRKEYDGK | VADVWSCGVT | LYVMLVGAYP | 200 |
| CeresClone:31041 | SI LHSRPKST | VGTPAYI APE | VLSRREYDGK | HADVWSCGVT | LYVMLVGAYP | 168 |
| CeresClone:39888 | SLLHSRPKST | VGTPAYI APE | VLSRREYDGK | HADVWSCGVT | LYVMLVGGYP | 168 |
| CeresClone:288489 | SLLHSKPKST | VGTPAYI APE | VLSRREYDGK | TADVWSCGVT | LYVMLVGGYP | 199 |
| CeresClone:240283 | SLLHSKPKST | VGTPAYI APE | VLSRREYDGK | TADVWSCGVT | LYVMLVGGYP | 199 |
| CeresClone:237589 | SLLHSKPKST | VGTPAYI APE | VLSRREYDGK | MADVWSCGVT | LYVMLVGAYP | 179 |
| CeresClone:95559 | SLLHSMPKST | VGTPAYI APE | VLSRGEYDGK | MADVWSCGVT | LYVMLVGAYP | 179 |
| CeresClone:260333 | SLLHSMPKST | VGTPAYI APE | VLSRGEYDGK | MADVWSCGVT | LYVMLVGAYP | 179 |
| Leod-CeresClone100245 | SLLHSRPKST | VGTPAYI APE | VLSRREYDGK | MADVWSCGVT | LYVMLVGAYP | 199 |
| CeresClone:1099630 | SLLHSRPKST | VGTPAYI APE | VLSRREYDGK | MADVWSCGVT | LYVMLVGAYP | 179 |
| CeresClone:623826 | SLLHSRPKST | VGTPAYI APE | VLSRREYDGK | LADVWSCGVT | LYVMLVGAYP | 199 |
| CeresClone:591143 | SLLHSRPKST | VGTPAYI APE | VLSRREYDGK | LADVWSCGVT | LYVMLVGAYP | 179 |
| CeresClone:1100861 | SLLHSRPKST | VGTPAYI APE | VLSRREYDGK | LADVWSCAVT | LYVMLVGAYP | 179 |
| Consensus | SLLHSRPKST | VGTPAYI APE | VLSRREYDGK | MADVWSCGVT | LYVMLVGAYP | 200 |

| | | | | | | |
|---|---|---|---|---|---|---|
| CeresClone:679007 | FEDPEDPRNF | RKTI SRI LGV | QYSI PDYVRV | SSDCRRLLSQ | I FVADPSKRI | 133 |
| CeresClone:515236 | FEDPEDPKNF | RKSI GRI MSV | QYAI PDYVRV | SKECRHLI SR | I FVANPAKRI | 250 |
| CeresClone:31041 | FEDPNDPKNF | RKTI QRI MAV | QYKI PDYVHI | SQECKHLLSR | I FVTNSAKRI | 218 |
| CeresClone:39888 | FEDPDDPRNF | RKTI QRI MAV | QYKI PDYVHI | SQECRHLLSR | I FVTNSAKRI | 218 |
| CeresClone:288489 | FEDPDDPKNF | RKTI GRI MSI | QYKI PEYVHV | SQDCKELLSR | I FVANSAKRI | 249 |
| CeresClone:240283 | FEDPDDPKNF | RKTI GRI MSI | QYKI PEYVHV | SQDCKELLSR | I FVANSAKRI | 249 |
| CeresClone:237589 | FEDPDDPKNF | RKTI GRI VSI | QYQI PEYVHL | SQDCRQLLAR | I FVANPAKRI | 229 |
| CeresClone:95559 | FEDQEDPKNF | KKTI QRI MAV | KYKI PDYVHI | SQDCKHLLSR | I FVTNSNKRI | 229 |
| CeresClone:260333 | FEDQEDPKNF | KKTI QRI MAV | KYKI PDYVHI | SQDCKHLLSR | I FVTNSNKRI | 229 |
| Lead-CeresClone100245 | FEDQEDPKNF | RKTI QKI MAV | QYKI PDYVHI | SQDCKNLLSR | I FVANSLKRI | 249 |
| CeresClone:1099630 | FEDQEDPKNF | RKTI QKI MAV | QYKI PDYVHI | SQDCKHLLSR | I FVANSLKRI | 229 |
| CeresClone:623826 | FEDQEDPKNF | RKTI NRI MAV | QYKI PDYVHI | SQDCRHLLSR | I FVANPARRI | 249 |
| CeresClone:591143 | FEDQDDPRNF | RKTI QRI MAV | QYKI PDYVHI | SQDCRHLLSR | I FVANPLRRI | 229 |
| CeresClone:1100861 | FEDQDDPRNF | RKTI QRI MAV | QYKI PDYVHI | SQDCRHLLSR | I FVANPLRRI | 229 |
| Consensus | FED-EDPKNF | RKTI QRI MAV | QYKI PDYVHI | SQDC-HLLSR | I FVANSAKRI | 250 |

| | | | | | | |
|---|---|---|---|---|---|---|
| CeresClone:679007 | TI PEI KHHPW | FLKNLPREI S | EREKANYKDA | DAAEPA---Q | AVDEI MRI VE | 180 |
| CeresClone:515236 | NI SEI KQHLW | FRKNLPREI I | EAERRGYEET | QKDQPS---Q | SVEEI MQI I Q | 297 |
| CeresClone:31041 | TLKEI KNHPW | YLKNLPKELI | ESAQAAYYKR | DT---SFSLQ | SVEDI MKI VG | 265 |
| CeresClone:39888 | TLKEI KKHPW | YLKNLPKELT | EPAQAAYYKR | EI--PSFSLQ | SVEDI MKI VG | 266 |
| CeresClone:288489 | TI REI RNHPW | FLKNLPRELT | EAAQAMYYKK | DNSAPTYSVQ | SVEEI MKI VE | 299 |
| CeresClone:240283 | TI REI RNHPW | FLKNLPRELT | EAAQAMYYKK | DNSAPTYSVQ | SVEEI MKI VE | 299 |
| CeresClone:237589 | TI REI RNHPW | FLKNLPRELT | EAAQAKYYKK | DNGAPTFSDQ | TVEEI MKI VE | 279 |
| CeresClone:95559 | TI ADI KKHPW | FLKNLPRELT | EI AQAAYFRK | EN--PTFSLQ | SVEEI MKI VE | 277 |
| CeresClone:260333 | TI GDI KKHPW | FLKNLPRELT | EI AQAAYFRK | EN--PTFSLQ | SVEEI MKI VE | 277 |
| Lead-CeresClone100245 | TI AEI KKHSW | FLKNLPRELT | ET AQAAYFKK | EN--PTFSLQ | TVEEI MKI VA | 297 |
| CeresClone:1099630 | TI AEI KKHPW | FIKNLPRELT | ET AQAAYFKK | EN--PTFSAQ | TAEEI MKI VD | 277 |
| CeresClone:623826 | TI KEI KSHPW | FVKNLPRELT | EVAQAAYYRK | EN--PTFSLQ | SI EDI MNI VE | 297 |
| CeresClone:591143 | SLKEI KSHPW | FLKNLPRELT | ESAQAMYYQR | GN--PSFSI Q | SVEEI MKI VG | 277 |
| CeresClone:1100861 | TI KEI KNHPW | FLRNLPRELT | ESAQAI YYQR | DS--PNFHLQ | SVDEI MKI VG | 277 |
| Consensus | TI KEI KNHPW | FLKNLPRELT | E-AQAAYYKK | -N--PTFSLQ | SVEEI MKI VE | 300 |

```
CeresClone:679007          EAKTPGDMSK VVDPALLA-- ---------- ---EMAELES DEEEADADDT   215
CeresClone:515236          EARTKIHTGE QA---GTGTS DVVRC----- ---DEANEEV DI------NDH  331
CeresClone:31041           EARNPAPSTS AVKSSGSGAD EEEE------ ---EDVEAEV EE-EEDDEDE   305
CeresClone:39888           EARNPAPSSN AVKGFDDDEE DVEDEVEE-- ---EEEEEEE EE-EEEEEDE   310
CeresClone:288489          KARTPPPSST PVAGFGWAEE DE-------- ---QEDSKEP DEEHEDGEDE   338
CeresClone:240283          KARTPPPSST PVAGFGWAEE DE-------- ---QEDSKEP DEEHEDGEDE   338
CeresClone:237589          EARTPPQSPA PVAGFGWAEE EEQEDGKKP- ---EDDEQDG EDEQYDGEDE   325
CeresClone:95559           EAKTPARVSR SIGAFGWGGG EDAEGKEEDA ---EEEVEEV EE-EEDEEDE   323
CeresClone:260333          EAKTPARVSR SIGAFGWGGG EDAEGKEEDA ---EEEVEEV EE-EEDEEDE   323
Lead-CeresClone100245      DAKTPPPVSR SIGGFGWGGN GDADGKEEDA EDVEEEEEEV EE-EEDDEDE   346
CeresClone:1099630         DAKTPPPVSR SIGGFGWGGE GDLEGKEEE- ---EVDEEEV EE-EEDEEDE   322
CeresClone:623826          EAKAPPPASR SIGGFGWGGE E--------- ---EEEDEEK EAVAEEEEDE   335
CeresClone:591143          EARDPPPVSR PVKGFGWDGE E--------- ---DEGEEDV EE-EEDEEDE   314
CeresClone:1100861         EARNPPPVSR ALKGFGWEGE ---------- ---EDLDEEV EE--EEDEDE   312

Consensus                  EARTPPP-SR SV-GFGWGGE D--E------ ---EEEEEEV EE-EEDEEDE   350

CeresClone:679007          Y--------- ----------   216
CeresClone:515236          FAKYL----- -----TLD--   339
CeresClone:31041           YEKHVKEAQS C-QESDKA--   322
CeresClone:39888           YEKHVKEAHS C-QEPPKA--   327
CeresClone:288489          YEKQVKQVHA S-GEFHLSC-   356
CeresClone:240283          YEKQVKQVHA S-GEFHLSC-   356
CeresClone:237589          YDKQVKQVHA S-GDFRHLIK   344
CeresClone:95559           YDKTVKQVHA SMGEVRVS--   341
CeresClone:260333          YDKTVKQVHA SMGEVRVS--   341
Lead-CeresClone100245      YDKTVKEVHA S-GEVRI S--   363
CeresClone:1099630         YDKTVKEVHA S-GEVRI S--   339
CeresClone:623826          YEKRVKEAQA S-GEFHVS--   352
CeresClone:591143          YDKRVKEVHA S-GEFQI S--   331
CeresClone:1100861         YDKRVKEVHA S-GEFQI S--   329

Consensus                  YDK-VKEVHA.S-GE-RI S--   370
```

```
CeresClone:618028           --MARTAATK LVLVALVAAM LLVA--SDAA ISCGQVNSAL ASCVSYAKGS   46
CeresClone:325450           MAAVLNSRKT PQVVAVLVAA ALLASSASAA ITCGQVGSSL APCIPYATGR   50
Lead-CeresClone101798       ----MAFALR FFTCLVLTVC IVAS--VDAA ISCGTVAGSL APCATYLSKG   44
CeresClone:1078888          ------MGLK FFTCLVLTVC IAAS--VDAA LTCGTVTSSL APCATYLSKG   42
CeresClone:473005           ----MASLKV AFLAAVLCMV VVSAPMAHAA ITCGQVTNSL INCIGYLQNG   46
CeresClone:1606591          -------MAM MVLCAIVTCM VVVAPYAEA- ISCGQVSGSL APCIGYLTRG   42

Consensus                   ----M-S--K -FLCAVLTVM -V-A--ADAA I-CGQV-SSL APCVTYL-KG   50

CeresClone:618028           GASPPGACCS GVRRLAGLAR STADKQAACR CIKSAAG--- GLNPGKAASI   93
CeresClone:325450           ASALPASCCS GVKSLNSAAR TSADRQAACR CLKSLANSVK SVNMGTVATI  100
Lead-CeresClone101798       G-LVPPSCCA GVKTLNSMAK TTPDRQQACR CIQSTAKSIS GLNPSLASGL   93
CeresClone:1078888          GAVVPGPCCA GVKKLNDMAK TTPDRQQACK CLKAAAK--- SINPSLASGL   89
CeresClone:473005           G-TPPSGCCN GVKSLNAAAK TTADRQTACN CLKSAASQIS GFKANNAASL   95
CeresClone:1606591          G-GVPSACCN GVRGLNNAAR TTPDRQTACN CLKSAYKSIR GINGGNAASL   91

Consensus                   GA-VPS-CC- GVKSLNS-A- TT-DRQ-ACR CLKSAAKSI- G-NP--AASL  100

CeresClone:618028           PSKCGVSIPY SISASVDCSK IH-   115
CeresClone:325450           PGKCGVSVGF PISMSTDCNK IS-   122
Lead-CeresClone101798       PGKCGVSIPY PISMSTNCNN IK-   115
CeresClone:1078888          PGKCSVSIPY PISMSTNCDN VK-   111
CeresClone:473005           PGKCGVSIPY KISTSTNCAT IKV   118
CeresClone:1606591          PGKCGVSIPY KISPNTDCTK VR-   113

Consensus                   PGKCGVSIPY PISMST-C-K IK-   123
```

```
CeresClone:241538        MAAARPGNLS ELEQKWHNGG GPACVLGVGT ANPANCVRQD EYIDWYFRIT   50
CeresClone:1604873       M--ASSIDIA AI-REAQRAR GPATILAIGT AIPSNCVYQA NYPDYYFRIT   47
Lead-CeresClone38370     MVMAGASSLD EI-RQAQRAD GPAGILAIGT ANPENHVLQA EYPDYYFRIT   49
CeresClone:1091268       ---MGPSSLD EI-RKAQRAD GPAGILAIGT ANPANHVLQA EYPDYYFRIT   46
CeresClone:615767        ---MASSTVC EI-RRLQRAD GPALVLAIGT ANPPNHLSQE EYLEYYFRAT   46
CeresClone:764645        ---------- ---------- ----MLAIGT ANPPHCVPQE DYPDYYFGVT   26

Consensus                M--A-SSSL- EI-RKAQRAD GPA-ILAIGT ANPAN-V-Q- EYPDYYFRIT   50

CeresClone:241538        KSDHLTHTKA IMRKICEKMM VKKRYLQVNE ELFSVHPEFL DPAAPSLDGK  100
CeresClone:1604873       KSEHMVDLKE KFKRMCDKSM IRKRYMHLTE EYLKENPNIC EYMAPSLDAR   97
Lead-CeresClone38370     NSEHMTDLKE KFKRMCDKST IRKRHMHLTE EFLKENPHMC AYMAPSLDTR   99
CeresClone:1091268       NSEHMTDLKE KFKRMCDKST IRKRHMHLTE EFLKENPNMC AYMAPSLDAR   96
CeresClone:615767        KSEHLTDLKR EFKSICDRTG TEKRFFHHIQ ELLDAHPRFF D----GCHDR   92
CeresClone:764645        KSDHLTDLKR TFAKLCGMIG IGRRFFHHTD ELLATHPDL- -----SLDAR   70

Consensus                KSEH-TDLKE KFKRMCDKS- IRKR-MHLTE E-LKE-PNMC DYMAPSLDAR  100

CeresClone:241538        LAVVAGAMPG LVAAAAEKAI ADWGRPAGDI THLVFATSSS AQLPHIDLRI  150
CeresClone:1604873       QDVVVVEVPK LGKEAAVKAI KEWGKPKSQI THLIFCTTSG VDMPGADYQL  147
Lead-CeresClone38370     QDIVVVEVPK LGKEAAVKAI KEWGQPKSKI THVVFCTTSG VDMPGADYQL  149
CeresClone:1091268       QDLVVVEVPK LGKDAAVKAI KEWGQPKSKI THVVFCTTSG VDMPGADYQL  146
CeresClone:615767        LEIAAAVAPD LAALAAAKAI TKWGRPATDI THLIVSTNSC ARAPGADLRI  142
CeresClone:764645        LDVVATAAPE LAASAAANAI AEWGRPAGDI THLVVSTNAG SHAPGTDVRL  120

Consensus                -DVV-VEVPK LG-EAAVKAI KEWGRP-S-I THLVF-TTSG -DMPGAD--L  150

CeresClone:241538        AALLGESTIV QRTVIGFHAC SGSSAALRVA KYIAENNRSA RVLVACADMW  200
CeresClone:1604873       TKLLGLRPSV KRFMMYQQGC FAGGTVLRMA KDLAENTR-A HASLLC----  192
Lead-CeresClone38370     TKLLGLRPSV KRLMMYQQGC FAGGTVLRIA KDLAENNRGA RVLVVCSEI-  198
CeresClone:1091268       TKLLGLRPSV KRLMMYQQGC FAGGTVLRLA KDLAENNRGA RVLVVCSEI-  195
CeresClone:615767        ASLLGLRPSV VCTLLQINGC SAGSASLRLA KDIAENNRGA RVLVVCVEL-  191
CeresClone:764645        VSLLGLRHDV LRTVLQLNGC ASGCAALRLA KDLAENNHGA RVLVACVEL-  169

Consensus                T-LLGLRPSV KRTMMYQ-GC -AGG--LRLA KDLAENNRGA RVLVVCAE--  200
```

```
CeresClone:241538        SVMDSYVVPN V-DHRYCLIG HAFIGDGAGA VVVGSRP-QE PVERPIFEMV  248
CeresClone:1604873       -ALRSLR--- ---------- ---------- ---------SR FVDRVLTLI   210
Lead-CeresClone38370     -TAVTFRGPS D-THLDSLVG QALFSDGAAA LIVGSDPDTS VGEKPIFEMV  246
CeresClone:1091268       -TAVTFRGPS D-THLVSLVG QALFSDGAAA LIVGSDPDVS AGEKPIFQMV  243
CeresClone:615767        -SVAALRGPE E-NYPHTLIS QAIFSDGAGA VIIGADI-VH PLERPLFEMV  238
CeresClone:764645        -TITAFRGPD EADSFDTLIP QGLFGDGAGA AIVGAEP--Y VHERPLFEMV  216

Consensus                -T---FRGP- --DH---LIG QALFSDGAGA -IVGSDP--- -VERPIFEMV  250

CeresClone:241538        SASQATVPCS ERAVAVELTN CGLEYRLEFG DVAAEVCGNI ERCLLDALSP  298
CeresClone:1604873       ---------- ---------- ---------- ---------- ----------  210
Lead-CeresClone38370     SAAQTILPDS DGAIDGHLRE VGLTFHL-LK DVPGLISKNI VKSLDEAFKP  295
CeresClone:1091268       SAAQTILPDS DGAIDGHLRE VGLTFHL-LK DVPGLISKNI EKSLDEAFKP  292
CeresClone:615767        SASQIVIPGT DHL------- ---------- ---------- ----------  251
CeresClone:764645        SASQYVIPDT EHMLTMQLGS GGIGGTI-AT GLPRLAAGIV EKCLLDAFGD  265

Consensus                SASQ---PDS D-AI----L-- -GL-F-L--- DVP-LVS-NI EK-L--AF-P  300

CeresClone:241538        LGI---GSVG WNNLFWVVHP GGPRIMDTFT AALKLQPEKL SASRRVLREY  345
CeresClone:1604873       ---------- ---------- ---------- ---------- ----------  210
Lead-CeresClone38370     L------GISD WNSLFWIAHP GGPAILDQVE IKLGLKEEKM RATRHVLSEY  340
CeresClone:1091268       L------GISD WNSLFWIAHP GGPAILDDVE KKLGLKAEKM RATRHVLSEY  337
CeresClone:615767        ---------- ---------- ---------- ---------- ----------  251
CeresClone:764645        RLAGIGGVVE WNNLFWAVHP GSSAMLDHIV RALRLAPAKL AASRTVVREY  315

Consensus                L------GI-D WN-LFWV-HP GGPAILD-V- --L-LK-EK- -A-R-VL-EY  350

CeresClone:241538        GNITGPTLIF VLDEAIRRRQ LDHEEGSCE- --WGLMVGLG PGFTIDVMAL  392
CeresClone:1604873       ---------- ---------- ---------- ---------- ----------  210
Lead-CeresClone38370     GNMSSACVLF ILDEMRRKSA KDGVATTGEG LEWGVLFGFG PGLTVETVVL  390
CeresClone:1091268       GNMSSACVLF ILDEMRRKSK EDGVATTGEG LEWGVLFGFG PGLTVETVVL  387
CeresClone:615767        ---------- ---------- ---------- ---------- ----------  251
CeresClone:764645        GNMLGATVIF VLDEVRRQRE DPEGEGASHD EGWGVMMGFG PGFTVETMLL  365

Consensus                GNMS-A-V-F -LDEMRRK-- -D-------E- --WGV--GFG PG-TVET-VL  400
```

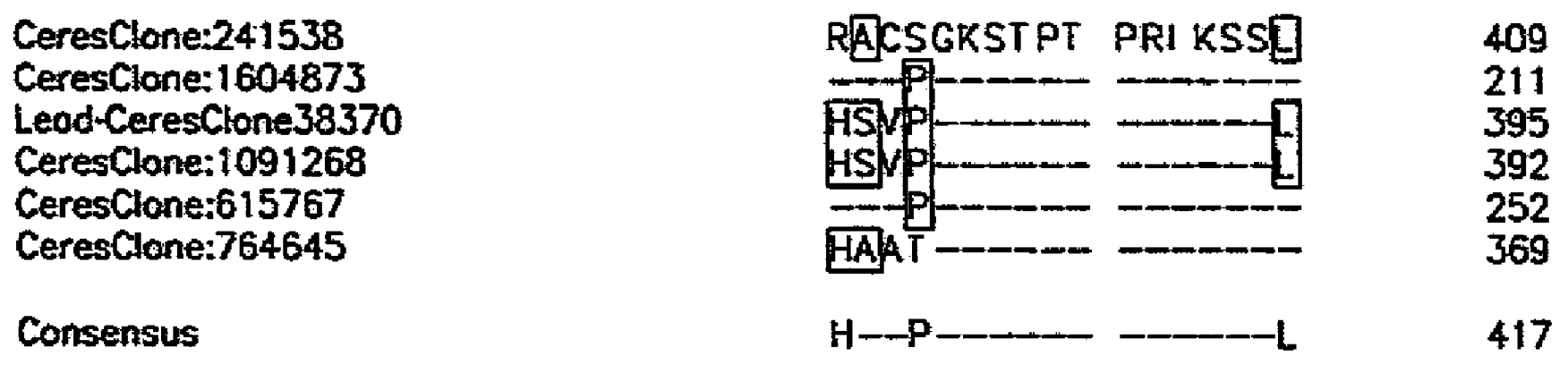

| | | |
|---|---|---|
| CeresClone:241538 | RACSGKSTPT PRIKSSL | 409 |
| CeresClone:1604873 | ---P------- -------- | 211 |
| Lead-CeresClone38370 | HSVP------- -------L | 395 |
| CeresClone:1091268 | HSVP------- -------L | 392 |
| CeresClone:615767 | ---P------- -------- | 252 |
| CeresClone:764645 | HAAT------- -------- | 369 |
| Consensus | H--P------- -------L | 417 |

```
Lead-CeresClone1496     MQIFVKTLTG KTITLEVESS DTIDNVKAKI QDKEGIPPDQ QRLIFAGKQL   50
CeresClone:1063698      MQIFVKTLTG KTITLEVESS DTIDNVKAKI QDKEGIPPDQ QRLIFAGKQL   50
gi|18252349             MQIFVKTLTG KTITLEVESS DTIDNVKAKI QDKEGIPPDQ QRLIFAGKQL   50
gi|34581769             MQIFVKTLTG KTITLEVESS DTIDNVKAKI QDKEGIPPDQ QRLIFAGKQL   50
gi|438111               MQIFVKTLTG KTITLEVESS DTIDNVKAKI QDKEGIPPDQ QRLIFAGKQL   50
CeresClone:544375       MQIFVKTLTG KTITLEVESS DTIDNVKAKI QDKEGIPPDQ QRLIFAGKQL   50

Consensus               MQIFVKTLTG KTITLEVESS DTIDNVKAKI QDKEGIPPDQ QRLIFAGKQL   50

Lead-CeresClone1496     EDGRTLADYN IQKESTLHLV LRLRGGAKKR KKKTYTKPKK IKHTHKKVKL  100
CeresClone:1063698      EDGRTLADYN IQKESTLHLV LRLRGGAKKR KKKTYTKPKK IKHKHKKVKL  100
gi|18252349             EDGRTLADYN IQKESTLHLV LRLRGGAKKR KKKTYTKPKK IKHKHKKVKL  100
gi|34581769             EDGRTLADYN IQKESTLHLV LRLRGGAKKR KKKTYTKPKK IKHKHKKVKL  100
gi|438111               EDGRTLADYN IQKESTLHLV LRLRGGAKKR KKKTYTKPKK IKHKHKKVKL  100
CeresClone:544375       EDGRTLADYN IQKESTLHLV LRLRGGAKKR KKKTYTKPKK IKHKHKKVKL  100

Consensus               EDGRTLADYN IQKESTLHLV LRLRGGAKKR KKKTYTKPKK IKHKHKKVKL  100

Lead-CeresClone1496     AVLQFYKVDG SGKVQRLKKE CPSVSCGPGT FMASHFDRHY CGKCGITYVF  150
CeresClone:1063698      AVLQFYKVDG SGKVQRLRKE CPNATCGAGT FMASHFDRHY CGKCGLTYVY  150
gi|18252349             AVLQFYKVDD SRKVQRLRKE CPNAECGAGT FMANHFDRHY CGKCGLTYVY  150
gi|34581769             AVLQFYKVDD SGKVQRLRKE CPNAECGAGT FMANHFDRHY CGKCGLTYVY  150
gi|438111               AVLQFYKVDD SGKVQRLRKE CPNAECGAGT FMANHFDRHY CGKCGQTYVY  150
CeresClone:544375       GILQFYKVDD SGKVQRLRKE CPNAECGAGT FMANHFDRHY CGKCGLTYVY  150

Consensus               AVLQFYKVDD SGKVQRLRKE CPNAECGAGT FMANHFDRHY CGKCGLTYVY  150

Lead-CeresClone1496     KKADEE-      156
CeresClone:1063698      QKEGAEA      157
gi|18252349             QKAG---      154
gi|34581769             NKAGGD-      156
gi|438111               QKADA--      155
CeresClone:544375       QKADA--      155

Consensus               QKA-AE-      157
```

```
CeresClone:479756       ---------- ---------- ---------M SAPLSAELRS KYNVRSI PVR  21
CeresClone:467309       MKFNPRVSSS RRKSRKAHFT APSSVRRVLM SAPLSAELRS KYNVRSI PVR  50
CeresClone:463579       MKFNPRVSSS RRKSRKAHFT APSSVRRVLM SAPLSTDLRS KYNVRSI PVR  50
CeresClone:1608715      MKFNPRVSSS RRKSRKAHFT APSSVRRVLM SAPLSTDLRS KYNVRSI PVR  50
Lead-CeresClone2561     ---------- ---------- ---------- ---------- ----------   0
CeresClone:1248535      MKYNPRVTSS RRKNRKAHFT ASSSERRVI M SSPLSTDLRA KYNVRSMPI R  50
CeresClone:22819        MKYNPRVTSS RRKNRKAHFT ASSSERRVI M SSPLSTDLRQ KYNVRSMPI R  50
CeresClone:1316364      ---------- ---------- ---------- ---------- ----------   0
CeresClone:1440308      MKRNPRVTSS RRKCRKAHFT APSSVRRVLM SAALSSELRH KYNVRSI PI R  50
CeresClone:297892       ---------- ---------- ---------M SAALSTELRH KYNVRSI PI R  21

Consensus               MKFNPRV-SS RRKSRKAHFT A-SS-RRVLM SAPLST-LRS KYNVRSI P-R  50

CeresClone:479756       KEDEVQVMRG TYKGREGKVI QVYRRKWVI H I ERI TREKVN GSTVNVGI HP  71
CeresClone:467309       KEDEVQVVRG TYKGREGKVT QVYRRKWVI H I ERI TREKVN GSTVNVGI HP 100
CeresClone:463579       KDDEVQVVRG TYKGREGKVV QVYRRKWVI H I ERI TREKVN GSTVNVGI HP 100
CeresClone:1608715      KDDEVQVVRG TYKGREGKVV QVYRRKWVI H I ERI TREKVN GSTVNVGI HP 100
Lead-CeresClone2561     ----MQVVRG TFKGREGKVM QVYRRKWVI H I ERI TREKVN GSTVNVGVNA  46
CeresClone:1248535      KDDEVQI VRG TYKGREGKVV QVYRRKWVI H I ERI TREKVN GTTVNVGVQP 100
CeresClone:22819        KDDEVQI VRG TYKGREGKVV QVYRRKWVI H I ERI TREKVN GTTVNVGI QP 100
CeresClone:1316364      -MTXVQVVRG TFKGREGKVV QXYRRRWVXH VERI TXXKVX GSTVNXGI HP  49
CeresClone:1440308      KDDEVQVVRG TFKGREGKVV QVYRRRWVI H VERI TREKVN GSTVNVGI HP 100
CeresClone:297892       KDDEVQVVRG TYKGREGKVV QVYRRRWVI H VERI TREKVN GSTVNVGI HP  71

Consensus               KDDEVQVVRG TYKGREGKVV QVYRRKWVI H I ERI TREKVN GSTVNVGI HP 100

CeresClone:479756       SKVVLTKLKL DKDRKAI LDR KAKGRAAADK EKGSGLRNRS LENKALI VSG 121
CeresClone:467309       SKVVVTKLKL DKDRKAI LDR KAKGRAAADK EKGTKFAPED I--------- 141
CeresClone:463579       SKVVVTKLRM DKDRKSLLDR KAKGRAAADK EKGTKFAPED V--------- 141
CeresClone:1608715      SKVVVTKLRM DKDRKSLLDR KAKGRAAADK EKGTKFAPED I--------- 141
Lead-CeresClone2561     SNVMI TKLRL DKDRKSLLER KANGRAAADK EKGTKFSAED V---------  87
CeresClone:1248535      SKVVI TKLRL DKDRKSLLER KAKGRAAADK DKGTKFTAED V--------- 141
CeresClone:22819        SKVVI TKLRL DKDRKSLLER KAKGRAAADK EKGTKFTSED V--------- 141
CeresClone:1316364      SXVI VTXXKL XKDRKALLVR KARGR-AADK AKG-KFTAEE VAAAAGGSTA  97
CeresClone:1440308      SKVI VTKLKL DKDRKALLDR KARGR-AADK AKG-KFTAED VAAAAGGATA 148
CeresClone:297892       SKVMVTKLKL DKDRKALLDR KARGR-AADK AKG-KFTADD VAAAAGGAAA 119

Consensus               SKVVVTKL-L DKDRK-LLDR KAKGRAAADK EKGTKFTAED V--------- 150
```

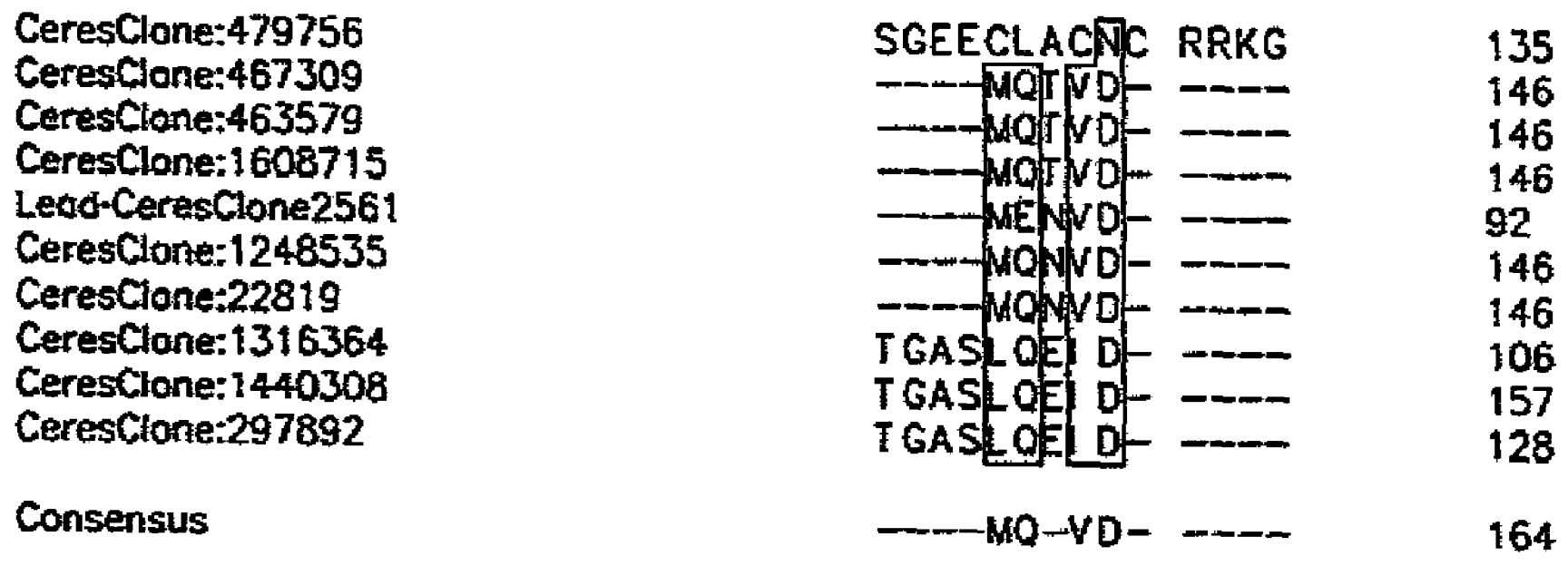

| | | |
|---|---|---|
| CeresClone:479756 | SGEECLACNC RRKG | 135 |
| CeresClone:467309 | -----MQTVD- ---- | 146 |
| CeresClone:463579 | -----MQTVD- ---- | 146 |
| CeresClone:1608715 | -----MQTVD- ---- | 146 |
| Lead-CeresClone2561 | -----MENVD- ---- | 92 |
| CeresClone:1248535 | -----MQNVD- ---- | 146 |
| CeresClone:22819 | -----MQNVD- ---- | 146 |
| CeresClone:1316364 | TGASLQEI D- ---- | 106 |
| CeresClone:1440308 | TGASLQEI D- ---- | 157 |
| CeresClone:297892 | TGASLQEI D- ---- | 128 |
| Consensus | -----MQ-VD- ---- | 164 |

```
gi|62701911           MAEAKQ---- QQQQPQAATA AAASGVWKTV KPFANGGASG MLATCVI QPI  46
CeresClone:702388     MADAKQ---- QQ-------A AAPTGVWKTI KPFVNGGASG MLATCVI QPI  39
gi|2130089            MADAKQ---- QQ-------A VAPSAAWMTV KPFVNGGASG MLATCVI QPI  39
gi|51860703           MADAKQ---- QPQ--QAAAA AATTGVWKTV KPFVNGGASG MLATCVI QPI  44
gi|53749331           MADAKQ---- ----QQQQTA AAATGVWKTV KPFVNGGASG MLATCVI QPI  43
Lead-CeresClone19510  MAEEKK---- ---------- -APISVWITV KPFVNGGASG MLATCVI QPI  35
gi|61651612           MGEEEKGKSA SNSSSNSNSN SNSSGVWRTI KPFVNGGASG MLATCVI QPI  50
gi|37964368           MGEEKK---- ---------- PQSAGVWPTV KPFVNGGASG MLATCVI QPI  36
gi|19913109           MGDKAK---- ---------S TSSAGAWPTV KPFANGGASG MLATCVI QPI  37
gi|1486472            MGEKP----- ---------- -VSGGVWPTV KPFINGGVSG MLATCVI QPI  34

Consensus             MA--KQ---- ---------A -AS-GVWKTV KPFVNGGASG MLATCVI QPI  50

gi|62701911           DMVKVRI QLG EGSAASVTKK MLANEGI SAF YKGLSAGLLR QATYTTARLG  96
CeresClone:702388     DMI KVKI QLG EGSAAQVAKT MYANEGLGSF YKGLSAGLLR QATYTTARLG  89
gi|2130089            DMVKVKI QLG EGSAATVTKK MLANEGI GSF YKGLSAGLLR QATYTTARLG  89
gi|51860703           DMVKVRI QLG EGSACQVTRN MLANEGVRSF YKGLSAGLLR QATYTTARLG  94
gi|53749331           DMVKVKI QLG EGSAAQVTKN MLANEGI GSF YKGLSAGLLR QATYTTARLG  93
Lead-CeresClone19510  DMI KVRI QLG QGSAASI TTN MLKNEGVGAF YKGLSAGLLR QATYTTARLG  85
gi|61651612           DMVKVRI QLG QGSALSI TKN MLRDDGI RAF YKGLSAGLLR QATYTTARLG 100
gi|37964368           DMI KVRI QLG QGSAGTVTKT MLKNEGFGAF YKGLSAGLLR QATYTTARLG  86
gi|19913109           DMI KVRI QLG QGSAGEVTRT MLKNEGFGAF YKGLSAGLLR QATYTTARLG  87
gi|1486472            DMI KVRI QLG QGSAADVTKT MLKNEGFGAF YKGLSAGLLR QATYTTARLG  84

Consensus             DM-KVRI QLG -GSAA-VTK- ML-NEGI GAF YKGLSAGLLR QATYTTARLG 100

gi|62701911           SFRVLTNKAV EANDGKPLPL VQKAGIGLTA GAI GACVGSP ADLALI RMQA 146
CeresClone:702388     SFRVLTNKAI EANDGKPLPL VQKAFIGLTA GAI GACVGSP ADLALI RMQA 139
gi|2130089            SFRVLTNKAV EANEGKPLPL LQKAVI GLTA GAI GASVGSP ADLALI RMQA 139
gi|51860703           SFRVLTNKAV EKNEGKPLPL I QKAFI GLTA GAI GACVGSP ADLALI RMQA 144
gi|53749331           SFRVLTNKAI EKNDGKPLPL VQKAFI GLTA GAI GACVGSP ADLALI RMQA 143
Lead-CeresClone19510  SFKLLTAKAI ESNDGKPLPL YQKALCGLTA GAI GACVGSP ADLALI RMQA 135
gi|61651612           SFKI LTNKAL EANEGKPLPL YQKALCGLSA GAI GASVGSP ADLALI RMQA 150
gi|37964368           SFRI LTNKAI EANDGKPLPL YQKALCGLTA GAI GASVGSP ADLALI RMQA 136
gi|19913109           SFRVLTNKAI EANDGKPLPL YQKALCGLTA GAI GACFGSP ADLALI RMQA 137
gi|1486472            SFRI LTNKAI EANEGKPLPL YQKALCGLTA GAI GAFVGSP ADLALI RMQA 134

Consensus             SFRVLTNKAI EANDGKPLPL -QKAL-GLTA GAI GACVGSP ADLALI RMQA 150
```

| | | | | | | |
|---|---|---|---|---|---|---|
| gi\|62701911 | DSTLPAAQSR | NYKNAFHALY | RIAADEGVLA | LWKGAGPTVV | RAMSLNMGML | 196 |
| CeresClone:702388 | DSTLPAAQRR | HYKNAFHALY | RITADEGVLA | LWKGAGPTVV | RAMSLNMGML | 189 |
| gi\|2130089 | DSTLPAAQRR | NYKNAFHALY | RIVADEGVLA | LWKGAGPTVV | RAMSLNMGML | 189 |
| gi\|51860703 | DSTLPAAQRR | NYKNAFHALY | RITADEGVLA | LWKGAGPTVV | RAMALNMGML | 194 |
| gi\|53749331 | DSTLPTAQRR | NYKNAFHALY | RIIADEGVLA | LWKGAGPTVV | RAMALNMGML | 193 |
| Lead-CeresClone19510 | DNTLPLAQRR | NYTNAFHALT | RISADEGVLA | LWKGCGPTVV | RAMALNMGML | 185 |
| gi\|61651612 | DATLPEAQRR | HYKNAFHALY | RIIADEGVLA | LWKGAAPTVV | RAMALNMGML | 200 |
| gi\|37964368 | DATLPAAQRR | HYTNAFQALY | RIVIDEGVLA | LWKGAGPTVV | RAMALNMGML | 186 |
| gi\|19913109 | DATLPVAQRR | NYTNAFHALY | RIVADEGVLS | LWKGAGPTVV | RAMALNMGML | 187 |
| gi\|1486472 | DATLPLAQRR | NYTNAFHALS | RIAVDEGVLA | LWKGAGPTVV | RAMALNMGML | 184 |
| Consensus | DSTLPAAQRR | NYKNAFHALY | RI-ADEGVLA | LWKGAGPTVV | RAMALNMGML | 200 |

| | | | | | | |
|---|---|---|---|---|---|---|
| gi\|62701911 | ASYDQSVELF | RDTLGAGEVT | TVLGASAVSG | LCASACSLPF | DYVKTQIQKM | 246 |
| CeresClone:702388 | ASYDQSVELF | RDKLGAGEYQ | TVIGASAISG | FCAAACSLPF | DYVKTQIQKM | 239 |
| gi\|2130089 | ASYDQSVELF | RDTLGAGELS | TMLGASAVSG | FCASACSLPF | DYVKTQIQKM | 239 |
| gi\|51860703 | ASYDQSVELF | RDKLGAGEIS | TVVGASAISG | FFASACSLPF | DYVKTQIQKM | 244 |
| gi\|53749331 | ASYDQSVELF | RDKLGAGEVS | TVLGASAVSG | FFASACSLPF | DYVKTQIQKM | 243 |
| Lead-CeresClone19510 | ASYDQSAEYM | RDNLGFGEMS | TVVGASAVSG | FCAAACSLPF | DFVKTQIQKM | 235 |
| gi\|61651612 | ASYDQSVEFF | RDSLGYGEVA | TVLGASTVSG | FFASACSLPF | DYVKTQIQKM | 250 |
| gi\|37964368 | ASYDQSVEFF | RDACGLSELP | TVIGASTVSG | FFASACSLPF | DYVKTQIQKM | 236 |
| gi\|19913109 | ASYDQSVEFF | KDNLGMGEAA | TVVGASSVSG | FFAAACSLPF | DYVKTQIQKM | 237 |
| gi\|1486472 | ASYDQSVEFF | RDNLGMGEAA | TVVGASSVSG | FFAAACSLPF | DYVKTQIQKM | 234 |
| Consensus | ASYDQSVE-F | RD-LGAGEVS | TV-GASAVSG | FFASACSLPF | DYVKTQIQKM | 250 |

| | | | | | | |
|---|---|---|---|---|---|---|
| gi\|62701911 | QPDASGKYPY | TGSLDCAMKT | LKSGGPFKFY | TGFPVYCVRI | APHAMMTWIF | 296 |
| CeresClone:702388 | QPDATGKYPY | TGSLDCAMQT | LKTGGPFKFY | SGFPVYCVRI | APHVMMTWLF | 289 |
| gi\|2130089 | QPDANGKYPY | TGSLDCVMKT | LKSGGPFKFY | TGFPVYCVRI | APHVMLTWIF | 289 |
| gi\|51860703 | QPDANGKYPY | TGSLDCAVKT | FKSGGPFKFY | TGFPVYCVRI | APHVMMTWIF | 294 |
| gi\|53749331 | QPDASGKYPY | TGSLDCAMKT | FKSGGPFKFY | TGFPVYCVRI | APHVMMTWIF | 293 |
| Lead-CeresClone19510 | QPDAQGKYPY | TGSLDCAMKT | LKEGGPLKFY | SGFPVYCVRI | APHVMMTWIF | 285 |
| gi\|61651612 | QPDAEGKYPY | KGSLDCT KT | LKSGGPFKFY | TGFPVYCVRI | APHAMMTL F | 300 |
| gi\|37964368 | QPDAQGKYPY | TGSMDCAMKT | LKAGGPFKFY | TGFPVYCVRI | APHVMMTWIF | 286 |
| gi\|19913109 | QPDAQGKYPY | TGSFDCAMKT | LKSGGPFKFY | TGFPVYCVRI | APHVMMTWIF | 287 |
| gi\|1486472 | QPDAEGKLPY | TGSFDCAMKT | LKAGGPFKFY | TGFPVYCIRI | APHVMMTWIF | 284 |
| Consensus | QPDA-GKYPY | TGSLDCAMKT | LKSGGPFKFY | TGFPVYCVRI | APHVMMTWIF | 300 |

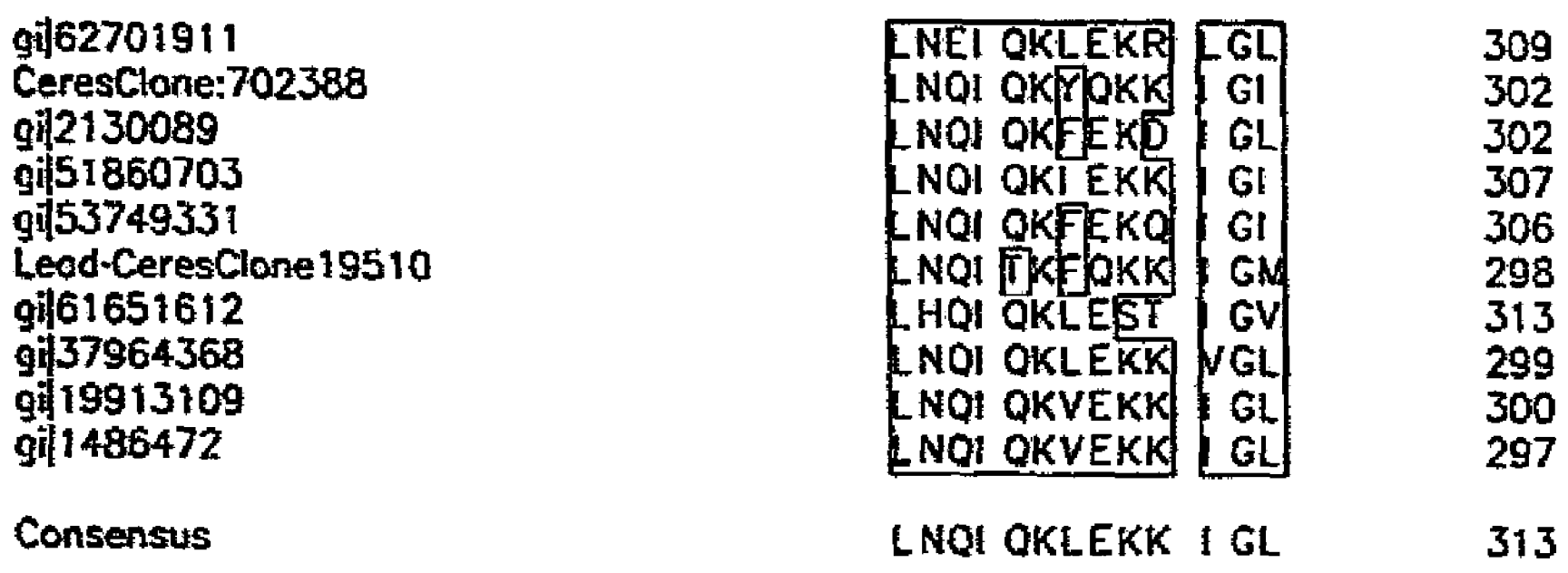

| | | |
|---|---|---|
| gi\|62701911 | LNEI QKLEKR LGL | 309 |
| CeresClone:702388 | LNQI QKYQKK I GI | 302 |
| gi\|2130089 | LNQI QKFEKD I GL | 302 |
| gi\|51860703 | LNQI QKI EKK I GI | 307 |
| gi\|53749331 | LNQI QKFEKQ I GI | 306 |
| Lead-CeresClone19510 | LNQI TKFQKK I GM | 298 |
| gi\|61651612 | LHQI QKLEST I GV | 313 |
| gi\|37964368 | LNQI QKLEKK VGL | 299 |
| gi\|19913109 | LNQI QKVEKK I GL | 300 |
| gi\|1486472 | LNQI QKVEKK I GL | 297 |
| Consensus | LNQI QKLEKK I GL | 313 |

```
CeresClone:1446800      MVTSSSERGQ -----AGSGG PAPTLTGWKD LPMELLVRII STVGDDRMVI  45
CeresClone:239171       MVTSSSERGQ -----AGSGG PAPTLTGWKD LPMELLVRII STVGDDRMVI  45
CeresClone:472861       MMVAGSGNGE -----KGVNS KVGVITEWKD IPVELLMQIL SLV-DDQTVI  44
Lead-CeresClone19486    MVMGGEASME LDQCFQKMKM EGISIKEWKD IPVELLMRIL SLV-DDRNVI  49
CeresClone:3549         ---------- -------MKM EGVLISEWKD IPVELLMKIL NLV-DDRTVI  32

Consensus               MV-S-S--G- ------GM-- E--TITEWKD IPVELLMRIL SLV-DDR-VI  50

CeresClone:1446800      VASGVCTGWR DALGWGVTNL SLTWCKLSMN NLMISLAHKF TKLQVLTLRQ  95
CeresClone:239171       VASGVCTGWR DALGWGVTNL SLTWCKLSMN NLMISLAHKF TKLQVLTLRQ  95
CeresClone:472861       TASGVCRGWR DAIYFGLARL SLSWCSKSMN NLVLSLVPKF VKLQTLILRQ  94
Lead-CeresClone19486    VASGVCTGWR DAISFGLTRL RLSWCNNNMN SLVLSLVPKF VKLQTLNLRQ  99
CeresClone:3549         IASCICSGWR DAVSLGLTRL SLSWCKKNMN SLVLSLAPKF VKLQTLVLRQ  82

Consensus               VASGVCTGWR DA---GLTRL SLSWCK-NMN NLVLSLAPKF VKLQTL-LRQ  100

CeresClone:1446800      NKPQLEDSAV EAVANYCHDL RELDLSRSFR LSDRSLYALA HGCPRLTRLN  145
CeresClone:239171       NKPQLEDSAV EAVANYCHDL RELDLSRSFR LSDRSLYALA HGCPRLTRLN  145
CeresClone:472861       DKPQLEDNAV ETIAKCCHEL QILDLSKSFK LTDHSLYELA LGCRDLTKLN  144
Lead-CeresClone19486    DKPQLEDNAV EAIANHCHEL QELDLSKSLK ITDRSLYALA HGCPDLTKLN  149
CeresClone:3549         DKPQLEDNAV EAIANHCHEL QDLDLSKSSK ITDHSLYSLA RGCTNLTKLN  132

Consensus               DKPQLEDNAV EAIAN-CHEL QELDLSKSFK LTDRSLYALA HGCPDLTKLN  150

CeresClone:1446800      ISGCSSFSDT ALIYLTCRCK NLKCLNLCGC VKAVTDRALQ AIAQNCGQLQ  195
CeresClone:239171       ISGCSSFSDT ALIYLTCRCK NLKCLNLCGC VKAVTDRALQ AIAQNCGQLQ  195
CeresClone:472861       ISGCSAFSDN ALAYLASFCR KLKVLNLCGC VRAASDTALQ AIGQYCNQLQ  194
Lead-CeresClone19486    LSGCTSFSDT AIAYLTRFCR KLKVLNLCGC VKAVTDNALE AIGNNCNQMQ  199
CeresClone:3549         LSGCTSFSDT ALAHLTRFCR KLKILNLCGC VEAVSDNTLQ AIGENCNQLQ  182

Consensus               ISGCSSFSDT ALAYLT-FCR KLKVLNLCGC VKAVTD-ALQ AIGQNCNQLQ  200
```

```
CeresClone:1446800        SLNLGWCDDV TDKGVTSLAS GCPDLRAVDL CGCVLITDES VVALANGCPH   245
CeresClone:239171         SLNLGWCDDV TDKGVTSLAS GCPDLRAVDS CGCVLITDES VVALANGCPH   245
CeresClone:472861         SLNLGWCDNV GDVGVTTLAY GCPDLRIVDL CGCVRITDDS VIALATRCPH   244
Lead-CeresClone19486      SLNLGWCENI SDDGVMSLAY GCPDLRTLDL CGCVLITDES VVALADWCVH   249
CeresClone:3549           SLNLGWCENI SDDGVMSLAY GCPDLRTLDL CSCVLITDES VVALANRCIH   232

Consensus                 SLNLGWCDNV -D-GVTSLAY GCPDLR-VDL CGCVLITDES VVALAN-CPH   250

CeresClone:1446800        LRSLGLYFCQ NITDRAMYSL ANSRVKSKRG RWDAVK---- --DGLANLNI   289
CeresClone:239171         LRSLGLYFCQ NITDRAMYSL ANSRVKSKRG RWDAVK---- --DGLANLNI   289
CeresClone:472861         LRSLGLYYCK NITDRAMYSL AHSKVNNR-- MWGSVKGGN- DEDGLRTLNI   291
Lead-CeresClone19486      LRSLGLYYCR NITDRAIYSL AQSGVKNKPG SWKSVKKGKY DEEGLRSLNI   299
CeresClone:3549           LRSLGLYYCR NITDRAMYSL AQSGVKNKHE MWRAVKKGKF DEEGLRSLNI   282

Consensus                 LRSLGLYYC- NITDRAMYSL ANSRVKNK-G -W-AVK-G-- DEDGLR-LNI   300

CeresClone:1446800        SQCTALTPPA VQAVCDSFPA LHTCPERHSL IISGCLSLTS VHCACALHPH   339
CeresClone:239171         SQCTALTPPA VQAVCDSFPA LHTCPERHSL IISGCLSLTS VHCACALHPH   339
CeresClone:472861         SQCTALTPSA VQAVCDSFPS LHTCSGRHSL IMSGCLNLTS VHCACAVHAH   341
Lead-CeresClone19486      SQCTALTSSA VQAVCDSFPA LHTCSGRHSL VMSGCLNLTT VHCACILQAH   349
CeresClone:3549           SQCTYLTPSA VQAVCDTFPA LHTCSGRHSL VMSGCLNLQS VHCACILQAH   332

Consensus                 SQCTALTPSA VQAVCDSFPA LHTCSGRHSL IMSGCLNLTS VHCACALHAH   350

CeresClone:1446800        RAGRALMANH AY   351
CeresClone:239171         RAGRALMANH AY   351
CeresClone:472861         RA-FTTFPHP AH   352
Lead-CeresClone19486      RA-HNAVPHP AH   360
CeresClone:3549           RF-HTVYPHP AH   343

Consensus                 RA---LMPHP AH   362
```

```
CeresClone:698804       MA--DRGGYV QVQHGQYGGG --HHGGQQ-- -QHGRQMGEQ MKGMFQEK--  41
CeresClone:1286956      MA--DRD--- --RSGIYGGA HATYGQQQQQ GGGGRPMGEQ VKGMLHDKGP  43
CeresClone:290537       MA--DRD--- --RSGIYGGG --AYGQQQ-- -GGGRPMGEQ VKGMIHDKGP  38
CeresClone:1283332      MA--DRD--- --RSGIYGGG --AYGQQQ-- -GGGRPMGEQ VKGMIHDKGP  38
CeresClone:1277502      MA--DRD--- --RSGIYGGG --AYGQQQ-- -GGGRPMGEQ VKGMIHDKGP  38
Lead-CeresClone19319    MANVDRDRRV HVDRTDKRVH QPNYEDDV-- -GFGGYGGYG AGSDYKSRGP  47
CeresClone:1171110      MS-------- ---------- ---------- ---------- ---------L   3

Consensus               MA--DRD--- --RSGIYGGG ---YGQQQ-- -GGGRPMGEQ VKGMIHDKGP  50

CeresClone:698804       ----ALTVAT LFPLGGLLLV LSGLALAGTV VGLAVATPVF LLFSPMLVPA  87
CeresClone:1286956      TASQALTVAT LFPLGGLLLV LSGLALTASV VGLAVATPVF LIFSPVLVPA  93
CeresClone:290537       TASQALTVAT LFPLGGLLLV LSGLALAAST VGLALATPVF LLFSPVLVPA  88
CeresClone:1283332      TASQALTVAT LFPLGGLLLV LSGLALAAST VGLALATPVF LLFSPVLVPA  88
CeresClone:1277502      TASQALTVAT LFPLGGLLLV LSGLALAAST VGLALATPVF LLFSPALVPA  88
Lead-CeresClone19319    STNQILALIA GVPIGGILLT LAGLILAGSV IGLLVSIPLF LLFSPVIVPA  97
CeresClone:1171110      TGSQLLALLA GVPLGAMLLL LSGISLIASL LGLAVATPLF IFFSPLLVPA  53

Consensus               TASQALTVAT LFPLGGLLLV LSGLALAASV VGLAVATPVF LLFSPVLVPA 100

CeresClone:698804       ALLIGLAVIG FLTSGALGLG GLSSLTVLAN TARQAFQRTP DYV---EEAR 134
CeresClone:1286956      ALLIGTAVMG FLTSGALGLG GLSSLTCLAN TARQAFQRTP DYV---EEAH 140
CeresClone:290537       ALLIGTAVAG FLTSGALGLG GLSSLTCLAN TARQAFQRTP DYV---EEAR 135
CeresClone:1283332      ALLIGTAVAG FLTSGALGLG GLSSLTCLAN TARQAFQRTP DYV---EEAR 135
CeresClone:1277502      ALLIGTAVAG FLTSGALGLG GLSSLTCLAN TARQAFQRTP DYV---EEAR 135
Lead-CeresClone19319    ALIIGLAVIG ILASGLFGLT GLSSVSMVLN YLRGTSDTVP EQL---DYAK 144
CeresClone:1171110      AFALGMAVIA VLAAGACGLA GLVLFSMVVN YLRQMPRGIT MMTVLPEQAK 103

Consensus               ALLIGTAV-G FLTSGALGLG GLSSLTCLAN TARQAFQRTP DYV---EEAR 150

CeresClone:698804       QRMADAAAAX GHKDAAGRPR HPEPRGGRAR RRRWPHRRHR RSGRRHRHRH 184
CeresClone:1286956      RRMAEAAAHA GHKTA----- ----QAGQAI QGR-AQEAGA GGGAGAGAGG 180
CeresClone:290537       RRMAEAAAHA GHKTA----- ----QAGHGI QSK-AQEAGA GTGAG----- 170
CeresClone:1283332      RRMAEAAAHA GHKTA----- ----QAGHGI QSK-AQEAGA GTGAG----- 170
CeresClone:1277502      RRMAEAAAHA GHKTA----- ----QAGHGI QSK-AQEAGA GTGAG----- 170
Lead-CeresClone19319    RRMADAVSYA GMKGK----- ----XMGQYV QDK-AHEA-R ETEFMTETHE 183
CeresClone:1171110      RHVADMAEYV GQKTK----- ----EVGQDI QTR-AHHA-Q GTTRMTVH-- 140

Consensus               RRMADAAAHA GHKTA----- ----QAGQ-I QSK-AQEAGA GTGAG----- 200
```

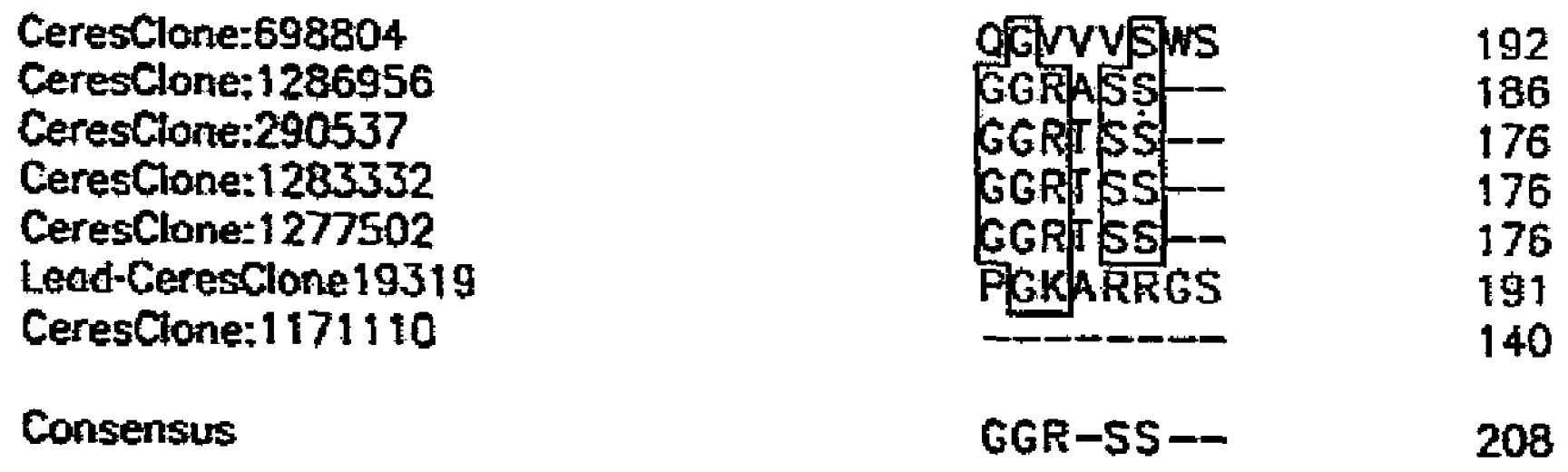

| | | |
|---|---|---|
| CeresClone:698804 | QGVVVSWS | 192 |
| CeresClone:1286956 | GGRASS-- | 186 |
| CeresClone:290537 | GGRTSS-- | 176 |
| CeresClone:1283332 | GGRTSS-- | 176 |
| CeresClone:1277502 | GGRTSS-- | 176 |
| Lead-CeresClone19319 | PGKARRGS | 191 |
| CeresClone:1171110 | -------- | 140 |
| Consensus | GGR-SS-- | 208 |

```
Lead-CeresClone19116   ----------  -MGGLAME--  --------EM  PLSVLFEQAR  KIHLAASESG   29
gi|8809589             ----------  -MGGLAME--  --------EM  PLSVLFEQAR  KIHLAASESG   29
gi|984756              MVEVEEVSNK  MQVQMRLHPA  AAAEEEDADL  PLPALFDKAS  HLHSLASSSS   50
gi|29367365            MVEVEEVSNK  MQAQMRLHPA  AAAEEEDADL  PLPALFDKAS  HLHSLASSSS   50
CeresClone:325957      MVDVEETGNK  LQSQMRLH--  AEPEDDAADL  PLPALFDRAS  RLHALASSSA   48

Consensus              MVEVEE--NK  MQ-QMRMH--  A--EEE-ADM  PLPALFD-AS  KLHSLASSSS   50

Lead-CeresClone19116   VDQDVVKKGC  EMFQKCEDMI  GKLALFSSNE  TKEDISTNNL  KYLLVPYYLA   79
gi|8809589             VDQDVVKKGC  EMFQKCEDMI  GKLALFSSNE  TKEDISTNNL  KYLLVPYYLA   79
gi|984756              LDQEGIRKGV  DLLRRCDEMV  SKVGLFSSNE  TKDDISTANL  KYLLVPYYLG  100
gi|29367365            LDQEGIRKGV  DLLRRCDEMV  SKLGLFSSNE  TKDDVSTANL  KYLLVPYYLG  100
CeresClone:325957      LDQDGIRTGV  DLLRRCDDMV  SKLGLFSPNE  TKEDVSTANL  KYLLVPYYLA   98

Consensus              LDQDGIRKGV  DMLRRCDDMV  SKLGLFSSNE  TKEDISTANL  KYLLVPYYLA  100

Lead-CeresClone19116   ELTEKIIQED  RIQIVKASYA  KLKEFFSFCE  AMELVPDEEL  EASSRGG--S  127
gi|8809589             ELTEKILQED  RIQIVKASYA  KLKEFFSFCE  AMELVPDEEL  EASSRGG--S  127
gi|984756              EMTERVAQED  RIPVLKASQD  HLKEFISICE  ALELISEDEL  EISRQKNLIP  150
gi|29367365            EMTERVAQED  RIPVLKASQD  HLKEFISICE  ALELISEDEL  ELSRQKQ--P  148
CeresClone:325957      EMTEKIAQED  RIPVLKTSQD  HLKEFIALCE  VLELIPEDEL  ELSRQKQ--P  146

Consensus              EMTEKIAQED  RIPVLKASQD  HLKEFISICE  AMELIPEDEL  ELSRQK---P  150

Lead-CeresClone19116   GAPADRRALK  IARFKRQKAA  EAKLLEIKER  KERRGRSTKA  SALSTPVESG  177
gi|8809589             GAPADRRALK  LARFKRQKAA  EAKLLEIKER  KERRGRSTKA  SALSTPVESG  177
gi|984756              WQIEEHRRLH  GSSAKRLQKQ  SSR----KER  KERRRRH-ES  SCLSAPIELG  196
gi|29367365            DTMANRRAQK  AARFKRQKAA  ETKLLEIKER  KERRRRSLRA  AALSAPIEAG  198
CeresClone:325957      DTLTNRRAQK  VARFKRQKAA  ETKLQEIRER  KERRGRSLRA  AALSAPIEAC  196

Consensus              ---A-RRALK  VARFKRQKAA  E-KLLEIKER  KERRGRS--A  SALSAPIE-G  200
```

```
Lead-CeresClone19116   EDDIPDDDSE EEREAWLSSI NLAICK---- ------AIDL LEMLKREEEM  217
gi|8809589             EDDIPDDDSE EERE--LSCL IAFLCRPGSP QLTWLFAIDL LEMLKREEEM  225
gi|984756              GD--LLRMME KEREGMVSYY LIGSIE---- ------GFDL LDMLKKEEEI  234
gi|29367365            EEDAFEDDGE EEREAWLATI SLALCK---- ------AFDL LDMLKKEEEM  238
CeresClone:325957      EEDDLENDGE EEREAWLATI SLALCK---- ------AFDL LDMLKKEEEM  236

Consensus              EDD---DD-E EEREAWLSTI SLALCK---- ------AFDL LDMLKKEEEM  250

Lead-CeresClone19116   LSAIKERQLK DGEGGFSRDA LDDRTKKAET WHRDAAARIQ YSKPAQPITC  267
gi|8809589             LSAIKERQLK DGEGGFSRDA LDDRTKKAET WHRDAAARIQ YSKPAQPITC  275
gi|984756              VPAVKE---- -GKRRMVMHL L--------- ---------- -------VKC  253
gi|29367365            LLAVKERQAK DGN-AFAREM LDERTKKAEA WHHNAANRAP YSKPADPITC  287
CeresClone:325957      LQAVKERKAK DGN-AFAREM LDERTKKAET WHHNAANRVA YSKPADPITC  285

Consensus              L-AVKERQ-K DGE--F-R-M LD-RTKKAET WH--AA-RI- YSKPA-PITC  300

Lead-CeresClone19116   ATFAQDVLEG RASVSQGHEH KNQPLIFGPA SIVGGPLSTE RERM AQVFQ  317
gi|8809589             ATFAQDVLEG RASVSQGHEH KNQPLIFGPA SIVGGPLSTE RERM AQVFQ  325
gi|984756              LMNVQKGLKH GTIMLPTVHH TPNQLI---Q SLV--QLTSE RERMAAQVFQ  298
gi|29367365            ATFAQDVIEG RASVSQAHEH KHQPLIFGPA SLVGGGLTSE RERMAAQVFQ  337
CeresClone:325957      ATFAQDVIEG RASVSQAHEH KHQPLIFGPA SIVGGGLTSE RERMTAQVFQ  335

Consensus              ATFAQDVLEG RASVSQ-HEH K-QPLIFGPA SIVGG-LTSE RERM-AQVFQ  350

Lead-CeresClone19116   PSHRMPTMCI EDAGLIEMNI MNDWQEQTKK AIEEATTSWY NDKPLRRKEE  367
gi|8809589             PSHRMPTMCI EDAGLIEMNI MNDWQEQTKK AIEEATTSWY NDKPLRRKEE  375
gi|984756              PSYRLPTMSI EEAGLREMKM MEKWQERTAK MIQESNSAWH KDGS-RSAQE  347
gi|29367365            PSYRLPTMSI EEAGLREMKM MEKWQERTAK MIQESNSAWH KDGS-RSAQE  386
CeresClone:325957      PSYRMPTMSI EEAGLREMKM MEKWQERTAE VMKESTSAWH KDGS-SSAQE  384

Consensus              PSYRMPTMSI EEAGLREMKM MEKWQERTAK MI-ESTSAWH KDGS-RSAQE  400
```

| | | | | | | |
|---|---|---|---|---|---|---|
| Lead-CeresClone19116 | DEEDDDEDDE | PVMKARAFDD | WKDDNPRGAG | NKKLTPCG | 405 |
| gi\|8809589 | DEEDDDEDEE | AVMKARAFDD | WKDDNPRGAG | NKKLTPCG | 413 |
| gi\|984756 | DEDAEEE--- | ---KARGWDD | WKDDNPRGAG | NKKLTPCG | 379 |
| gi\|29367365 | DEDAEEE--- | ---KARAWDD | WKDDNPRGAG | NKKLTPCG | 418 |
| CeresClone:325957 | DEDAEEE--- | ---KARAWDD | WKDDNPRGAG | NKKLTPCG | 416 |
| Consensus | DEDAEEE--- | ---KARAWDD | WKDDNPRGAG | NKKLTPCG | 438 |

```
CeresClone:759040       MSNPKGSKML QFVNYRMRVT IQDGRQLVGK FMAFDRHMNL VLGDCEEFRK  50
gi|50934399             MSNPKGSKML QFVNYRMRVT IQDGRQLVGK FMAFDRHMNL VLGDCEEFRK  50
CeresClone:519929       MSMSKSSKML QYINYRMRVT IQDGRQLVGK FMAFDRHMNL VLGDCEEFRK  50
Lead-CeresClone10879    MSMSKSSKML QFINYRMRVT IQDGRQLICK FMAFDRHMNL VLGDCEEFRK  50
CeresClone:1375012      MSMSKSSKML QFINYRMRVT IQDGRQLVGK FMAFDRHMNL VLGDCEEFRK  50
CeresClone:205653       MSMSKSSKML QFINYRMRVT IQDGRQLVGK FMAFDRHMNL VLGDCEEFRK  50
CeresClone:36005        M--------- ---------- ---------- ---------- ----------   1

Consensus               MSMSKSSKML QFINYRMRVT IQDGRQLVGK FMAFDRHMNL VLGDCEEFRK  50

CeresClone:759040       LPPSKSSKTT --GEREERRT LGLLLLRGEE VVSMTVEGPP PPDESRAKAS  98
gi|50934399             LPPSKSSKTT --GEREERRT LGLLLLRGEE VVSMTVEGPP PPDESRAKAA  98
CeresClone:519929       LPPAKGKKPA EGGDREDRRT LGLVLLRGEE VISMTVEGPP PPEESRSKA-  99
Lead-CeresClone10879    LPPAKGNKKT -SEEREERRT LGLVLLRGEE VISMTVEGPP PPEESRAKS-  98
CeresClone:1375012      LPPGKGKKIN --EEREERRT LGLVLLRGEE VISMTVKGPP PPEESRAKA-  97
CeresClone:205653       LPPAKGKKIN --EEREDRRT LGLVLLRGEE VISMTVEGPP PPEESRAKA-  97
CeresClone:36005        ---------- ---------- ---------- -----TVEGPP PPEESRAKA-  16

Consensus               LPPAKG-K-- ---EREERRT LGLVLLRGEE VISMTVEGPP PPEESRAKA- 100

CeresClone:759040       AGVAALSGTG VGRAAGRGVA TGPLLQAQPG LSGPVRGVGG PAPGMMQPQI 148
gi|50934399             GAGAAMAGPG VGRAAGRGVP AGQMLQAQPG LAGPVRGVGG PAPGMMQPQI 148
CeresClone:519929       VGAAALAGPG IGRAAGRGIP XAPVVQAQPG LAGPVRGMGG PAPGMMQPQI 149
Lead-CeresClone10879    GSVTAVAGPG IGRAAGRGVP TGPLVQAQPG LSGPVRGIGG PAPGMMQPQI 148
CeresClone:1375012      GSAAALAGPG VGRAAGRGVP TGPLVQAQPG LSGPVRGVGG PSPGMMQPQI 147
CeresClone:205653       GSAAAVAGPG IGRAAGRGVP TGPLVQAQPG LSGPVRGVGG PAPGMMQPQI 147
CeresClone:36005        GSAAAVAGPG IGRAAGRGVP TGPLVQAQPG LSGPVRGVGG PAPGMMQPQI  66

Consensus               GSAAA-AGPG IGRAAGRGVP TGPLVQAQPG LSGPVRGVGG PAPGMMQPQI 150

CeresClone:759040       SRPPMPNLSA PPVAY----P QVVRPP-PMG MPPMRPG--- ---------GP 182
gi|50934399             SRPPMPNLSA PPVAY----P QVVRPPPGQM PPPMRPP--- ---------QM 183
CeresClone:519929       SRP--PQLNA PPVSYPGGGP PVMRPP-GQM PGQFAPP--- ----PMARGP 189
Lead-CeresClone10879    SRP------- ---------P QIIRPP-GQM PPQ--PP-FA GQG-----GP 173
CeresClone:1375012      SR-------- ---------P PVMRPP-GQM LPP--PPAFG GQGPPMGRGP 177
CeresClone:205653       SRP--PQLSA ---------P PIIRPP-GQM LPP--PP-FG GQGPPMGRGP 182
CeresClone:36005        SRP--PQLSA ---------P PIIRPP-GQM LPP--PP-FG GQGPPMGRGP 101

Consensus               SRP--P-LSA ---------P PVIRPP-GQM LPP--PP-F- GQG-PM-RGP 200
```

```
CeresClone:759040        PPMQMQFQRP -----PGPP- ---PAPYP-- CAP---PQ-- -QFMRGPPPM   215
gi|50934399              PLPF---QRP -----PGVP- ---PA-FP-- GGP---PPPP GPFMRGPPPM   215
CeresClone:519929        PPPMPPGQFA PQRPGGPPPQ FQVPPQFG-- QRP-MGPPPP GQMVRGPP--   234
Lead-CeresClone10879     PPPY--GMRP ---PYPGPP- ---PPQYGGQ QRPMM PPPG G-MMRGPP--   211
CeresClone:1375012       PPPAYGGMRP ---QFGGPP- ---PP-YG-- QRP-MGPPPG GMMMRGPP--   214
CeresClone:205653        PPPY--GMRP PPQQFSGPP- ---PPQYG-- QRP-M PPPG G-MMRGPP--   220
CeresClone:36005         PPPY--GMRP PPQQFSGPP- ---PPQYG-- QRP-M PPPG G-MMRGPP--   139

Consensus                PPPY--GMRP ----f-GPP- ---PPQYG-- QRP-M-PPPG G-MMRGPP--   250

CeresClone:759040        GPPPGRPGMP SMPPPPGMRP -MPPTQF-G- ---QPPRHGM PPPPPGPQQP   259
gi|50934399              GPPQVRPGMP G-GPPPGMRP GMPPPPF--- ------RPGM PPPPPGPQQP   255
CeresClone:519929        APPR--PGMP A-PPPP--RP GMPPPPGSGV PVFGPPRPGM PPPPN----P   275
Lead-CeresClone10879     -PP---HGMQ G-PPPS--RP GI-PPPG-GA PMFAPPHPGM PPAPP----N   248
CeresClone:1375012       -PPP--HGMQ G-PPPP--R- ---PPPG-G- --FA-PRPGM QGPPP----P   245
CeresClone:205653        -PPL--HGMQ G-PPPP--RP GMPPAPG-G- --FAPPRPGM PP--------   252
CeresClone:36005         -PPP--HGMQ G-PPPP--RP GMPPAPG-G- --FAPPRPGM PP--------   171

Consensus                -PP---HGMQ G-PPPP--RP GMPPPPG-G- --FAPPRPGM PPPPP----P   300

CeresClone:759040        GQNPQQ   265
gi|50934399              GQNPPQ   261
CeresClone:519929        PNQQQQ   281
Lead-CeresClone10879     HHNQQH   254
CeresClone:1375012       QHNQQQ   251
CeresClone:205653        -HNQQQ   257
CeresClone:36005         -HNQQQ   176

Consensus                -HNQQQ   306
```

```
Lead-CeresClone8916   MSLNILAANA KHKVWLKPTS EMSFLYGNHV LKGGLGRITD SIVPGDGVVV  50
CeresClone:945362     MSLNLLAANA KHKVWLKPTS EMSFLYGNHV LKGGLGRITD SIVPGDGVVV  50

Consensus             MSLN-LAANA KHKVWLKPTS EMSFLYGNHV LKGGLGRITD SIVPGDGVVV  50

Lead-CeresClone8916   FSMSDVPLGF GIAAKSTQDC RKLDPNGIVV LHQADIGEYL RGEDDL      96
CeresClone:945362     FSMSDVPLGF GIAAKSTQDC RKLDPNGIVV LHQADIGEYX RDEDXL      96

Consensus             FSMSDVPLGF GIAAKSTQDC RKLDPNGIVV LHQADIGEYL R-EDDL      96
```

```
gi|45477162           ---------- ---------- ------MASD GVVTVY-G-- DGAITDT---  18
CeresClone:575584     IPHAPPLFRR LPSLFSSLPL AAEKMASDGS GVVTVYGSGN NGAGTQLEP-  49
gi|31429734           ---------- ---------- ----MASDGT DVVALY-GGA NGLSH-----  20
gi|50933621           ---------- ---------- ----MATDGT GVVTVYGSGT NGAALLEPSN  26
CeresClone:1278155    ---------- ---------- ----MASDGS GVVTVYGS-- NGAELLEPSK  24
CeresClone:1371669    ---------- ---------- ----MASDGS GVVTVYGN-- NGAALLEPPK  24
gi|17104657           ---------- ---------- ------MAGT GVVAVY-G-- EGAMTETK--  19
Lead-CeresClone8877   ---------- ---------- ------MEGT GVVAVY-G-- NGAITEA---  18
gi|2501578            ---------- ---------- ------MAGT GVVAVY-G-- NGAITET---  18
gi|46399271           ---------- ---------- ------MAGS GVVTLY-G-- NGALTETT--  19
CeresClone:707209     ---------- ---------- ----MEGSGS GVVTVY-G-- NGAITET---  20
gi|45477167           ---------- ---------- ----MEGEGS RVVALYDG-- NGAITE-T--  21

Consensus             ---------- ---------- ----M--DGT GVVTVY-G-- NGAITE----  50

gi|45477162           --KVSSYAVK VGLAQMLRGG VIMDVVNAEQ ARIAEEAGAT AVMALERVPA  66
CeresClone:575584     --KSSPFSVK VGLAQMLRGG VIMDVVNAEQ ARIAEEAGAC AVMALERVPA  97
gi|31429734           --KSGSFSVK VGLAQMLRGG VIMDVVTPEQ ARIAEEAGAC AVMALERVPA  68
gi|50933621           H-KSATFSVK VGLAQMLRGG VIMDVVTPEQ ARIAEEAGAC AVMALERVPA  75
CeresClone:1278155    QPKSATFSVK VGLAQMLRGG VIMDVVTPEQ ARLAEEAGAC AVMALERVPA  74
CeresClone:1371669    QPKSSTFSVK VGLAQMLRGG VIMDVVTPEQ ARLAEEAGAC AVMALERVPA  74
gi|17104657           --QKSPFSVK VGLAQMLRGG VIMDVVNAEQ ARIAEEAGAC AVMALERVPA  67
Lead-CeresClone8877   --KKSPFSVK VGLAQMLRGG VIMDVVNAEQ ARIAEEAGAC AVMALERVPA  66
gi|2501578            --KKSPFSVK VGLAQMLRGG VIMDVVNPEQ ARIAEEAGAC AVMALERVPA  66
gi|46399271           --KQSPFSVK VGLAQMLRGG VIMDVVNAEQ ARIAEEAGAC AVMALERVPA  67
CeresClone:707209     --KKSPFSVK VGLAQMLRGG VIMDVVNAEQ TRIAEEAGAC AVMALERVPA  68
gi|45477167           --KKSPFSVK VGLAQMLRGG VIMDVVNADQ ARIAEEAGAC AVMALERVPA  69

Consensus             --KKSPFSVK VGLAQMLRGG VIMDVVNAEQ ARIAEEAGAC AVMALERVPA  100
```

| | | | | | | |
|---|---|---|---|---|---|---|
| gi\|45477162 | DI RAQGGVAR | MSDPGLI KEI | KSAVTI PVMA | KARI GHFVEA | QI LEAI GI DY | 116 |
| CeresClone:575584 | DI RAQGGVAR | MSDPGLI REI | KRAVTI PVMA | KARI GHFVEA | QI LESI GVDY | 147 |
| gi\|31429734 | DI RAQGGVAR | MSDPGLI RDI | KRSVTI PVMA | KARI GHLVEA | QI LEAI GVDY | 118 |
| gi\|50933621 | DI RAQGGVAR | MSDPGLI RDI | KRAVTI PVMA | KARI GHFVEA | QI LEAI GVDY | 125 |
| CeresClone:1278155 | DI RAQGGVAR | MSDPGLI RDI | KRAVTI PVMA | KARI GHFVEA | QI LEAVGVDY | 124 |
| CeresClone:1371669 | DI RAQGGVAR | MSDPGLI RDI | KRAVTI PVMA | KARI GHFVEA | QI LEAVGVDY | 124 |
| gi\|17104657 | DI RAQGGVAR | MSDPEMI KEI | KNAVTI PVMA | KARI GHFVEA | QI LEAI GVDY | 117 |
| Lead-CeresClone8877 | DI RAQGGVAR | MSDPQMI KEI | KQAVTI PVMA | KARI GHFVEA | QI LEAI GI DY | 116 |
| gi\|2501578 | DI RAQGGVAR | MSDPQLI KEI | KQSVTI PVMA | KARI GHFVEA | QI LEAI GI DY | 116 |
| gi\|46399271 | DI RAQGGVAR | MSDPQLI KEI | KQAVTI PVMA | KARI GHFVEA | QI LEAI GI DY | 117 |
| CeresClone:707209 | DI RAQGGVAR | MSDPQLI KDI | KRAVTI PVMA | KARI GHFVEA | QI LEAI GI DY | 118 |
| gi\|45477167 | DI RAQGGVAR | MSDPQLI KEI | KRAVTI PVMA | KARI GHFVEA | QI LEAI GI DY | 119 |
| Consensus | DI RAQGGVAR | MSDP-LI KEI | KRAVTI PVMA | KARI GHFVEA | QI LEAI G-DY | 150 |

| | | | | | | |
|---|---|---|---|---|---|---|
| gi\|45477162 | I DESEVLTPA | DDXHHI NKHN | FRI PFVCGCR | NLGEALRRI A | EGAAMI RTKG | 166 |
| CeresClone:575584 | VDESEVLTLX | DDAHHI NKHX | FRVPFVCGCR | NLGEALRRI R | EGAAMI RTKG | 197 |
| gi\|31429734 | VDESEVLTLA | DDAHHI NKNN | FRVPFVCGCR | DLGEALRRI R | EGAAMI RTKG | 168 |
| gi\|50933621 | VDESEVLTLA | DDAHHI NKHN | FRVPFVCGCR | DLGEALRRI R | EGAAMI RTKG | 175 |
| CeresClone:1278155 | VDESEVLTPA | DDAHHI NKHN | FRVPFVCGCR | DLGEALRRVR | EGAAMI RTKG | 174 |
| CeresClone:1371669 | VDESEVLTPA | DDAHHI NKHN | FRVPFVCGCR | DLGEALRRVR | EGAAMI RTKG | 174 |
| gi\|17104657 | VDESEVLTLA | DEDNHI NKHN | FKI PFVCGCR | NLGEALRRI R | EGAAMI RTKG | 167 |
| Lead-CeresClone8877 | I DESEVLTLA | DEDHHI NKHN | FRI PFVCGCR | NLGEALRRI R | EGAAMI RTKG | 166 |
| gi\|2501578 | VDESEVLTPA | DEENHI NKHN | FRI PFVCGCR | NLGEALRRI R | EGAAMI RTKG | 166 |
| gi\|46399271 | VDESEVLTLA | DDENHI NKHN | FRI PFVCGCR | NLGEALRRI R | EGAAMI RTKG | 167 |
| CeresClone:707209 | VDESEVLTLA | DDANHI NKHN | FRI PFVCGCR | NLGEALRRLR | EGAAMI RTKG | 168 |
| gi\|45477167 | VDESEVLTLA | DDANHI NKHN | FRI PFVCGCR | NLGEALRRI R | EGAAMI RTKG | 169 |
| Consensus | VDESEVLTLA | DDAHHI NKHN | FRI PFVCGCR | NLGEALRRI R | EGAAMI RTKG | 200 |

```
gi|45477162              EAGTGNVI EA VRHVRSVLGD I RKLQSLDDD EVFAFAKQI A APYELVRQTK 216
CeresClone:575584        EAGTGNVI EA VRHVRSVMGD VRALRSMDDD EVFTYAKSI A APYDLVMQTK 247
gi|31429734              EAGTGNVVEA VRHVRSVMGD I RALRSMDDD EVFSYAKRI A APYDLVMQTK 218
gi|50933621              EAGTGNVVEA VRHVRSVMGD I RALRNMDDD EVFSYAKRI A APYDLVMQTK 225
CeresClone:1278155       EAGTGNVVEA VRHVRSVMGD VRALRSMDDD EVFAYAKRI A APYDLVMQTK 224
CeresClone:1371669       EAGTGNVVEA VRHVRSVAGA VRALRGMDDD EVFAYAKRI A APYDLVMQTK 224
gi|17104657              EAGTGNVVEA VRHVRSVNGA I RLLRSMDDD EVFTYAKKI A APYDLVVQTK 217
Lead-CeresClone8877      EAGTGNI I EA VRHVRSVNGD I RVLRNMDDD EVFTFAKKLA APYDLVMQTK 216
gi|2501578               EAGTGNVI EA VRHVRSVMGD I RLLRNMDDD EVFTFAKKI A APYDLVMQTK 216
gi|46399271              EAGTGNI I EA VRHVRSVMGD I RVLRNMDDD EVFTFAKKLQ APYDLVMQTK 217
CeresClone:707209        EAGTGNI I EA VRHVRSVMSD I RVLRNMDDD EVFTFAKSI A APYDLVMQTK 218
gi|45477167              EAGTGNI I EA VRHVRSVMSD I RVLRNMDDD EVFTFAKSI A APYDLVMQTK 219

Consensus                EAGTGNVI EA VRHVRSVMGD I RVLRNMDDD EVFT-AK-I A APYDLVMQTK 250

gi|45477162              QLGRLPVVNF AAGGVATPAD AALMMQLGCD GVFVGSGVFK SGDPARRARA 266
CeresClone:575584        QLGRLPVVQF AAGGVATPAD AALMMQLGCD GVFVGSGVFK SGDPARRARA 297
gi|31429734              QLGRLPVVQF AAGGVATPAD AALMMQLGCD GVFVGSGI FK SGDPALRARA 268
gi|50933621              QLGRLPVVQF AAGGVATPAD AALMMQLGCD GVFVGSGI FK SGDPARRARA 275
CeresClone:1278155       QLGRLPVVQF AAGGVATPAD AALMMQLGCD GVFVGSGI FK SGDPARRARA 274
CeresClone:1371669       QLGRLPVVQF AAGGVATPAD AALMMQLGCD GVFVGSGI FK SGDPARRARA 274
gi|17104657              ELGRLPVVQF AAGGVATPAD AALMMQLGCD GVFVGSGVFK SGDPVKRAKA 267
Lead-CeresClone8877      QLGRLPVVQS AAGGVATPAD AALMMQLGCD GVFVGSGI FK SGDPARRARA 266
gi|2501578               QLGRLPVVQF AAGGVATPAD AALMMQLGCD GVFVGSGVFK SGDPARRARA 266
gi|46399271              QLGRLPVVHF AAGGVATPAD AALMMQLGCD GVFVGSGI FK SGDPAKRGRA 267
CeresClone:707209        QLGRLPVVHF AAGGVATPAD AALMMQLGCD GVFVGSGVFK SGDPAKRARA 268
gi|45477167              QLGRLPVVHF AAGGVATPAD AALMMQLGCD GVFVGSGVFK SGDPAKRARA 269

Consensus                QLGRLPVVQF AAGGVATPAD AALMMQLGCD GVFVGSG-FK SGDPARRARA 300
```

```
gi|45477162            I VQAVTHYND PHI LAEVSCS LGEAMVGI NL KDEK--VERY AERSE   309
CeresClone:575584      I VQAVTHYSD PNVLAEVSCD  LGEAMVGI NL SDPK--VERF AARSE   340
gi|31429734            I VQAVTHYSD PKI LAEVSSG LGEAMVGI NL SDPK HVERF AARSD   313
gi|50933621            I VQAVTHYSD PKI LAEVSSG LGEAMVGI NL SDPK--VERF AARSE   318
CeresClone:1278155     I VQAVTHYSD PTI LADVSTG LGEAMVGI NL NDPK--VERY AARSE   317
CeresClone:1371669     I VQAVTHYSD PTI LTDVSAG LGEAMVGI NL NDPK--VERY AARSE   317
gi|17104657            I VQAVTNYRD AAVLAEVSCG  LGEAMVGL NL -DDK--VERF ASRSE   309
Leod-CeresClone8877    I VQAVTHYSD PEMLVEVSCG  LGEAMVGI NL NDEK--VERF ANRSE   309
gi|2501578             I VQAVTHYSD PDMLAEVSCG  LGEAMVGI NL NDKK--VERF ANRSE   309
gi|46399271            I VQAVTHYSD PGLLAEI SCG LGEAMVGI NL -DDK--VERY ANRSE   309
CeresClone:707209      I VQAVTHYSD PEVLAEVSCG  LGEAMVGI NL TDDK--VERF ANRSE   311
gi|45477167            I VQAVTHYSD PEI LAEVSCG LGEAMVGI NL SDTN--VERF ANRSE   312

Consensus              I VQAVTHYSD PEI LAEVSCG LGEAMVGI NL -D-K--VERF A-RSE   345
```

/tmp/Lead-CeresClone8254.aln

```
CeresClone:219727      TSAVVASFPA PPRTIIPFVF PSTPSLPHPK AMAALSWIRL RPPRAAILIL   50
gi|50931507            ---------- ---------- ---------- ----MATASS RPPRAALLVL   16
Lead-CeresClone8254    ---------- ---------- ---------- ------MNRL FSLFSLALIA   14
CeresClone:635423      ---------- ---------- ---------- --------MG NPSLSSLLLV   12

Consensus              ---------- ---------- ---------- --------RL RPPR-A-LIL   50

CeresClone:219727      LLLALHISPS FAAN-----F EGFDSDDLPV A---AGGLDA DDDEGLDGVY   92
gi|50931507            LLLALSFSLL LAAH-----F EGFGSDDLHS AHADAASADD EDDEGLD-VE   60
Lead-CeresClone8254    FLCLHHHVLA SSSSD----F EGFDAED--- ---------- -DDVSEDSTE   46
CeresClone:635423      LLCI SLILA LAQADSDSHF EGFEAED--- ---------- -DDDDLEDSS   48

Consensus              LL--L---LA LAA-D----F EGFD--DL-- A---A---D- -DDEGLD--E  100

CeresClone:219727      LPPPPPISLS TSAPSPPVTT T------PAP NPNP-AIPTP RDPTPA----  131
gi|50931507            LPPPPRISLS TSTPSPPVTT TTTTTSAPNP NPDPNPTLTP PNPTPT----  106
Lead-CeresClone8254    LH-------- HSLRPPLLTQ SESTVLDLDP SPDSDSIPAS KSDPPTQTVK   88
CeresClone:635423      LHP------- ASLRSPPLS- --------DP TPTPQPPPSD LPKFPP----   78

Consensus              L-PPP-ISLS TSL-SPP-TT T--T---PDP NPDP--TPTP --PTPT----  150

CeresClone:219727      ------LDLW DEDEFEGIPV PEALPSDDSA APAEVDPSDP STEAPVEVAP  175
gi|50931507            ------LDLW DEDEFEGIPV PEAASSDESS TPAEAAPSDP AADAAAEAAP  150
Lead-CeresClone8254    PSSSISFDYW DEDEFEGLPE DEKSIESPVF SDDASSPADP QTPDLESASE  138
CeresClone:635423      ------FDFW DDDEFEGVPV EHSSPE---- -----PPSDP KSPENATTTQ  113

Consensus              -------D-W DEDEFEGIPV -EAS--D-S- -PAE--PSDP -T---A-AA-  200

CeresClone:219727      AAKRSPAELL RAFSFEIACA SFLVCYVLNY FTGKRQNENI ALAWATKFAT  225
gi|50931507            APPRRPAELL RAYTVEIACV SFLICFLLNY FTGKRQNEA  ALAWATRFAT  200
Lead-CeresClone8254    TPDTDLPKKM QSYTVEIVCV SILIGYAINY FTGKRENENL ALAWASKFGL  188
CeresClone:635423      TPPT--PNPP RSFSVEI CG SFLIMFAINY FSGKRENENI ALSWAAQFAA  161

Consensus              -PP--P-ELL R---VEI-CV SFLIC---NY FTGKR-NENI ALAWATKFAT  250
```

```
CeresClone:219727      RDSIFDKNFS LLGTGDG--- KDTPLLLKEG QDVFKFYASG RRFCQGLLAT   272
gi|50931507            RDSIFDKNFS LLGTGDG--- KDTPLLMKEG QDVFKFYASG RRYCQGMLAT   247
Lead-CeresClone8254    KDTIFEKNFS LLGVGEG--- EDSPLLLKEA TNVFKFYASG RRYCHGLLAT   235
CeresClone:635423      KDSIFEKNFS LLGIGDGVDE EEAPLLLKEG QTTFKFYASG RRYCQGLLAT   211

Consensus              -DSIF-KNFS LLG-GDG--- -DTPLLLKEG QDVFKFYASG RRYCQGLLAT   300

CeresClone:219727      MEMRARYDLL SKFVELVFPR KDTITFEVVM NEEAMDHVVL AVARKKAAKT   322
gi|50931507            MEMRARHDLL SKLVELVFPR KDTITFEVVM NEEAMDHVML AVARKKAAKT   297
Lead-CeresClone8254    LELKSRHDLI SRLFNSVVPC KDEISFEVYM NDEAMDHIVF AMARKKAAKT   285
CeresClone:635423      LELKSRHDLI ARIYNMIVPC RDEIAFEVYM NDDAMDHVVF AMAKKKVAKA   261

Consensus              -E---RHDL- S-L--LV-P- KD-ITFEV-M N-EAMDHVV- A-ARKKAAKT   350

CeresClone:219727      MHKEERDLQR FASVLTSAPA -----GRKWV SDELAVVAES KEVAGDMITE   367
gi|50931507            MQKEERDLQK FAGVLTSAPA -----GRRWV ADELAVVAES KEVAGDMITE   342
Lead-CeresClone8254    MHKELGDLQR FCGMVPSPG- -----GRKWV TEELAVVSES KEVAGDMITD   329
CeresClone:635423      MHKDVTDLQR FGTLLSAPSA TATATARKWV ADDLAVISES KEVANDLITD   311

Consensus              MHKE-RDLQR F--VLTS-PA -----GRKWV ADELAVV-ES KEVAGDMIT-   400

CeresClone:219727      AVLDQVLGEK ACEKFGKWFI SLHFSDQLAG SYKKVLIFKF VLPDASNMSE   417
gi|50931507            AVLDQVLGDK AFEKFGKWFI SLHFSDQLAG SYKKVLSFKF VLPDASNMAE   392
Lead-CeresClone8254    VVLDQVFGDK SFEKFGKYFI SMHFSDQHPG KHRKMLLFKF ALPDKHMDD    379
CeresClone:635423      AVIDQVFGEK AFEKFGKGLI SLHFSDQHPG IHKKILLFKF VLPAAKDMAD   361

Consensus              AVLDQV-G-K AFEKFGKWFI SLHFSDQ--G S-KKVL-FKF VLPDA-NMA-   450

CeresClone:219727      MTRLVSLVPY YIDLVGRYKL SSHARSKTDG ARTKAAQEAF RELQSARQEA   467
gi|50931507            MTRLVALVPY YIDLVGRYKL SNHARSKTEA ARTKASQEAF REQQGLRQEA   442
Lead-CeresClone8254    MVRLIALIPY YIDLIGRYKL SSQARNKTDG ARQKAAQEAY KELENVRQEA   429
CeresClone:635423      MTRLVALVPY YIDLIGRYKL SSQARSKTEA ARQKAALEAQ KELRNAQQEA   411

Consensus              MTRLVALVPY YIDL-GRYKL SS-ARSKT-- AR-KAAQEAF -ELQN-RQEA   500
```

| | | | | | | |
|---|---|---|---|---|---|---|
| CeresClone:219727 | LQRKKAEKKK | LMEETDAKLS | AEALRRKDEK | ERARQMKKSG | PKVKMLRS- | 515 |
| gi\|50931507 | LQRKKAEKKK | LMEEAEAKLS | AEALRKKEEK | ERARQMKKSM | PKVKMLRS- | 490 |
| Lead-CeresClone8254 | LQRKKAEKKK | ILEEAQAKLS | SEALRKKEAK | ERARQMKKSM | PKVKMSRGH | 478 |
| CeresClone:635423 | MQRRKAERKK | MVEEAEAKLS | AESVRKKEAK | ERARQMKKAM | PRMKMSRGA | 460 |
| Consensus | LQRKKAEKKK | LMEEAEAKLS | AEALRKKE-K | ERARQMKKSM | PKVKM-R-- | 549 |

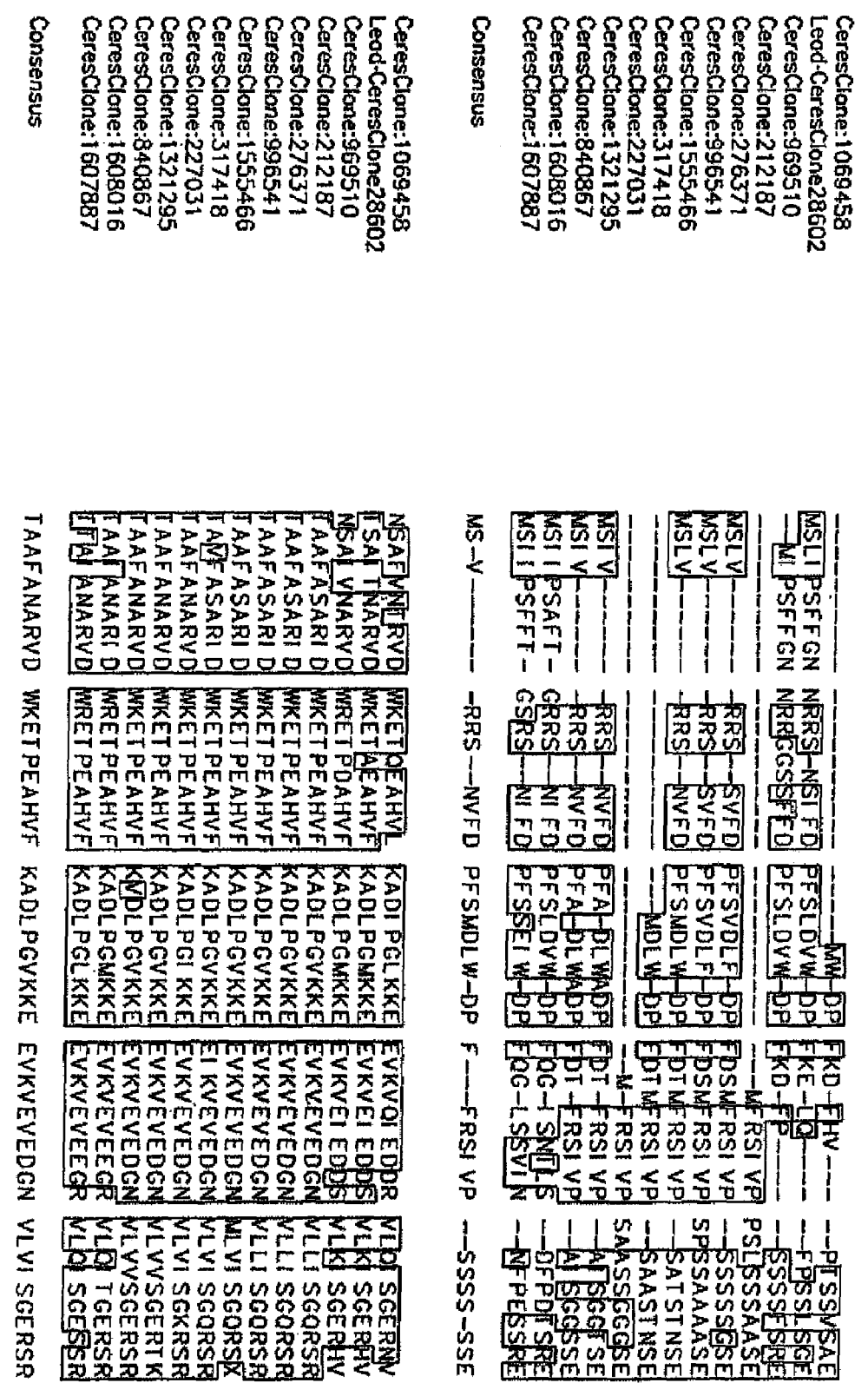

```
CeresClone:1069458      ---------- ---------- -----MW-DP FKD-FHV--- --PTSSVSAE  18
Lead-CeresClone28602    MSLIPSFFGN NRRS-NSIFD PFSLDVW-DP FKE-LQ---- --FPSSLSGE  41
CeresClone:969510       --MIPSFFGN NRRGGSSFFD PFSLDVW-DP FKD-FP---- --SSSSFSRE  40
CeresClone:212187       ---------- ---------- ---------- ---MFRSIVP PSLSSSAASE  17
CeresClone:276371       MSLV------ -RRS--SVFD PFSVDLF-DP FDSMFRSIVP --SSSSSGSE  38
CeresClone:996541       MSLV------ -RRS--SVFD PFSVDLF-DP FDSMFRSIVP SPSSAAAASE  40
CeresClone:1555466      MSLV------ -RRS--NVFD PFSMDLW-DP FDTMFRSIVP --SATSTNSE  38
CeresClone:317418       ---------- ---------- ---MDLW-DP FDTMFRSIVP --SAASTNSE  24
CeresClone:227031       ---------- ---------- ---------- --M-FRSIVP SAASSGGGSE  17
CeresClone:1321295      MSIV------ -RRS--NVFD PFA-DLWADP FDT-FRSIVP --AISGGTSE  37
CeresClone:840867       MSIV------ -RRS--NVFD PFA-DLWADP FDT-FRSIVP --AISGGSSE  37
CeresClone:1608016      MSIIPSAFT- GRRS--NIFD PFSLDVW-DP FQG-ISNILS --DFPDTSRE  43
CeresClone:1607887      MSIIPSFFT- GSRS--NIFD PFSSEIW-DP FQG-LSSVIN --NFPESSRE  43

Consensus               MS-V------ -RRS--NVFD PFSMDLW-DP F---FRSIVP --SSSS-SSE  50

CeresClone:1069458      NSAFVNTRVD WKETQEAHVL KADIPGLKKE EVKVQIEDDR VLQISGERNV  68
Lead-CeresClone28602    TSAITNARVD WKETAEAHVF KADLPGMKKE EVKVEIEDDS VLKISGERHV  91
CeresClone:969510       NSALVNARVD WRETPDAHVF KADLPGMKKE EVKVEIEDDS VLKISGERHV  90
CeresClone:212187       TAAFASARID WKETPEAHVF KADLPGVKKE EVKVEVEDGN VLLISGQRSR  67
CeresClone:276371       TAAFASARID WKETPEAHVF KADLPGVKKE EVKVEVEDGN VLLISGQRSR  88
CeresClone:996541       TAAFASARID WKETPEAHVF KADLPGVKKE EVKVEVEDGN VLLISGQRSR  90
CeresClone:1555466      TAAFASARID WKETPEAHVF KADLPGVKKE EVKVEVEDGN MLVISGQRSK  88
CeresClone:317418       TAVFASARID WKETPEAHVF KADLPGVKKE EIKVEVEDGN VLVISGQRSR  74
CeresClone:227031       TAAFANARVD WKETPEAHVF KADLPGIKKE EVKVEVEDGN VLVISGKRSR  67
CeresClone:1321295      TAAFANARVD WKETPEAHVF KADLPGVKKE EVKVEVEDGN VLVVSGERTK  87
CeresClone:840867       TAAFANARVD WKETPEAHVF KVDLPGVKKE EVKVEVEDGN VLVVSGERSR  87
CeresClone:1608016      TAAIANARID WRETPEAHVF KADLPGMKKE EVKVEVEEGR VLQITGERSR  93
CeresClone:1607887      TFAIANARVD WRETPEAHVF KADLPGLKKE EVKVEVEEGR VLQISGESSR  93

Consensus               TAAFANARVD WKETPEAHVF KADLPGVKKE EVKVEVEDGN VLVISGERSR  100
```

| | | | | | | |
|---|---|---|---|---|---|---|
| CeresClone:1069458 | EKEDKNDTWH | RVDRSSGKFM | RRFRLPENAK | VEQVKACMEN | GVLTVTIPKE | 118 |
| Lead-CeresClone28602 | EKEEKQDTWH | RVERSSGQFS | RKFKLPENVK | MDQVKASMEN | GVLTVTVPKV | 141 |
| CeresClone:969510 | EKEDKNDTWH | RVERSSGQFT | RKFRLPENVK | MDQVKAAMEN | GVLTVTVPKA | 140 |
| CeresClone:212187 | EKEDKGDKWH | RVERSSGQFV | RRFRLPENAK | TEEVRAALEN | GVLTVTVPKA | 117 |
| CeresClone:276371 | EKEDKGDKWH | RVERSSGQFV | RRFRLPENAK | TEEVRAALEN | GVLTVTVPKA | 138 |
| CeresClone:996541 | EKEDKGDKWH | RVERSSGQFV | RRFRLPENAK | TEEVRAALEN | GVLTVTVPKA | 140 |
| CeresClone:1555466 | EKEDKDDKWH | RVERSXGQFV | RRFRLPENXK | VDQXKAGXEX | GVLTVTVPKA | 138 |
| CeresClone:317418 | EKEDKDDKWH | RVERSSGQFV | RRFRLPENAK | VDQVKAGLEN | GVLTVTVPKA | 124 |
| CeresClone:227031 | EEEDKNDKWH | RVERSSGQFM | RRFRLPENAK | VDEVKAGLEN | GVLTVTVPKT | 117 |
| CeresClone:1321295 | EKEDKNDKWH | RVERSSGKFV | RRFRLPEDAK | VEEVKAGLEN | GVLTVTVPKA | 137 |
| CeresClone:840867 | EKEDKNDKWH | RVERSSGKFV | RRFRLPEDAK | VEEVKAGLEN | GVLTVTVPKA | 137 |
| CeresClone:1608016 | EHEEKNDTWH | RVERSSGKFF | RRFXLPENAK | MEHVKASMGD | GVLTVTVPKE | 143 |
| CeresClone:1607887 | ENEEKNDKWH | RVERSSGRFM | RRFRLPENAK | MDQVKAAMEN | GVLTVTVPKA | 143 |
| Consensus | EKEDKNDKWH | RVERSSGQFV | RRFRLPENAK | VD-VKAAMEN | GVLTVTVPKA | 150 |

| | | | |
|---|---|---|---|
| CeresClone:1069458 | EV--KKSDVK | PI EI SG | 132 |
| Lead-CeresClone28602 | EEAKKKAQVK | SI DI SG | 157 |
| CeresClone:969510 | EM--KKPDVK | SI QI SG | 154 |
| CeresClone:212187 | EV--KKPEVK | SI QI SV | 131 |
| CeresClone:276371 | EV--KKPEVK | SI QI SG | 152 |
| CeresClone:996541 | EV--KKPEVK | SI QI SG | 154 |
| CeresClone:1555466 | EE--KKPEVK | AI EXSG | 152 |
| CeresClone:317418 | EE--KKPEVK | AI EI SG | 138 |
| CeresClone:227031 | EV--KKPEVK | AI EI SG | 131 |
| CeresClone:1321295 | EV--KKPEVK | AI EI SG | 151 |
| CeresClone:840867 | EV--KKPEVK | AI EI SG | 151 |
| CeresClone:1608016 | EE--KKPAVK | AI DI SG | 157 |
| CeresClone:1607887 | EV--KNPAVK | AI DI SG | 157 |
| Consensus | EV--KKPEVK | AI EI SG | 166 |

```
gi|50916178            --MR---VLV HSAESPATP- -AAASIDSD  MVVILASLLC ALICVAGLAL   43
CeresClone:1509889     -MAR---ILL EAAAGSGPP- ---TDSINSD MILILAGLLC ALVCVLGLGL   42
CeresClone:1369486     MAAR---RLL EEAVAAG--- -AQQDSLNSD LVLILAGLLC ALVCVLGLGL   43
CeresClone:476765      -MTRGL-RLL QSAAAPPPE- -AVAAAVESD FVVILAALLC ALICVVGLVA   46
CeresClone:1120324     -MTRAL-RYL GERNSS---- -TDSAVVDSD FVVILAALLC ALICVLGLVA   43
Lead-CeresClone27464   -MARLLFRLL QEANSTSPA- -EASPPFNSD LVLILAVLLC ALTCIIGLIA   47
gi|15027985            -MARLLFRLL VESNTPSPAI DNSTAALNSD LVVILAALLC ALICVLGLIA   49
CeresClone:957229      -MARLLFRLL QEFNSPTPA- -TPSPALYSD LVVVIAALLC ALICVLGLLA   47

Consensus              -MAR-L-RLL QEANS-SP-- ---S--INSD LVVILAALLC ALICVLGL-A   50

gi|50916178            VARCACRRRG AAT----TTT TTTTTPAATS PAPKGLKKKA TDALPTVSFA   89
CeresClone:1509889     VARCACSWRW A------AAS RSQPAADATK AANRGVKKEV LRSLPTVTYV   86
CeresClone:1369486     VARCACSRHW A--------- -RAADAPP-- GANRGVKKEV LRALPTVRYV   81
CeresClone:476765      IARCAWLRRG T------AGS SAAGAVSSPA TANKGLKKKV VNSLPKFTYA   90
CeresClone:1120324     VARCGCLRRL R------LSS SATTPQSPTS AANKGVKKKV LRSLPKLTAT   87
Lead-CeresClone27464   VSRCAWLRRI AS-----RNR SDQTHPPPVA AANKGLKKKV LRSLPKLTYS   92
gi|15027985            VSRCVWLRRL AAGNRTVSGS QTQSPQPPVA AANKGLKKKV LQSLPKLTFS   99
CeresClone:957229      VSRCVWLRRI A------NRS ATNSDQPP-- -ANKGLKKKV LKSLPKLTYS   88

Consensus              VARCA-LRR- A--------S S-----PP-A AANKGLKKKV LRSLPKLTYA  100

gi|50916178            LKQ--QQQQA ---ECAICLA EFAGGEELRL LPHCGHAFHV SCIDTWLGTH  134
CeresClone:1509889     PDSGKAKAAA GADECAICLA EFEEGQAMRV LPQCGHAFHA ACVDTWLRAH  136
CeresClone:1369486     ADGGEASESD ---ECAICLA EFEDGQDMRV LPQCSHAFHT ACVDAWLRSH  128
CeresClone:476765      DDG-DRRKWS ---ECAICLT EFGAGDEVRV LPQCGHGFHV ACVDTWLASH  136
CeresClone:1120324     AES--AVKFA ---DCAICLT EFAAGDEIRV LPQCGHGFHV SCIDAWLRSH  132
Lead-CeresClone27464   PDSPPAEKLV ---ECAICLT EFAAGDELRV LPQCGHGFHV SCIDTWLGSH  139
gi|15027985            PESPESEKFA ---ECAICLA EFSAGDELRV LPQCGHGFHV ACIDTWLGSH  146
CeresClone:957229      PDSPPAEKFA ---ECAICLM EFAAGDELRV LSQCGHGFHV SCIDTWLGSH  135

Consensus              PDS-EA-KFA ---ECAICLA EFAAGDELRV LPQCGHGFHV -CIDTWLGSH  150
```

| | | | | | | |
|---|---|---|---|---|---|---|
| gi\|50916178 | ATCPSCRATV | GTSTLFLPLP | GRCRRCGEVD | LPTLHDFST- | ---ATATAHH | 180 |
| CeresClone:1509889 | SSCPSCRRVL | AAPAD-LPPG | EPCRRCG--A | RPGFRALWK- | ---APAPCSA | 179 |
| CeresClone:1369486 | SSCPSCRRVL | VAEL---PRG | ERSGRCG--A | RPG------- | ----GLDALL | 162 |
| CeresClone:476765 | SSCPSCRAPF | AVVA------ | -RCQKCG--H | FPAVASASA- | ---ASESKAV | 173 |
| CeresClone:1120324 | SSCPSCRQIL | V-VS------ | -RCDKCG--G | IPAPASSSSD | PPPPDSEARF | 172 |
| Lead-CeresClone27464 | SSCPSCRQIL | V-VT------ | -RCHKCG--G | LPG-SSSSG- | ---PEPDTRI | 174 |
| gi\|15027985 | SSCPSCRQIL | V-VA------ | -RCHKCG--G | LPG-SSSSGL | ESEPEIEIRI | 185 |
| CeresClone:957229 | SSCPSCRQIL | VGIA------ | -RCQKCG--G | LPG-SSSSG- | ---PEPDTRI | 171 |
| Consensus | SSCPSCRQVL | V-VA------ | -RC-KCG--G | LPG-SSSS-- | ---PE-D-RI | 200 |

| | | | | |
|---|---|---|---|---|
| gi\|50916178 | NTPP------ | ---------- | ---------- | 184 |
| CeresClone:1509889 | EGPT------ | ---------- | -------FLA | 186 |
| CeresClone:1369486 | KAVP------ | ---------- | -------LCR | 169 |
| CeresClone:476765 | GCDNAAVSAA | NANRNNVIIT | NGFSNYGFLP | 203 |
| CeresClone:1120324 | KGRE-----D | DANR------ | -------FLP | 184 |
| Lead-CeresClone27464 | KQRE-----D | GPDN------ | -------FLP | 186 |
| gi\|15027985 | KQGE-----D | DPNS------ | -------FLP | 197 |
| CeresClone:957229 | KQDDPNSNNN | DNXS------ | -------XLN | 188 |
| Consensus | K--------D | D-N------- | -------FLP | 230 |

```
CeresClone:1609975      MSWQAYVDDH LMCEIEGNHL TAAAIIGHDG SVWAQSSNFP QVKPEEITAI   50
CeresClone:1066115      MSWQTYVDDH LMCDVEGNRL TAAAILGQDG SVWAQSANFP QLKPEEINGI   50
CeresClone:1030509      MSWQSYVDDH LMCDVEGNHL TAAAILGQDG SVWAQSANFP QLKTEEINGI   50
Lead-CeresClone25886    MSWQSYVDDH LMCEVEGNHL THAAIFGQDG SVWAQSSAFP QLKPAEIAGI   50
CeresClone:1068409      MSWQSYVDDH LMCDVEGNHL TSAAILGQDG SVWAQSTNFP QLKPAEIEGI   50
CeresClone:1374642      MSWQSYVDDH LMCDVEGNHL TSAAILGQDG SVWAQSTNFP QLKPAEIEGI   50

Consensus               MSWQSYVDDH LMCDVEGNHL TAAAILGQDG SVWAQS-NFP QLKP-EI-GI   50

CeresClone:1609975      MNDFNEPGSL APTGLHLGGT KYMVIQGEAG AVIRGKKGPG GVTVKKTGMA  100
CeresClone:1066115      NKDFNEPGTL APTGLFIGGT KYMVIQGEPN AVIRGKKGAG GVTIKKTTQA  100
CeresClone:1030509      TKDFEEPGFL APTGLFLGGA KYMVIQGEPG AVIRGKKGPG GVTIKKTTQA  100
Lead-CeresClone25886    NKDFEEAGHL APTGLFLGGE KYMVVQGEAG AVIRGKXGPG GVTIKKTTQA  100
CeresClone:1068409      KKDFEEPGHL APTGLFLGGE KYMVVQGEGG AVIRGKKGPG GVTIKKTNQA  100
CeresClone:1374642      KKDFEEPGHL APTGLFLGGE KYMVVQGEGG AVIRGKKGPG GVTIKKTNQA  100

Consensus               -KDFEEPGHL APTGLFLGGE KYMV-QGE-G AVIRGKKGPG GVTIKKTTQA  100

CeresClone:1609975      IILGIYDEPM TPGQCNMIVE RLGDYLLDQG F  131
CeresClone:1066115      MVFGIYEEPM TPGQCNMVVE RLGDYLIESG L  131
CeresClone:1030509      LVIGIYEEPM TGGQCNLVVX RLG------- -  123
Lead-CeresClone25886    LVFGIYDER- ---------- ---------- -  109
CeresClone:1068409      FVFGIYDEPM TGGQCNLVVE RLGDYLIESD L  131
CeresClone:1374642      FVFGIYDEPM TGGQCNLVVE RLGDYLIESD L  131

Consensus               LVFGIYDEPM TGGQCNMVVE RLGDYLIES- L  131
```

```
CeresClone:616734        --MAI RVPKS MRAKRELLKH APKLVENGKK MLILHGTKTS AVLNSVLADL   48
gi|34914658              MVAAI RVPRS QRAKRELLKH APKLVETGKK TLILHGTKTS AVLNSVLADL   50
CeresClone:246177        MVASI RVPKT QRARRELLKH APKLVETSKK TLILHGTKTS AVLNSVLSDI   50
Lead-CeresClone25758     -MMEI RTPKT GKAKRVLESR APKLVETGKK TLILHGTKTS ATLSSVMTEL   49
CeresClone:598129        -MLEI KTAKT RKGKRELEKR APKLVESGKK TLILHGTKTS GVLNAVLAQI   49
CeresClone:1045071       -MLEI KTAKT RKGKRELEKR APKLVESGKK TLILHGTKTS GVLNAVLAQI   49

Consensus                -M--I R-PKT --AKREL-K- APKLVETGKK TLILHGTKTS AVLNSVLAD-   50

CeresClone:616734        FHLKRDHAVK YTKKNDSIRP FESGGETSLE FFSLKSDCSL LVYGSHSKKR   98
gi|34914658              FHLKRDNAVK YSKKNDNIRP FESGGETSLE FFSLKTDCSL IVYGSHSKKR   100
CeresClone:246177        YHLKRDNAVK YTKKNDNIRP FESGGESSLE FFSLKADCSL IVYGSHSKKR   100
Lead-CeresClone25758     YRLKKGGAIR YSRRNENIRP FESGGETSLE FFSQKTDCSI FVYGSHTKKR   99
CeresClone:598129        YHLKKDCAVK YSRRNENVKP FEAGGETSLE FFSLKTDCSI FVYGSHSKKR   99
CeresClone:1045071       YHLKKDCAVK YSRRNENVKP FEAGGETSLE FFSLKTDCSI FVYGSHSKKR   99

Consensus                YHLK-DNAVK YS--N-NIRP FESGGETSLE FFSLKTDCS- -VYGSHSKKR   100

CeresClone:616734        PNNLVLGRTY DHHIYDLVEV GVENYKSIES YAYDKKLAPK LGTKPFFAFI   148
gi|34914658              PNNLVLGRTY DHHIYDLVEV GVENYKSIES YMYDKKLAPK LGSKPFFAFI   150
CeresClone:246177        PNNLILGRTY DHHIYDLVEV GVENYKSMES YVYDKKLAPL LGSKPFFAFI   150
Lead-CeresClone25758     PDNLVLGRMY DHQVYDLIEV GIENFKSLRA FSYYKKFAPH EGTKPFICEI   149
CeresClone:598129        PDNLVIGRTY DHHIYDLVEV GVENFKPMES FSYDKKLAPK EGSKPFIVFI   149
CeresClone:1045071       PDNLVIGRTY DHHIYDLVEV GVENFKPMES FSYDKKLAPK EGSKPFIVFI   149

Consensus                P-NLVLGRTY DHHIYDLVEV GVEN-KSMES -SYDKKLAPK -GSKPF-AFI   150

CeresClone:616734        GEHFESVEGL KHLKEMLLDH FKGEVVENLN LAGVDRIFVC TAISPTTVYM   198
gi|34914658              GEHFESVEEL KHLKEVLLDL FKGEVVENLN LAGVDRVFVC TAISPTTVYM   200
CeresClone:246177        GEHFESAEEL KHLKEVLLDL FRGEVVENLN LAGVDRIYVC TAISPTTVYM   200
Lead-CeresClone25758     GEGFENVSEL KHLKEVLTDL FRGEVVDNLN LTGLDRAYVC SAISPTKVFL   199
CeresClone:598129        GEGFEAVEEL KHLKEVLLDL LRGEVVENLN LAGVDRAYVC AALSPNRVFF   199
CeresClone:1045071       GEGFEAVEEL KHLKEVLLDL LRGEVVENLN LAGVDRAYVC AALSPNRVFF   199

Consensus                GE-FESVEEL KHLKEVLLDL FRGEVVENLN LAGVDR-YVC TAISPT-V-M   200
```

```
CeresClone:616734      MHCALRLKRS GTSIPRMELV EVGPSVDLVL RRHRQAAESL QKEAMKAPCH  248
gi|34914658            MHCALRLKRS GTSIPRIELV EVGPSMDLVV RRHRYPVESL KKEAMKTADH  250
CeresClone:246177      MHCALRLKRS GTSIPRMELV EVGPSMDLVV RRHRLPAESL KKEAMKTAEH  250
Lead-CeresClone25758   THCALKLKKS GSIVPRMELV EVSPSMDLVI RRNRLPNDSL MKEAMRTSKD  249
CeresClone:598129      THCALRLKKS GTVVPRMELE EVGPSMDFVL RRHRPPNESL RKEALKTSRE  249
CeresClone:1045071     THCALRLKKS GTVVPRMELE EVGPSMDFVL RRHRPPNESL RKEALKTSRE  249

Consensus              -HCALRLK-S GT--PRMELV EVGPSMDLVL RRHR-PNESL -KEAMKTS--  250

CeresClone:616734      --AKKVKNVT NNPVEGKQGR IYIPDQEVSK LTVTSNIKGL KRERRDAK-K  295
gi|34914658            --AKKMKNVT KDPVHGKLGK VYIPDQQIAK MSLSNDVKGL KRERREAK-K  297
CeresClone:246177      --AKKMKNVT KDPVQGKLGK VYMPDQQVGK LTLSNDIKGL KRERREAK-K  297
Lead-CeresClone25758   KPKKKEKNVD QDAVLGKTGK IYMPDQKLKE MKLFDKSKGS KRERKDAKLK  299
CeresClone:598129      KPKKKEKNVK KDELQGKIGS IYIPDQKVGE TPLPYKAKGV KRERRESKRK  299
CeresClone:1045071     KPKKKEKNVK KDELQGKIGS IYIPDQKVGE TPLPYKAKGV KRERRESKRK  299

Consensus              KP-KK-KNVT KDPVQGK-GK IYIPDQKVG- -TLSN--KGL KRERREAK-K  300

CeresClone:616734      NKEHSKKQKV AENPE  310
gi|34914658            NKDH--SKKQ KINPE  310
CeresClone:246177      NQD---SKKQ KVNPE  309
Lead-CeresClone25758   HKEETVAKKM KVSSE  314
CeresClone:598129      NESDGSASKR KKEDS  314
CeresClone:1045071     NESDGSASKR KKEDS  314

Consensus              NK-D--AKK- K-NPE  315
```

```
gi|1143319                  MASSL-APAT K-AATNLRL- --THSL---- ---RFSPKPN NLRF------ 32
CeresClone:626132           MASSL-APAT K-AATNLRL- --THSL---- ---RFSPKPN NLRF------ 32
Lead-CeresClone25607        MASLS-VPCV K-ICALNRR- --VGSLP-GI STQRWQPQPN GI SF------ 38
gi|1070006                  MASLS-VPYA K-I SAPNRR- --VGSIP-GR T--RWQPQLN GVSF------ 36
gi|44190488                 MASLSIVPYA K-I SAPSRR- --VGSIP-GI ---RRQLKPS GI SF------ 36
gi|1070008                  MASLS-VPYA K-I SAPNRR- --VESIP-GI ---RRQPQPS GI SF------ 35
gi|12006165                 MASFT-I PCP KCVVVPFAH- --LGLNS-QT QQRNALGLKK SLSFGSLSSD 45
CeresClone:1243020          MASFS-VPCP KCPTITSSSSS LPLGLNSQKV SFQSGLI LKP SLSFGSLSAE 49
CeresClone:625652           MASFS-VPCP KCPTITSSSP- -PLGLKSLNV SFQRVLSLKP SLSFGSLSAE 47

Consensus                   MAS-S-VP-- K-VS---R-- --VGS----I ---R--P-PN SLSF------ 50

gi|1143319                  ------ATKP GNTLLCTRVK AQLNE-VALD SSSNATSPPM KAKSKEEPPA 75
CeresClone:626132           ------ATKP GNTLLCARVK AQLDE-VALD SSSNATEPPI KAKSKEEPPA 74
Lead-CeresClone25607        ----P-SDVS QNHSAFWRLR ATTNE--VVS NSTPMTNGG- ---------Y 71
gi|1070006                  ----P-SDVS QNQSTI WRLR ATTNE--VVS NSTPVTNGG- ---------C 69
gi|44190488                 ----HVSHVS QTQSTI WRLH ATTNE-KVVS NSTPVTNGG- ---------C 71
gi|1070008                  ----HVSHVS QTQSTI WRLR ATTNE--VVS NSTPVTNGG- ---------C 69
gi|12006165                 SAPNGIQCLN KKQSSVWKLQ AQPKEAVTVE NSAPVQVNCP KI APPEEKDD 95
CeresClone:1243020          SAASRIQCLN RKQFSVLKAT KVENS----- NSAPVTVNCP TVASSKENQV 94
CeresClone:625652           SAASRLQCLN RKQFSVLKAT KVENS----- NSAPVMVNCP NVASSKEKEV 92

Consensus                   -----I S-VN Q-QS--WRLR A--NE---V- NS-PVTN-G- ------EE--- 100

gi|1143319                  KPLAEPSSSV LATQ-ESVSQ FI TQVASLVK LVDSRDI VEL KLKQHDVEVT 124
CeresClone:626132           KPLAEPSSSV LATQ-ESVSQ FI TQVASLVK LVDSRDI VEL KLKQHDVEVT 123
Lead-CeresClone25607        MNGKAKT-NV -PEP-AELSE FMAKVSGLLK LVDSKDI VEL ELKQLDCEI V 118
gi|1070006                  LNGNVKS-NV -PES-AKLSN FMAKVSGLLK LVDSRDI VEL ELKQLDCEI V 116
gi|44190488                 LNGNVKT-NV -PEPAAELSD FMSKVSSLLK LVDSRDI VEL ELKQLDCEI V 119
gi|1070008                  LNGNVKT-NV PPEPAAELSD FI SKVSGLLK LVDSRDI VEL ELKQLDCEI V 118
gi|12006165                 HNGKPSGPSF SADA-SSI SA FMNQVSDLVK LVDSKDI MEL QLKQANCELV 144
CeresClone:1243020          HNGKLSDTTI -PDE-ASI I A FMSQVSDLVK LVDSRDI VEL QLKQSDCELM 142
CeresClone:625652           HNGKLSGGTI -PDD-ASI I A FMSQVSDLVK LVDSRDI VEL QLKQSDCELM 140

Consensus                   -NG-V----V -PE--ASI S- FMSQVS-LVK LVDSRDI VEL ELKQ-DCEI V 150
```

```
gi|1143319            IRKKEAM-PQ PPPAPQPSVV YSPPPPALPP PPVPASTPA- ------PTLAR  167
CeresClone:626132     IRKKEAM-PQ PPPPPQPAVV YSSPPPVLPP PSVPASTPA- ------PTLAR  166
Lead-CeresClone25607  IRKKEAL--Q QAVPPAPVYH SM--PPVMAD FSMPPAQPV- ---ALPPSPT  160
gi|1070006            IRKKEALQQQ PTPPPAPVYH SMASP--MAG LQMAPSQPV- ---APPPFSL  160
gi|44190488           IRKKEALQQQ ATQPPAPVYH SMMPPPPMAG LPMPPSPPV- ---SPPPSPA  165
gi|1070008            IRKRKL---- -TAATAPVYH SMMPPPPMEG LPMPPSPPV- -------SPPA  156
gi|12006165           IRKKEAL--- -LPPPATFVA PVSQPFPYPT NSLPAAPPPV ATSTPASSPS  190
CeresClone:1243020    IRKKEAL--- -QPPP--IIA PAPPPMHYAT FPSPSSPLP- AEAAPASSAP  185
CeresClone:625652     IRKKEAL--- -QPPP--VIA PTSPPMHYAT VPSPPPPPA- --AAPASSAP  181

Consensus             IRKKEAL--Q --PPPAPVV- -M-PPP-MA- -PMPPSPP-- ----PPSSA-  200

gi|1143319            ATPTPTSAPA VKSAKSSLPP LKSPMA-GTF YRSPAPGEPS FVKVGDKVKK  216
CeresClone:626132     ATPSPTSAPA VKSAKSSLPP LKSPMA-GTF YRSPAPGEPP FVKVGDKVKK  215
Lead-CeresClone25607  PTSTPATAKP TSAPSSSHPP LKSPMA-GTF YRSPGPGEPP FVKVGDKVQK  209
gi|1070006            VLSAPETAKP VTPPSSFTSS TQESYGLGTF YRSPGPGEPP FVKVGDKVQK  210
gi|44190488           PSSAAETAKP ATAPSSSHPP LKSPMA-GTF YRSPGPGEPP FVKVGDKVRK  214
gi|1070008            PSSAPATANT ATAPSSSHPP LKSPMA-GTF YRSPGPGEPP FVKVGDKVQK  205
gi|12006165           SKAAPALP-P AKASKSSHPA LKCPMA-GTF YRSPAPGEPP FVKVGDKVQK  238
CeresClone:1243020    PKAAPALPSP GKASTSSHPP LKCPMA-GTF YRSPAPGEPA FVKVGDKVKK  234
CeresClone:625652     PKAVPALPSP AKAGTSSHPT LKCPMA-GTF YRSPAPGEPA FVKVGDKVQK  230

Consensus             PTSAPATA-P -KA-SSSHPP LKSPMA-GTF YRSPAPGEPP FVKVGDKVQK  250

gi|1143319            GQVVCIIEAM KLMNEIEADQ SGTIVEIVAE DAKSVSVDTP LFVIQP  262
CeresClone:626132     GQVVCIIEAM KLMNEIEADQ SGTIVEIVAE DAKSVSVDTP LFVIQP  261
Lead-CeresClone25607  GQIVCIIEAM KLMNEIEAEK SGTIMELLAE DGKPVSVDTP LFVIAP  255
gi|1070006            GQVVCIIEAM KLMNEIEAEK SGTITELLAE DGKPVSVDTP LFTIVP  256
gi|44190488           GQVVCIIEAM KLMNEIEAEK SGTITELLAE DGKPVSVDTP LFTIAP  260
gi|1070008            GQVVCIIEAM KLMNEIEAEK SGTITELLAE DGKPVSVDTP LFTIAP  251
gi|12006165           GQVICIIEAM KLMNEIEADQ SGTVAEVVAE DGKPVSVDTP LFVIVP  284
CeresClone:1243020    GQVICIIEAM KLMNEIEADQ SGTIAEVLAE DGKPVSVDMP LFVIVP  280
CeresClone:625652     GQVICIIEAM KLMNEIEADQ SGTIAEVLAE DGKPVSVDTP LFVIVP  276

Consensus             GQVVCIIEAM KLMNEIEADQ SGTI-EILAE DGKPVSVDTP LFVI-P  296
```

| | | | | | | |
|---|---|---|---|---|---|---|
| CeresClone:303545 | EERNTHTLGF | PMAAAAPTHA | PVSSSACRSG | F--------- | SSSDVSFPNF | 41 |
| CeresClone:788296 | ---------- | --MAAPLPRA | PVSSPASRAA | L--------- | CPARSNPCTA | 29 |
| gi\|34903270 | ---------- | ---------- | ---------- | ---------- | ---------- | 0 |
| gi\|56783703 | ---------- | -MAAPPLPRA | PVSSSAAAAS | PGGRALLLLR | VGGGGSGRCA | 39 |
| CeresClone:463846 | ---------- | --MAVSYVHM | LQCNRGFHKG | N--------- | --LSYPNCSY | 27 |
| CeresClone:947207 | ---------- | --MAI SYNAL | AQSLPGRSSF | F--------- | VPKAL---CI | 26 |
| Lead-CeresClone25538 | ---------- | --MAVSYNAL | AQSL-ARSSC | F--------- | I PKPYSFRDT | 28 |
| gi\|50313439 | ---------- | ---------- | ---------- | ---------- | ---------- | 0 |
| Consensus | ---------- | --MA-S---- | --SS-A--S- | ---------- | -----S---- | 50 |

| | | | | | | |
|---|---|---|---|---|---|---|
| CeresClone:303545 | RSAAASAPGW | RRREPYPAVS | VVSSSPQSVP | GAI IVDTEVD | TLLDSVKWDS | 91 |
| CeresClone:788296 | AAPSSGALCW | RRRQPCPMLS | I APGSARSTP | AALAVDPKVE | ALLDSVKWDV | 79 |
| gi\|34903270 | ---------- | ---------- | ---------- | ---------- | ---------- | 0 |
| gi\|56783703 | GVAAAAAPGW | RR--PFPAAS | VAARSAGTTP | GEVAVDPKVE | AI LDSVKWDS | 87 |
| CeresClone:463846 | KARRSHRLVF | ---------- | ---------A | SMHTPEPKVD | SLLDSVKWDT | 58 |
| CeresClone:947207 | KQRSRSTVVF | ---------- | -----ASNDK | NI  ALQAKVD | TLLDRI KWDE | 61 |
| Lead-CeresClone25538 | KLRSRSNVVF | ---------- | -----ACNDN | KNI ALQAKVD | NLLDRI KWDD | 63 |
| gi\|50313439 | ---------- | ---------- | ---------- | ---------- | ---------- | 0 |
| Consensus | K--S-S---- | ---------- | -----A---- | --I AV--KVD | -LLDSVKWD- | 100 |

| | | | | | | |
|---|---|---|---|---|---|---|
| CeresClone:303545 | KGLAVAI AQN | VDTGAI LMQG | FANKEALAKT | I STRKATFFS | RSRSSLWTKG | 141 |
| CeresClone:788296 | KGLAVAI AQN | VDTGAI LMQG | FANKEALAAT | I STRKATFYS | RSRSSLWTKG | 129 |
| gi\|34903270 | ---------- | -------MQG | FANKEALATT | I STRKATFYS | RSRSSLWTKG | 33 |
| gi\|56783703 | KGLAVAI AQN | VDTGAI LMQG | FANKEALATT | I STRKATFYS | RSRSSLWTKG | 137 |
| CeresClone:463846 | KGLVVAI AQN | VDTGAI LMQG | FANREAI ATT | I SSRKATFYS | RSRSTLWTKG | 108 |
| CeresClone:947207 | KGLAVAI AQN | VDTGAVLMQG | FANREALSTT | LTSRKATFFS | RSRSTLWTKG | 111 |
| Lead-CeresClone25538 | KGLAVAI AQN | VDTGAVLMQG | FVNREALSTT | I SSRKATFFS | RSRSTLWTKG | 113 |
| gi\|50313439 | ---------- | ---------G | FVNREALATT | I SSRKATFFS | RSRSSLWI KG | 31 |
| Consensus | KGLAVAI AQN | VDTGAI LMQG | FAN-EALATT | I S-RKATF-S | RSRSSLWTKG | 150 |

```
CeresClone:303545      ETSMNFINVH DIFLDCDHDS IIYLGKPDGP TCHTGAETCY YTSVYDALQS  191
CeresClone:788296      ETSMNFINVH DIFLDCDRDS IIYLGTPDGP TCHTGAETCY YSSVYDALQG  179
gi|34903270            ETSMNFINVH DIFLDCDRDS IIYLGKPDGP TCHTGAETCY YTSVYDALQG  83
gi|56783703            ETSMNFINVH DIFLDCDRDS IIYLGKPDGP TCHTGAETCY YTSVYDALQG  187
CeresClone:463846      ETSNNFINVH DVFIDCDRDS IIYLGKPDGP TCHTGAETCY YTSVFDLLKQ  158
CeresClone:947207      ETSNNFINVL DVYLDXDXDS IIYLGTPDGP TCHTGAETCY YTSVLDQLXN  161
Lead-CeresClone25538   ETSNNFINIL DVYVDCDRDS IIYLGTPDGP TCHTGEETCY YTSVFDQLNN  163
gi|50313439            ETSNNFINIL DVYIDCDRDS IIYLGTPDGP TCHTGAETCY YTSVFDQLND  81

Consensus              ETS-NFINVH D-FLDCDRDS IIYLG-PDGP TCHTGAETCY YTSVYDALQN  200

CeresClone:303545      SKPNEGRQVM TTLYSLEDTI SRRHEEKVTD GGGKPSWTKK LLLDNQLLCS  241
CeresClone:788296      SKSNQERQVT TTLYSLEDTI SRRKEEIVTE GSGKPSWTKK LLLDNQLLCS  229
gi|34903270            SKPNQDRQVV STLYSLEDTI SRRKEEIVTE GSGKPSWTKK LILDNRLLCS  133
gi|56783703            SKPNQDRQVV STLYSLEDTI SRRKEEIVTE GSGKPSWTKK LILDNRLLCS  237
CeresClone:463846      QEAEENKLAL TSLYALESTI SQRKTELIGE NE-KPSWTKR LLLNDKLLCS  207
CeresClone:947207      DEAXGEKLAS TTLYSLESTI SKRKEESXVP QEGKPSWTRR LLTDDALLCS  211
Lead-CeresClone25538   DEASGNKLAL TTLYSLESI- SKRKEESTVP QEGKPSWTRR LLTDDALLCS  213
gi|50313439            EEP-GNKLAL TTLYSLESI- SKRKEESTVP QEGKPSWTRR LLTDDTLLCS  131

Consensus              ---NQ----L TTLYSLE-TI SRRKEEIVTE GEGKPSWTK- LLLD--LLCS  250

CeresClone:303545      KIREEAGEL- QTLLENEDQS RAASEMADLL YHAMVLLRVK DVKMEQVLEV  291
CeresClone:788296      KIREEAGEL- QTLLENEEKS RTASEMADLL YHAMVLLSVR DVKMEEVLEV  279
gi|34903270            KISEEAGELN QTLLENEDES RTISEMGDLL YHAMVLLRVK GVRMEQVLEV  183
gi|56783703            KISEEAGELN QTLLENEDES RTISEMGDLL YHAMVLLRVK GVRMEQVLEV  287
CeresClone:463846      KIREEANELC QTLENNEDEK RTASEMADVL YHAMVLLAKK GVKIEDVLQV  257
CeresClone:947207      KIREEADELC RTLEDKEEVS RTASEMADML YHAMVLLSKR DVKFEDVLEV  261
Lead-CeresClone25538   KIREEADELC RTLEDNEEVS RTPSEMADVL YHAMVLLSKR GVKMEDVLEV  263
gi|50313439            KIREEADELC RTLEDNEEVS NTASEMADVL YHSMVLLSKR DVEIEDVL--  179

Consensus              KIREEA-ELC QTL-ENE-ES RTASEMADLL YHAMVLLS-- -VKMEDVLEV  300
```

| | | | | |
|---|---|---|---|---|
| CeresClone:303545 | LRKRFSQSGI | EEKASRNKS- | ---- | 310 |
| CeresClone:788296 | LRKRFSQSGV | EEKASRKKS- | ---- | 298 |
| gi\|34903270 | LRKRFSQSGI | EEKASRNKS- | ---- | 202 |
| gi\|56783703 | LRKRFSQSGI | EEKASRNKS- | ---- | 306 |
| CeresClone:463846 | LRLRFSQSGI | EEKKSRVSQK | SVDD | 281 |
| CeresClone:947207 | XRKRFSQSGI | EEKQSRSK-- | ---- | 279 |
| Lead-CeresClone25538 | LRKRFSQSGI | EEKQNRTK-- | ---- | 281 |
| gi\|50313439 | ---------- | ---------- | ---- | 179 |
| Consensus | LRKRFSQSGI | EEKASR-KS- | ---- | 324 |

```
gi|1808694              ---------- ---------- ---------- ---MASASKE EVIGKLNVRV   17
CeresClone:1605876      ---------- ---------- ---------- --------ME GVVGLMKLRV   12
Lead-CeresClone23322    ---------- ---------- ---------- --------ME ELVGLLRIRV   12
CeresClone:950968       ---------- --DIDRCLFS QEKTQRNFVW REQRKRLKME ELAGLLRIRV   38
CeresClone:513057       ---------- ---------- ---------- --------ME NLLGLLRIHV   12
CeresClone:568719       EKGTAAVPCL QPQLNQSVAI TLVSHHPPRA RSRRSSTMLG HLVGLVKVRV   50
gi|50907613             ---------- ---------- ---------- -------MLG HLVGLVKVRV   13
CeresClone:399010       ---------- ---------- -------MVG KKRGVISPLD HLAGLLEVRV   23
CeresClone:302545       ---------- ---------- ---------- -------MLD HLVGLLKLRV   13
CeresClone:242695       ---------- ---------- ---------- -------MLD HLVGLLKLRV   13

Consensus               ---------- ---------- ---------- --------ME HLVGLLKIRV   50

gi|1808694              VRGSNLAICD PLTHTSDPYV VLHYGA-QKV KTSVQKKNPN PVWNEVLQLS   66
CeresClone:1605876      KRGINLVARD --TKSSDAYI VATLDD-QKF KAKVTKGSCN PVWNDELTLT   59
Lead-CeresClone23322    KRGINLAQRD --TLSSDPFV VITMGS-QKL KTRVVENNCN PEWNEELTLA   59
CeresClone:950968       KKGINLARRD --SLSSDPFV VITMGT-QKL KGRTVENNCN PEWNEELTLA   85
CeresClone:513057       EKGVNLAIRD --VVSSDPYV VIKMGK-QKL KTRVVNKNLN PEWNDDLTLS   59
CeresClone:568719       TRGVNLAIRD --LRSSDPYV VVRMGK-QKL KTRVVRKSIN PEWNDELTLS   97
gi|50907613             VRGVNLAVRD --LRSSDPYV IVRMGK-QKL KTRVIKKTTN PEWNDELTLS   60
CeresClone:399010       VRGVDLAIRD --LRSSDPYV VLRIGKAQKV KTRVVKKSIN PEWNEKLTLS   71
CeresClone:302545       VRGVNLAVRD --LRSSDPYV VVRIGK-QKL KTRVVKKSVN PEWDDELTLS   60
CeresClone:242695       VRGVNLAVRD --LRSSDPYV VVRIGK-QKL KTRVVKKSVN PEWDDELTLS   60

Consensus               VRGVNLAVRD --LRSSDPYV VIRMGK-QKL KTRVVKKN-N PEWNDELTLS  100

gi|1808694              VTNPTKPVHL EVFDEDKFTA DDSMGVAEIN LTDIYDAAKL D--LKHAADG  114
CeresClone:1605876      MRDPKAPIHI AVYDKDRFSN DDNMGEAEID VKPYIECLRM GLNMADTPNG  109
Lead-CeresClone23322    LRHPDEPVNL IVYDKDTFTS HDKMGDAKID IKPFLEVHKM G--LQELPDG  107
CeresClone:950968       LKHPNEPVTL IVYDKDTFTS HDKMGDAKID IKPFLEVHKL G--LQELPDG  133
CeresClone:513057       ISDPHAPIHL HVYDKDTFSM DDKMGDAEFF IGPFIEAVKM R--LSSLPNN  107
CeresClone:568719       IEDPTIPVKL DVFDKDTFF- DDPMGNAELD IGPLVEAARM RVQLQGVADN  146
gi|50907613             IEDPAVPVRL EVYDKDTFI- DDAMGNAELD IRPLVEVVKM K--IEGVADN  107
CeresClone:399010       IEDPAVPIRL EVFDKDTFV- DDAMGNAELD IRPLVEIVKM K--LQGVADK  118
CeresClone:302545       IEDPAVPIRL EVFDKDTFV- DDTMGNAEVD IRPLVEIVKM K--LQDVADR  107
CeresClone:242695       IEDPAVPIRL EVFDKDTFV- DDTMGNAEVD IRPLVEIVKM K--LQDVADR  107

Consensus               IEDP-VP-RL EV-DKDTFT- DD-MGNAEID IRPLVE-VKM K--LQDVAD-  150
```

```
gi|1808694               TRI KTI YFVG VNYLGGESHV MWKDGKVVQD LI LKLTKTDS GLI TLQLEWV   164
CeresClone:1605876       TTLSCVQPTE HNCLANESSI I WENGKI VQD MHLRLRGVER GEVVI QI ELV   159
Lead-CeresClone23322     TEI KRVVPNR ENCLAEASSI VSNNGKI VQN MI LLLRNVEC GEVEI QLEWI  157
CeresClone:950968        TVI KRVLPTK ENCLSEESRI VYHNGKI VQD MI LVLRNVEC GEVEI QLEWI  183
CeresClone:513057        TI VTKVLPSR QNSLAEESHI VWKDGKVVQN MVLRLRNVET GEVELQLHWI    157
CeresClone:568719        TVVKKLVPNR QNCLAEQSAI YLSEGTVKQD VVLRLRNVEC GEVELQLQWI     196
gi|50907613              TVVKKVVPNR QNCLAEESTI YI SEGKVKQD VVLRLRDVEC GEI ELQLQWV   157
CeresClone:399010        TVVKKLVPNR QNCLAEESSI YI SEGKVKQD LVVRLRNVEC GEI ELQLQWV   168
CeresClone:302545        TVVKKLVPNR QNCLAEESSI YI SEGKVKQD MVVRLRNVES GEI ELQLQWI   157
CeresClone:242695        TVVKKLVPNR QNCLAEESSI YI SEGKVKQD MVVRLRNVES GEI ELQLQWI   157

Consensus                TVVKKI VPNR QNCLAEESSI -I SEGKV-QD MVLRLRNVEC GE-ELQLQWI   200

gi|1808694               HVPGVK--L- --    171
CeresClone:1605876       LLPGHNLDV- --    168
Lead-CeresClone23322     DI PGSR-GL- --   165
CeresClone:950968        EI PGGR-GL- --   191
CeresClone:513057        DI PGSR-HL- --   165
CeresClone:568719        DI PGSK-GVS GF   207
gi|50907613              DI PGSK-GV- --   165
CeresClone:399010        HLPGSK-GV- --    176
CeresClone:302545        DLPGSK-GV- --    165
CeresClone:242695        DLPGSK-GV- --    165

Consensus                DI PGSK-GV- --   212
```

```
CeresClone:1091493      ---------- ---------- ---------MA SPDVEYRCFV GGLAWATDDR   22
CeresClone:977670       ---------- ---------- ---------MA SPDVEYRCFV GGLAWATDDR   22
CeresClone:972545       ---------- ---------- ---------- MSEVEYRCFV XGLAWATGDA   20
CeresClone:963616       ---------- ---------- ---------- MSEVEYRCFV GGXAWATGDA   20
CeresClone:322573       ---------- ---------- ---------- ---MSTKLFI GGLDWGVDDV   17
CeresClone:289956       ---------- ---------- ---------- ---MSTKLFI GGLDWGVDDV   17
Lead-CeresClone7191     MAFCNKLGGL LRQN-ISSNG NVPVTSMLGS LRLMSTKLFI GGLSWGTDDA   49
CeresClone:1388283      MAFCKSLGGL LRQGVVSQTG NIPVTSVLGS LRYMSTKLFV GGLSWGTDDQ   50

Consensus               ---------- ---------- ---------- --------FV GGLAW-TDD-   50

CeresClone:1091493      ALETAFSQFG DVLDSKIIND RETGRSRGFG FVTFKDEKSM KDAIEGMNGQ   72
CeresClone:977670       ALETAFSQYG DVLDSKIIND RETGRSRGFG FVTFKDEKSM KDAIEGMNGQ   72
CeresClone:972545       ELERTFXQFG EVIDSKIIND RETGRSRGFG FVTFKDEKSM KDAIDEMNGK   70
CeresClone:963616       ELERTFSQFG EVIDSKIIND RETGRSRGFG FVTFKDEKSM KDAIDEMNGK   70
CeresClone:322573       KLREAFSSFG EVIEARVITD RETGRSRGFG FVNYSDSDAA KEAISAMDGK   67
CeresClone:289956       KLREAFSSFG EVIEARVITD RETGRSRGFG FVNYSDSDAA KEAISAMDGK   67
Lead-CeresClone7191     SLRDAFAHFG DVVDAKVIVD RETGRSRGFG FVNFNDEGAA TAAISEMDGK   99
CeresClone:1388283      SLREAFANFG EVVDAKVIVD RETGRSRGFG FVNFTDETAA NTAISEMDGK  100

Consensus               -L-EAFS-FG EV-D-K-IND RETGRSRGFG FV-F-DEK-- KDAI-EM-GK  100

CeresClone:1091493      DLDGRSITVN EAQSRGSG-- --GGGGRGG G-GGGYRSGG GGGYGGGGGG  117
CeresClone:977670       DLDGRSITVN EAQSRGG--- --GGGGRGG G-GGGYRSGG GGGYGGGGGG  116
CeresClone:972545       ELDGRTIXVX EAQSRGG--- --GGGGRGG G-GYGDRR-G GGGYXSGGGG  113
CeresClone:963616       ELDGRTITVN EAQSRGG--- --GGGGRGG G-GYGDRR-G GGGYGSGGGG  113
CeresClone:322573       EIDGRQVRVN MANERPAGNR ---GGGGYGG G-GY-----G GGGYGGGGGY  108
CeresClone:289956       EIDGRQVRVN MANERPAGNR ---GGGGYGG G-GY-----G GGGYGGGGGY  108
Lead-CeresClone7191     ELNGRHIRVN PANDRPSAPR AYGGGGGYSG G--------G GGGYGGGGGS  141
CeresClone:1388283      DLNGRSIRVN VANERPSTPR -YGGGGGYGG GGGY-----G GGGYGGGSYG  144

Consensus               ELDGRSIRVN EA--R-S--R --GGGGG-GG G-GYG-R--G GGGYGGGGGG  150
```

| | | |
|---|---|---|
| CeresClone:1091493 | YGGGGGRRE- GGYSGGCGGG | 136 |
| CeresClone:977670 | YGGGGGRRE- GGYSGGGGG- | 134 |
| CeresClone:972545 | RGGG------ -GYXSGG--- | 123 |
| CeresClone:963616 | YGGGGGRRDG GGYGGGDGSY | 133 |
| CeresClone:322573 | GGGGLIYRFA L--------- | 119 |
| CeresClone:289956 | GGGG----YG GGSQSYDA-- | 122 |
| Lead-CeresClone7191 | YGGG----DG GGY------- | 150 |
| CeresClone:1388283 | AGGG----DG GGY------- | 153 |
| | | |
| Consensus | YGGG---RDG GGY--G---- | 170 |

```
CeresClone:476264           MGELKDTEAY EEELIDYEEE EEKAPD--SA KPVAESGKKG YVGIHSSGFR  48
CeresClone:1462142          MGEAKENDVY EEELLDYEED DDKTVDGSAA KPTGEVAKKG YVGIHSSGFR  50
Lead-CeresClone1011386      MGDARDNEAY EEELLDYEEE DEKVPD-SGN KVNGEAVKKG YVGIHSSGFR  49

Consensus                   MGEAKDNEAY EEELLDYEEE DEK-PD-S-A KP-GE--KKG YVGIHSSGFR  50

CeresClone:476264           DFLLKPELLR AIVDSGFEHP SEVQHECIPQ AILGMDVICQ AKSGMGKTAV  98
CeresClone:1462142          DFLLKPELLR AIQDCGFEHP SEVQHECIPQ AILGMDVICQ AKSGMGKTAV  100
Lead-CeresClone1011386      DFLLKPELLR AIVDSGFEHP SEVQHECIPQ AILGMDVICQ AKSGMGKTAV  99

Consensus                   DFLLKPELLR AIVDSGFEHP SEVQHECIPQ AILGMDVICQ AKSGMGKTAV  100

CeresClone:476264           FVLSTLQQVD PVPGQVAALV LCHTRELAYQ ICHEFERFST YLPDIKAAVF  148
CeresClone:1462142          FVLSSLQQID PVAGQVAALV LCHTRELAYQ ICHEFERFSK YLIEVKVAVF  150
Lead-CeresClone1011386      FVLSTLQQIE PSPGQVSALV LCHTRELAYQ ICNEFVRFST YLPDTKVSVF  149

Consensus                   FVLSTLQQID PVPGQVAALV LCHTRELAYQ ICHEFERFST YLPD-KVAVF  150

CeresClone:476264           YGGVNIKVHK ELLKNECPHI VVGTPGRILA LARDKDLGLK NVRHFILDEC  198
CeresClone:1462142          YGGVHIRKHK DLLKNECPHI VVGTPGRILA LARDKDLSLK NVRHFILDEC  200
Lead-CeresClone1011386      YGGVNIKIHK DLLKNECPHI VVGTPGRVLA LAREKDLSLK NVRHFILDEC  199

Consensus                   YGGVNIK-HK DLLKNECPHI VVGTPGRILA LARDKDLSLK NVRHFILDEC  200

CeresClone:476264           DKMLESLDMR RDVQEIFKLT PHDKQVMMFS ATLSKEIRPV CKKFMQDPME  248
CeresClone:1462142          DKMLESLDMR RDVQEIFKMT PHDKQVMMFS ATLSKEIRPV CKKFMQDPME  250
Lead-CeresClone1011386      DKMLESLDMR RDVQEIFKMT PHDKQVMMFS ATLSKEIRPV CKKFMQDPME  249

Consensus                   DKMLESLDMR RDVQEIFKMT PHDKQVMMFS ATLSKEIRPV CKKFMQDPME  250

CeresClone:476264           IYVDDEAKLT LHGLVQHYIK LQETEKNRKL NDLLDALDFN QVVIFVKSVS  298
CeresClone:1462142          IYVDDEAKLT LHGLVQHYIK LSEAEKNRKL NDLLDALDFN QVVIFVKSVS  300
Lead-CeresClone1011386      IYVDDEAKLT LHGLVQHYIK LSEMEKNRKL NDLLDALDFN QVVIFVKSVS  299

Consensus                   IYVDDEAKLT LHGLVQHYIK LSE-EKNRKL NDLLDALDFN QVVIFVKSVS  300
```

| | | | | | | |
|---|---|---|---|---|---|---|
| CeresClone:476264 | RAAELNKLLV | ECNFPSI CI H | SAMSQEERLK | RYKGFKEGKQ | RI LVATDLVG | 348 |
| CeresClone:1462142 | RAAELNKLLC | ECNFPSI CI H | SGMTQEERLT | RYKNFKEGHK | RI LVATDLVG | 350 |
| Lead-CeresClone1011386 | RAAELNKLLV | ECNFPSI CI H | SGMSQEERLT | RYKSFKEGHK | RI LVATDLVG | 349 |
| Consensus | RAAELNKLLV | ECNFPSI CI H | SGMSQEERLT | RYK-FKEGHK | RI LVATDLVG | 350 |
| CeresClone:476264 | RGI DI ERVNI | VI NYDMPDSA | DTYLHRVGRA | GRFGTKGLAI | TFVSSIADSE | 398 |
| CeresClone:1462142 | RGI DI ERVNI | VI NYDMPDSA | DTYLHRVGRA | GRFGTKGLAI | TFVSSASDSD | 400 |
| Lead-CeresClone1011386 | RGI DI ERVNI | VI NYDMPDSA | DTYLHRVGRA | GRFGTKGLAI | TFVASASDSE | 399 |
| Consensus | RGI DI ERVNI | VI NYDMPDSA | DTYLHRVGRA | GRFGTKGLAI | TFVSSASDSE | 400 |
| CeresClone:476264 | VLNQVQSRFE | VDI KELPEQI | DTSTYMPN | 426 | | |
| CeresClone:1462142 | VLNQVQERFE | VDI KELPEQI | DTSTYMPS | 428 | | |
| Lead-CeresClone1011386 | VLNQVQERFE | VDI KELPEQI | DTSTYMPS | 427 | | |
| Consensus | VLNQVQERFE | VDI KELPEQI | DTSTYMPS | 428 | | |

```
gi|7415614               ---MHVRNDS SGSSLVAMLA -SCSPAAAVQ AQPGGGGMED TVSCGQKRPY  46
CeresClone:527229        ---------- -MMLMSQLFP ADAYTQIISQ Q------GET NKKPRRRRNK  33
CeresClone:1351153       ---------- -MAFISQLYP -DVYTQIVQP V------GEV KQPKRRRKKT  32
gi|4006894               --MNYTVDDQ NMAFISQLYP -DVYTQIVQP V------GEV KQPKRRRKKT  41
CeresClone:1440579       ------MEQY DGLFPPAYVD -DSSSLLLVP NANGTADEER PRA-RRRRRR  42
gi|45593100              MDRYGEKQQQ QQMFASYV-- -DASLLAASG E----VQGER PRA-RRRRRR  42
gi|50938719              MDRYGEKQQQ QQMFASYV-- -DASLLAASG E----VQGER PRA-RRRRRR  42
Lead-CeresClone729085    ---MSPEEGE RLLFPSFVFP -DGFPADDAT PAV--SGGEQ KKAGRQRRRR  44
CeresClone:901184        ---MSSEEGE RLLFPSFVFP -DSFPADDAT PVV--SGGEQ KKAGRQRRRR  44
gi|46242609              ---------- ---LSLFCLV -GCCV----- -----AGGEQ KKA-RQRRRR  25
CeresClone:1565969       ---MGYEEED RLLFPSSVFT -ESFTEAAAT ATTPGSGSEQ TKA-RQL---  42
CeresClone:324157        ---MGCEEEE RLLFPSFVFP -ESFAEAATP G----SGGEQ KKA-RQRRRR  41

Consensus                -------E-- RMMF-SYVFP -DAY------ -----SGGEQ KKA-R-RRRR  50

gi|7415614               YSTIEASGED PGEEDVGDDC IQQSKKRRLT FDQVRSHEKN FEIENKLEPE  96
CeresClone:527229        KNKG------ -GENGASE-- --ANKKRKLS EVQVNLLEQN FGNERKLESE  72
CeresClone:1351153       KGSVA----- -SADGGNG-- --LFRKRKLT DEQVNMLEMS FGDEHKLESE  72
gi|4006894               KGSVA----- -SADGGNG-- --LFRKRKLT DEQVNMLEMS FGDEHKLESE  81
CeresClone:1440579       AARC------ -GGGGGELDG GGDHKKRRLT DEQVEMLELS FREERKLETG  85
gi|45593100              GARCVG---- -GGGGGGEVD GGDPKKRRLS DEQVEMLELS FREERKLETG  87
gi|50938719              GARCVG---- -GGGGGGEVD GGDPKKRRLS DEQVEMLELS FREERKLETG  87
Lead-CeresClone729085    RARQAAAG-- -EGAGGDD-- --AAKKRRLS DEQAQFLEMS FRKERKLETP  87
CeresClone:901184        RARQAAS--- -GEGGGDD-- --AAKKRRLS DEQAQFLEMN FRKERKLETP  86
gi|46242609              KVKPEAAAAL AGESGGDE-- --QAKKRRLS DEQARFLEMS FKKERKLETP  71
CeresClone:1565969       ---------- -----SDG-- --QARKRRLS DGHXXFLELS FGKERKLETP  73
CeresClone:324157        KPRPAE---- -GGEGADE-- --QARKRRLS DDQARFLELS FRKERKLETP  82

Consensus                K-R------- -G--GGDE-- ----KKRRLS DEQV-MLE-S FR-ERKLET-  100
```

| | | | | | | |
|---|---|---|---|---|---|---|
| gi\|7415614 | RKMQLANELG | LQPRQVAVWF | QNRRARWKTK | QLERDYEVLT | LDYNRLKSEF | 146 |
| CeresClone:527229 | RKDRLAMELG | LDPRQVAVWF | QNRRARWKNK | KLEE------ | -EYSSLKKNH | 115 |
| CeresClone:1351153 | RKDRLAAELG | LDPRQVAVWF | QNRRARWKNK | RLEE------ | -EYNKLKNSH | 115 |
| gi\|4006894 | RKDRLAAELG | LDPRQVAVWF | QNRRARWKNK | RLEE------ | -EYNKLKNSH | 124 |
| CeresClone:1440579 | RKVHLAAELG | LDPKQVAVWF | QNRRARHKSK | LLEE------ | -EFAKLKQAH | 128 |
| gi\|45593100 | RKVHLASELG | LDPKQVAVWF | QNRRARHKSK | LLEE------ | -EFSKLKHAH | 130 |
| gi\|50938719 | RKVHLASELG | LDPKQVAVWF | QNRRARHKSK | LLEE------ | -EFSKLKHAH | 130 |
| Lead-CeresClone729085 | RKVQLAAELG | LDTKQVAVWF | QNRXARYKSK | LIE------- | ---------- | 120 |
| CeresClone:901184 | RKVQLA---- | ---------- | ---------- | ---------- | ---------- | 92 |
| gi\|46242609 | RKVQLAAELG | LDAKQVAVWF | QNRRARHKSK | LMEE------ | -EFAKLRSAH | 114 |
| CeresClone:1565969 | RKVQLAAELG | LDAKQVAVWF | QNRRARHKSK | LMEE------ | -EXXSLRAAH | 116 |
| CeresClone:324157 | RKVQLAADLG | LDAKQVAVWF | QNRRARHKSK | LMEE------ | -EFSKLRAAH | 125 |
| Consensus | RKVQLAAELG | LDPKQVAVWF | QNRRARHKSK | LLEE------ | -EYSKLK-AH | 150 |

| | | | | | | |
|---|---|---|---|---|---|---|
| gi\|7415614 | EAVLQEKQEL | QDEMECLTEK | IQTAI PNSAD | PI LEKRKRI | SMSQPSSLKT | 196 |
| CeresClone:527229 | EATLLEKCCL | ESEVLKLKEQ | LSEA------ | --EKEI QRLL | ESAER----- | 152 |
| CeresClone:1351153 | DNVVVDKCRL | ESEVI QLKEQ | LYDA------ | --EREI QRLA | ERVE------ | 151 |
| gi\|4006894 | DNVVVDKCRL | ESEVI QLKEQ | LYDA------ | --EREI QRLA | ERVE------ | 160 |
| CeresClone:1440579 | DAAI LHKCHL | ENEVMRLKDK | LVLA------ | --EELTRFR | S-AGNHAVSG | 169 |
| gi\|45593100 | DAAI LHKCHL | ENEVLRLKER | LVVA------ | --EEEVRRLR | SAAGSHTASG | 172 |
| gi\|50938719 | DAAI LHKCHL | ENEVLRLKER | LVVA------ | --EEEVRRLR | SAAGSHTASG | 172 |
| Lead-CeresClone729085 | ---------- | ---------- | ---------- | ---------- | ---------- | 120 |
| CeresClone:901184 | ---------- | ---------- | ---------- | ---------- | ---------- | 92 |
| gi\|46242609 | DAVVLQNCHL | ETELLKLKER | LADV------ | --EEEKAKLA | AVAAATTGGG | 156 |
| CeresClone:1565969 | DAAVLHNCHL | ETEV------ | ---------- | ---------- | ---------- | 130 |
| CeresClone:324157 | DAVVLHNCHL | ETELLKMKDR | LAEV------ | --EEEKTKLV | AAAAAAAGGA | 167 |
| Consensus | DA-VL-KCHL | E-EVL-LKER | L--A------ | --EEEI QRL- | S-A------- | 200 |

```
gi|7415614               FEGPVKS--- -ERIAAEANG RNDALTPCKE EGS---KEEG SKETSSD---  236
CeresClone:527229        ---------- -VPSNSSSSS QSQSMEAVDP PFF---GEFG VDGYEDD---  185
CeresClone:1351153       ---------- -GGSSNSPIS SSVSVEANET PFF---GDYK VGDDGDDYDH  187
gi|4006894               ---------- -GGSSNSPIS SSVSVEANET PFF---GDYK VGDDGDDYDH  196
CeresClone:1440579       DGGDVMA--- -RAVCSGSPS SSFSTGTCQQ PGG---GGGG GDHLGDD-DL  211
gi|45593100              EGGDIMGLGG SGACVAGSPS SSFWTGTCQP PSF---G--G GDPFGDD-DL  216
gi|50938719              EGGDIMGLGG SGACVAGSPS SSFSTGTCQP PSF---G--G GDHLGDD-DL  216
Lead-CeresClone729085    ---------- ---------- ---------- ---------- ----------  120
CeresClone:901184        ---------- ---------- ---------- ---------- ----------  92
gi|46242609              GGG------- -GGGSSSPTS SSFSTVTYHP VLA---GQFG VEAAAEEADL  195
CeresClone:1565969       ---------- -VGQCTTPSR R--------- ---------- ----------  140
CeresClone:324157        A--------- -GAGSSSPSS SSFSTVTHHP AAALQVGQFG VEPEEAA-DL  206

Consensus                ---------- -G--SSS--S SS-S------ P-----G--G -----DD-D-  250

gi|7415614               -SISQVKYLT RTAFV---LW IAARFSHCPI V-----  263
CeresClone:527229        ----VF-YVP ETHYINGMEW INLYM----- ------  205
CeresClone:1351153       LFYP----VP ENSYIDEAEW MSLYI----- ------  208
gi|4006894               LFYP----VP ENSYIDEAEW MSLYI----- ------  217
CeresClone:1440579       LYVPDY-AYA DSSVV---EW FSLYGLM--- ------  234
gi|45593100              VYVPEYGGYA DNSVV---EW FSLYGLI--- ------  240
gi|50938719              VYVPEYGGYA DNSVV---EW FSLYGLI--- ------  240
Lead-CeresClone729085    ---------- ---------- ---------- ------  120
CeresClone:901184        ---------- ---------- ---------- ------  92
gi|46242609              TYMSE---YA YNSYMLELAA AGYCGGVYDQ FS----  224
CeresClone:1565969       ---------- ---------- ---------- ------  140
CeresClone:324157        AYMTE---YA YNSYMNMMDL APGYFGGVVY DYDHFN  239

Consensus                -YV-E----- -NSYV---EW -SLY------ ------  286
```

```
CeresClone:689576        --MASAACSC TD--GTWWVY ALPALLG--- ---------SD TLCAHPALLA 35
CeresClone:779234        -MAPSEKCGW LLYVSLAAKC CGNGDGK--- ---------- --PYRVVGFV 34
gi|2739008               MTSHIDDNLW II--ALTSKC TQENLAW--- ---------- --------VL 27
gi|20197777              MATKLESSLI F---ALLSKC SVLSQTN--- ---------- -----LAFSL 29
CeresClone:29661         MATKLDTSSL LL--ALLSKC SLLTQTN--- ---------- -----LALSL 30
CeresClone:1152303       --MSPEAYVL FF--NSFNLV TFEAFAS--- ---------- ---------- 23
gi|15222937              --MSPEAYVL FF--NSFNLV TFEAFAS--- ---------- ---------- 23
Lead-CeresClone627596    -MSSSELSSF FL--LR--LS DLLSFDV--- ---------- ---------- 22
gi|12325138              --MTIDMYLS FA--SRSGSS PFPSLEL--- ---------- ---------- 23
gi|5921925               ---MENRRSS GG--SGWWVC VLPLFTKDGP AYFLHSSSDD VSAWRQWPLY 45
gi|50916627              MDATLGASTT HG-----YLL LLPANST--- ---------- -------TFF 25
CeresClone:796158        ---------- ---------- ---------- ---------- ---------- 0
gi|50939101              -MALSSMAAA QE--SSLLLF LLPTSAA--- ---------- -------SVF 27

Consensus                ---------- ----S---L- -L-------- ---------- ---------- 50

CeresClone:689576        GLIFLATVSX XLLAWATSPG GPAWTNGRGR -------LGV TP----IVGP 74
CeresClone:779234        VVLLAAFVVI SLLHWAS-QG GAAWGRYWWR R------KGL GIGEARIPGP 77
gi|2739008               LIMGSLWLTM TFYYWSH-PG GPAWGKYYTY S------PPL SI----IPGP 66
gi|20197777              LAVTII WLAI SLFLWTY-PG GPAWGKYLFG RLISGSYKTG NV----IPGP 74
CeresClone:29661         LVASLASLAL SLFFWSH-PG GPAWGKYFLH RR-----RQT TV----IPGP 70
CeresClone:1152303       ----VSLIIA TVAFLLS-PG GLAWAWTGSS -------KSR VS----IPGP 57
gi|15222937              ----VSLIIA TVAFLLS-PG GLAWAWTGSS -------KSR VS----IPGP 57
Lead-CeresClone627596    -LLGVMFLVA VFGYWLV-PG GFAWAFSKFK ---------- PA----IPGP 56
gi|12325138              -CLSIFLFIS LFVFWLT-PG GFAWALYKAR FHTRPESKTG PA----IPGP 67
gi|5921925               IALLIVAVCA VLVSWLS-PG GCAWAGRHKR --------GR VA----IPGP 82
gi|50916627              SPLLAALLAV TSLLWLV-PG GPAWALSRCR R------P-- ------PPGA 60
CeresClone:796158        ---------- ---------- ---------- ---------- ---------- 0
gi|50939101              PPLISVVVLA ALLLWLS-PG GPAWALSRCR --------GT PP----PPGV 64

Consensus                --L-----I-- -L--WLS-PG G-AWA----R ---------- -----I PGP 100
```

```
CeresClone:689576      RGLPVFGSIF ALS-RGLPHR ALAEMARAAG PRAKELMAFS VGDTPAVVSS  123
CeresClone:779234      RGFPVIGSMG LMT-G-LAHR KLAAAAAGN- VRRRRLMSFS MGETRVVVTA  124
gi|2739008             KGFPLIGSMG LMT-SLAHHR IAAAAAT--- CRAKRLMAFS LGDTRVIVTC  112
gi|20197777            KGFPLVGSMS LMS-STLAHR RIADAAE-K- FGAKRLMAFS LGETRVIVTC  121
CeresClone:29661       RGLPFVGSMS LMS-NTLAHR CIAATAE-K- FRAERLMAFS LGETRVIVTC  117
CeresClone:1152303     SG-----SLS VFS-GSNPHR VLAALAK-R- FKASPLMAFS VGFSRFVISS  99
gi|15222937            SG-----SLS VFS-GSNPHR VLAALAK-R- FKASPLMAFS VGFSRFVISS  99
Lead-CeresClone627596  SGYPVVGLVW AFI-GPLTHR VLAKLAE-T- FDAKPLMAFS VGFTRFIISS  103
gi|12325138            SGLPIFGLLL AFVNNALTHR ILANIAD-T- CKAKALMAFS VGSTRFVITS  115
gi|5921925             KGWPIICSLM DMS-VGLPHR KLESLAR-L- HGAKQLMSFS LGCTPAVITS  129
gi|50916627            PG-----ALA ALA-GPAAHR ALAAMSRSV- PGGAALASFS VGLTRFVVAS  103
CeresClone:796158      ---------- ---------- ---------- ---------- ----------  0
gi|50939101            AG----GAAS ALS-GPAAHR VLAGLSRAV- EGGAAVMSLS VGLTRLVVAS  108

Consensus              -G-PI-GSM- -MS---L-HR -LA-LA---- -RAK-LMAFS VG-TR-VV-S  150

CeresClone:689576      CPATAREVLA HPSFADRPVK RSARELMFAR AIGFAPNGE- YWRRLRRVAS  172
CeresClone:779234      DPDVARELLA SPAFADRPVK ESAYGLMFHR AIGFAPYGA- YWRTLRRVSS  173
gi|2739008             HPDVAKEILN SSVFADRPVK ESAYSLMFNR AIGFASYGV- YWRSLRRIAS  161
gi|20197777            NPDVAKEILN SPVFADRPVK ESAYSLMFNR AIGFAPHGV- YWRTLRRIAS  170
CeresClone:29661       NPDVAKEILN SPVFADRPVK ESAYSLMFNR AIGFAPYGV- YWRTLRKIAS  166
CeresClone:1152303     EPETAKEILS SSAFADRPVK ESAYELLFHR AMGFAPYGE- YWRNLRRISS  148
gi|15222937            EPETAKEILS SSAFADRPVK ESAYELLFHR AMGFAPYGE- YWRNLRRISS  148
Lead-CeresClone627596  HPDTAKEILN SSAFADRPVK ESAYELLFHR AMGFAPYGE- YWRNLRRISA  152
gi|12325138            EPETAKELLN SSAFADRPVK ESAYELLFDR AMGFAPFGD- YWRELRRISS  164
gi|5921925             DPEVARELLT SPHFANRPLK QSAQQLLFGR AIGFAPNGG- YWRLLRRIAS  178
gi|50916627            RPDTARELLS SAAFADRPVK DAARGLLFHR AMGFAPSGD- YWRALRRVSA  152
CeresClone:796158      ---------- ---------- ---------- -MGFAPSGDA HWRALRRLAA  19
gi|50939101            RPETAREILV SPAFGDRPVK DAARQLLFHR AMGFAPSGDA HWRGLRRASA  158

Consensus              -PDTAKEIL- S-AFADRPVK ESAYELMF-R AMGFAP-G-- YWR-LRRISS  200
```

```
CeresClone:689576        THLFSPRRVA SHEPGRQGDA EAMLRSIAAE QSAX--GAVA LRPHLQAAAL  220
CeresClone:779234        SHLFSPRQVA ASAAQRAVIA HQMVDAMRPV GGAG-VKHVE ARRFLKRASL  222
gi|2739008               NHLFCPRQIK ASELQRSQIA AQMVHILNNK RHRS-----LR VRQVLKKASL  207
gi|20197777              NHLFSTKQIR RAETQRRVIS SQMVEFLEKQ SSNE---PCF VRELLKTASL  217
CeresClone:29661         NHLFSPKQIK RSETQRSVIA NQIVKCLTKQ SNTK--GLCF ARDLIKTASL  214
CeresClone:1152303       THLFSPRRIA SFEGVRVGIG MKMVKKIKSL VTSDACGEVE VKKIVHFGSL  198
gi|15222937              THLFSPRRIA SFEGVRVGIG MKMVKKIKSL VTSDACGEVE VKKIVHFGSL  198
Lead-CeresClone627596    THMFSPRRIA AQGVFRARIG AQMVRDIVGL MGRD--GVVE VRKVLHFGSL  200
gi|12325138              THLFSPKRIF SSGESRRKIG QNMVGEIKNA MECY--GEVH IKKILHFGSL  212
gi|5921925               AHLFAPRRIA AHEAGRQADV VAMLDDIQKE YHSK--GVVR VRRFLQGAAL  226
gi|50916627              NHLFTPRRVA ASAPRRLAIG ERMLDRLSAL AG----GEIG MRRVLHAASL  198
CeresClone:796158        AHLFGPRRVA ASAPHRSSIG TRMLGDVASL MARH--GEVA PRRFLHAASL  67
gi|50939101              AHLFGPRRVA GSAPEREAIG ARIVGDVASL MSRR--GEVP LRRVLHAASL  206

Consensus                -HLFSPRRIA ASE--R--IG -QMV--I-SL -SS---G-V- VR-ILH-ASL  250

CeresClone:689576        NNIMGSVFGI RYDVTSG-AG AAEAEHLKSM VREGFELLGA FNWSDHLPWL  269
CeresClone:779234        HNVMWSVFGR RYELDEA--G SGEAAELKSL VDEGYDLLGQ LNWSDHLPWL  270
gi|2739008               SNMMCSVFGQ EYKLHDP--- NSGMEDLGIL VDQGYDLLGL FNWADHLPFL  254
gi|20197777              NNMMCSVFGQ EYELEKN--- ---HVELREM VEEGYDLLGT LNWTDHLPWL  261
CeresClone:29661         NNMMCSVFGK EYELEEE--- HEEVSELREL VEEGYDLLGT LNWTDHLPWL  261
CeresClone:1152303       NNVMTTVFGE SYDFDEV--- NGKGCFLERL VSEGYELLGI FNWSDHFWFL  245
gi|15222937              NNVMTTVFGE SYDFDEV--- NGKGCFLERL VSEGYELLGI FNWSDHFWFL  245
Lead-CeresClone627596    NNVMKSVFGR SYVFGEG--- -GDGCELEGL VSEGYHLLGV FNWSDHFPLL  246
gi|12325138              NNVMSSVFGK TYNFNEGIVY SKESNELEHL VSEGYELLGI FNWSDHFPGM  262
gi|5921925               NNIMGSVFGR RFDMSHE--- NEEVKKLREM VDEGFQLLGA FNWADHLPWL  273
gi|50916627              DHVMDTVFGI RYDGDSQ--- --EGAELEAM VKEGYDLLGM FNWGDHLPLL  243
CeresClone:796158        NHVMAVVFGK RYDDFTS--- -QEGVVVEEM VNEGYDLLGT FNWADHLPFL  113
gi|50939101              GHVMATVFGK RHGDISI--- -QDGELLEEM VFEGYDLLGK FNWADHLPLL  252

Consensus                NNVM-SVFGK -YD-DE---- N-E--ELE-M V-EGYDLLG- FNWSDHLPWL  300
```

| | | |
|---|---|---|
| CeresClone:689576 | AHLYDPSNVT RRCAALVPRV QTFVRGVIDE HRRRRQNSAA LNDN------ | 313 |
| CeresClone:779234 | ARF-DLQKIR SRCSALVPRV NRFVGRIDE HRAALNDDDD AVV------- | 312 |
| gi\|2739008 | AHF-DAQNIR FRCSNLVPMV NRFVGTIAE HRASKTETNR ---------- | 293 |
| gi\|20197777 | SEF-DPQRLR SRCSTLVPKV NRFVSRISE HRNQTGDLPR ---------- | 300 |
| CeresClone:29661 | SEF-DPQRIR SRCSNLVPKV NRFVNRISD HREQTRDSPS ---------- | 300 |
| CeresClone:1152303 | RWF-DFQGVR KRCRALVSEV NTFVGGIEK HKMKKGNNLN GEEN------ | 288 |
| gi\|15222937 | RWF-DFQGVR KRCRALVSEV NTFVGGIEK HKMKKGNNLN GEEN------ | 288 |
| Lead-CeresClone627596 | GWL-DLQGVR KSCRSLVDRV NVYVGKILE HRVKRVAQGE DNKAIDTDSS | 295 |
| gi\|12325138 | RWL-DLQGVR RRCRSLVGRV NVFVGKIND HKSKRSLRDN PEESTYDD-- | 309 |
| gi\|5921925 | RPL-DPLRIH ARCARLVPRV TTFVSNIEQ HRREEQRRES GDQC------ | 316 |
| gi\|50916627 | KWL-DLQGVR RRCRTLVQRV DVFVRSIDE HRQRKRRTGG NGGG---EELP | 290 |
| CeresClone:796158 | KWL-DLQGVR RRCNRLVRQV EAYVGNIQE HKARRASGSG IADE-----LS | 158 |
| gi\|50939101 | RWL-DLQGIR RRCNRLVQKV EVFVGKIQE HKAKRAAGGV AVAD----GVL | 298 |
| Consensus | RWL-D-QGVR RRCS-LV--V N-FVG-II-E HR-K------ --E------- | 350 |

| | | |
|---|---|---|
| CeresClone:689576 | ADFVDXLLSL EGXEKLGDDD MVAILWEMVF RGTDTTTLLT EWCMAELVRH | 363 |
| CeresClone:779234 | -DFTDVLLSL QGSDKLSDAD MIAVLWEMIF RGTDTVAVVI EWVLARLMLH | 361 |
| gi\|2739008 | -DFVDVLLSL PEPDQLSDSD MIAVLWEMIF RGTDTVAVLI EWILARMALH | 342 |
| gi\|20197777 | -DFVDVLLSL HGSDKLSDPD IIAVLWEMIF RGTDTVAVLI EWILARMVLH | 349 |
| CeresClone:29661 | -DFVDVLLSL DGPDKLSDPD IIAVLWEMIF RGTDTVAVLI EWILARMVLH | 349 |
| CeresClone:1152303 | -DFVDVLLGL QKDEKLSDSD MIAVLWEMIF RGTDTVAILV EWVLARMVLH | 337 |
| gi\|15222937 | -DFVDVLLGL QKDEKLSDSD MIAVLWEMIF RGTDTVAILV EWVLARMVLH | 337 |
| Lead-CeresClone627596 | GDFVDVLLDL EKENRLNHSD MVAVLWEMIF RGTDTVAILL EWILARMVLH | 345 |
| gi\|12325138 | -DFVDVLLGM HGNSKLSDSD MIAVLWEMIF RGTDTVAILL EWILARMVLH | 358 |
| gi\|5921925 | -DFVDVLLSL QGEDKLDEED MIAVLWEMIF RGTDTTALLT EWTMAELVLH | 365 |
| gi\|50916627 | GDFVDVLLGL QGEEKMTESD MVAVLWEMIF RGTDTVAILL EWIMARMVLH | 340 |
| CeresClone:796158 | GDFVDVLLGL DGEDKMSESD MIAVLWEMIF RGTDTVAILM EWIMARMVLH | 208 |
| gi\|50939101 | GDFVDVLLDL QGEEKMSDSD MIAVLWEMIF RGTDTVAILM EWVMARMVMH | 348 |
| Consensus | -DFVDVLL-L -G-DKLSDSD MIAVLWEMIF RGTDTVAILI EWILARMVLH | 400 |

| | | | | | | |
|---|---|---|---|---|---|---|
| CeresClone:689576 | PAVXARVRXE | XDAAVG--AG | GCPTDADVAR | MPYLQAVVKE | TLRAHPPGPL | 411 |
| CeresClone:779234 | QDVQARVHEE | LDRVVG--PN | RAVTESDAAS | LVFLQAVVKE | VLRLHPPGPL | 409 |
| gi\|2739008 | PHVQSKVQEE | LDAVVG--KA | RAVAEDDVAV | MTYLPAVVKE | VLRLHPPGPL | 390 |
| gi\|20197777 | PDMQSTVQNE | LDQVVG--KS | RALDESDLAS | LPYLTAVVKE | VLRLHPPGPL | 397 |
| CeresClone:29661 | PDI QSTVHNE | LDQI VG--RS | RAVEESDVVS | LVYLTAVVKE | VLRLHPPGPL | 397 |
| CeresClone:1152303 | QDI QDKLYRE | I ASATSN-NI | RSLSDSDI PK | LPYLQAI VKE | TLRLHPPGPL | 386 |
| gi\|15222937 | QDI QDKLYRE | I ASATSN-NI | RSLSDSDI PK | LPYLQAI VKE | TLRLHPPGPL | 386 |
| Lead-CeresClone627596 | PEI QAKAQSE | I DSVVG--SG | RSVSDDDLPN | LPYVRAI VKE | TLRMHPPGPL | 393 |
| gi\|12325138 | PDI QAKAQAE | I DQ VGD-SG | RQVTDSDLPK | LPYVRAI VKE | TLRMHPPGPL | 407 |
| gi\|5921925 | PEAQKKAQAE | LDAVVG--HD | RSVKDSDI PK | LPYI QAVVKE | ALRMHPPGPL | 413 |
| gi\|50916627 | PDI QAKAQAE | LDAVVG--RG | RAVSDCDVAG | LRYLQCVVKE | ALRVHPPGPL | 388 |
| CeresClone:796158 | PEI QSKARAE | LDAVVG--RG | RAVMDEDVAR | LPYI QCI VKE | TLRMHPPGPL | 256 |
| gi\|50939101 | PEI QAKAQAE | VDAAVGGRRG | R-VADGDVAS | LPYI QSI VKE | TLRMHPPGPL | 397 |
| Consensus | PDI QAKVQ-E | LDAVVG---- | RAVSDSDVA- | LPYLQAVVKE | TLRMHPPGPL | 450 |

| | | | | | | |
|---|---|---|---|---|---|---|
| CeresClone:689576 | LSWARLATAD | VPLCNGMVVP | AGTTAMVNMW | AI THDAAVWA | DPDAFAPERF | 461 |
| CeresClone:779234 | LSWARLATSD | VHVD-GLHVP | AGTTAMVNMW | AI THDPTVWV | KPAEFKPERF | 458 |
| gi\|2739008 | LSWARLSI ND | TTI D-GYHVP | AGTTAMVNTW | AI CRDPHVWK | DPLEFMPERF | 439 |
| gi\|20197777 | LSWARLAI TD | TI VD-GRLVP | AGTTAMVNMW | AVSHDPHVWV | DPLEFKPERF | 446 |
| CeresClone:29661 | LSWARLAI TD | TI I D-GRRVP | AGTTAMVNMW | AI AHDPHVWE | NPLEFKPERF | 446 |
| CeresClone:1152303 | LSWARLAI HD | VHVG-PNLVP | AGTIAMVNMW | SI THNAKI WT | DPEAFMPERF | 435 |
| gi\|15222937 | LSWARLAI HD | VHVG-PNLVP | AGTIAMVNMW | SI THNAKI WT | DPEAFMPERF | 435 |
| Lead-CeresClone627596 | LSWARLSI HD | TQI G-NHFVP | AGTTAMVNMW | AI THDQEVWY | EPKQFKPERF | 442 |
| gi\|12325138 | LSWARLSI HD | TQI G-THFI P | AGTTAMVNMW | AI THDEKVWP | EAHEYKPERF | 456 |
| gi\|5921925 | LSWARLSTED | VNMGDGMCVP | AGTTAMVNMW | SI THDPNI WE | SPYEFRPERF | 463 |
| gi\|50916627 | LSWARLAVRD | AHVG-GHVVP | AGTTAMVNMW | AI AHDPELWP | EPDEFRPERF | 437 |
| CeresClone:796158 | LSWARLAVHD | AHVG-GHLVP | AGTTAMVNMW | AI AHDAAVWP | EPELFRPERF | 305 |
| gi\|50939101 | LSWARLAVHD | ARVG-GHAVP | AGTTAMVNMW | AI AHDAAVWP | EPDAFRPERF | 446 |
| Consensus | LSWARLAI -D | --VG-GH-VP | AGTTAMVNMW | AI THD--VW- | -P-EFKPERF | 500 |

```
CeresClone:689576      LP-------SG GGADVDVRGV DLRLAPFGAG ASRLPRQ--- ----------  492
CeresClone:779234      LGGSSSDHAA AGAEFSVIGS DLRLAPFGSG RRSCPGKSLA LATVGFWVAT  508
gi|2739008             VT-------AG GDAEFSILGS DPRLAPFGSG RRACPGKTLG WATVNFWVAS  483
gi|20197777            VA-------KE GEVEFSVLGS DLRLAPFGSG RRICPGKNLG FTTVMFMTAM  490
CeresClone:29661       VA-------KE GEVEFSVLGS DLRLAPFGSG RRVCPGKNLG LTTVIFMTAT  490
CeresClone:1152303     ---------- -SEDVSIMGS DLRLAPFGSG RRVCPGKAMG LATVHLWIGQ  475
gi|15222937            ---------- -SEDVSIMGS DLRLAPFGSG RRVCPGKAMG LATVHLWIGQ  475
Lead-CeresClone627596  L--------- KDEDVPIMGS DLRLAPFGSG RRVCPGKAMG LATVELWLAM  483
gi|12325138            LG-------AQ ESNNFPIMGS DLRLAPFGAG RRVCPGKSMG LATVELWLAQ  500
gi|5921925             VV-------FE GGEEVDVRGN DLRLAPFGAG RRVCPGKALG LATVNLWVAK  507
gi|50916627            A--------- -EEDVSVLGG DLRLAPFGAG RRACPGKTLA LATVHLWLAQ  477
CeresClone:796158      M--------- -EEEVSVLGS DLRLAPFGAG RRVCPGKMLA LATVHLWLAQ  345
gi|50939101            S--------- EGEDVGVLGG DLRLAPFGAG RRVCPGRMLA LATAHLWLAQ  487

Consensus              ---------- --E-VSVMGS DLRLAPFGSG RRVCPGK-LG LATVHLWIAQ  550

CeresClone:689576      --------EP GPHH------ ---------- RGPLGCPPRA RLPVGPA--   515
CeresClone:779234      LLHEFEWTPP SSDGSGGVDL SEVLRLSCEM AAPLEARLRP RRAV------  552
gi|2739008             LLHEFEW-VP SDEK--GVDL TEVLKLSSEM ANPLTVKVRP RRG-------  523
gi|20197777            MLHEFEW-GP SDGN--GVDL SEKLRLSCEM ANPLPAKLRR RRS-------  530
CeresClone:29661       LLHEFEWLTP SDEK--TVDL SEKLRLSCEM ANPLAAKLRP RRSFSV---   534
CeresClone:1152303     LIQNFEW-VK GSC---DVEL AEVLKLSMEM KNPLKCKAVP RNVGFA---   517
gi|15222937            LIQNFEW-VK GSC---DVEL AEVLKLSMEM KNPLKCKAVP RNVGFA---   517
Lead-CeresClone627596  FLQKFKW-MP CDDS--GVDL SECLKLSMEM KHSLKTKVVA RPVVSLAM-   528
gi|12325138            LLGSYKW-VS CGE----VDL SETLKLSLEM KNTLVCKAIP RG-------   537
gi|5921925             LLHHFEW-LP HAEH--PVDL SEVLKLSCEM ARPLHCVPVT RVPFAKFSD   553
gi|50916627            LLHRFEW-AP VGG---GVHL LERLNMSLEM EKPLVCKAKP RW-------   515
CeresClone:796158      LLHRFEW-AP ATAASGGVDL SERLKMSLEM ATPLVCRAVA R--------   385
gi|50939101            LLHAFDW-SP TAA---GVDL SERLGMSLEM AAPLVCKAVA RA-------   525

Consensus              LLH-FEW--P ------GVDL SE-LKLSLEM ANPL-CK-VP R--------   599
```

```
CeresClone:1063637      MASTCFRAAA RVASAAGRSA AATR------ ---SAPSAAR ---------A   32
CeresClone:639432       MASTCFRAAA RAATAACRSA ASR------- ---SMPSVGR ----------   30
CeresClone:1104229      MASACSRIAQ RTSISSIKSA IKSNRASSF  ---SKPASSS ----------   37
Lead-CeresClone264705   ---MASRFMS RSSISSLKSA IRSSFRNSPI GTGSSPAAAS FAGFRIPSKP   47
CeresClone:979674       MASACNRFMN RSSVSSLRSA IRSSLHKSPI GTGSSPSASS -AGFRIPSKP   49

Consensus               MAS-CSR-A- RSSISSLRSA IRSN---S-- ---SSPSA-S ----------   50

CeresClone:1063637      AAAAHRASSF SRMPVELGCC AGLSLLPLHS AVAAARLTSR LSTAS-SCRA   81
CeresClone:639432       -SAARRAPLI SRVPLELGCC AGMSLLPLHS AVAAARLTSR LSTASRSSSA   79
CeresClone:1104229      --SPLRQSLL TRISPELRCA Q--SMLPLHS AVAAARMTSC LSVTSRSCRA   83
Lead-CeresClone264705   AASPLPRFSF SRCPSELGCV Q--SLLPLHS TVAAARLTSC LSTTSRSSRA   95
CeresClone:979674       AASP--RFSF SRCPSELGCA Q--SLLPLHS TVAAARLTSC LSVTSRNSRA   95

Consensus               AASP-RR-SF SR-P-ELGC- Q--SLLPLHS AVAAARLTSC LSTTSRSSRA  100

CeresClone:1063637      LSQEMGLSVR R--    92
CeresClone:639432       LSQDENDDT- ---    88
CeresClone:1104229      LSQELGLSVP R--    94
Lead-CeresClone264705   LTQEMGLSVP R--   106
CeresClone:979674       LSQGTLCCTS PDL   108

Consensus               LSQEMGLSV- R--   113
```

```
Lead-CeresClone225597   -MEDLVSSPS FRSVLSSSSE GQAQSGESSW TDYFVDFMLS EEERKRQADA   49
CeresClone:839318       -MDDLVSSSS LKSVL-SCSE AEAQPEESSW TDYFVDFMMS EEEEKXQ---   45
gi|50937881             MRSAL ISCSS TSEDQQAAAA AQAQPEESTW TDYFVDFMMS EEEKKSQEDH   50

Consensus               -M-DLVSSSS --SVL-S-SE AQAQPEESSW TDYFVDFMMS EEE-K-Q-D-   50

Lead-CeresClone225597   SSYSYCAI ED EGGSKYGGDG SNRD-EEEEE EEESMVSDAA SHAPITAGAT   98
CeresClone:839318       -XASYCXF-- ---------- -----DQDDE EEGSMI SDAA SLAPAAL---   74
gi|50937881             GASSYCSHGG DG--VYGDCS DQKELEEEEG EEDSMI SDAA SCAPAAAAL-   97

Consensus               ---SYC---- -G---YG--- ------EEEEE EE-SMI SDAA S-APAAA---   100

Lead-CeresClone225597   ALI PAGRYKE LKKLKKKPFG KALDHDGSLE DTASSPVNSP KVSMVSQLEL   148
CeresClone:839318       -----ADRYKG LKKLKKKVF- KXLDHDDXLE DTAXSPVNSP KVSALSQLEF   119
gi|50937881             -----PDRYKE LKKLKKKVF- KALDHDDSLE DTASSPVNSP KVSALTQLEL   142

Consensus               -----ADRYKE LKKLKKKVF- KALDHDDSLE DTASSPVNSP KVSALSQLEL   150

Lead-CeresClone225597   SPKRRCNI RD LTKGVVGI GD DHGGEGMDVC TDATTTEGAR LGDQYHTSI A   198
CeresClone:839318       SPKIRCNVTD LAKG-AGI GN YYGRDGI DCE DAXAVMEGVR FXDQSQRGI T   168
gi|50937881             SPKRRCNTRD LTKE-VGI GD DRGREGMDYA D--AMVEGVR FVDQSQKSVT   189

Consensus               SPKRRCN-RD LTKG-VGI GD D-GREGMD-- D--A--EGVR F-DQSQ-SI T   200

Lead-CeresClone225597   PCAELKDKGI CLFPFSVLLH YHGPN   223
CeresClone:839318       PCAELKXKGL CLVXLSMLLN YQG--   191
gi|50937881             PCGELKDKGL CLFPLSMLLH YHG--   212

Consensus               PCAELKDKGL CLFPLSMLLH YHG--   225
```

```
CeresClone:537600          -------MSFL  EEFQANLDSL  PVILQKKYAL  LRDLDKSLHD  IQRQNEORCE   44
CeresClone:473923          -------MSFL  EEFHANLDSL  PVILRKKYTL  LRDLDKSLQD  IKRQNEORCE   44
Lead-CeresClone157730      MAIARTGVYV   DDYLE-----  ---LQRLLNT  VRELDERSQS  LINQTRQQTK   42
CeresClone:704991          MAIARTGVYV   DDYLEYSSTL  AGDLQRILST  MHELDERAHG  ILGQTKGQIK   50
gi|50918691                MAIARTGVYV   DDYLEYSSTL  AGDLQRILST  MRELDERAHG  IMGQTKEQIK   50

Consensus                  MAIARTGVYV   DDYLE----L  ---LQRLLST  -RELDERAH-  I--QT-QQ-K   50

CeresClone:537600          QEIEDIRRGV   RSGNIT----  -----PDTSVI RFSDEALDEQ  NHSIRVADEK   86
CeresClone:473923          QEIEDIKRGV   RSGNIT----  -----PDTSAI RFSDEALDEQ  KHSIRVADEK   86
Lead-CeresClone157730      YCLGLASQSS   KKGNGNHYNN  GGLDEEETIE  KMRKEIESSQ  ENALSLCTEK   92
CeresClone:704991          YLLGVPSHGF   DRPNVVH---  -----DENASE KMTRDIENSQ  DNALSLCTEK   93
gi|50918691                YLLGVPSHGF   DRSNMDD---  -----DESASE RMKKDIEASQ  DNALSLCTEK   93

Consensus                  Y-LGV-SRG-   RRGNI-----  ----DE--AE  RMSKEIE-SQ  DNALSLCTEK  100

CeresClone:537600          VALAVQAYDL   VDTHIQHLDQ  YLKRFGEEIR  RE------REN AAITGVPASG   131
CeresClone:473923          VALAVQAYDL   VDTNIQQLDQ  YLKKFDEEIR  RE------REN AAITGVPASG   131
Lead-CeresClone157730      VLLARQAYDL   IDSHVKRLDE  DLNNFAEDLK  QEGKIPPDEP  SVLPPLPIVP   142
CeresClone:704991          VLLARQAYDL   IESHIKRLDE  DLGQFAEDLK  QEGKIPPDEP  HILPPMPVGG   143
gi|50918691                VLLARQAYDL   IESHIKRLDE  DLGQFAEDLK  QEGKIPPDEP  SILPAISAFS   143

Consensus                  VLLARQAYDL   IDSHIKRLDE  DL-QFAEDLK  QEGKIPPDEP  -VLP-VPA-G   150

CeresClone:537600          SEGNTKSGRG   NESGTGRGGR  KK----TRQT  TVTPAATEAQ  ATANPTG---   174
CeresClone:473923          PEGNTKSGRG   NESGTGRGGR  KK----TRQT  TM---VTEAQ  ATSNPTG---   171
Lead-CeresClone157730      KAEKRKSFYG   TPQPKKIDYR  DRDW--DRDR  --DFELMPPP  G-SNRKDLMP   187
CeresClone:704991          RDERRRSSFS   TPQAARKFVR  EKEWDRDRER  GMDFDLMPPP  GSSNKKAVAS   193
gi|50918691                RDDKRRPGFS   TPQATKKF-R  EREW--DRER  GMDFDLMPPP  G-SNKKTTAP   189

Consensus                  R-EKRKSGYG   TPQ-TK---R  -KEW--DR-R  -MDFDLMPPP  GTSNKK----   200
```

```
CeresClone:537600          MDLELPVDPN EPTYCFCNQV SYGAMVACDN PNCK-I EWFH FGCVGL--KE    221
CeresClone:473923          MDLELPVDPN EPTYCFCNQV SYGAMVACDN PNCK-I EWFH FGCVGL--KE    218
Lead-CeresClone157730      I E-EQPI DPN EPTYCVCHQV SFGDMI ACDN ENCQGGEWFH YTCVGLTPET  236
CeresClone:704991          MDVDQMI DPN EPTYCI CHQV SYGDMI ACDN ENCEGGEWFH YSCVGLTPET  243
gi|50918691                MDVDQTI DPN EPTYCI CHQI SYGDMI ACDN DNVI -I I EFF PNELYI----  234

Consensus                  MD-EQPI DPN EPTYCI CHQV SYGDMI ACDN ENCK-I EWFH --CVGL----  250

CeresClone:537600          QPKGKWYCSN CAATKNRRRG K      242
CeresClone:473923          QPKGKWYCSN CAATKNRRRS K      239
Lead-CeresClone157730      RFKGKWYCPT CRLLPQSH-- -      254
CeresClone:704991          RFKGKWFCPT CRNLQ----- -      258
gi|50918691                ------SVEQ SGKLN----- -      243

Consensus                  --KGKWYC-- C--LK----- -      271
```

| | | | | | | |
|---|---|---|---|---|---|---|
| CeresClone:545212 | ---------- | ---------- | ---------- | ---------- | ---------- | 0 |
| CeresClone:325158 | ---------- | ---------- | ---------- | -MAASFRCSA | AA---RSYNI | 16 |
| CeresClone:279689 | MAAALQATPI | KTLATSRWRV | EGAEARPRPR | PI AVSFRCSA | AA---RSYNI | 47 |
| gi\|21592944 | MAAFLQ-TNI | RL----EI PG | RYSSLTDHKF | RAPYRI RCAA | ASPVKKRYNI | 46 |
| CeresClone:34420 | MAAFLQ-TNI | RL----EI PG | RYSSLTDHKF | RAPYRI RCAA | ASPVKKRYNI | 46 |
| gi\|15221631 | MAAFLQ-TNI | RL----EI PG | RYSSLTDHKF | RAPYRI RCAA | ASPVKKRYNI | 46 |
| gi\|4512615 | MAAFLQ-TNI | RL----EI PG | RYSSLTDHKF | RAPYRI RCAA | ASPVKKRYNI | 46 |
| CeresClone:95686 | ---------- | ---------- | ---------- | ---------- | ---------- | 0 |
| gi\|53749178 | MAAFLQ-TNI | SLNAI KI VPG | KYSSLTDHQF | RAPYRI RCAA | ASPGKKRYNI | 49 |
| gi\|18377879 | MAAFLQ-TNI | SLNAI KI VPG | KYSSLTDHQF | RAPYRI RCAA | ASPGKKRYNI | 49 |
| Lead-CeresClone152141 | MAAALQ-TNI | RT---VKVPA | TFRAVSKQSL | -APFRVRCAV | ASPGKKRYTI | 45 |
| CeresClone:1107090 | MAAALQ-TNI | RP---VKFPA | TLRALTKQSS | PAPFRVRCAA | ASPGKKRYNI | 46 |
| gi\|17827 | MAAALQ-TNI | RP---VKFPA | TLRALTKQSS | PAPFRVRCAA | ASPGKKRYNI | 46 |
| Consensus | MAA-LQ-TNI | R------I P- | -YSSLT---- | -APYRI RCAA | ASP-KKRYNI | 50 |

| | | | | | | |
|---|---|---|---|---|---|---|
| CeresClone:545212 | ---------- | ---------- | ---------- | -----ML MGG | AALDATGLPL | 15 |
| CeresClone:325158 | TLLPGDGI GP | EVVAVAKDVL | SLAGALEGVE | LRFQEKLVGG | SALDATGVPL | 66 |
| CeresClone:279689 | TLLPGDGI GP | EVVAVAKDVL | SFAGALEGVE | LRFQEKLVGG | SALDATGVPL | 97 |
| gi\|21592944 | TLLPGDGI GP | EVI SVAKNVL | QKAGFLQGLE | FDFQEMPFGG | AALDLVGVPL | 96 |
| CeresClone:34420 | TLLPGDGI GP | EVI SVAKNVL | QKAGFLQGLE | FDFQEMPFGG | AALDLVGVPL | 96 |
| gi\|15221631 | TLLPGDGI GP | EVI SVAKNVL | QKAGFLQGLE | FDFQEMPFGG | AALDLVGVPL | 96 |
| gi\|4512615 | TLLPGDGI GP | EVI SVAKNVL | QKAGFLQGLE | FDFQEMPFGG | AALDLVGVPL | 96 |
| CeresClone:95686 | ---------- | ---------- | ---------- | -----MPVGG | AALDLVGVPL | 15 |
| gi\|53749178 | ALLPGDGI GP | EVI SVAKNVL | QKAGSLEGLE | FDFKEMPVGG | AALDLVGVPL | 99 |
| gi\|18377879 | ALLPGDGI GP | EVI SVAKNVL | QKAGSLEGLE | FDFKEMPVGG | AALDLVGVPL | 99 |
| Lead-CeresClone152141 | TLLPGDGI GP | EVVSI AKNVL | QQAGSLEGVE | FNFREMPI GG | AALDLVGVPL | 95 |
| CeresClone:1107090 | TLLPGDGI GP | EVI SI AKNVL | QQAGSLEGLE | FSFQEMPVGG | AALDLVGVPL | 96 |
| gi\|17827 | TLLPGDGI GP | EVI SI AKNVL | QQAGSLEGLE | FSFQEMPVGG | AALDLVGVPL | 96 |
| Consensus | TLLPGDGI GP | EVI SVAKNVL | QKAGSLEGLE | F-FQEMPVGG | AALDLVGVPL | 100 |

```
CeresClone:545212        PHETLSAAKQ SHAVLLGAVG GYKWDRNDKH LKPETGLLQ  RKELGVFANL   65
CeresClone:325158        PDETLDAAKG SDAVLLGAIG GYKWDNNEKH LKPETGLLQL RAGLGVFANL  116
CeresClone:279689        PDETLDEAKG SDAVLLGAIG GYKWDTNEKH LKPETGLLQL RAGLGVFANL  147
gi|21592944              PEETSTAAKQ SDAILLGAIG GYKWDKNEKH LRPEMGLLNI RRDLNVFANL  146
CeresClone:34420         PEETSTAAKQ SDAILLGAIG GYKWDKNEKH LRPEMGLLNI RRDLNVFANL  146
gi|15221631              PEETSTAAKQ SDAILLGAIG GYKWDKNEKH LRPEMGLLNI RRDLNVFANL  146
gi|4512615               PEETSTAAKQ SDAILLGAIG GYKWDKNEKH LRPEMGLLNI RRDLNVFANL  146
CeresClone:95686         REETFTAAKL SDAILLGAIG GYKWDKNEKH LRPEMALFYL RRDLKVFANL   65
gi|53749178              PEETFTAAKL SDAILLGAIG GYKWDKNEKH LRPEMALFYL RRDLKVFANL  149
gi|18377879              PEETFTAAKL SDAILLGAIG GYKWDKNEKH LRPEMALFYL RRDLKVFANL  149
Lead-CeresClone152141    PEETISAAKE SDAVLLGAIG GYKWDNNEKH LRPEKGLLQI RAALKVFANL  145
CeresClone:1107090       PEETVSAAKE SDAVLLGAIG GYKWDKNEKH LKPETGLLQL RAGLKVFANL  146
gi|17827                 PEETVSAAKE SDAVLLGAIG GYKWDKNEKH LKPETGLLQL RAGLKVFANL  146

Consensus                PEET-TAAKQ SDAILLGAIG GYKWDKNEKH LRPEMGLL-L RRDL-VFANL  150

CeresClone:545212        RPATVYSPLV DASTLKREVA EGVDIMLIRE LTGGIYFGEP RGFGTNDNGE  115
CeresClone:325158        RPAAVLPQLV DASTLKKEVA EGVDIMVVRE LTGGIYFGKP RGFGTNDNGD  166
CeresClone:279689        RPAAVLPQLV DASTLKKEVA EGVDIMVVRE LTGGIYFGKP RGFGTNDKGD  197
gi|21592944              RPATVLPQLV DASTLKKEVA QGVDMMIVRE LTGGIYFGEP RGITINENGE  196
CeresClone:34420         RPATVLPQLV DASTLKKEVA QGVDMMIVRE LTGGIYFGEP RGITINENGE  196
gi|15221631              RPATVLPQLV DASTLKKEVA QGVDMMIVRE LTGGIYFGEP RGITINENGE  196
gi|4512615               RPATVLPQLV DASTLKKEVA QGVDMMIVRE LTGGIYFGEP RGITINENGE  196
CeresClone:95686         RPATVLPQLV DASTLKKEVA EGVDMMIVRE LTGGIYFGEP RGITINENGE  115
gi|53749178              RPATVLPQLV DASTLKKEVA EGVDMMIVRE LTGGIYFGEP RGITINENGE  199
gi|18377879              RPATVLPQLV DASTLKKEVA EGVDMMIVRE LTGGIYFGEP RGITINENGE  199
Lead-CeresClone152141    RPATVLPQLV DASTLKREVA EGVDLMVVRE LTGGIYFGEP RGIKTNENGE  195
CeresClone:1107090       RPATVLPQLV DASTLKREVA EGVDLMVVRE LTGGIYFGVP RGIKTNENGE  196
gi|17827                 RPATVLPQLV DASTLKREVA EGVDLMVVRE LTGGIYFGVP RGIKTNENGE  196

Consensus                RPATVLPQLV DASTLKKEVA EGVDMMIVRE LTGGIYFGEP RGITINENGE  200
```

| | | | | | | |
|---|---|---|---|---|---|---|
| CeresClone:545212 | EIGFNTEIYA | THEIDRIAHF | AFKVAQKRRR | KLCSVDKANV | LEASMLWRKR | 165 |
| CeresClone:325158 | DIGFNTEVYP | ASEIDRIARV | AFEVARKRRG | RLCSVDKANV | LEASMLWRKR | 216 |
| CeresClone:279689 | DIGFNTEVYS | ASEIDRIARV | AFEVARKRRG | KLCSVDKANV | LEASMLWRKK | 247 |
| gi\|21592944 | EVGFNTEIYA | AHEIDRIARV | AFETARKRRG | KLCSVDKANV | LDASILWRKR | 246 |
| CeresClone:34420 | EVGFNTEIYA | AHEIDRIARV | AFETARKRRG | KLCSVDKANV | LDASILWRKR | 246 |
| gi\|15221631 | EVGFNTEIYA | AHEIDRIARV | AFETARKRRG | KLCSVDKANV | LDASILWRKR | 246 |
| gi\|4512615 | EVGFNTEIYA | AHEIDRIARV | AFETARKRRG | KLCSVDKANV | LDASILWRKR | 246 |
| CeresClone:95686 | EVGVSTEIYA | AHEIDRIARV | AFETARKRRG | KLCSVDKANV | LDASILWRKR | 165 |
| gi\|53749178 | EVGVSTEIYA | AHEIDRIARV | AFETARKRRG | KLCSVDKANV | LDASILWRKR | 249 |
| gi\|18377879 | EVGVSTEIYA | AHEIDRIARV | AFETARKRRG | KLCSVDKANV | LDASILWRKR | 249 |
| Lead-CeresClone152141 | EVGFNTEVY- | AHEIDRIARV | AFETARKRRG | KLCSVDKANV | LEASILWRKR | 244 |
| CeresClone:1107090 | EVGYNTEVYA | AHEIDRIARV | AFETARKRRG | KLCSVDKANV | LDASILWRRR | 246 |
| gi\|17827 | EVGYNTEVYA | AHEIDRIARV | AFETARKRRG | KLCSVDKANV | LDASILWRRR | 246 |
| Consensus | EVGFNTEIYA | AHEIDRIARV | AFETARKRRG | KLCSVDKANV | LDASILWRKR | 250 |

| | | | | | | |
|---|---|---|---|---|---|---|
| CeresClone:545212 | FLAIAQEYPD | VELSHMYVDN | ASMQLIRDPK | QFDTMVTNNI | FGDILSDEAS | 215 |
| CeresClone:325158 | VTALASEFPD | ELSHMYVDN | AAMQLVRNPK | QFDTIVTNNI | FGDILSDEAS | 266 |
| CeresClone:279689 | VTALASEFPD | ELSHMYVDN | AAMQLVRNPK | QFDTIVTNNI | FGDILSDEAS | 297 |
| gi\|21592944 | VTALASEYPD | VELSHMYVDN | XAMQLVRDPK | QFDTIVTNNI | FGDILSDEAS | 296 |
| CeresClone:34420 | VTALASEYPD | VELSHMYVDN | AAMQLVRDPK | QFDTIVTNNI | FGDILSDEAS | 296 |
| gi\|15221631 | VTALASEYPD | VELSHMYVDN | AAMQLVRDPK | QFDTIVTNNI | FGDILSDEAS | 296 |
| gi\|4512615 | VTALASEYPD | VELSHMYVDN | AAMQLVRDPK | QFDTIVTNNI | FGDILSDEAS | 296 |
| CeresClone:95686 | VTALASEYPD | VELSHMYVDN | AAMQLIRDPK | QFDTIVTNNI | FGDILSDEAS | 215 |
| gi\|53749178 | VTALASEYPD | VELSHMYVDN | AAMQLIRDPK | QFDTIVTNNI | FGDILSDEAS | 299 |
| gi\|18377879 | VAALASEYPD | VELSHMYVDN | AAMQLIRDPK | QFDTIVTNNI | FGDILSDEAS | 299 |
| Lead-CeresClone152141 | VTALASEYPD | VELSHMYVDN | AAMQLVRDPK | QFDTIVTNNI | FGDILSDEAS | 294 |
| CeresClone:1107090 | VTALAAEYPD | VELSHMYVDN | AAMQLVRDPK | QFDTIVTNNI | FGDILSDEAS | 296 |
| gi\|17827 | VTALAAEYPD | VELSHMYVDN | AAMQLVRDPK | QFDTIVTNNI | FGDILSDEAS | 296 |
| Consensus | VTALASEYPD | VELSHMYVDN | AAMQLVRDPK | QFDTIVTNNI | FGDILSDEAS | 300 |

| | | | | | | |
|---|---|---|---|---|---|---|
| CeresClone:545212 | MVTGSI GMLP | SASLGASGPG | LFEPXHGSAP | DI AGQDKANP | FATVLSAAML | 265 |
| CeresClone:325158 | MI TGSI GMLP | SASVGESGPG | LFEPI HGSAP | DI AGQDKANP | LATI LSAAML | 316 |
| CeresClone:279689 | MI TGSI GMLP | SASVGESGPG | LFEPI HGSAP | DI AGQDKANP | LATI LSAAML | 347 |
| gi\|21592944 | MI TGSI GMLP | SASLGESGPG | LFEPI HGSAP | DI AGQDKANP | LATI LSAAML | 346 |
| CeresClone:34420 | MI TGSI GMLP | SASLGESGPG | LFEPI HGSAP | DI AGQDKANP | LATI LSAAML | 346 |
| gi\|15221631 | MI TGSI GMLP | SASLGESGPG | LFEPI HGSAP | DI AGQDKANP | LATI LSAAML | 346 |
| gi\|4512615 | MI TGSI GMLP | SASLGESGPG | LFEPI HGSAP | DI AGQDKANP | LATI LSAAML | 346 |
| CeresClone:95686 | MI TGSI GMLP | SASLGESGPG | LFEPI HGSAP | DI AGQDKANP | LATI LSAAML | 265 |
| gi\|53749178 | MI TGSI GMLP | SASLGESGPG | LFEPI HGSAP | DI AGQDKANP | LATI LSAAML | 349 |
| gi\|18377879 | MI TGSI GMLP | SASLGESGPG | LFEPI HGSAP | DI AGQDKANP | LATI LSAAML | 349 |
| Lead-CeresClone152141 | MI TGSI GMLP | SASLSDSGPG | LFEPI HGSAP | DI AGQDKANP | LATI LSAAML | 344 |
| CeresClone:1107090 | MI TGSI GMLP | SASLSDSGPG | LFEPI HGSAP | DI AGQDKANP | LATI LSAAML | 346 |
| gi\|17827 | MI TGSI GMLP | SASLSDSGPG | LFEPI HGSAP | DI AGQDKANP | LATI LSAAML | 346 |
| Consensus | MI TGSI GMLP | SASLGESGPG | LFEPI HGSAP | DI AGQDKANP | LATI LSAAML | 350 |

| | | | | | | |
|---|---|---|---|---|---|---|
| CeresClone:545212 | LRYGLGEEKA | AERI ENAVMD | TLNRGFRTGD | IYSAGT--KL | VGCKQLGEEI | 313 |
| CeresClone:325158 | LRYGLGEENA | ANRI EAAVTE | TLNHGFRTGD | IYSPGT--TL | VGCKRMGEEV | 364 |
| CeresClone:279689 | LRYGLGEENA | ARRI EAAVTE | TLNHGFRTGD | IYSPGT--TL | VGCKRMGEEV | 395 |
| gi\|21592944 | LKYGLGEEKA | AKMI EDAVVD | ALNKGFRTGD | IYSPGN--KL | VGCKEMGEEV | 394 |
| CeresClone:34420 | LKYGLGEEKA | AKMI EDAVVD | ALNKGFRTGD | IYSPGN--KL | VGCKEMGEEV | 394 |
| gi\|15221631 | LKYGLGEEKA | AKMI EDAVVD | ALNKGFRTGD | IYSPGN--KL | VGCKEMGEEV | 394 |
| gi\|4512615 | LKYGLGEEKA | AKMI EDAVVD | ALNKGFRTGD | IYSPGNVCKL | VGCKEMGEEV | 396 |
| CeresClone:95686 | LKYGLGEEKA | AKRI EDAVVD | ALNKGFRTGD | IYSPGN--KL | VGCKEMGEEV | 313 |
| gi\|53749178 | LKYGLGEEKA | AKRI EDAVVD | ALNKGFRTGD | IYSPGN--KL | VGCKEMGEEV | 397 |
| gi\|18377879 | LKYGLGEEKA | AKRI EDAVVD | ALNKGFRTGD | IYSPGN--KL | VGCKEMGEEV | 397 |
| Lead-CeresClone152141 | LKYGLGEEKA | AKRI EDAVLV | ALNNGFRTGD | IYSAGT--KL | VGCKEMGEEV | 392 |
| CeresClone:1107090 | LKYGLGEEKA | AKRI EDAVLG | ALNKGFRTGD | IYSAGT--KL | VGCKEMGEEV | 394 |
| gi\|17827 | LKYGLGEEKA | AKRI EDAVLG | ALNKGFRTGD | IYSAGT--KL | VGCKEMGEEV | 394 |
| Consensus | LKYGLGEEKA | AKRI EDAVVD | ALNKGFRTGD | IYSPGN--KL | VGCKEMGEEV | 400 |

| | | |
|---|---|---|
| CeresClone:545212 | LKSVES--NV PAGAAAV | 328 |
| CeresClone:325158 | LKTVNSLKEV AAVN--- | 378 |
| CeresClone:279689 | LKTVESLKEV AAVN--- | 409 |
| gi\|21592944 | LKSVDS--KV PV----- | 404 |
| CeresClone:34420 | LKSVDS--KV PV----- | 404 |
| gi\|15221631 | LKSVDS--KV PV----- | 404 |
| gi\|4512615 | LKSVDS--KV PV----- | 406 |
| CeresClone:95686 | LKSVES--KV PATV--- | 325 |
| gi\|53749178 | LKSVES--KV PATV--- | 409 |
| gi\|18377879 | LKSVES--KV PATV--- | 409 |
| Lead-CeresClone152141 | LKSVDS--QV PASV--- | 404 |
| CeresClone:1107090 | LKSVDS--HV QASV--- | 406 |
| gi\|17827 | LKSVDS--HV QASV--- | 406 |
| Consensus | LKSVDS--KV PA----- | 417 |

```
gi|50947311                 MSAPSDPAVA THPQAGAAAA ASSSSGLTFK LHPLVI VNVS DHHTRVKAQ-   49
CeresClone:328761           MSAPSDAAVA AAAPASTTTA AASSGGLTFK LHPLVI VNVS DHHTRVKAQ-   49
Lead-CeresClone150912       ---------- --------MA PSSSSGLTFK LHPLVI VNI S DHYTRVKTQL   32
gi|17940314                 ---------- --------MA PSSSSGLTFK LHPLVMLNI S DHFTRVKTQL   32
CeresClone:36616            ---------- ---------- ---------- -----MLNI S DHFTRVKTQL   15

Consensus                   ---------- ---------A -SSSSGLTFK LHPLVI VNI S DH-TRVKTQL   50

gi|50947311                 ---AACSGDG ASS---AAAG GQPPRVFGCV I GVQRGRTVE I FNSFELVLD   93
CeresClone:328761           ---AACSGDS SSPSSSAPGA GQPPRVFGCV I GVQRGRTVE I FNSFELVLD   96
Lead-CeresClone150912       NPPASI CASG HGSNNGEAMF QQNPRVYGCV I GVQRGRTVE I FNSFELLYD   82
gi|17940314                 NPPAASCATG NGSNNADAML LQNPRVYGCV I GLQRGRTVE I FNSFELI FD   82
CeresClone:36616            NPPAASCATG NGSNNADAML LQNPRVYGCV I GLQRGRTVE I FNSFELI FD   65

Consensus                   NPPAA-CATG NGSNNADAM- -QNPRVYGCV I GVQRGRTVE I FNSFEL-FD  100

gi|50947311                 PVSGTLDRAF LEKKQELYKK VFPDFYVLGW YSTGSDVRDT DMQ HKALMD  143
CeresClone:328761           PVSGTLDRAF LDKKQELYKK VFPDFYVLGW YSTGSDVHDT DML HKSLMD  146
Lead-CeresClone150912       PSTQTLDRSF LEKKQELYKK VFPDFYI LGW YSTGSDAEES DMHI HKALMD  132
gi|17940314                 PALDTLDRSF LEKKQELYKK VFPDFYVLGW YSTGSDATES DMHI HKALMD  132
CeresClone:36616            PALDTLDRSF LEKKQELYKK VFPDFYVLGW YSTGSDATES DMHI HKALMD  115

Consensus                   PAS-TLDRSF LEKKQELYKK VFPDFYVLGW YSTGSDA-ES DMHI HKALMD  150

gi|50947311                 I NESPVYLLL NPAI NLSQKD LPVTI YESEL HVI DGSPQLI FVRANYTI ET  193
CeresClone:328761           I NESPVYLLL NPTI NLSQKD LPVTI YESEL HVI DGI PQLI FVRSNYTI ET  196
Lead-CeresClone150912       I NESPVYVLL NPAI NHTQKD LPVTI YESEL HVI DGI PQLI FAHTSYTI ET  182
gi|17940314                 I NESPVYVLL NPAI NHAQKD LPVTI YESEF HVI DGI PQSI FVHTSYTI ET  182
CeresClone:36616            I NESPVYVLL NPAI NHAQKD LPVTI YESEF HVI DGI PQSI FVHTSYTI ET  165

Consensus                   I NESPVYVLL NPAI NH-QKD LPVTI YESEL HVI DGI PQLI FVHTNYTI ET  200
```

| | | | | | | |
|---|---|---|---|---|---|---|
| gi\|50947311 | VEAERI SVDH | VAHLKPSDGG | SAATQLAAHL | TGI HSAI KML | NSRVRVI HQY | 243 |
| CeresClone:328761 | VEAERI SVDH | VAHLKPSDGG | SAATQLAAHL | TGI HSAI KML | NSRVRVI HQY | 246 |
| Lead-CeresClone150912 | VEAERI SVDH | VAHLKPSDGG | SAATQLAAHL | TGI HSAI KML | NSRI RVLYQN | 232 |
| gi\|17940314 | VEAERI SVDH | VAHLKPSDGG | SAATQVAAHL | TGI HSAI KML | NSRI RVLYQH | 232 |
| CeresClone:36616 | VEAERI SVDH | VAHLKPSDGG | SAATQLAAHL | TGI HSAI KML | NSRI RVLYQH | 215 |
| Consensus | VEAERI SVDH | VAHLKPSDGG | SAATQLAAHL | TGI HSAI KML | NSRI RVLYQ- | 250 |

| | | | | | | |
|---|---|---|---|---|---|---|
| gi\|50947311 | LVSMQKG-DM | PLDNSLLRQV | SSLVRRLPAM | ESEKFQDDFL | MEYNDTLLMT | 292 |
| CeresClone:328761 | LVAMQKG-DL | PLDNSLLRQV | SSLVRRLPAM | ESQKFQDDFL | MEYNDTLLMT | 295 |
| Lead-CeresClone150912 | LAAMQKG-DK | SCDNSVLRQV | SSLLRRLPAM | ESERFQDNFL | MEYNDKLLI T | 281 |
| gi\|17940314 | I VAMQKGCDK | PCENSVLRQV | SSLLRSLPAA | ESEKFNENFL | MEYNDKLLMS | 282 |
| CeresClone:36616 | I VAMQKG-DK | PCENSVLRQV | SSLLRSLPAA | ESEKFNENFL | MEYNDKLLMS | 264 |
| Consensus | LVAMQKG-DK | PCDNSVLRQV | SSLLRRLPAM | ESEKFQDNFL | MEYNDKLLMT | 300 |

| | | | | | |
|---|---|---|---|---|---|
| gi\|50947311 | YLAMFTNCSS | TMNELVEKFN | ATYERSTARR | GGRGAFM | 329 |
| CeresClone:328761 | YLAMVTKCSS | TMNELVEK N | TSYERTTSRR | GGRGAFM | 332 |
| Lead-CeresClone150912 | YLAMI TNCSS | NMNEMVDKFN | TAYDRNT-RR | GGRTAFM | 317 |
| gi\|17940314 | YLAMI TNCTS | NMNEVVDKFN | TAYDKHS-RR | GGRTAFM | 318 |
| CeresClone:36616 | YLAMI TNCTS | NMNEVVDKFN | TAYDKHS-RR | GGRTAFM | 300 |
| Consensus | YLAMI TNCSS | NMNE-VDKFN | TAYDR-T-RR | GGRTAFM | 337 |

| | | | | | | | |
|---|---|---|---|---|---|---|---|
| CeresClone:687467 | MSDSEEHHFE | SKADAGASKT | YPQQAGTVRK | NGFI VI KNRP | CKVVEVSTSK | 50 |
| CeresClone:388126 | MSDSEEHHFE | SKADAGASKT | YPQQAGTVRK | NGFI VI KNRP | CKVVEVSTSK | 50 |
| CeresClone:939972 | MSDSEEHHFE | SKADAGASKT | YPQQAGTVRK | NGFI VI KNRP | CKVVEVSTSK | 50 |
| CeresClone:1289769 | MSDSEEHHFE | SKADAGASKT | YPQQAGTVRK | NGFI VI KNRP | CKVVEVSTSK | 50 |
| CeresClone:1389175 | MSD-EEHHFE | S-SDAGASKT | YPQQAGNI RK | GGHI VI KGRP | CKVVEVSTSK | 48 |
| Lead-CeresClone118337 | MSD-DEHHFE | A-SESGASKT | YPQSAGNI RK | GGHI VI KNRP | CKVVEVSTSK | 48 |
| CeresClone:1075190 | MSETDEHHFE | SKADSGASKT | YPQQAGAI RK | GGHI VI KARP | CKVVEVSTSK | 50 |
| CeresClone:1488709 | MSDTDEHHFE | SKADSGASKT | YPQQAGAI RK | GGHI VI KARP | CKVVEVSTSK | 50 |
| CeresClone:1069165 | MSDTDEHHFE | SKADSGASKT | YPQQAGAI RK | GGHI VI KARP | CKVVEVSTSK | 50 |
| CeresClone:567871 | MSDTDEHHFE | SKADSGASKT | YPQQAGAI RK | GGHI VI KARP | CKVVEVSTSK | 50 |
| CeresClone:743658 | MSDTDEHHFE | SKADSGASKT | YPQQAGAI RK | GGHI VI KARP | CKVVEVSTSK | 50 |
| CeresClone:1326914 | MSDTDEHHFE | SKADSGASKT | YPQQAGAI RK | GGHI VI KARP | CKVVEVSTSK | 50 |
| Consensus | MSDTDEHHFE | SKADSGASKT | YPQQAGAI RK | GGHI VI KARP | CKVVEVSTSK | 50 |

| | | | | | | | |
|---|---|---|---|---|---|---|---|
| CeresClone:687467 | TGKHGHAKSP | FGAI NI FNGK | KLEDI GPSSP | NCDI PHVNRT | EYQLI DI SED | 100 |
| CeresClone:388126 | TGKHGHAKCH | FVAI DI FNGK | KLEDI VPSSH | NCDI PHVNRT | EYQLI DI SED | 100 |
| CeresClone:939972 | TGKHGHAKCH | FVAI DI FNGK | KLEDI VPSSH | NCDI PHVNRT | EYQLI DI SED | 100 |
| CeresClone:1289769 | TGKHGHAKCH | FVAI DI FNGK | KLEDI VPSSH | NCDI PHVNRT | EYQLI DI SED | 100 |
| CeresClone:1389175 | TGKHGHAKCH | FVAI DI FTAK | KLEDI VPSSH | NCDVPHVNR | DYQLI DI SED | 98 |
| Lead-CeresClone118337 | TGKHGHAKCH | FVAI DI FTAK | KLEDI VPSSH | NCDVPHVNRV | DYQLI DI TED | 98 |
| CeresClone:1075190 | TGKHGHAKCH | FVAI DI FNGK | KLEDI VPSSH | NCDVPHVDRQ | DYQLI DI TDD | 100 |
| CeresClone:1488709 | TGKHGHAKCH | FVAI DI FNGK | KLEDI VPSSH | NCDVPHVDRQ | DYQLI DI TDD | 100 |
| CeresClone:1069165 | TGKHGHAKCH | FVAI DI FNGK | KLEDI VPSSH | NCDVPHVDRQ | DYQLI DI TDD | 100 |
| CeresClone:567871 | TGKHGHAKCH | FVAI DI FNGK | KLEDI VPSSH | NCDVPHVDRQ | DYQLI DI TDD | 100 |
| CeresClone:743658 | TGKHGHAKCH | FVAI DI FNGK | KLEDI VPSSH | NCDVPHVDRQ | DYQLI DI TDD | 100 |
| CeresClone:1326914 | TGKHGHAKCH | FVAI DI FNGK | KLEDI VPSSH | NCDVPHVDRQ | DYQLI DI TDD | 100 |
| Consensus | TGKHGHAKCH | FVAI DI FNGK | KLEDI VPSSH | NCDVPHV-RQ | DYQLI DI T-D | 100 |

```
CeresClone:687467         GFVSLLTSDG NTKDDLRLPT DETLXAQIKE GFES------ ---------- 134
CeresClone:388126         GFVSLLTSDG NTKDDLRLPT DETLVAAACS CHLPF----- ---------- 135
CeresClone:939972         GFVSLLTSDG NTKDDLRLPT DETLVAQ--- ---------- ---------- 127
CeresClone:1289769        GFVSLLTSDG NTKDDLRLPT DETLVAQIKE GFESGKDLVV TVOSAMGEEQ 150
CeresClone:1389175        GFVSLLTDSG GTKDDLKXXX DDSLSALMKS GFEEGKDVXV SVMSSMGEEQ 148
Lead-CeresClone118337     GFVSLLTDSG GTKDDLKLPT DDGLTAQL-L CFVNAHEAWI R--------- 138
CeresClone:1075190        GYVSLLTESG NTKDDXEAST DDVLLGQIKT GFAXGKDL-- ---------- 138
CeresClone:1488709        GYVSLLTESG NTKDDLKLPT DXXLLGQIKT GFADGKDL I SVMSAMGEEQ 150
CeresClone:1069165        GYVSLLTESG XTKDDLKLPT DDV------- ---------- ---------- 123
CeresClone:567871         GYVSLLTESG NTKDDLKLPT DDVLLGQIKT GFADGKDL I SVMSAMGEEQ 150
CeresClone:743658         GYVSLLTESG NTKDDLKLPT DDVLLGQIKT GFADGKDL I SGCPPG---- 146
CeresClone:1326914        GYVSLLTESG NTKDDLKLPT DDVLL----- ---------- ---------- 125

Consensus                 G-VSLLTESG NTKDDLKLPT DD-LLAQIKT GF--GKDL-I ---------- 150


CeresClone:687467         ---------- -  134
CeresClone:388126         ---------- -  135
CeresClone:939972         ---------- -  127
CeresClone:1289769        ICALKDVGPK -  160
CeresClone:1389175        ICAVKG---- -  154
Lead-CeresClone118337     ---------- -  138
CeresClone:1075190        ---------- -  138
CeresClone:1488709        ICAVK----- -  155
CeresClone:1069165        ---------- -  123
CeresClone:567871         ICAVKEIGGG K  161
CeresClone:743658         ---------- -  146
CeresClone:1326914        ---------- -  125

Consensus                 ---------- -  161
```

| | | | | | | |
|---|---|---|---|---|---|---|
| CeresClone:1389544 | -MSWSAPDDI | LLSTSLAGFL | D--------- | ---------- | ----TNVVLQ | 26 |
| CeresClone:218224 | -MSWSAPDDI | LLSTSLAGFL | DKKLIVLLRD | GRKLLGTLCS | FDQFANVVLQ | 49 |
| CeresClone:1283561 | -MSWSAPDDI | LLSTSLAGFL | DKKLIVLLRD | GRKLLGTLCS | FDQFANVVLQ | 49 |
| CeresClone:1273479 | -MSWSAPDDI | LLSTSLAGFL | DKKLIVLLRD | GRKLLGTLCS | FDQFANVVLQ | 49 |
| CeresClone:639565 | -MSWAGPDEI | LLSTSLAGFL | DKKLIVLLRD | GRKLLGTLCS | FDQFANVVLQ | 49 |
| gi\|50924582 | MSSWAGPDEI | FLSTSLAGFL | DKKLIVLLRD | GRKLLGTLCS | FDQFANVVLQ | 50 |
| CeresClone:716576 | -M-------- | ---------- | ---------- | -----GTLRS | FDQFANAVLE | 16 |
| CeresClone:952177 | -MSWAGPEDM | YLSTSLASYL | DRKILVLLRD | GRKLMGTLRS | FDQFANAVLE | 49 |
| CeresClone:968213 | -M-------- | ---------- | ---------- | -----GTLRS | FDQFANAVLE | 16 |
| Lead-CeresClone117369 | -MSWAGPEEI | YLSTSLASYL | DRKLLVLLRD | GRKLMGTLRS | FDQFANAVLE | 49 |
| Consensus | -MSW--PDDI | LLSTSLAGFL | DKKLIVLLRD | GRKLLGTLCS | FDQFANVVLQ | 50 |
| CeresClone:1389544 | GACERVIVGE | QYCDVPLGLY | VIRGENVVLI | GEL------- | DREKDELPAH | 69 |
| CeresClone:218224 | GACERVIVGE | QYCDVPLGLY | VIRGENVVLI | GEL------- | DREKDELPAH | 92 |
| CeresClone:1283561 | GACERVIVGE | QYCDVPLGLY | VIRGENVVLI | GEL------- | DREKDELPAH | 92 |
| CeresClone:1273479 | GACERVIVGG | QYCDVPLGLY | VIRGENVVLI | GEL------- | DHEKDELPAH | 92 |
| CeresClone:639565 | GACERVIVGE | LYCDVPFGLY | VIRGENVVLI | GEL------- | DREKDELPSH | 92 |
| gi\|50924582 | GACERVIVGE | LYCDVPLGLY | VIRGENVVLI | GELVWFWIEQ | DREKDELPAH | 100 |
| CeresClone:716576 | GACERVIXGD | LYCDIPLGLY | VIRGENVVLI | GEL------- | DLEREELPEH | 59 |
| CeresClone:952177 | GACERVIVGE | QYCDIPLGLY | VIRGENVVLI | GDL------- | DXEREELPPH | 92 |
| CeresClone:968213 | GACERVIVGE | QYCDIPLGLY | VIXGENVVLI | GEM------- | DTEREELPPH | 59 |
| Lead-CeresClone117369 | GACERVIVGE | QYCDIPLGLY | VIRGENVVLI | GEL------- | DTEREELPPH | 92 |
| Consensus | GACERVIVGE | QYCDVPLGLY | VIRGENVVLI | GEL------- | DREKDELPAH | 100 |
| CeresClone:1389544 | MTCVSEAEIR | KAEKAEREXR | DLKGTMRKRM | EFLDXD | | 105 |
| CeresClone:218224 | MTCVSEAEIR | KAEKAEREAR | DLKGTMRKRM | EFLDFD | | 128 |
| CeresClone:1283561 | MTCVSEAEIR | KAEKAEREAR | DLKGTMRKRM | EFLDFD | | 128 |
| CeresClone:1273479 | MTCVLEAEIR | KAEKAEREAR | DLKGTMRKRM | EFLDFD | | 128 |
| CeresClone:639565 | MTCVSEAEIR | TAEKAEKEAR | DLKGTMRKRM | EFLDFD | | 128 |
| gi\|50924582 | MTCVSEAEIR | KAEKAEREAR | DLKGSMRKRM | EFLDFD | | 136 |
| CeresClone:716576 | MTRVSTAEIK | RAQKAEREAS | DLKGTMRKRM | EFLDFD | | 95 |
| CeresClone:952177 | M RVSETEIK | RAQKVEREAS | ELRGTMRKRM | EFLDFD | | 128 |
| CeresClone:968213 | M RVSETEIK | RAQKVEREAS | ELRGTMRKRM | EFLDFD | | 95 |
| Lead-CeresClone117369 | M RVSEAEIK | RAQKVEREAG | ELRGTMRKRM | EFLDFD | | 128 |
| Consensus | MTCVSEAEIR | KAEKAEREAR | DLKGTMRKRM | EFLDFD | | 136 |

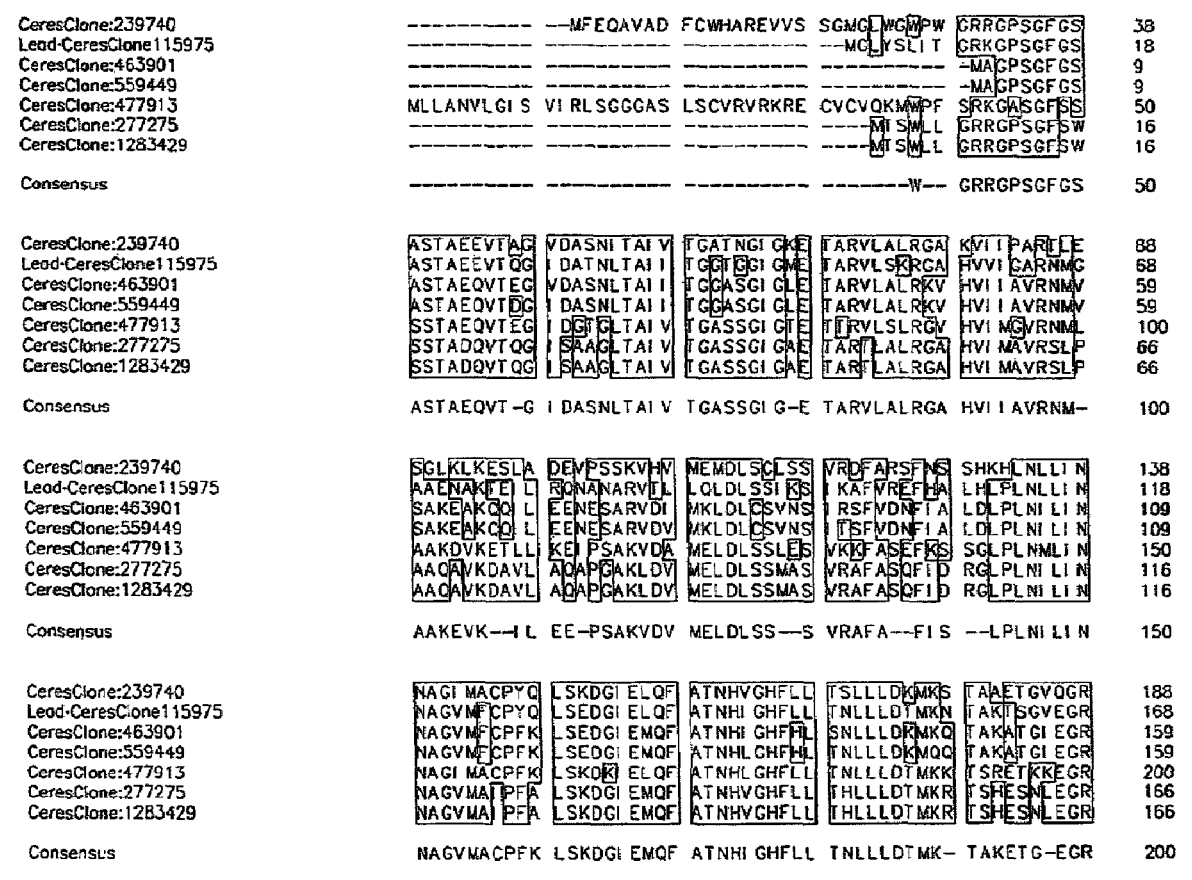

```
CeresClone:239740          ---------- --MFEQAVAD FCWHAREVVS SGMGLWGWPW GRRGPSGFGS   38
Lead-CeresClone115975      ---------- ---------- ---------- --MCLYSLIT GRKGPSGFGS   18
CeresClone:463901          ---------- ---------- ---------- ---------- -MAGPSGFGS    9
CeresClone:559449          ---------- ---------- ---------- ---------- -MAGPSGFGS    9
CeresClone:477913          MLLANVLGIS VIRLSGGGAS LSCVRVRKRE CVCVQKMWPF SRKGASGFSS   50
CeresClone:277275          ---------- ---------- ---------- ----MTSWLL GRRGPSGFSW   16
CeresClone:1283429         ---------- ---------- ---------- ----MTSWLL GRRGPSGFSW   16

Consensus                  ---------- ---------- ---------- -------W-- GRRGPSGFGS   50

CeresClone:239740          ASTAEEVTAG VDASNITAIV TGATNGIGKE TARVLALRGA KVIIPARILE   88
Lead-CeresClone115975      ASTAEEVTQG IDATNLTAII TGGTGGIGME TARVLSKRGA HVVIGARNMG   68
CeresClone:463901          ASTAEQVTEG VDASNLTAII TGGASGIGLE TARVLALRKV HVIIAVRNMV   59
CeresClone:559449          ASTAEQVTDG IDASNLTAII TGGASGIGLE TARVLALRKV HVIIAVRNMV   59
CeresClone:477913          SSTAEQVTEG IDGTGLTAIV TGASSGIGTE TTRVLSLRGV HVIMGVRNML  100
CeresClone:277275          SSTADQVTQG ISAAGLTAIV TGASSGIGAE TARTLALRGA HVIMAVRSLP   66
CeresClone:1283429         SSTADQVTQG ISAAGLTAIV TGASSGIGAE TARTLALRGA HVIMAVRSLP   66

Consensus                  ASTAEQVT-G IDASNLTAIV TGASSGIG-E TARVLALRGA HVIIAVRNM-  100

CeresClone:239740          SGLKLKESLA DEVPSSKVHV MEMDLSCLSS VRDFARSFNS SHKHLNLLIN  138
Lead-CeresClone115975      AAENAKIEIL RQNANARVIL LQLDLSSIKS IKAFVREFHA LHLPLNLLIN  118
CeresClone:463901          SAKEAKQQIL EENESARVDI MKLDLCSVNS IRSFVDNFIA LDLPLNILIN  109
CeresClone:559449          SAKEAKQQIL EENESARVDV MKLDLCSVNS ITSFVDNFIA LDLPLNILIN  109
CeresClone:477913          AAKDVKETLL KEIPSAKVDA MELDLSSLES VKKFASEFKS SGLPLNMLIN  150
CeresClone:277275          AAQAVKDAVL AQAPGAKLDV MELDLSSMAS VRAFASQFID RGLPLNILIN  116
CeresClone:1283429         AAQAVKDAVL AQAPGAKLDV MELDLSSMAS VRAFASQFID RGLPLNILIN  116

Consensus                  AAKEVK--IL EE-PSAKVDV MELDLSS--S VRAFA--FIS --LPLNILIN  150

CeresClone:239740          NAGIMACPYQ LSKDGIELQF ATNHVGHFLL TSLLLDKMKS TAAETGVQGR  188
Lead-CeresClone115975      NAGVMFCPYQ LSEDGIELQF ATNHIGHFLL TNLLLDTMKN TAKTSGVEGR  168
CeresClone:463901          NAGVMFCPFK LSEDGIEMQF ATNHIGHFHL SNLLLDKMKQ TAKATGIEGR  159
CeresClone:559449          NAGVMFCPFK LSEDGIEMQF ATNHLGHFHL TNLLLDKMQQ TAKATGIEGR  159
CeresClone:477913          NAGIMACPFK LSKDKIELQF ATNHLGHFLL TNLLLDTMKK TSRETKKEGR  200
CeresClone:277275          NAGVMAIPFA LSKDGIEMQF ATNHVGHFLL THLLLDTMKR TSHESNLEGR  166
CeresClone:1283429         NAGVMAIPFA LSKDGIEMQF ATNHVGHFLL THLLLDTMKR TSHESNLEGR  166

Consensus                  NAGVMACPFK LSKDGIEMQF ATNHIGHFLL TNLLLDTMK- TAKETG-EGR  200
```

```
CeresClone:239740          INVSSVAHK RSDGTCFELN KLNDKARYQP FIAYAHSKLA NVLHTNELSR   238
Lead-CeresClone115975      LNVSSVAHI YTYQEGIQFD SINDICSYSD KRAYGQSKLA NILHANELSR   218
CeresClone:463901          INLSSIAHN YTYRKGIRFN KINERKGYGN KRAYGQSKLA NILHTNELSR   209
CeresClone:559449          INLSSIAHN YTYRKGIRFN KINERKGYGN KKAYGQSKLA NILHTNELSR   209
CeresClone:477913          VNVSSEAHR FTYSEGIRFD KINDESSYSN WRAYGQSKLA NILHANELTR   250
CeresClone:277275          VNVSSEGHR LAYREGIRFD KINDESVYSS IGAYGQSKLA NILHANELAR   216
CeresClone:1283429         VNVSSEGHR LAYREGIRFD KINDESVYSS IGAYGQSKLA NILHANELAR   216

Consensus                 I-NVSS-AHR YTYREGIRFD KIND-S-YSN -RAYGQSKLA NILHANELSR   250

CeresClone:239740         RFQEEGCNLT ANSLHPGVIV TNIIRYVAGN SALISALSPV ANLVLKSVPR   288
Lead-CeresClone115975     QLQEEGVNIT ANSVHPGLIL TNLFQHT--- ALLMRFLKFF SFYLMKNIPQ   265
CeresClone:463901         RLQEEGVNIT ANSVHPGVIM TPLMRHS--- SYLMHFLKVF TFYIMKNVPQ   256
CeresClone:559449         RLQEEGVNIT ANSVHPGVIM TPLMRHS--- SYLMHFLKVF TFYIMKNVPQ   256
CeresClone:477913         RLKEDGVDIS ANSLHPGVIA TNLSRHI--- SPVNGLTKAI ARLVLKNVQQ   297
CeresClone:277275         RFEEDNVNIT ANSLHPGSII TNLLRYH--- SILDVLHRTL GKLVLKNAEQ   263
CeresClone:1283429        RFEEDNVNIT ANSLHPGSII TNLLRYH--- SILDVLHRTL GKLVLKNAEQ   263

Consensus                 RLQEEGVNIT ANSLHPGVI- TNL-RH---- S-LM--LK-L --LVLKNVPQ   300

CeresClone:239740         GAATTCYLAL HPNVKGVSGK YFADCNEATP TAVARDSELA KRLWSFSEEL   338
Lead-CeresClone115975     GAATTCYVAL HPSVKGVTGR YFADCNEVTP SKLARDETLA QKLWDFSVKL   315
CeresClone:463901         GAATTCYVAL HPSVKGVTGK YFVDCNQCKP SSHAKNKQLA KKLWDFSNDL   306
CeresClone:559449         GAATTCYVAL HPSVKGVTGK YFVDCNQCKP SSHAKNKQLA KKLWDFSNDL   306
CeresClone:477913         GAATTCYVAL HPQVKGTSGK YFSASNVAKT TSQGTDADLA KNLWDFSMDL   347
CeresClone:277275         GAATTCYLAL HPHVKGVSGK YFCDCNLYEP SANAKDMELA KRLWDFGVEL   313
CeresClone:1283429        GAATTCYLAL HPHVKGVSGK YFCDCNLYEP SANAKDMELA KRLWDFGVEL   313

Consensus                 GAATTCYVAL HP-VKGVSGK YF-DCN--KP S--AKD-ELA K-LWDFSV-L   350

CeresClone:239740         VKIYADMSQT TQASEEEETT VTKDVFQDK    367
Lead-CeresClone115975     INSVSKKNYL GFDDTT---- ---------    331
CeresClone:463901         IKSISKA--- ---------- ---------    313
CeresClone:559449         IKSISKA--- ---------- ---------    313
CeresClone:477913         TK-------- ---------- ---------    349
CeresClone:277275         IT-------- ---------- ---------    315
CeresClone:1283429        IT-------- ---------- ---------    315

Consensus                 IK--S----- ---------- ---------    379
```

```
Lead-CeresClone115946   -------MDS SANINKALTE FRFSDLEPPL SGDIIEALNQ SDFEFCTPVQ   43
gi|34896098             MSSSSSSLAA AAARKRALTE QRFSELSPAL SPEVVKALKG GGFRRCTPVQ   50

Consensus               MSSSSSS--- -A----ALTE -RFS-L-P-L S------AL-- --F--CTPVQ  50

Lead-CeresClone115946   AATIPLLCSY KDVAVDAATG SGKTLAFVVP LVEILRRSTS FPPKPHQVMG   93
gi|34896098             AAAIPLLLSH KDVAVDAATG SGKTLAFVVP VVEILRRRPS -PPKPHEVLG   99

Consensus               AA-IPLL-S- KDVAVDAATG SGKTLAFVVP -VEILRR--S FPPKPH-V-G  100

Lead-CeresClone115946   VIISPTRELS FQIYNVAQPF VSTLANVNSV LLVGGREVKA DMKIIEEEGC  143
gi|34896098             IIISPTRELS SQIYNVAQPF FATLKGVSSM LLVGGFDIKA ELKKLEEEGA  149

Consensus               -IISPTRELS -QIYNVAQPF --TL--V-S- LLVGG---KA --K--EEEG-  150

Lead-CeresClone115946   NVLIGTPGRL SDIMERMEIL DFRNLEILIL DEADRLLEMG FQRQVNYIIS  193
gi|34896098             NILVGTPGKL FDVMERLDTL NYKNLEILIL DEADRLLDLG FQKQITSIIS  199

Consensus               N-L-GTPG-L -D-MER---L ---NLEILIL DEADRLL--G FQ-Q---IIS  200

Lead-CeresClone115946   RLPKQRRTGL FSATQTEGVE ELAKAGLRNP VRVEVRAK-- --SKSESSQQ  239
gi|34896098             KLPKLRRTGL FSATQTEAVK ELAKAGLRNP VRVEVKTEVK PTGKDGAQQE  249

Consensus               -LPK-RRTGL FSATQTE-V- ELAKAGLRNP VRVEV---VK PT-K----Q-  250

Lead-CeresClone115946   LTNSKTPSGL HLEYMECEAD KKSSQLVDLL IKNSDKKLIV FFMTCASVDY  289
gi|34896098             LGPSKTPLGL RLEYMICEAS NKSSQLVDFL VQNNGKKIMV YFATCACVDY  299

Consensus               L--SKTP-GL -LEYM-CEA- -KSSQLVD-L --N--KK--V -F-TCA-VDY  300

Lead-CeresClone115946   WGLVLSKIPA LKSISLIPIH GDMKQNARDK ALASFTKASS GALLCTDVAA  339
gi|34896098             WAIVLPLLDS LKGSPIIPYH GKMKQGPREK ALASFSALSS GILVCTDVAA  349

Consensus               W--VL----- LK----IP-H G-MKQ--R-K ALASF---SS G-L-CTDVAA  350
```

```
Lead-CeresClone115946   RGLDIPGIDY VVQYDPPQDP NMFNHRACRT ARLGRQGRAI VFLLPKEEAY  389
gi|34896098             RGLDIPHVDL IVQYDPPQDP NVFIHRAGRT ARYDQEGDAI VFLLPKEDTY  399
Consensus               RGLDIP--D- -VQYDPPQDP N-F-HRAGRT AR----G-AI VFLLPKE--Y  400

Lead-CeresClone115946   VEFMRIRRVP LEERKCSEDA SDVIPIIRSA AMKDRAVMEK GLKAFVSFVR  439
gi|34896098             VEFLKRRGVP LTERECSTNA VDIVPQIRSA ALEDRNVMEK GLTAFVSFVR  449
Consensus               VEF---R-VP L-ER-CS--A -D--P-IRSA A--DR-VMEK GL-AFVSFVR  450

Lead-CeresClone115946   AYKEHHCSFI FRWKDLEIGK LAMGYGLLYL PSMSEVKQHR LSSEGFTPVE  489
gi|34896098             AYKEHHCSYI FSWKDLEIGR LGMEYGLLQI PSMPEVKHHS LSLEGFTPVK  499
Consensus               AYKEHHCS-I F-WKDLEIG- L-M-YGLL-- PSM-EVK-H- LS-EGFTPV-  500

Lead-CeresClone115946   GVKFEEIKFK DKYREKQRQQ NLQVRKEKRQ EEKKEKGKRK RVDASASNDP  539
gi|34896098             DVDVTKIKYK DKAREKQRQK TLK-RKAEEL ALRPEIEKRR K----APEKP  544
Consensus               -V----IK-K DK-REKQRQ- -L-VRK---- ----E--KR- -VDASA---P  550

Lead-CeresClone115946   KKASRKLTGK QRQTIQTAED EEVMDRDYKL MIKVKKGLIK EDEYERLTG-  588
gi|34896098             EKPKRKKTGK QRQAVQTKED MDELANEYRL LKKLKRGVID EDEYEKLTGF  594
Consensus               -K--RK-TGK QRQ--QT-ED -------Y-L --K-K-G-I- EDEYE-LTGF  600

Lead-CeresClone115946   ----DDDLF- ---------- ---------- ---------- ----------  593
gi|34896098             GESDDDDSSD GGDSDLDERK ERGNKVLKKI KQKGKAKGSR RFEGRSKQKT  644
Consensus               GESDDDD--D GGDSDLDERK ERGNKVLKKI KQKGKAKGSR RFEGRSKQKT  650

Lead-CeresClone115946   ---  593
gi|34896098             RRR  647
Consensus               RRR  653
```

```
gi|34908122              ---------- ---------- ---------- --------ME SLRVH-----  7
Lead-CeresClone109514    ---------- ---------- ---------- ---------M VARSEE V--  9
gi|7798996               ---------- ---------- ---------- ---------M VARSEEVE--  9
CeresClone:569852        ----I QTHPS QKHLAI SVPS PSFVSVVFRS SALLFGLMAH GKRSRQQAES  46
gi|55734104              ---------- ---------- ---------- --------MG VKRFREEQ--  10
gi|2346974               ---------- ---------- ---------- -------MSA MKRSREDR--  11
gi|2346976               ---------- ---------- ---------- -------MSS I KRSRSEE--  11
CeresClone:1608104       ---------- ---------- ---------- --------MT I KRSMEDD--  10
CeresClone:603406        SNNFVPFQSL CPFSYI HI FI LPHLKTKHPA I FQFLFWLVV MKREREVD--  48

Consensus                ---------- ---------- ---------- ---------- VKRSRE----  50

gi|34908122              ---------- ---ASALLSL SSPA-----A SASQPTSSSS TTEGVFECKT  39
Lead-CeresClone109514    ------I VEE DTTAKCLMLL SRVG------ ---ECGGGCG GDERVFRCKT  44
gi|7798995               -------I VE DTAAKCLMLL SRVG------ -----ECGGG GEKRVFRCKT  41
CeresClone:569852        TSVSLLDLDS GDMARILLLF SGHH------ -QHHAHYGPS SPERVFECKT  89
gi|55734104              ---------- --SANCLMLL SKVGLLSEME KSAVPALKPG AGGRI YECKT  48
gi|2346974               ------QVEA AAMANCLMLL SKLN-----D KSTSTTTTNQ DHHNDFECKT  50
gi|2346976               ----YGQVEA EAMANCLMLL SKLN------ --DHNTSKNQ DHHNEFECKT  49
CeresClone:1608104       -----REVEN LAMANCLMLL SRVG------ ------QSGS TPDRVFHCKT  43
CeresClone:603406        ---------S LTMANCLMLL SRGS------ EFEATYSSTS MSNRVFECKT  83

Consensus                -------VE- --MANCLMLL SRV------- ---------- --ERVFECKT  100

gi|34908122              CSKRFPSFQA LGGHRTSHTR LQAKLLSDPA AAAAAAERD RARVHECAVC  89
Lead-CeresClone109514    CLKEFSSFQA LGGHRASHKK L-I NSDNPSL LGSLS--NKK TKTSHPCPI C  91
gi|7798996               CLKEFSSFQA LGGHRASHKK L-I NSSDPSL LGSLSNKKTK TATSHPCPI C  90
CeresClone:569852        CNRRFPSFQA LGGHRASHKK P--RLADGA- -GA----EPP KPKVHGCSI C  131
gi|55734104              CKKQFLTFQA LGGHRASHKK L--RLMAADL LHQSL--AVT KPKTHACSI C  94
gi|2346974               CNKRFSSFQA LGGHRASHKR P--KLLIGA- -GEFLV-QPS SKKMHECSI C  95
gi|2346976               CNKRFPSFQA LGGHRASHKR T--KVLTGA- -GEFLAQQAK KNKMHECSI C  95
CeresClone:1608104       CDKEFKSFQA LGGHRASHKR P--KTSDGS- ----EARTPP KPKTHECPVC  86
CeresClone:603406        CNRQFPSFQA LGGHRASHKK P--RLMAGDI EGQLLHDSPP KPKTHECSI C  131

Consensus                CNK-F-SFQA LGGHRASHKK ---KLM-G-- -G-------- K-KTHECSI C  150
```

```
gi|34908122             GVEFSMGQAL GGHMRRHRGE TGTT---TVV LADADDSGGA TVPQPPEP--   134
Lead-CeresClone109514   GVKFPMGQAL GGHMRRHRNE KAS----SML VTRSFLPETT TVTALKKFSS   137
gi|7798996              GVEFPMGQAL GGHMRRHRSE KASP---GTL VTRSFLPETT TVTTLKKSSS   137
CeresClone:569852       GLEFAVGQAL GGHMRRHRAV -------AAA GPGVGLGLSL GLGLGPNEDG   174
gi|55734104             GLEFPLGQAL GGHMRRHRGA ALDG---EKP VVVSDKPVAK AVPFLMRSNS   141
gi|2346974              GMEFSLGQAL GGHMRRHRAA --------ID EKSKAATKAM MIPVLKKSNS   137
gi|2346976              GMEFSLGQAL GGHMRRHRDE -------NNK TLKVARKTTT MIPVLKKSNS   138
CeresClone:1608104      GLEFAIGQAL GGHMRRHRDV ---------- ---GNEKSGR PVAARPESVT   123
CeresClone:603406       GLEFAIGQAL GGHMRRHRAA NLNGNVHNST ATSSSSGGSS FDSSPKKKAD   181

Consensus               GLEF--GQAL GGHMRRHR-- ---------- ---S------ -V--LKKSNS   200

gi|34908122             ---------- MPDLNYPPLE D--------- AGDGSEPELL NLLV   159
Lead-CeresClone109514   GKRVA----- CLDFDLDSVE ----CLVNWK LELGRT---- -SWC   168
gi|7798996              GKRVA----- CLDLDSME-- ----SLVNWK LELGRT-S-- ----   164
CeresClone:569852       NKKAAAAAEL ALDLNEPALE EEPADRAMLG LAVGFRP-RG G---   214
gi|55734104             SKRIFGFEVD GLDLNLTPED NDP-DER--- --DKFPP-LL EFFV   178
gi|2346974              SKRIF----- CLDLNLTPRN EDV-DLKLWP TAPISSP-VL RIFI   174
gi|2346976              SKRIF----- CLDLNLTPRN EDV-DLKLWP TAPISSP-VL RIFI   175
CeresClone:1608104      KRGLF----- -MDLNLTPLE N---DLKLWS NTVNTALAM- ----   153
CeresClone:603406       NKRVL----- VLDLNLTPFE N---DLEFLK IGKPTTF-VD YLY-   215

Consensus               NKR------- -LDLNLTP-E ----DLK-W- ----S-P-V- --F-   244
```

```
CeresClone:300623         -------MPS SFLTSSSSSA SSHLSYLIPA RAAAPPPFAM GQGYGATSGG   43
Lead-CeresClone103581     ---------- ---------- --MPSEPNQT RPTRVQPS-- ----------   16
gi|5668794                ---------- ---------- --MPSEPNQT RPTRVQPS-- ----------   16
gi|37051131               ---------- ---------- MPSSDSGESR RSIKPQ---- ----------   16
CeresClone:666382         ---------- ---------- MPSSNSGESR RASKPH---- ----------   16
CeresClone:978708         ---------- ---------- --------MI MTAK------ ----------    6
CeresClone:1068780        ---------- ---------- -------MLM MAAK------ ----------    7
CeresClone:324937         ---------- -----MEEML MAGNANPNPP PAAAPSAPGA QT---QSQRG   32
gi|4996640                MDAAHWHQGL GLVKPMEEML MAA----NAA AGANPNPAAT AP---SSVTG   43
gi|50928017               ---------- --------ML MAA----NAA AGANPNPAAT AP---SSVTG   25
CeresClone:678544         ---------- --------ML MGAPSANQQV QGSNPNPPAQ AP---SSAPG   29
CeresClone:738478         MDAAHWPQGL GLVKPMEEML MGAPSSNQQV QGSNPNPPAQ AP---SSAPG   47
gi|3341468                ---------- ----MDTSHW PQGIGLVKAV EPSKPVP--- ----------   23
gi|1360078                -------LPL PFFNMDTSHW PQGIGLAKAV EPSKPVPV-- ----------   31

Consensus                 ---------- ---------- M---S----- ---KP-P--- ----------   50

CeresClone:300623         GVANATSAAA APPPPRQGAS RNAGAGHPPL PRPPPRQCPR CRSANTKFCY   93
Lead-CeresClone103581     ---------- ---------- ---TAAYPPP NLAEPLPCPR CNSTTTKFCY   43
gi|5668794                ---------- ---------- ---TAAYPPP NLAEPLPCPR CNSTTTKFCY   43
gi|37051131               ---------- ---------- ---NRPGAPA PEQENLPCPR CDSTNTKFCY   43
CeresClone:666382         ---------- ---------- ---RSVAAPP VEPENLPCPR CDSANTKFCY   43
CeresClone:978708         ---------- ---------- ---QQQQPEL PEQEQLNCPR CASPNTKFCY   33
CeresClone:1068780        ---------- ---------- ---QQQQPEL PEQQDLKCPR CDSPNTKFCY   34
CeresClone:324937         GGAPPPAAGA AAPSAGATVG AAGTERRARP HKEKALNCPR CNSTNTKFCY   82
gi|4996640                GALRGGGGGG APPVAG-GAG AGSTERRARP QKEKALNCPR CNSTNTKFCY   92
gi|50928017               GALRGGGGGG APPVAG-GAG AGSTERRARP QKEKALNCPR CNSTNTKFCY   74
CeresClone:678544         AGGPMRGGTP AMAVAGSGAG AGSTERRPRP QKEKAINCPR CNSTNTKFCY   79
CeresClone:738478         AGGPMRGGTP AMAVAASGVG AGSTERRPRP QKEKAINCPR CNSTNTKFCY   97
gi|3341468                ---------- ---------- ---TERKPRP QKEQAINCPR CNSTNTKFCY   50
gi|1360078                ---------- ---------- ---TERKPRP QKEQAINCPR CNSTNTKFCY   58

Consensus                 ---------- ---------- ---TERRPRP -KE-ALNCPR CNSTNTKFCY  100
```

```
CeresClone:300623         YNNYSREQPR YLCKACRRHW TEGGTLRDVP VGGG-RKNRR GAKGGADAKC   142
Lead-CeresClone103581     YNNYNLAQPR YYCKSCRRYW TQGGTLRDVP VGGGTRRSSS KRHRSFSTTV   93
gi|5668794                YNNYNLAQPR YYCKSCRRYW TQGGTLRDVP VGGGTRRSSS KRHRSFSTTA   93
gi|37051131               YNNYNYSQPR HLCKACRRYW THGGTLRDIP VGGGTRKNAK RSRTHHVAVT   93
CeresClone:666382         YNNYNYSQPR HFCKSCRRYW THGGTLRDIP VGGGSRKNAK RSRTHHAAAA   93
CeresClone:978708         YNNYNLSQPR HFCKNCRRYW TKGGSLRNIP VGGGTRKNSS KRSSVGSSSS   83
CeresClone:1068780        YNNYNLSQPR HYCKNCRRYW TKGGSLRNIP VGGGSRKNTK RSSSSSPSSS   84
CeresClone:324937         YNNYSLQQPR YFCKTCRRYW TEGGSLRNVP VGGGSRKNKR SSSSAASTSA   132
gi|4996640                YNNYSLQQPR YFCKTCRRYW TEGGSLRNVP VGGGSRKNKR SSSSAASASP   142
gi|50928017               YNNYSLQQPR YFCKTCRRYW TEGGSLRNVP VGGGSRKNKR SSSSAASASP   124
CeresClone:678544         YNNYSLQQPR YFCKTCXRYW TEGGSLRNVP VGGGSRKNK- ----------   118
CeresClone:738478         YNNYSLQQPR YFCKTCRRYW TEGGSLRNVP VGGGSRKNKR SSSSSASASA   147
gi|3341468                YNNYSLSQPR YFCKTCRRYW TEGGSLRNVP VGGGSRKNKR SSSSSNNSSS   100
gi|1360078                YNNYSLSQPR YFCKTCRRYW TDGGSLRNVP VGGGSRKNKR SNSSSNNSSS   108

Consensus                 YNNYNLSQPR YFCKTCRRYW TEGGSLRNVP VGGGSRKNKR -SSSS-S-S-   150

CeresClone:300623         SASAAA---- ---------- --AAPAQQGG NVVLGADTFP GDLLR-----   171
Lead-CeresClone103581     TSSSSSSSV- ---------- --ITSTTQEP ATTEASQIKV SNVTS-----   125
gi|5668794                TSSSSSSSV- ---------- --ITTTTQEP ATTEASQTKV TNLIS-----   125
gi|37051131               SSSSSS---- ---------- --AVTSAPEQ NYPSMTPIQG GSFPYGGVDG   127
CeresClone:666382         TSSSSSTSSA ---------- --TTSAHEHH NAHTLTALAP MTAATHFGHD   131
CeresClone:978708         APS------- ---------- --SSSPKSKT VAVSD----- ----------   99
CeresClone:1068780        NLKDKT---- ---------- --VAVPDQKP NSEEESRP-- ----------   106
CeresClone:324937         AMS------- ---------- --GIVSVKNP KLVHEGAHHD LNLAFPHHNN   163
gi|4996640                ASASTANSVV TSASMSMSMA STGGGASKNP KLVHEG-AQD LNLAF--PHH   189
gi|50928017               ASASTANSVV TSASMSMSMA STGGGASKNP KLVHEG-AQD LNLAF--PHH   171
CeresClone:678544         ---------- ---------- ---------- ---------- ----------   118
CeresClone:738478         SAAASATASV ANSSML---- --GAAPNKNP KLAHEGAAHD LNLAF-PHHQ   190
gi|3341468                STSSSYKKIP DLT------- --IPTSSQNP KIINE--PHD LNLAFNPSAT   139
gi|1360078                STSSSYKKIP DLTIP----- --TSSSTQNP KIINE--PHD LNLTFNPSTT   149

Consensus                 SSSSS----- ---------- ----S--QNP -LV-E----- LNL-F-----   200
```

```
CeresClone:300623          ---------- ---------- ---------- ---------- --------QL  173
Lead-CeresClone103581      ---------- ---------- ---------- ---------- --------GH  127
gi|5668794                 ---------- ---------- ---------- ---------- --------GH  127
gi|37051131                EGKQNMS--- ---------- ---------- ---------- --------VC  136
CeresClone:666382          GDVKQTNGN- ---------- ---------- ---------- --------AC  142
CeresClone:978708          ---------- ---------- ---------- ---------- ----------  99
CeresClone:1068780         ---------- ---------- ---------- ---------- ----------  106
CeresClone:324937          GRALQPPEFP SSFPNLESSS VCYPGAAMLG NGAAGRGMGA LSAMELLRST  213
gi|4996640                 GGLQAPGEFP -AFPSLESSS VCNPGGP--- MGTNGRGGGA LSAMELLRST  235
gi|50928017                GGLQAPGEFP -AFPSLESSS VCNPGGP--- MGTNGRGGGA LSAMELLRST  217
CeresClone:678544          ---------- ---------- ---------- ---------- ----------  118
CeresClone:738478          GGMQAQADYM -AFPSLESSS MCNPGGGGM- AANGARAGGA LSAMELLRST  238
gi|3341468                 SNFSNISEFM -ALPLMNPN- ---------- ---------- --------ST  159
gi|1360078                 SNFSNISEFM -ALPLMNPN- ---------- ---------- --------ST  169

Consensus                  ---------- ---------- ---------- ---------- --------S-  250

CeresClone:300623          VQFQPDAAVG ---------- ---------- ---------- ----------  183
Lead-CeresClone103581      GSFASLLGLG SGNGGLDY-- ---------- ---------- ----------  145
gi|5668794                 GSFASLLGLG SGNGGLDY-- ---------- ---------- ----------  145
gi|37051131                GSFTSLLNNN PQQNSGFLAL GGF------- ---------- ----------  159
CeresClone:666382          GSYTSL--LN NTQGSGFFAL GGF------- ---------- ----------  163
CeresClone:978708          ---------- ---------- ---------- ---------- ----------  99
CeresClone:1068780         ---------- ---------- ---------- ---------- ----------  106
CeresClone:324937          GCYVPLQHVQ LGMPAEYAAP AGFTLGEFRI PPPP--QSQS VLGFSLDTHG  261
gi|4996640                 GCYMPLQ-VP MQMPAEYATP -GFALGEFRA PPPPPQSSQS LLGFSLDAHG  283
gi|50928017                GCYMPLQ-VP MQMPAEYATP -GFALGEFRA PPPPPQSSQS LLGFSLDAHG  265
CeresClone:678544          ---------- ---------- ---------- ---------- ----------  118
CeresClone:738478          GCYMPLQ-MP MQMPGEYGAA -GFSLGEFRA PAPP--QSQS LLGFSLDAHG  284
gi|3341468                 TSFMSSIMPQ LSDSNNIM-- ---------- ---------- ----------  177
gi|1360078                 TSFMSSIMPQ ISDSNNIM-- ---------- ---------- ----------  187

Consensus                  G-Y--L--V- ---------- ---------- ---------- ----------  300
```

```
CeresClone:300623          ---------GG GYAIDLSAWH QMVAATVPPP PPPGTGGDVS SLGLGAAGA-  224
Lead-CeresClone103581      ---------GF GYGYGLEDMS I--------- -GYLGDSSVG EIPVVDGCG-  176
gi|5668794                 ---------GF GYGYGLEEMS I--------- -GYLGDSSVG EIPVVDGCGG  177
gi|37051131                ---------GL GLGHGLGDMG FGIGR-EWSF PGMMDGSNMG VPVVSSGIG-  199
CeresClone:666382          ---------GL GLGHGFDDMG FGIGRSGWAF PGMVDNGNIG GAIASSGVN-  204
CeresClone:978708          ---------- ---------- ---------- ---------- ----------  99
CeresClone:1068780         ---------- ---------- ---------- ---------- ----------  106
CeresClone:324937          -------TGG YSAGGLQ--E SAVGRMLFPF EDLKPXGERS WRRCKQRRS-  301
gi|4996640                 SVGGPSAAGF GSSAGLQGVP ESTGRLLFPF EDLKPTVSSG TGGGGASGGG  333
gi|50928017                SVGGPSAAGF GSSAGLQGVP ESTGRLLFPF EDLKPTVSSG TGGGGASGGG  315
CeresClone:678544          ---------- ---------- ---------- ---------- ----------  118
CeresClone:738478          SVGGASMAGY GSGAGMQGMQ DRSGRLLFAF EDLKPTANSG AGGGESGGGS  334
gi|3341468                 --------YS SSSTGLPNLH DLKPTLNFSL DGFDNNNGYG SLQGETAGXK  219
gi|1360078                 --------YS SSSTGLPNLH DLKPTLNFSL DGFDNNNGYG SLQGETAGAK  229

Consensus                  --------G- G---GL--M- -------F-- ---------G ----------  350

CeresClone:300623          ---------- ---------- -GAGAEANCV ALQYWSEDGM PGLDGPC  250
Lead-CeresClone103581      ---------- ---------- ---------- ---------- -------  176
gi|5668794                 ---------- -----DTWQI GEIEGKSGGD SLIWPGLEIS MQTNQVK  209
gi|37051131                ---------- --NSWQLEGG ETGFVGGGGD CFSWPGLAIS TPGNGLK  234
CeresClone:666382          ---------- -----TWQLE SGEGGFVGGD CFSWPGLAIS TPGNGLK  236
CeresClone:978708          ---------- ---------- ---------- ---------- -------  99
CeresClone:1068780         ---------- ---------- ---------- ---------- -------  106
CeresClone:324937          ---------- ---------- ---------- ---------- -------  301
gi|4996640                 --AGVDGGHQ FDHGKEQQAG GGGGGPGGHD TPGFWNGMIG GGSGTSW  378
gi|50928017                --AGVDGGHQ FDHGKEQQAG GGGGGPGGHD TPGFWNGMIG GGSGTSW  360
CeresClone:678544          ---------- ---------- ---------- ---------- -------  118
CeresClone:738478          G-AGVDGGDH QFEQGNKEQQ GNGTPVGQPD TPGFWNGMIG GGGTW--  378
gi|3341468                 LFFPLDDLKN VSTPNDDHEF DEQNRGQAAE SHGFWNGMLG GGS----  262
gi|1360078                 LFFPL----- ---------- ---------- ---------- -------  234

Consensus                  ---------- ---------- ---------D ---W----I- -------  397
```

| | | |
|---|---|---|
| gi\|38260609 | ------MLKS VNPMAFYE-- ---LGEQQFP FL-GYIVSK- ------PGNA | 31 |
| gi\|60460512 | ------MTTV YDPSHHLITSK KLCFKDLELP PR-KKQLHC- ------CHNA | 36 |
| gi\|56605376 | --MIAESMLL -NPTSHIST-- ---WDSLDDP SPAISSYFS- ------TAHV | 36 |
| gi\|34906436 | MMMMGEGVSS ------VPP- ---WSHLPVS GV--DVLGG- ------GGGG | 31 |
| CeresClone:673872 | --MLGEHHRG -NPTVLVPP- ---WPAHDDP TA--EMYSAF LTNDVNAGEY | 41 |
| Lead-CeresClone101255 | -MMI GESHRG FNPTVHI PP- ---WPLSEDL TV-SDI YGS- ------PDGG | 37 |
| gi\|22531114 | -MMI GESHRG FNPTVHI PP- ---WPLSEDL TV-SDI YGS- ------PDGG | 37 |
| Consensus | --MI GE--R- -NPT-HI PP- ---W---EDP TV---I Y-S- ---------- | 50 |
| | | |
| gi\|38260609 | GAYEI ----- --------DP PI PSVD---- --------DA I YGSDEFRMY | 56 |
| gi\|60460512 | AAMELPHHEA RLHKYLPSNE DDDGTD---- --------DP -YGTDHFRMY | 73 |
| gi\|56605376 | SPLDS--PTA ALNDFDSSLW EDPDLP---- ------APVDA -YSCDQFRMY | 74 |
| gi\|34906436 | GDEMTPYVIA ALRDYLPAND VGVGADEEEE AAAMAAAVDA -YACDEFRMY | 80 |
| CeresClone:673872 | SPYHLQEALT ALQRFLPSNE TDADSD-SSE AAQPDAAVDA -YTCDHFRMY | 89 |
| Lead-CeresClone101255 | SSMME--ALA ELQRYLPSNE PDPDSD--PD LSGPDSPI DA -YTCDHFRMY | 82 |
| gi\|22531114 | SSMME--ALA ELQRYLPSNE PDPDSD--PD LSGPDSPI DA -YTCDHFRMY | 82 |
| Consensus | S-M-----LA -LQRYLPSNE -DPDSD---- -----A-VDA -Y-CDHFRMY | 100 |
| | | |
| gi\|38260609 | AYKIKRCPRI RSHDWTECPY AHRGEKAIRR DPRRYSFCAV ACPAFRN-GA | 105 |
| gi\|60460512 | EFKVRRCTRS RSHDWTDCPF AHPGEKARRR DPTRYQYSGT ICSDFRRGGC | 123 |
| gi\|56605376 | EFKVRSCARG RSHDWTKCPY AHTGEKARRR DPRKFNYSGA ECPDLRH-GC | 123 |
| gi\|34906436 | EFKVRRCARG RSHDWTECPF AHPGEKARRR DPRKYHYSGT ACPDFRK-GG | 129 |
| CeresClone:673872 | EFKVRRCARG RSHDWTECPY AHPGEKARRR DPRRFHYSGV ACPEFRK-GN | 138 |
| Lead-CeresClone101255 | EFKVRRCARG RSHDWTECPY AHPGEKARRR DPRKFHYSGT RVLSFVK-VV | 131 |
| gi\|22531114 | EFKVRRCARG RSHDWTECPY AHPGEKARRR DPRKFHYSGT ACPEFRK-GC | 131 |
| Consensus | EFKVRRCARG RSHDWTECPY AHPGEKARRR DPRKYHYSGT ACPDFRK-G- | 150 |
| | | |
| gi\|38260609 | CHRGDICEFA HGVFEYWLHP ARYRTRACNA GNLCQRKVCF FAHAPEQLR- | 154 |
| gi\|60460512 | CPRGDDCEFA HGVFECWLHP TRYRTEACKD GKNCKRKVCF FAHSSRELRL | 173 |
| gi\|56605376 | CKKGDACEYA HGTFEIWLHP DRYRTQPCRD GTGCRRRVCF FAHTSEQLRI | 173 |
| gi\|34906436 | CKRGDACEYA HGVFECWLHP ARYRTQPCKD GTACRRRVCF FAHTPDQLRV | 179 |
| CeresClone:673872 | CRKGDACEFA HGVFECWLHP ARYRTQPCKD GTSCRRRVCF FAHTPEQLRV | 188 |
| Lead-CeresClone101255 | AREETHVSFL MVFLSVGF-- TRRVIGLSRV KTVVTVAVVF VSLLIRRIRL | 179 |
| gi\|22531114 | CKRGDACEFS HGVFECWLHP ARYRTQPCKD GGNCRRRVCF FAHSPDQIRV | 181 |
| Consensus | CKRGDACEFA HGVFECWLHP ARYRTQPCKD GT-CRRRVCF FAH-PEQLRI | 200 |

```
gi|38260609            ---------- ---------- ---------- ------QSEG KHRCRYAYRP  168
gi|60460512            LPES--QPPY KNSDKNYNHC CLFCRSVT-- ------SSSS LSPTSTLLGL  213
gi|56605376            PGKQSVRSPR A--------- ----REMA-- ------IPAV SSPTSILLSP  202
gi|34906436            LPAQQSSPRS VASSPLAESY DGSPLRRQAF ESYLTKTIMS SSPTSTLMSP  229
CeresClone:673872      LPMQ--SPRS VAN--SSESY DGSPMRQV-- ------SLSS AAAAAFMSSP  226
Lead-CeresClone101255  ---------- ---------- -GFCLIKA-- ------LIVL IRSIFCLLRF  200
gi|22531114            LPNQ--SPDR VDS------- ----FDVL-- ------SPTI RRAFQFSISP  210

Consensus              LP-Q---P-- --S------- ---------- ------S-S- -S-TS-LLSP  250


gi|38260609            VRT--TAARG RNGDGVG--- ---------- ---------- ----------  183
gi|60460512            SHFSRSPSLS PPLSPLKHQQ RTPRYGGDRI SKFGTEMISS YDDVLLKEVM  263
gi|56605376            SSD--SPPLS PISPVISGGE SLSR------ ------LVAL MHSLRLDELK  238
gi|34906436            PKS--PPSES PPLSPDG-AA AIRRGSWPGV GSPVNDVLAS FRQLRLNKVK  276
CeresClone:673872      AASL-SPPES PPS------- ---------- ---VNEMVAS LRNLQLGKMK  255
Lead-CeresClone101255  VER------- ---------- ---------- ---------- ----------  203
gi|22531114            SSN--SPPVS PRGDSDSSCS LLSRSLGSNL ---GNDVVAS LRNLQLNKVK  255

Consensus              S-S--SP--S P--------- ---R------ -------VAS --NL-L-KVK  300


gi|38260609            ---------- ---------- ---------- MRLDGDD--- ----------  190
gi|60460512            SYL------- ---------- --------GT MNLSEVSSPM ATTANINIPW  288
gi|56605376            TNP------- ---------- -GVSSFSPNL RRSSGAA--- ----------  257
gi|34906436            SSPSGGW--- --SYPSSSAV YGSPKAATGL YSLPTTPLAS TATVTTASSF  321
CeresClone:673872      SMP------- -HNRNVSVGS PRGSVLRPGF LSLPTTP--- -----IQQPV  289
Lead-CeresClone101255  ---------- ---------- ---------- ---------- ----------  203
gi|22531114            SSLSSSYNNQ IGGYGSGFGS PRGSVLGPGF RSLPTTP--- -----TRPGF  297

Consensus              S--------- ---------- --------G- -SL------- -----T----  350


gi|38260609            ------FDTW ------QSPV KSGKSDLDIN EERVLKCWSG ISIVDDHYEP  228
gi|60460512            ------FDV- -SFKGAPSTV SPSGSGEYFN GGGDDEKNNG NGV-------  323
gi|56605376            ------FDLW DRGNEEEPAM ERVESGRNLR AQMYAKLMRE NSVDRVRPMI  301
gi|34906436            MPNLEPLDL- -GLIGDEEPV QRVESGRALR EKVFERLSRD GAI-SGDATA  368
CeresClone:673872      RSGVKCFDVW DESFEEEPVM ERVESGRGIR AKMFEKLSKE NSL-------  332
Lead-CeresClone101255  ------FSF- ---------- ---------- -RFLRRLTRR R---------  216
gi|22531114            ------MNIW ENGLEEEPAM ERVESGRELR AQLFEKLSKE NCMGRIEPDP  341

Consensus              ------FD-W ------EE--- ERVESGR-LR --MFEKLSRE NS--------  400
```

| | | |
|---|---|---|
| gi\|38260609 | SDLDLDLSHI DWISELVD | 246 |
| gi\|60460512 | --VLDHDLDL GWVNELLN | 339 |
| gi\|56605376 | SAGSLN---- -------- | 307 |
| gi\|34906436 | FATAGVGLDV DWVSDLIN | 386 |
| CeresClone:673872 | -DASASPPDL GWVSELVK | 349 |
| Lead-CeresClone101255 | ---------- -------- | 216 |
| gi\|22531114 | DQGAGDTPDV GWVSDLVM | 359 |
| Consensus | --------D- -WVSELV- | 418 |

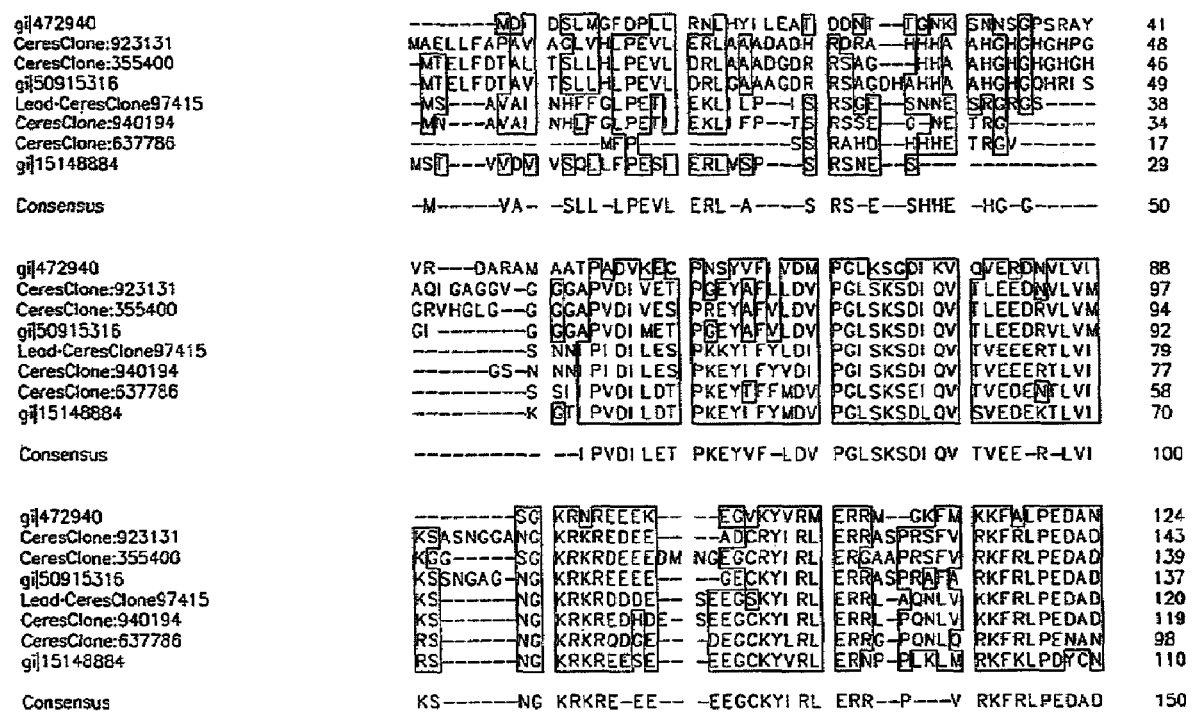

```
gi|472940                -------MDI DSLMGFDPLL RNLHYILEAT DDNT--TGNK SNNSGPSRAY   41
CeresClone:923131        MAELLFAPAV AGLVHLPEVL ERLAAADADH RDRA---HHA AHGHGHGHPG   48
CeresClone:355400        -MTELFDTAL TSLLHLPEVL DRLAAADGDR RSAG---HHA AHGHGHGHGH   46
gi|50915316              -MTELFDTAV TSLLHLPEVL DRLGAAAGDR RSAGDHAHHA AHGHGDHRIS   49
Lead-CeresClone97415     -MS---AVAI NHFFGLPETI EKLILP--IS RSGE--SNNE SRGRGS----   38
CeresClone:940194        -MN---AVAI NHLFGLPETI EKLIFP--TS RSSE--G-NE TRG-------   34
CeresClone:637786        ---------- -----MFP-- --------SS RAHD--HHHE TRGV------   17
gi|15148884              MSI---VVDM VSQLLFPESI ERLVSP---S RSNE--S--- ----------   29

Consensus                -M-----VA- -SLL-LPEVL ERL-A----S RS-E--SHHE -HG-G-----   50

gi|472940                VR---DARAM AATPADVKEC PNSYVFIVDM PGLKSGDIKV QVERDNVLVI   88
CeresClone:923131        AQIGAGGV-G GGAPVDIVET PGEYAFLLDV PGLSKSDIQV TLEEDNVLVM   97
CeresClone:355400        GRVHGLG--G GGAPVDIVES PREYAFVLDV PGLSKSDIQV TLEEDRVLVM   94
gi|50915316              GI-------G GGAPVDIMET PGEYAFVLDV PGLSKSDIQV TLEEDRVLVM   92
Lead-CeresClone97415     ---------S NNIPIDILES PKKYIFYLDI PGISKSDIQV TVEEERTLVI   79
CeresClone:940194        ------GS-N NNIPIDILES PKEYIFYVDI PGISKSDIQV TVEEERTLVI   77
CeresClone:637786        ---------S SIIPVDILDT PKEYTFFMDV PGLSKSEIQV TVEDENTLVI   58
gi|15148884              ---------K GTIPVDILDT PKEYIFYMDV PGLSKSDLQV SVEDEKTLVI   70

Consensus                ---------- --IPVDILET PKEYVF-LDV PGLSKSDIQV TVEE-R-LVI  100

gi|472940                --------SG KRNREEEK-- --EGVKYVRM ERRM--GKFM KKFALPEDAN  124
CeresClone:923131        KSASNGGANG KRKREDEE-- --ADCRYIRL ERRASPRSFV RKFRLPEDAD  143
CeresClone:355400        KGG-----SG KRKRDEEEDM NGEGCRYIRL ERGAAPRSFV RKFRLPEDAD  139
gi|50915316              KSSNGAG-NG KRKREEEE-- --GECKYIRL ERRASPRAFA RKFRLPEDAD  137
Lead-CeresClone97415     KS------NG KRKRDDDE-- SEEGSKYIRL ERRL-AQNLV KKFRLPEDAD  120
CeresClone:940194        KS------NG KRKREDHDE- SEEGCKYIRL ERRL-PQNLV KKFRLPEDAD  119
CeresClone:637786        RS------NG KRKRQDGE-- -DEGCKYLRL ERRG-PQNLQ RKFRLPENAN   98
gi|15148884              RS------NG KRKREESE-- -EEGCKYVRL ERNP-PLKLM RKFKLPDYCN  110

Consensus                KS------NG KRKRE-EE-- -EEGCKYIRL ERR--P---V RKFRLPEDAD  150
```

| | | | | | |
|---|---|---|---|---|---|
| gi\|472940 | TDKI SALCQD | GVLTVTVEKL | PPPEPKKPKT | IQVQVA | 160 |
| CeresClone:923131 | AGAVAARCEN | GVLTVTVKKQ | PPP-EKKTKS | VQVAI A | 178 |
| CeresClone:355400 | TGGVAARCEN | GVLTVTVKKL | PPP-EKKAKT | VQVTI A | 174 |
| gi\|50915316 | TGGI SARCEN | GVLTVTVKKR | PPP-EKKTKS | VQVTI A | 172 |
| Lead-CeresClone97415 | MASVTAKYQE | GI LTVVI KKL | PPQ-PPKPKT | VQI AVS | 155 |
| CeresClone:940194 | VEAVAAKYQD | GVLTVTVGKV | PPQ-PPKKKT | VQI AVS | 154 |
| CeresClone:637786 | VSAI TAKCEN | GVLTVVVEKH | PPP--QKSKT | VEVAI A | 132 |
| gi\|15148884 | VSAI TAKCEN | GVLTVVVEKM | PPP--SKAKT | VKVAVS | 144 |
| Consensus | V-A--AKCEN | GVLTVTVKKM | PPP--KK-KT | VQVA-A | 186 |

| | | | | | | |
|---|---|---|---|---|---|---|
| CeresClone:237870 | ---------- | ---------- | ---------- | ---------- | ---------- | 0 |
| gi\|50907773 | -MAAANLLSR | ALL------- | PALNPNPSSH | SNRVSPSAVS | LRCRHCLTAS | 42 |
| Lead-CeresClone96020 | MAAVTQFLSQ | PSSTRGTLNQ | YQLNQTSLS- | --RIPFLSLK | STLKPLKRLS | 47 |
| CeresClone:593648 | -MAGSHLLSH | SPSLPKTYN- | YSLNQNPLSQ | NLFFPPLKFK | STTKPRV--- | 45 |
| Consensus | -MA---LLS- | --S---T-N- | Y-LNQNPLS- | --R-PPL--K | ST-KP----S | 50 |
| CeresClone:237870 | ------MASP | SPPPQPAAAG | V----PKHCF | RRGADGYLYC | EGVRVEDAMA | 40 |
| gi\|50907773 | VRASLSTAAP | SPPPRPAAAA | ADGRAPKRCF | RRGADGHLYC | EGVRVEDAMG | 92 |
| Lead-CeresClone96020 | VKAAVSQNST | KTLTKESASS | -----FDHCF | KKSSDGFLYC | EGTKVQDIME | 92 |
| CeresClone:593648 | LRAVLSQNAA | KTAVEDTKNA | H----FQHCF | TKSEDGYLYC | EGLKVHDIME | 91 |
| Consensus | VRA-LSQ--P | --PP--AAAA | ------KHCF | R--ADGYLYC | EGV-VED-ME | 100 |
| CeresClone:237870 | AAERSPFYLY | SKLQILRNFA | AYRDALQGLR | SIVGYAVKAN | NNLPVLRVLR | 90 |
| gi\|50907773 | AAERTPFYLY | SKPQVVRNFT | AYRDALEGLR | SIVGYAVKAN | NNLRVLQLLR | 142 |
| Lead-CeresClone96020 | TVEKRPFYLY | SKPQITRNLE | AYKEALEGVR | SVIGYAIKAN | NNLKILEYLR | 142 |
| CeresClone:593648 | SVERRPFYLY | SKPQITRNVE | AYKDALEGLS | SIIGYAIKAN | NNLKILEHLR | 141 |
| Consensus | A-ER-PFYLY | SKPQI-RN-E | AY-DALEGLR | SI-GYA-KAN | NNLK-LE-LR | 150 |
| CeresClone:237870 | ELGCGAVLVS | GNELRLALQA | GFDPARCIFN | GNGKTLEDLK | LAAESGVFVN | 140 |
| gi\|50907773 | ELGCGAVLVS | GNELRLALRA | GFDPTRCIFN | GNGKTLEDLV | LAAESGVFVN | 192 |
| Lead-CeresClone96020 | SLGCGAVLVS | GNELRLALLA | GFDPTKCIFN | GNGKSLEDLV | LAAQEGVFVN | 192 |
| CeresClone:593648 | HLGCGAVLVS | GNELRLALRA | GFDPTRCIFN | GNGKILEDLV | LAAQEGVFVN | 191 |
| Consensus | ELGCGAVLVS | GNELRLALRA | GFDPTRCIFN | GNGKTLEDLV | LAA--GVFVN | 200 |
| CeresClone:237870 | VDSEFDLENI | VRAARATGKK | VPVLLRINPD | VDPQVHPYVA | TGNKTSKFGI | 190 |
| gi\|50907773 | IDSEFDLENI | VTAARVAGKK | VPVLLRINPD | VDPQVHPYVA | TGNKTSKFGI | 242 |
| Lead-CeresClone96020 | VDSEFDLNNI | VEASRISGKQ | VNVLLRINPD | VDPQVHPYVA | TGNKNSKFGI | 242 |
| CeresClone:593648 | IDSEFDLENI | TEAAKRAGKK | VNVLLRINPD | VDPQVHPYVA | TGNKNSKFGI | 241 |
| Consensus | -DSEFDLENI | VEAAR-AGKK | V-VLLRINPD | VDPQVHPYVA | TGNK-SKFGI | 250 |

```
CeresClone:237870         RNEKLQWFLN SIKSYSNEIK LVGVHCHLGS TITKVDIFRD AAVLMVNYVD  240
gi|50907773               RNEKLQWFLD SIKSYSNDIT LVGVHCHLGS TITKVDIFRD AAGLMVNYVD  292
Lead-CeresClone96020      RNEKLQWFLD EVKAHPKELK LVGAHCHLGS TITKVDIFRD AAVLMIEYID  292
CeresClone:593648         RNEKLQWFLD AVKELPNELK LVGAHCHLGS TITKVDIFRD AAILMINYID  291

Consensus                 RNEKLQWFLD S-KSY-NE-K LVG-HCHLGS TITKVDIFRD AAVLM-NY-D  300

CeresClone:237870         EIRAQGFKLE YLNIGGGLGI DYHHTDAVLP TPMDLINTVR ELVLSQDLTL  290
gi|50907773               EIRAQGFELE YLNIGGGLGI DYHHTDAVLP TPMDLINTVR ELVLSRDLTL  342
Lead-CeresClone96020      EIRRQGFEVS YLNIGGGLGI DYYHAGAVLP TPMDLINTVR ELVLSRDLNL  342
CeresClone:593648         QIRDQGFEVD YLNIGGGLGI DYYHSGAILP TPRDLIDTVR DLVISRGLNL  341

Consensus                 EIRAQGFE-E YLNIGGGLGI DY-HT-AVLP TPMDLINTVR ELVLSRDL-L  350

CeresClone:237870         IIEPGRSLIA NTCCFVNRVT GVKSNGTKNF IVVDGSMAEL IRPSLYGAYQ  340
gi|50907773               IIEPGRSLIA NTCCFVNRVT GVKSNGTKNF IVVDGSMAEL IRPSLYGAYQ  392
Lead-CeresClone96020      IIEPGRSLIA NTCCFVNYVT GVKTNGTKNF IVIDGSMAEL IRPSLYDAYQ  392
CeresClone:593648         IIEPGRSLIA NTCCLVNRVT GVKSNGSKNF IVIDGSMAEL IRPSLYDAYQ  391

Consensus                 IIEPGRSLIA NTCCFVNRVT GVKSNGTKNF IV-DGSMAEL IRPSLY-AYQ  400

CeresClone:237870         HIELVSPPTP GAEVATFDIV GPVCESADFL GKDRELPTPD EGACLVVHDA  390
gi|50907773               HIELVSPSP- DAEVATFDIV GPVCESADFL GKDRELPTPD KGACLVVHDA  441
Lead-CeresClone96020      HIELVSPTPP EAEVTKFDVV GPVCESADFL GKDRELPTPP QGACL-----  437
CeresClone:593648         HIELVSPAPS NAETTTFDVV GPVCESADFL GKGRELPTPA KGTGLVVHDA  441

Consensus                 HIELVSP-PP -AEV-TFD-V GPVCESADFL GKDRELPTPD KGACLVVHDA  450

CeresClone:237870         GAYCMSMAST YNLKLRPPEY WVEEDGSIVK IRHEEKLDDY MKFFDGLPA   439
gi|50907773               GAYCMSMAST YNLKLRPPEY WVEDDGSIAK IRRGESFDDY MKFFDNLSA   490
Lead-CeresClone96020      ---------- ---------- W--------- ---------F MTLVHTV--   446
CeresClone:593648         GAYCMSMAST YNLKMRPPEY WVEDDGSVSK IRHGETFEDH IRFFEGL--   488

Consensus                 GAYCMSMAST YNLKLRPPEY WVEDDGSI-K IRHGE-FDDY MKFFDGL-A   499
```

```
CeresClone:258380       MGYEDEPPEP EIEEGAEEEP ENNEDAGWLL LPHRFVFRFW FVGEREEMAA  50
CeresClone:942159       ---------- ---------- ---------- ---------- ---------M   1
CeresClone:963616       ---------- ---------- ---------- ---------- ---------M   1
CeresClone:972545       ---------- ---------- ---------- ---------- ---------M   1
CeresClone:1101112      ---------- ---------- ---------- ---------- -------MAS   3
CeresClone:583672       ---------- ---------- ---------S ASLTPLNTNF LGFIQFSMAS  21
CeresClone:965777       ---------- ---------- ---------- ---------- -------MAS   3
CeresClone:945779       ---------- ---------- ---------- ---------- -------MAA   3
CeresClone:1092319      ---------- ---------- ---------- ---------- -------MAA   3
Lead-CeresClone95453    ---------- ---------- ---------- ---------- -------MAS   3
CeresClone:1091493      ---------- ---------- ---------- ---------- -------MAS   3
CeresClone:977670       ---------- ---------- ---------- ---------- -------MAS   3

Consensus               ---------- ---------- ---------- ---------- -------MAS  50

CeresClone:258380       SDVEYRCFVG GLAWATDDHS LNNAFSLYGE VLESKIILDR ETQRSRGFGF 100
CeresClone:942159       ADVEYRCFVG XLAWATDDQS LQNAFSKYGD VIDSKIITDR ETGRSRGFGF  51
CeresClone:963616       SEVEYRCFVG GXAWATGDAE LERTFSQFGE VIDSKIINDR ETGRSRGFGF  51
CeresClone:972545       SEVEYRCFVX GLAWATGDAE LERTFXQFGE VIDSKIINDR ETGRSRGFGF  51
CeresClone:1101112      ADVEYRCFVG GLAWATDNYD LEKAFSQYGD VVESKIINDR ETGRSRGFGF  53
CeresClone:583672       SDVEYRCFVG GLAWATDDQA LERAFSQYGE IVETKIINDR ETGRSRGFGF  71
CeresClone:965777       PDVEYRCFVG GLAWATDERS LETAFSKFGE LVDSKIINDR ETGRSRGFGF  53
CeresClone:945779       PDVEYRCFVG GLAWATDERS LETAFSKFGE LVDSKIINDR ETGRSRGFGF  53
CeresClone:1092319      PDVEYRCFVG GLAWATDERS LETAFSKFGE LVDSKIINDR ETGRSRGFGF  53
Lead-CeresClone95453    GDVEYRCFVG GLAWATDDRA LETAFAQYGD VIDSKIINDR ETGRSRGFGF  53
CeresClone:1091493      PDVEYRCFVG GLAWATDDRA LETAFSQFGD VLDSKIINDR ETGRSRGFGF  53
CeresClone:977670       PDVEYRCFVG GLAWATDDRA LETAFSQYGD VLDSKIINDR ETGRSRGFGF  53

Consensus               SDVEYRCFVG GLAWATDDRS LETAFSQ-GE VIDSKIINDR ETGRSRGFGF 100
```

| | | | | | | |
|---|---|---|---|---|---|---|
| CeresClone:258380 | VTFSTEDAMR | SAI EGMNGKE | LDGRNI TVNE | AQSRGGRGGG | GGGYGGGR-- | 148 |
| CeresClone:942159 | VTFASDEAMR | QAI EAMNGQD | LDGRNI TVNE | AQSRR--SGG | GGG------- | 92 |
| CeresClone:963616 | VTFKDEKSMK | DAI DEMNGKE | LDGRTI TVNE | AQSRG--GGG | GGG------- | 92 |
| CeresClone:972545 | VTFKDEKSMK | DAI DEMNGKE | LDGRTI XVXE | AQSRG--GGG | GGG------- | 92 |
| CeresClone:1101112 | VTFASEDSMR | DAI EGMNGQN | LDGRNI TVNE | AQSRG--SRG | GGG--GGY-- | 97 |
| CeresClone:583672 | VTFASEQSMK | DAI EGMNGQN | LDGRNI TVNE | AQSRG--GGG | GGGGGGGYG | 119 |
| CeresClone:965777 | VTFKDEQSMK | DAI EGMNGQD | LDGRSI TVNE | AQSRG--SGG | GGG---GR-- | 96 |
| CeresClone:945779 | VTFKDEQSMK | DAI EGMNGQD | LDGRSI TVNE | AQSRG--SGG | GGR------- | 94 |
| CeresClone:1092319 | VTFKDEQSMK | DAI EGMNGQD | LDGRSI TVNE | AQSRG--SGG | GGG---GR-- | 96 |
| Lead-CeresClone95453 | VTFKDEKAMK | DAI EGMNGQD | LDGRSI TVNE | AQSRG--SGG | GGGHRGGG-- | 99 |
| CeresClone:1091493 | VTFKDEKSMK | DAI EGMNGQD | LDGRSI TVNE | AQSRG--SGG | GGG--GRG-- | 97 |
| CeresClone:977670 | VTFKDEKSMK | DAI EGMNGQD | LDGRSI TVNE | AQSRG----GG | GGG--GRG-- | 96 |
| Consensus | VTFKDE-SMK | DAI EGMNGQD | LDGRNI TVNE | AQSRG--SGG | GGG--GG--- | 150 |

| | | | | | | |
|---|---|---|---|---|---|---|
| CeresClone:258380 | ---------- | --RDGGGYG- | -GGGGGYGG- | -----GRGGY | GG-------- | 170 |
| CeresClone:942159 | ---------- | --GFGGG--- | -GGGGGYF-- | ---------- | ---------- | 103 |
| CeresClone:963616 | ---------- | --RGGGGYGD | RRGGGGYGS- | -----GGGGY | GG-------- | 116 |
| CeresClone:972545 | ---------- | --RGGGGYGD | RRGGGGYXS- | ---------- | ---------- | 109 |
| CeresClone:1101112 | ---------- | --GSGGGYNR | SGGAGGYGG- | ----RREGAY | NR-------- | 122 |
| CeresClone:583672 | GGRGGGYGGG | GRGGGGGYNR | SGGGGGYGG- | ------GGGY | GGG------- | 155 |
| CeresClone:965777 | ---------- | --GGGGGYR- | -GGGGGYG-- | -----GGGGY | ---------- | 115 |
| CeresClone:945779 | ---------- | --GGGGGYRG | -GGGGGYGG- | -----GGGGY | ---------- | 115 |
| CeresClone:1092319 | ---------- | --GGGGGYRG | GGGGGGYGG- | -----GGGGY | ---------- | 118 |
| Lead-CeresClone95453 | ---------- | --GGGGGY-S | -GGGGSYGGG | GGXREGGGGY | SGGGGYSSRG | 135 |
| CeresClone:1091493 | ---------- | --GGGGGYRS | -GGGGGYGG- | -----GGGGY | GG-------- | 120 |
| CeresClone:977670 | ---------- | --GGGGGYRS | -GGGGGYGG- | -----GGGGY | GG-------- | 119 |
| Consensus | ---------- | --GGGGGY-- | -GGGGGYGG- | -----GGGGY | -G-------- | 200 |

```
CeresClone:258380          ------GGGG YGGG--NRGG G------YG- ---NNDGNWR N---------  193
CeresClone:942159          ------GGQR RE-------- ---------- ---------- ----------  109
CeresClone:963616          ------GGGR RDGGG----- -------YG- ---GGDGSY- ----------  133
CeresClone:972545          ------GGGG RGGGG----- -------YX- ---SGG---- ----------  123
CeresClone:1101112         ------NGGG YGGDRDHRYG P------YG- ---DGGSRYS R---------  147
CeresClone:583672          ------GGGG YGGGRDRGYG GGGDRG-YSR GGDGGDGGWR N---------  189
CeresClone:965777          ------GGGR REGG--YSGG GGGGYSSRG- ---GGGGGYG GGG-------  146
CeresClone:945779          ------GGGR REGG--YSGG GGGYSS-RG- ---GGGGGYG GGGRREGGG   151
CeresClone:1092319         ------GGGR REGG--YSGG GGGYSS-RG- ---GGGGGYG GGGRREGG-  153
Lead-CeresClone95453       GGGGSYGGGR REGGGGYGGG EGGGYG-GS- ---GGGGGW- ----------  169
CeresClone:1091493         ------GGGR REGG------ -------YS- ---GGGGGG- ----------  136
CeresClone:977670          ------GGGR REGG------ -------YS- ---GGGGG-- ----------  134

Consensus                  ------GGGR REGG-----G -------YG- ---GGGGGW- ----------  249
```

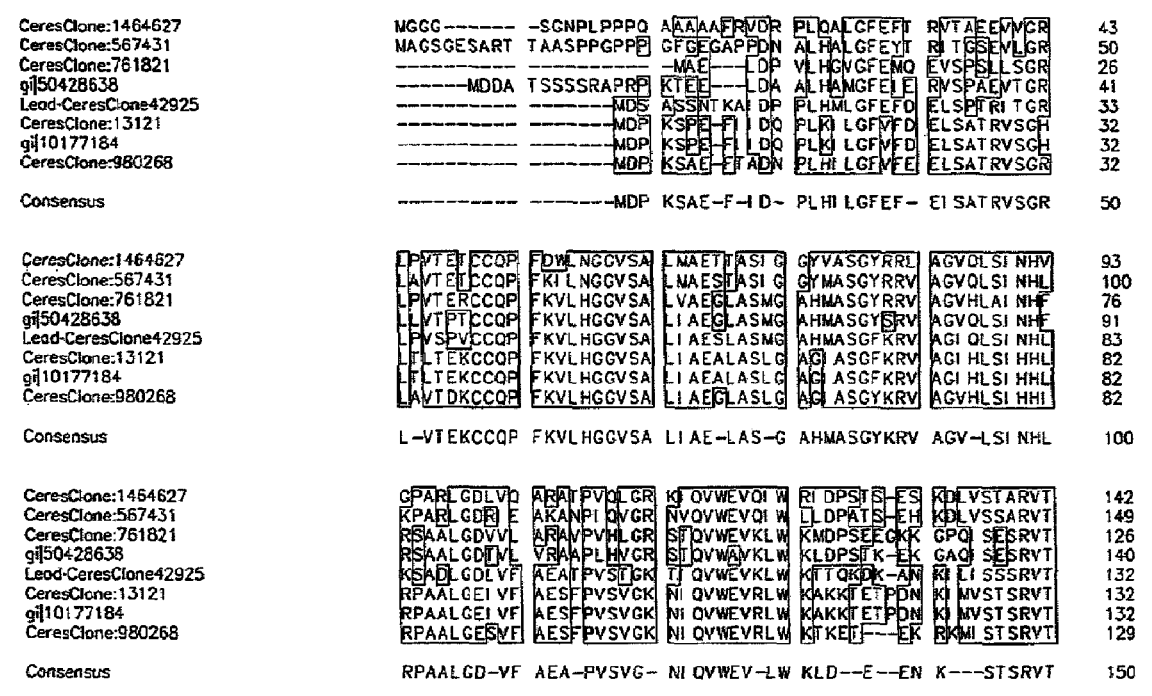

```
CeresClone:1464627      MGGG------ -SGNPLPPPQ AAAAAFRVDR PLQALGFEFT RVTAEEVVGR   43
CeresClone:567431       MAGSGESART TAASPPGPPP GFGEGAPPDN ALHALGFEYT RITGSEVLGR   50
CeresClone:761821       ---------- ---------- -MAE---LDP VLHGVGFEMQ EVSPSLLSGR   26
gi|50428638             ------MDDA TSSSSRAPRP KTEE---LDA ALHAMGFEIE RVSPAEVTGR   41
Lead-CeresClone42925    ---------- -------MDS ASSNTKAIDP PLHMLGFEFD ELSPTRITGR   33
CeresClone:13121        ---------- -------MDP KSPE-FIIDQ PLKILGFVFD ELSATRVSGH   32
gi|10177184             ---------- -------MDP KSPE-FIIDQ PLKILGFVFD ELSATRVSGH   32
CeresClone:980268       ---------- -------MDP KSAE-FTADN PLHILGFVFE ELSATRVSGR   32

Consensus               ---------- -------MDP KSAE-F-ID- PLHILGFEF- EISATRVSGR   50

CeresClone:1464627      LPVTETCCQP FDWLNGGVSA LMAETTASIG GYVASGYRRL AGVQLSINHV   93
CeresClone:567431       LAVTETCCQP FKILNGGVSA LMAESTASIG GYMASGYRRV AGVQLSINHL  100
CeresClone:761821       LPVTERCCQP FKVLHGGVSA LVAEGLASMG AHMASGYRRV AGVHLAINHF   76
gi|50428638             LLVTPTCCQP FKVLHGGVSA LIAEGLASMG AHMASGYSRV AGVQLSINHF   91
Lead-CeresClone42925    LPVSPVCCQP FKVLHGGVSA LIAESLASMG AHMASGFKRV AGIQLSINHL   83
CeresClone:13121        LTLTEKCCQP FKVLHGGVSA LIAEALASLG AGIASGFKRV AGIHLSIHHL   82
gi|10177184             LTLTEKCCQP FKVLHGGVSA LIAEALASLG AGIASGFKRV AGIHLSIHHL   82
CeresClone:980268       LAVTDKCCQP FKVLHGGVSA LIAEGLASLG AGIASGYKRV AGVHLSIHHI   82

Consensus               L-VTEKCCQP FKVLHGGVSA LIAE-LAS-G AHMASGYKRV AGV-LSINHL  100

CeresClone:1464627      GPARLGDLVQ ARATPVQLGR KIQVWEVQIW RIDPSTS-ES KDLVSTARVT  142
CeresClone:567431       KPARLGDRIE AKANPIQVGR NVQVWEVQIW LLDPATS-EH KDLVSSARVT  149
CeresClone:761821       RSAALGDVVL ARAVPVHLGR STQVWEVKLW KMDPSEEGKK GPQISESRVT  126
gi|50428638             RSAALGDTVL VRAAPLHVGR STQVWAVKLW KLDPSTK-EK GAQISESRVT  140
Lead-CeresClone42925    KSADLGDLVF AEATPVSTGK TIQVWEVKLW KTTQKDK-AN KILISSSRVT  132
CeresClone:13121        RPAALGEIVF AESFPVSVGK NIQVWEVRLW KAKKTETPDN KIMVSTSRVT  132
gi|10177184             RPAALGEIVF AESFPVSVGK NIQVWEVRLW KAKKTETPDN KIMVSTSRVT  132
CeresClone:980268       RPAALGESVF AESFPVSVGK NIQVWEVRLW KTKET---EK RKMISTSRVT  129

Consensus               RPAALGD-VF AEA-PVSVG- NIQVWEV-LW KLD--E--EN K---STSRVT  150
```

| | | |
|---|---|---|
| CeresClone:1464627 | LLTNLPTPEK MKSFEQGLKK F--------- SSKL | 167 |
| CeresClone:567431 | LLTNLSTPEE MKI YEKGI KK Y--------- -AKL | 173 |
| CeresClone:761821 | LLCNLPVPDN LHHAGDALKK YAAAATTPTP TSKL | 160 |
| gi\|50428638 | LLCNLPVPES VKNAGEALKK Y--------- -SKL | 164 |
| Leod-CeresClone42925 | LI CNLPI PDN AKDAANMLKM V--------- -AKL | 156 |
| CeresClone:13121 | LFCGLPI PDH VKDAPDELKK V--------- ISKL | 157 |
| gi\|10177184 | LFCGLPI PDH VKDAPDELKK V--------- ISKL | 157 |
| CeresClone:980268 | LLSGLPVPDH AKDSLDQLKK F--------- VSKL | 154 |
| Consensus | LLCNLP-PD- VKDA-D-LKK Y--------- -SKL | 184 |

```
gi|18034437              ---------L GLSLG-SFGP SSSGGSHPPP ALPLPSNLFR PSLQE---ID    37
gi|1149535               MMIHQREDHL GLSLSLSSPA HRPSSSSSPL QLNLAPSMPT PSTPPFNLFH    50
Lead-CeresClone42533     MMFEK--DDL GLSLGLNFP- -----KKQIN LKSNPSVSMT PSSSSFGLFR    42
gi|8919876               MMLEK--DDL GLSLGLNYP- -----KKQMN LNSNPSVSMT PSSSSFGLLR    42
CeresClone:527278        -MVQK--EDL GLSLSLNFPH HSTPNPQHLS LMSSSTHSSS PSGFN---PQ    44
CeresClone:514259        MTVEK--EDL GLSLSLSFP- -----QNPPT HLHLNLVSSS PSSHN---PQ    39
CeresClone:1044452       MTVQK--EDL GLSLSLSFP- ---------- -----LLSSS PSSHN---PQ    29
gi|1234900               MTVQK--EDL GLSLSLSFP- ---------- -----LLSSS PSSHN---PQ    29

Consensus                MMV-K--DDL GLSLSLSFP- ---------- -L---SVSST PSS-N---PQ    50

gi|18034437              RTQRSLGAFL QAP--TAAAV CREPASAFRG IDVNRPPTIV DCGEENNNPI    85
gi|1149535               KKETSDGYIL DA-------C RVETRSFLKG IDVNRLPAIT VDMEEEA---    90
Lead-CeresClone42533     RSSWNESFTS SVP--NSDSS QKETRTFIRG IDVNRPPSTA EYGDEDA---    87
gi|8919876               RSSLNESFTS SVP--NSDSS QKETRTFIRG IDVNRPPSTA EYGEEDA---    87
CeresClone:527278        KPSWNEAFAS SDPDRNSDTC RGETRSFLRG IDVNRLPSAV DA-EEEA---    90
CeresClone:514259        KPSWNDPFTS SA-------- ---GSSFLRG IDVNRLPSVV DC-EEEA---    74
CeresClone:1044452       KPSWNDPIFT SS-------- -GEAGSFLRG IDVNRLPSVV DC-EEEA---    66
gi|1234900               KPSWNDPIFT SS-------- -GEAGSFLRG IDVNRLPSVV DC-EEEA---    66

Consensus                KPSWND-F-S SAP---S-S- --ETRSFLRG IDVNRLPSVV DC-EEEA---   100

gi|18034437              ASPSPNSTVC SSSGKRTSG- -EREEKEDGD RAASSSFEVE DDDGGGGDAS   133
gi|1149535               GVSSPNSTIS SVSGKRSLER SENGNGDDL- LDCSRGLINS DEEDG---DN   136
Lead-CeresClone42533     GVSSPNSTVS SSTGKRSER- -----EEDTD PQGSRG-I-S DDEDG---DN   126
gi|8919876               GVSSPNSTVS SSTGKRSER- -----EEDTD PQGSRGGI-S DDEDG---DN   127
CeresClone:527278        GVSSPNSTVS CVSGKRSER- EPNGEEHDMD RACSRG-I-S DEEDA---ET   134
CeresClone:514259        GVSSPNSTVS SVSGKRSERE EANGEENDTD RACSRGII-S DEEDA---ET   120
CeresClone:1044452       GVSSPXSTVS SVSGKRSER- ETNGEENDTD RACSRGII-S DEEDA---ET   111
gi|1234900               GVSSPNSTVS SVSGKRSER- ETNGEENDTD RACSRGII-S DEEDA---ET   111

Consensus                GVSSPNSTVS SVSGKRSER- E-NGEE-DTD RACSRGII-S DEED----ET   150
```

| | | | | | | |
|---|---|---|---|---|---|---|
| gi\|18034437 | ARKKLRLSKE | QAVVLEETFK | EHSTLNPKEK | IALAKQLNLM | PRQVEVWFQN | 183 |
| gi\|1149535 | SRKKLRLSKD | QSAI LEDSFK | EHNTLNPKQK | LALAKRLGLR | PRQVEVWFQN | 186 |
| Lead-CeresClone42533 | SRKKLRLSKD | QSAI LEETFK | DHSTLNPKQK | QALAKQLGLR | ARQVEVWFQN | 176 |
| gi\|8919876 | SRKKLRLSKD | QSAI LEETFK | DHSTLNPKQK | QALAKQLGLR | ARQVEVWFQN | 177 |
| CeresClone:527278 | SRKKLRLSKD | QSSI LEESFK | EHNTLNPKQK | LALAKQLGLR | PRQVEVWFQN | 184 |
| CeresClone:514259 | SRKKLRLSKD | QSI I LEESFK | EHNTLNPKQK | LALAKQLGLR | ARQVEVWFQN | 170 |
| CeresClone:1044452 | SRKKLRLSKD | QSI VLEESFK | EHNTLNPKQK | LALAKQLGLR | ARQVEVWFQN | 161 |
| gi\|1234900 | SRKKLRLSKD | QSI VLEESFK | EHNTLNPKQK | LALAKQLGLR | ARQVEVWFQN | 161 |
| Consensus | SRKKLRLSKD | QS-I LEESFK | EHNTLNPKQK | LALAKQLGLR | ARQVEVWFQN | 200 |
| | | | | | | |
| gi\|18034437 | RRARTKLKQT | EVDCEYLRRC | CENLTEENRR | LQKEVNELRA | LKLSPQFY-- | 231 |
| gi\|1149535 | RRARTKLKQT | EVDCEFLKRC | CENLTDENRR | LMKEVQELRA | LKLSPQFYMQ | 236 |
| Lead-CeresClone42533 | RRARTKLKQT | EVDCEFLRRC | CENLTEENRR | LQKEVTELRA | LKLSPQFYMH | 226 |
| gi\|8919876 | RRARTKLKQT | EVDCEFLRRC | CENLTEENRR | LQKEVTELRA | LKLSPQFYMH | 227 |
| CeresClone:527278 | RRARTKLKQT | EVDCEVLKRC | CENLTEENRR | LQKEVQELRA | LKLSPQFYMQ | 234 |
| CeresClone:514259 | RRARTKLKQT | EVDCEFLKRC | CENLTVENRR | LQKEVQELRA | LKLSPQFYMH | 220 |
| CeresClone:1044452 | RRARTKLKQT | EVDCEFLKRC | CENLTEENRR | LQKEVQELRA | LKLSPQFYMH | 211 |
| gi\|1234900 | RRARTKLKQT | EVDCEFLKRC | CENLTEENRR | LQKEVQELRA | LKLSPQFYMH | 211 |
| Consensus | RRARTKLKQT | EVDCEFLKRC | CENLTEENRR | LQKEVQELRA | LKLSPQFYMH | 250 |
| | | | | | | |
| gi\|18034437 | MSPPTTLTMC | PQCERVAAQP | -----SSAAA | IRPPSHH--- | ---QRPAAGM | 270 |
| gi\|1149535 | MTPPTTLTMC | PSCERVSAPP | SSSTGPSSTP | VETPRPHHSG | S--SHHRVAF | 284 |
| Lead-CeresClone42533 | MSPPTTLTMC | PSCEHVSVPP | -----PQ--P | QAATSAHH-- | -----RSLPV | 262 |
| gi\|8919876 | MSPPTTLTMC | PSCEHVSAPP | -----PQQPP | QAATSAQH-- | ---HRGSLPV | 267 |
| CeresClone:527278 | MSPPTTLTMC | PSCERVAVXS | SA---XGSAT | RHHPMAHAHA | ---HARPMPN | 278 |
| CeresClone:514259 | MTPPTTLTMC | PSCERVAVPP | -----SS--A | VDPAMRHHHV | PPTQPRAFPI | 263 |
| CeresClone:1044452 | MTPPTTLTMC | PSCERVAFPP | -----PL--P | LI LPRVTITC | LHLTPGPFPL | 254 |
| gi\|1234900 | MTPPTTLTMC | PSCERVAVPP | -----SS--A | VDPATRHHHV | PPSHPRAFPI | 254 |
| Consensus | M-PPTTLTMC | PSCERVAVPP | -----PS--P | V--PS-HH-- | -----RALP- | 300 |

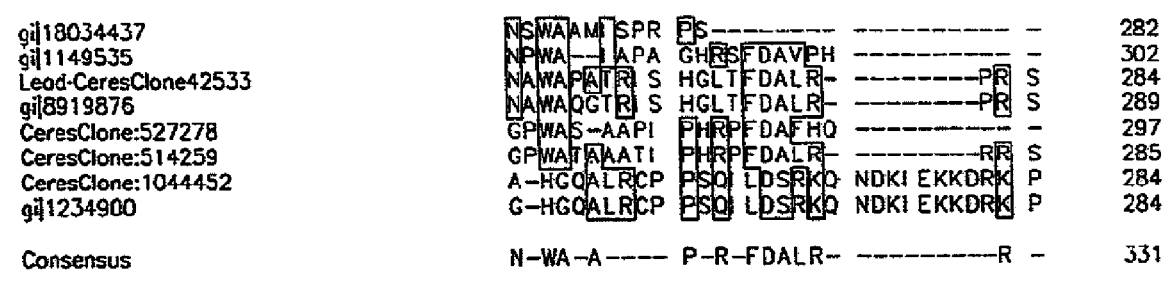

| | | |
|---|---|---|
| gi\|18034437 | NSWAAMISPR PS---------- ----------- - | 282 |
| gi\|1149535 | NPWA--IAPA GHRSFDAVPH ----------- - | 302 |
| Lead-CeresClone42533 | NAWAPATRI S HGLTFDALR- ---------PR S | 284 |
| gi\|8919876 | NAWAQGTRI S HGLTFDALR- ---------PR S | 289 |
| CeresClone:527278 | GPWAS-AAPI PHRPFDAFHQ ----------- - | 297 |
| CeresClone:514259 | GPWATAAATI PHRPFDALR- ---------RR S | 285 |
| CeresClone:1044452 | A-HGQALRCP PSQI LDSRKQ NDKI EKKDRK P | 284 |
| gi\|1234900 | G-HGQALRCP PSQI LDSRKQ NDKI EKKDRK P | 284 |
| Consensus | N-WA-A---- P-R-FDALR- ---------R - | 331 |

| | | |
|---|---|---|
| CeresClone:1245439 | -MAGGVIQQI LRRKLHPRFT NSPLLSPIVA KKDDAGSTGS QSLRALALIG | 49 |
| CeresClone:112937 | MVGGGVIRQL LRRKLHSQSV ATPVLSMLSS KKANE-DAGS AGLRAFALMG | 49 |
| CeresClone:30054 | MVGGGVIRQL LRRKLHSQSV ATPVLSMLSS KKANE-DAGS AGLRAFALMG | 49 |
| Lead-CeresClone41320 | MVGGGVIQQI LRRKLHSQSL ATPVLSWFSS KKAHE-DAGS SGVRALALLG | 49 |
| CeresClone:621235 | -MAGGVIQQI LRRKLHPRFT NSPLLSPIVA KKDDAGSTGS QSLRALALIG | 49 |
| CeresClone:516928 | -MAGGVIQQI LRRKLHPRFT NSPLLSPIVA KKDDAGSTGS QSLRALALIG | 49 |
| CeresClone:287422 | MAAARGLNQL LKRTLYNQSV GSSPLFSFRG KHEES----S AGLRALALLG | 46 |
| CeresClone:399596 | ---------- ---------- ---------- ---------- ---------- | 0 |
| CeresClone:1556600 | MAAARGINQL LKRILHNQSA GPWLLSSFRG NHEES----S AGLRALALLG | 46 |
| Consensus | M-AGGVIQQ- LRRKLHSQS- -SPLLS-I-- KKDDA---GS AGLRALAL-G | 50 |

| | | |
|---|---|---|
| CeresClone:1245439 | AGLSGLFSFS TMAAADEAEH GLACPSYPWP HKGILSSYDH ASIRRGHQVY | 99 |
| CeresClone:112937 | AGITGLLSFS TVASADEAEH GLECPNYPWP HEGILSSYDH ASIRRGHQVY | 99 |
| CeresClone:30054 | AGITGLLSFS TVASADEAEH GLECPNYPWP HEGILSSYDH ASIRRGHQVY | 99 |
| Lead-CeresClone41320 | AGVSGLLSFS TVASADEAEH GLESPEYPWP HDGILSSYDH ASIRRGHQVY | 99 |
| CeresClone:621235 | AGLSGLFSFS TMAAADEAEH GLACPSYPWP HKGILSSYDH ASIRRGHQVY | 99 |
| CeresClone:516928 | AGLSGLFSFS TMAAADEAEH GLACPSYPWP HKGILSSYDH ASIRRGHQVY | 99 |
| CeresClone:287422 | VGASGLLSFA TIASADEAEH GLAAPDYPWP HAGIMSSYDH ASIRRGHQVY | 96 |
| CeresClone:399596 | ---------- ---------- ---------- ----MSSYDH ASIRRGHQVY | 16 |
| CeresClone:1556600 | VGASGLLSFA TIASADEAEH GLAAPDYPWP HAGIMSSYDH ASIRRGHQVY | 96 |
| Consensus | AGLSGLLSFS T-ASADEAEH GLACP-YPWP H-GILSSYDH ASIRRGHQVY | 100 |

| | | |
|---|---|---|
| CeresClone:1245439 | TEVXASWHSM XLISYXDLGG ---------- ---------- ---------- | 119 |
| CeresClone:112937 | QQVCASCHSM SLISYRDLVG VAYTEEEAKA MAAEIEVVDG PNDEGEMFTR | 149 |
| CeresClone:30054 | QQVCASCHSM SLISYRDLVG VAYTEEEAKA MAAEIEVVDG PNDEGEMFTR | 149 |
| Lead-CeresClone41320 | QQVCASCHSM SLISYRDLVG VAYTEEEAKA MAAEIEVVDG PNDEGEMFTR | 149 |
| CeresClone:621235 | TEVCASCHSM SLISYRDLVG VAYTEEEVKA MAAEIEVVDG PNDEGEMFTR | 149 |
| CeresClone:516928 | TEVCASCHSM SLISYRDLVG VAYTEEEVKA MAAEIEVVDG PNDEGEMFTR | 149 |
| CeresClone:287422 | TQVCASCHSM SLISYRDLVG VAYTEEETKA MAAEIEVVDG PNDEGEMFTR | 146 |
| CeresClone:399596 | TQVCASCHSM SLISYRDLVG VAYTEEETKA MAAEIEVVDG PNDEGEMFTR | 66 |
| CeresClone:1556600 | TQVCASCHSM SLISYRDLVG VAYTEEETKA MAAEIEVVDG PNDEGEMFTR | 146 |
| Consensus | TQVCASCHSM SLISYRDLVG VAYTEEE-KA MAAEIEVVDG PNDEGEMFTR | 150 |

| | | | | | | |
|---|---|---|---|---|---|---|
| CeresClone:1245439 | ---------- | ---------- | ---------- | ---------- | ---------- | 119 |
| CeresClone:112937 | PGKLSDRLPE | PYSNESAARF | ANGGAYPPDL | SLVTKARHNG | QNYVFALLTG | 199 |
| CeresClone:30054 | PGKLSDRLPE | PYSNESAARF | ANGGAYPPDL | SLVTKARHNG | QNYVFALLTG | 199 |
| Lead-CeresClone41320 | PGKLSDRFPQ | PYANESAARF | ANGGAYPPDL | SLITKARHNG | PNYVFALLTG | 199 |
| CeresClone:621235 | PGKLSDRFPQ | PYANEAAARF | ANGGAYPPDL | SLVTKARHNG | QNYVFALLTG | 199 |
| CeresClone:516928 | PGKLSDRFPQ | PYANEAAARF | ANGGAYPPDL | SLVTKARHNG | QNYVFALLTG | 199 |
| CeresClone:287422 | PGKLSDRFPQ | PYANEQAARF | ANGGAYPPDL | SLITKARHNA | QNYVFALLTG | 196 |
| CeresClone:399596 | PGKLSDRFPQ | PYANEQAARF | ANGGAYPPDL | SLITKARHNG | QNYVFALLTG | 116 |
| CeresClone:1556600 | PGKLSDRFPQ | PYANEQAARF | ANGGAYPPDL | SLITKARHNG | QNYVFALLTG | 196 |
| Consensus | PGKLSDRFPQ | PYANESAARF | ANGGAYPPDL | SL-TKARHNG | QNYVFALLTG | 200 |

| | | | | | | |
|---|---|---|---|---|---|---|
| CeresClone:1245439 | ---------- | ---------- | ---------- | ---------- | ---------- | 119 |
| CeresClone:112937 | YRDPPAGISI | REGLHYNPYF | PGGAIAMPKM | LNDEAVEYED | GTPATEAQMG | 249 |
| CeresClone:30054 | YRDPPAGISI | REGLHYNPYF | PGGAIAMPKM | LNDEAVEYED | GTPATEAQMG | 249 |
| Lead-CeresClone41320 | YRDPPAGISI | REGLHYNPYF | PGGAIAMPKM | LNDEAVEYED | GMPATEAQMG | 249 |
| CeresClone:621235 | YRDPPAGVSI | REGLHYNPYF | PGGAIAMPKM | LNDGAVEYED | GTPATEAQMG | 249 |
| CeresClone:516928 | YRDPPAGVSI | REGLHYNPYF | PGGAIAMPKM | LNDGAVEYED | GTPATEAQMG | 249 |
| CeresClone:287422 | YHDPPAGVQI | REGLHYNPYF | PGGAIAMPKM | LNDGAVEYED | GTPATEAQMG | 246 |
| CeresClone:399596 | YHDPPAGVQI | REGLHYNPYF | PGGAIAMPKM | LNDGAVEYED | GTPATEAQMG | 166 |
| CeresClone:1556600 | YRDPPAGVQI | REGLHYNPYF | PGGAIAMPKM | LNDGAVEYED | GTPATEAQMG | 246 |
| Consensus | YRDPPAGVSI | REGLHYNPYF | PGGAIAMPKM | LNDGAVEYED | GTPATEAQMG | 250 |

| | | | | | | |
|---|---|---|---|---|---|---|
| CeresClone:1245439 | -------GML | IQKKE----- | ---------- | ---------- | RL-MQLK--- | 134 |
| CeresClone:112937 | KDVVSFLSWA | AEPEMEERKL | MGFKWIFLLS | LALLQAAYYR | RLKWSVLKSR | 299 |
| CeresClone:30054 | KDVVSFLSWA | AEPEMEERKL | MGFKWIFLLS | LALLQAAYYR | RLKWSVLKSR | 299 |
| Lead-CeresClone41320 | KDIVSFLAWA | AEPEMEERKL | MGFKWIFLLS | LALLQAAYYR | RLKWSVLKSR | 299 |
| CeresClone:621235 | KDVVSFLTWA | AEPEMEERKL | MGFKWIFVLS | LALLQAAYYR | RLRWSVLKSR | 299 |
| CeresClone:516928 | KDVVSFLTWA | AEPEMEERKL | MGFKWIFVLS | LALLQAAYYR | RLRWSVLKSR | 299 |
| CeresClone:287422 | KDVVSFPSWA | AEPEMEERKL | MGVKWIFLLS | LALLQAAYYR | RMRWSVLKSR | 296 |
| CeresClone:399596 | KDVVSFLSWA | AEPEMEERKL | MGVKWIFLLS | LALLQAAYYR | RMRWSVLKSR | 216 |
| CeresClone:1556600 | KDVVSFLSWA | AEPEMEERKL | MGVKWIFLLS | LALLQAAYYR | RMRWSVLKSR | 296 |
| Consensus | KDVVSFLSWA | AEPEMEERKL | MGFKWIFLLS | LALLQAAYYR | RLRWSVLKSR | 300 |

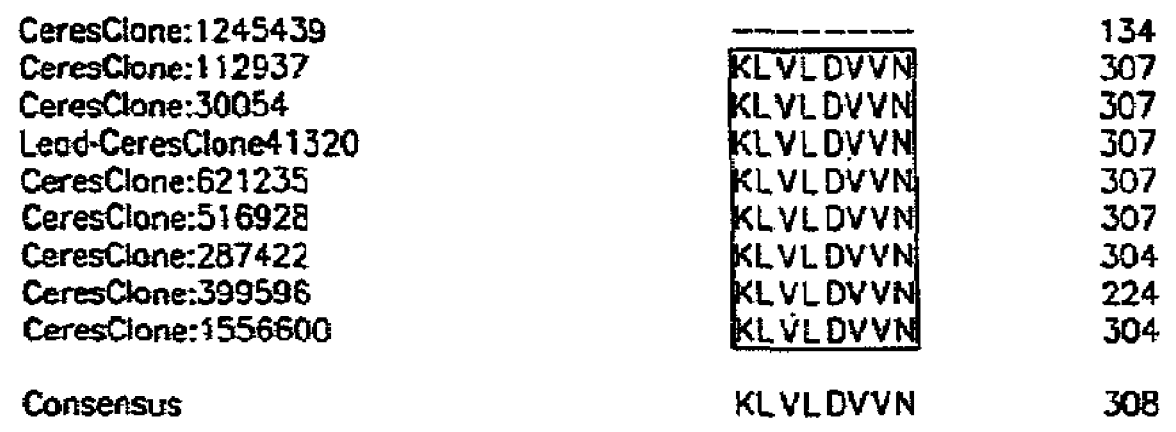

| | | |
|---|---|---|
| CeresClone:1245439 | -------- | 134 |
| CeresClone:112937 | KLVLDVVN | 307 |
| CeresClone:30054 | KLVLDVVN | 307 |
| Lead-CeresClone41320 | KLVLDVVN | 307 |
| CeresClone:621235 | KLVLDVVN | 307 |
| CeresClone:516928 | KLVLDVVN | 307 |
| CeresClone:287422 | KLVLDVVN | 304 |
| CeresClone:399596 | KLVLDVVN | 224 |
| CeresClone:1556600 | KLVLDVVN | 304 |
| | | |
| Consensus | KLVLDVVN | 308 |

```
gi|51702424              ------MPMG- ---SSAAMPA LPPGFRFHPT DEELIVHYLR RQAASMPSPV   41
gi|53749460              -------MVG- -----KISSD LPPGFRFHPT DEELIMYYLR YQATSRPCPV   38
CeresClone:533917        MDSRDSSSG-  -----SQHPH LPPGFRFHPT DEELVVHYLK RKAASAPLPV   44
gi|52353038              MESTDSSTG-  ----TRHQPQ LPPGFRFHPT DEELIVHYLK KRVAGAPIPV   45
Lead-CeresClone38214     MESTDSSGG-  ---PPPPQPN LPPGFRFHPT DEELVVHYLK RKAASAPLPV   46
CeresClone:1114366       ----------  -----MSELQ LPPGFRFHPT DEELVMHYLC RKCASQSIAM   35
CeresClone:1452029       --MVASQGG-  GRRDAEAELN LPPGFRFHPT DEELVVHYLC RKVACQQLPV   47
gi|62530909              MEMAAAVGGS  GRRDAEAELN LPPGFRFHPT DEELVVHYLC RKVARQPLPV   50
gi|56785066              --MAAAVGGS  GRRDAEAELN LPPGFRFHPT DEELVVHYLC RKVARQPLPV   48

Consensus                -----S--G-  ------AE-N LPPGFRFHPT DEELVVHYLK RK-ASQPLPV   50

gi|51702424              PIIAEVNIYK CNPWDLPGKA LFGENEWYFF SPRDRKYPNG ARPNRAAGSG   91
gi|53749460              SIIPEIDVYK FDPWELPEKA EFGENEWYFF TPRDRKYPNG VRPNRAAVSG   88
CeresClone:533917        AIIADVDLYK FDPWELPSKA TFGEQEWYFF SPRDRKYPNG ARPNRAATSG   94
gi|52353038              DIIGEIDLYK FDPWELPAKA LFGEQEWFFF SPRDRKYPNG ARPNRAATSG   95
Lead-CeresClone38214     AIIAEVDLYK FDPWELPAKA SFGEQEWYFF SPRDRKYPNG ARPNRAATSG   96
CeresClone:1114366       PIIAEIDLYK YDPWELPGLA LYGEKEWYFF SPRDRKYPNG SRPNRSAGSG   85
CeresClone:1452029       PIIAEVDLYK FDPWDLPEKA LFGRKEWYFF TPRDRKYPNG SRPNRAAGRG   97
gi|62530909              PIIAEVDLYK LDPWDLPEKA LFGRKEWYFF TPRDRKYPNG SRPNRAAGRG  100
gi|56785066              PIIAEVDLYK LDPWDLPEKA LFGRKEWYFF TPRDRKYPNG SRPNRAAGRG   98

Consensus                PIIAEVDLYK FDPWDLP-KA LFGEKEWYFF TPRDRKYPNG -RPNRAAGSG  100

gi|51702424              YWKATGTDKA ILSTPANESI GVKKALVFYR GKPPKGVKTD WIMHEYRLTA  141
gi|53749460              YWKATGTDKA IYS--ANKYV GIKKALVFYK GKPPKGVKTD WIMHEYRLSD  136
CeresClone:533917        YWKATGTDKP ILTTYGHHKV GVKKALVFYG GKPPKGVKTN WIMHEYRLVD  144
gi|52353038              YWKATGTDKP VFTSGGTQKV GVKKALVFYG GKPPKGVKTN WIMHEYRVVE  145
Lead-CeresClone38214     YWKATGTDKP VLASDGNQKV GVKKALVFYS GKPPKGVKSD WIMHEYRLIE  146
CeresClone:1114366       YWKATGADKP I---GLPKPV GIKKALVFYA GKAPKGEKTN WIMHEYRLAD  132
CeresClone:1452029       YWKATGADKP IAPKGGGGAA GIKKALVFYS GKAPRGFKTD WIMHEYRLAD  147
gi|62530909              YWKATGADKP VAPKGSARTV GIKKALVFYS GKAPRGVKTD WIMHEYRLAD  150
gi|56785066              YWKATGADKP VAPKGSARTV GIKKALVFYS GKAPRGVKTD WIMHEYRLAD  148

Consensus                YWKATGTDKP I---G----V GIKKALVFYS GKPPKGVKTD WIMHEYRL-D  150
```

| | | |
|---|---|---|
| gi\|51702424 | ADNRTIKR-- ------RGSS MRLDDWVLCR IHKKCGNLPN FSSSDQEQEH | 183 |
| gi\|53749460 | SKSQTYSK-- ------QSGS MRLDDWVLCR IYKKKNLGKT IE---MMKVE | 175 |
| CeresClone:533917 | DSFNSSSKPP PLVPHNKKNS LRLDDWVLCR IYKKSNNTTL PRPPMMEHEE | 194 |
| gi\|52353038 | NKTNNKPLGC DNIVANKKGS LRLDDWVLCR IYKKNNFQRS IDD--LHDML | 193 |
| Lead-CeresClone38214 | NKPNNRPPGC D--FGNKKNS LRLDDWVLCR IYKKNNASRH VDNDKDHDMI | 194 |
| CeresClone:1114366 | VDRSSAAR-- -----KKKNS LRLDDWVLCR IYNKKGAIEK RGPPPTPVVY | 175 |
| CeresClone:1452029 | ADRAPG---- ------KKGS RKLDEWVLCR LYNKKNNWEK VK-------- | 179 |
| gi\|62530909 | ADRAPGG--- ------KKGS QKLDEWVLCR LYNKKNNWEK VK---LEQQD | 188 |
| gi\|56785066 | ADRAPGG--- ------KKGS QKLDEWVLCR LYNKKNNWEK VK---LEQQD | 186 |
| Consensus | -D-------- ------KKGS MRLDDWVLCR IYKKKNN--- V----M---- | 200 |

| | | |
|---|---|---|
| gi\|51702424 | EQESSTVEDS Q--------- -NNHTVSSP- ---------- -KSEAFDGDG | 211 |
| gi\|53749460 | EEELEAQNVS I--------- ---------- ---------- --NNAIEVGG | 194 |
| CeresClone:533917 | ELSMDNMLPT MSTLSMANNK MQNPKPPSRS T--------- -SYGPLGLEN | 234 |
| gi\|52353038 | GSIPQNVPNS I--------- -LQGIKPS-- ---------- -NYGTILLEN | 220 |
| Lead-CeresClone38214 | DYIFRKIPPS LSMAAASTGL HHHHHNVSRS MNFFPGKFSG GGYGIFSDGG | 244 |
| CeresClone:1114366 | GDEVVEEKPR L--------- ---------- ---------- ---SEMGMPP | 193 |
| CeresClone:1452029 | AEEPEAAAPL R--------- ---------- ---------- ----NQQGAA | 196 |
| gi\|62530909 | VASVAAAAPR N--------- -HHHQ----- ---------- -NGEVMDAAA | 212 |
| gi\|56785066 | VASVAAAAPR N--------- -HHHQ----- ---------- -NGEVMDAAA | 210 |
| Consensus | ---V----PS ---------- --H------- ---------- -----M---- | 250 |

| | | |
|---|---|---|
| gi\|51702424 | DDHLQLQ--- -QFRPMAIAK ---------- SCSLTDLLNI VDYAALSHLL | 247 |
| gi\|53749460 | PQIMKLPRI- ---------- ---------- -CSLSHLLEL DYFGSIPQLL | 222 |
| CeresClone:533917 | DDNFFEGVLA VDQSMQNGSD SHIFSPNSKG DNNNNNNNNA SNFPIKRALI | 284 |
| gi\|52353038 | ESNMYD-GIM -NN--TNDII ---------- NNNNRSIPQI ----SSKRTM | 252 |
| Lead-CeresClone38214 | NTSIYDGGGM INNIGTDSVD ---------- HDNNADVVGL NHASSSGPMM | 284 |
| CeresClone:1114366 | PPVMPN---- -DFVYFDTSD ---------- SVPKLHTTES ----SCSEQV | 224 |
| CeresClone:1452029 | EDSMSD---- -SFQTHDSDI ---------- DNNAFGVQN- ----GFGNMV | 226 |
| gi\|62530909 | ADTMSD---- -SFQTHDSDI ---------- DNASAGLRHG ----GCGGGG | 243 |
| gi\|56785066 | ADTMSD---- -SFQTHDSDI ---------- DNASAGLRHG ----GCGGGG | 241 |
| Consensus | -D-M-D---- --F---DS-- ---------- -N----L-N- ----S---M- | 300 |

```
gi|51702424             LDGAG----- ASSSDAGADY QLPPENPLIY SQPPWQQTLH YNNNNGYVNN   292
gi|53749460             SDNL------ ---------- --------LY DDQSYTMNNV SNTSNVDQVS   248
CeresClone:533917       TSQL------ --WNETGS-- -----PGSSS SCKRFHGDLN CGCSNAEDNN   319
gi|52353038             HGGL------ -YWNNDEATT TTTTIDRNHS PNTKRFLVEN NEDDGLNMNN   295
Lead-CeresClone38214    MANLKRTLPV PYWPVAEE-- -----EQDAS PSKRFHGVGG GGGDCSNMSS   327
CeresClone:1114366      VSPE------ -FTSEVQS-- --------EP KWKDWSGEKS SLDFGFNYID   257
CeresClone:1452029      HGQA------ -MTMRNGI-- --GSVARTVK EDSYWFTDLN LDDLQAPYNV   265
gi|62530909             FGDV------ -APPRNGF-- ------VTVK EDNDWFTGLN FDELQPPY--   276
gi|56785066             FGDV------ -APPRNGF-- ------VTVK EDNDWFTGLN FDELQPPY--   274

Consensus               ---L------ ------G--- --------V- E---W---LN -DD------NN   350

gi|51702424             ---------- ------ETIDV PQLPEARVDD Y------GMN GDKYNGMKRK   321
gi|53749460             ---------- -------SQQ QNTNNITSNN C------NIF FN--------   267
CeresClone:533917       ---------- ---DSFISLL SQFPQNATFQ PN-----AIH GS--------   343
gi|52353038             ISRITNHEQS SSIANFLSQF PQNPSIQQQQ QQQEEVLGSL ND--------   337
Lead-CeresClone38214    ---------- -------SMM EETPPLMQQQ G------GVL GD--------   346
CeresClone:1114366      ---------- ---------- ---------- -------ATA FG--------   262
CeresClone:1452029      ---------- -------THV LNPNPVQTMN -------LAA GQ--------   283
gi|62530909             ---------- -------MMN LQHMQMQMVN P------AAP GH--------   295
gi|56785066             ---------- -------MMN LQHMQMQMVN P------AAP GH--------   293

Consensus               ---------- -------S-- -Q----Q--N ---------- G---------   400

gi|51702424             RSSGSLYCSQ LQLPADQYSG MLIHPFLSQQ LHM   354
gi|53749460             ------YQQP LFVNPTFQSQ ---------- ---   281
CeresClone:533917       -VEDDGAPRQ QFHLHGINWN ---------- ---   362
gi|52353038             ---GVVFRQP YNQVTGMNWY S--------- ---   355
Lead-CeresClone38214    ----GLFRTT SYQLPGLNWY SS-------- ---   364
CeresClone:1114366      ---GGGSNQ LFPLQDMFMY NMPKPY---- ---   285
CeresClone:1452029      ---GHGYLQS MSSPSTKMWQ TILPPF---- ---   306
gi|62530909             ---DGGYLQS ISSPQMKMWQ TILPPF---- ---   318
gi|56785066             ---DGGYLQS ISSPQMKMWQ TILPPF---- ---   316

Consensus               -----GY-Q- L-------W- -I--PF---- ---   433
```

```
gi|23296480             MAIISEMEEA RPSMVP---- ---------- ---FTASFD- PSNPIAFLEK   32
Lead-CeresClone38105    MAIISEVEEE SSSSRPMIFP ---------- ---FRATLS- SANPLGFLEK   36
gi|30524691             MAILSDYEEE EHQPQPEKKQ PSKK------ ---FSATFD- PSNPLGFLQS   40
CeresClone:474785       MAIISDFNEE EPKPAHSSPP QPQSSSSSSS ---FSATFD- RSNPIAFLER   46
CeresClone:703932       M--------- ---------- ---------- ---------- ----------    1
gi|51535412             MAIISDFQEE EAPPRQQQQP ASVAAAAGSG DEVLAAELER RGGAIPFLQA   50

Consensus               MAIISDFEEE E--PRP---P ---------- ---FSATFD- -SNPI-FLEK   50

gi|23296480             VLDVIGKESN FLKKDTAEKE IVAAVMAAKQ RLREAEKKKL EKESVKSMEV   82
Lead-CeresClone38105    VFDFLGEQSD FLKKPSAEDE IVVAVRAAKE KLKKAEKKKA EKESVKPVEK   86
gi|30524691             TLEFVSKESD FFAKESSAKD VVSLVQKVKE KYIEEVENKK KKLLDESAAA   90
CeresClone:474785       VFEFVSEQSD FLATQSAEKE IVSLVHAAGK KKRELLKAER ENADKKKRED   96
CeresClone:703932       ---------- ---------- ---------- ---------- ----------    1
gi|51535412             AIDVARRRSD LFRDPSAVSR VTSMASAARA VVEAEERKAR EAKRKAEEAE  100

Consensus               VLDFV---SD FLKK-SAEKE IVSLV-AAKE KL-E-EKKKR EKE--K--E-  100

gi|23296480             EKPKKDSLKP TELEKPKE-- --------ES LMATDPMELE KPKEEKESGP  122
Lead-CeresClone38105    KAEKEIVKLV EKKVEKESVK PTMAASSAEP LEVEKPKDEE ---EKKESGP  133
gi|30524691             AAAAAAAAAS SSSSDLEK-- ---------- -KVDDNESAE ---EIEKSKY  124
CeresClone:474785       LKVTEERQKV EKRLNEEK-- ---------E LKAEDT---- ---NKNESAS  128
CeresClone:703932       ---------- ---------- ---------- ---------- ----------    1
gi|51535412             RKAAEAERKA KAPAEPKP-- --------ES SAGKDSMEVD ---KKEEGNV  137

Consensus               -K--E---K- EK--E-EK-- --------E- LK-ED--E-E ---EK-ES--  150

gi|23296480             IVPNKGNGLD FEKYSWGQNL QEVTINIPMP EGTKSRSVTC EIKKNRLKVG  172
Lead-CeresClone38105    IVPNKGNGFD LENYSWIQNL QEVTVNIPVP TGTKARTVVC EIKKNRLKVG  183
gi|30524691             KAPNSGNGQD LENYSWIQSL QEVTVNVPVP PGTKSRFIDC QIKKNHLKVG  174
CeresClone:474785       RVPNKGNGLD LEKYSWTQSL QEVNVNVPVP NGTKSRFVTV EIKKNHLKVG  178
CeresClone:703932       ---------- -EKYSWTQQL PEVNVNVPVP EGTKSRFVVC EIKKDHLKVG   40
gi|51535412             RKPNAGNGLD LEKYSWIQQL PEVTITVPVP QGTKSRFVVC DIKKNHLKVG  187

Consensus               RVPNKGNGLD LEKYSWIQ-L QEVTVNVPVP EGTKSRFVVC EIKKNHLKVG  200
```

| | | | | | | |
|---|---|---|---|---|---|---|
| gi\|23296480 | LKGQDLI VDG | EFFNSVKPDD | CFWNI EDQKM | I SVLLTKQDQ | MEWWKYCVKG | 222 |
| Lead-CeresClone38105 | LKGQDPI VDG | ELYRSVKPDD | CYWNI EDQKV | I SI LLTKSDQ | MEWWKCCVKG | 233 |
| gi\|30524691 | LKGQPPI I DG | ELFKPVKPDD | CFWSLEDQKS | I SMLLTKHDQ | MEWWRSLVKG | 224 |
| CeresClone:474785 | LKGQPPI I EG | EFHKSVKPDD | CYWSI EDQNS | I SI LLTKHDQ | MEWWKQLVKG | 228 |
| CeresClone:703932 | LKGQPPI I DG | ELHKPVKVDD | CFWSI EDGKA | LSI LLTKHNQ | MEWWKSVI KG | 90 |
| gi\|51535412 | LKGQPPI I DG | ELFKPVKVDD | CFWSI EDGKS | LSI LLTKQNQ | MEWWKSVVKG | 237 |
| Consensus | LKGQPPI I DG | ELFK-VKPDD | CFWSI EDQKS | I SI LLTKHDQ | MEWWKS-VKG | 250 |

| | | | | | | |
|---|---|---|---|---|---|---|
| gi\|23296480 | EPEI DTQKVE | PETSKLGDLD | PETRASVEKM | MFDQRQKQMG | LPRSDEI EKK | 272 |
| Lead-CeresClone38105 | EPEI DTQKVE | PETSKLGDLD | PETRSTVEKM | MFDQRQKQMG | LPTSEELQKQ | 283 |
| gi\|30524691 | EPEI DTQKVE | PESSKLSDLD | PETRSTVEKM | MFDQRQKSMG | LPTSDDMQKQ | 274 |
| CeresClone:474785 | DPEI DTQKVE | PENSKLGDLD | PETRQTVEKM | MFDQRQKSMG | LPTSEELQKQ | 278 |
| CeresClone:703932 | DPEVDTQKAE | PETSKLSDLD | PETRQTVEKM | MFDQRQKQMG | LPTSDEMQKQ | 140 |
| gi\|51535412 | DPEVDTQKVE | PENSKLADLD | PETRQTVEKM | MFDQRQKQMG | LPTSDEMQKQ | 287 |
| Consensus | -PEI DTQKVE | PETSKL-DLD | PETR-TVEKM | MFDQRQKQMG | LPTSDEMQKQ | 300 |

| | | | | |
|---|---|---|---|---|
| gi\|23296480 | DMLKKFMAQN | PGMDFSNAKF | N | 293 |
| Lead-CeresClone38105 | EI LKKFMSEH | PEMDFSNAKF | N | 304 |
| gi\|30524691 | DMLKKFMSEH | PEMDFSNAKF | N | 295 |
| CeresClone:474785 | EMLKKFMSEH | PEMDFSRAKI | S | 299 |
| CeresClone:703932 | DMLKKFMSQH | PEMDFSRAKI | A | 161 |
| gi\|51535412 | DMLKKFMAQH | PEMDFSNAKI | A | 308 |
| Consensus | DMLKKFMS-H | PEMDFSNAK- | N | 321 |

```
gi|10177828            ---------- -MTAKDWTTT SLHRVFAMQG GEDDLSYVNN SDSQALAFTL  39
Lead-CeresClone37493   -------MGS KGDNVAVCNM KLERLLSMKG GKGQDSYANN SQAQANHARS  43
gi|50929439            MASMKGENVT VSAAAAPRMK KLASMLCMKG GNGDGSYLNN SQAQALHARR  50
gi|50929453            ---------- ----MQEQQQ DFKNVFCMEG GQGESSYINN SQSQSRNLKM  36
gi|50929459            ---------- ------MQKV LMKDVFCNEG GQGESSYIKN SQVQSRNLQM  34
gi|54290518            ---------- ---------- ---------- ---------- ---------M   1
gi|50929461            ---------- ---------- -MKNVFCMKG GQGESSYLKN SKVDFRNLQM  29

Consensus              ---------- ---------- -LKNVFCMKG GQGE-SY-NN SQ-QA-NL-M  50

gi|10177828            SKPILISSLQ SIKLFSD--- -QTPIKITDL GCATGSNTFT TVDTVVETLQ  85
Lead-CeresClone37493   MLHLLEETLE NVHLNSSAS- -PPPFTTVDL GCSSGANTVH IIDFIVKHIS  91
gi|50929439            MLHFLEETLD AM-MERSSS- -DKLFTAADL GCSCGSNSLF IVDVIVRRVS  97
gi|50929453            MLYALEETLD KIQLPRHRPG NKPLLTAADL GCSCGQNTLL IADVIVDHMT  86
gi|50929459            MLPTLKETLD KVQLPRR-PG -KHLLTAADL GCSCGHNTLI VADAIVEHMT  82
gi|54290518            MLYALEETLD KIAIPPRGPG -RLLLTAADL GCSCGRSSLV VADAIVQHMT  50
gi|50929461            MLRALEETLD KVVLPHHGPG -RLLLTAADL GCSCGRNTLV VADAIVQHMT  78

Consensus              ML--LEETLD K--LP---PG ---LLTAADL GCSCG-NTLI -AD-IV-HMT 100

gi|10177828            RRYTARCGGG G-------SP EFEAFFCDLP SNDFNMLFKL LAE------- 121
Lead-CeresClone37493   KRFDAAGID- --------PP EFTAFFSDLP SNDFNTLFQL LPPLVSNTC- 131
gi|50929439            EAYESRGRD- --------AP EFQVFFSDLP SNDFNTLFQL LPPLLAPVAG 138
gi|50929453            D----KSFCS KDDD----GL EFCFYFSDLP SNDFNTLFHL LPQ------- 121
gi|50929459            RKLRSCIFDD QDDG-DAADP EFCFYFSDLP SNDFNTLFHL LPQ------- 124
gi|54290518            KLC--RGRCK HVDAVAAADP EFMFYFSDLP SNDFNTLFSL LPP-------  91
gi|50929461            KLCRRRGKGE HGDD-AAADP EFCFYFSDLP SNDFNTLFGL LPH------- 120

Consensus              K----RG-G- --D------P EF-FYFSDLP SNDFNTLF-L LP-------- 150

gi|10177828            ---------K QKVDSPAKYF AGGVAGSFYD RLFPRGTTHV AVSLSALHWL 162
Lead-CeresClone37493   -MEECLAA-- ---DSNRSYF VAGVPGSFYR RLFPARTLDF FHSAFSLHWL 175
gi|50929439            SLEECLAAGE GAATATRPYH AAGVPGTFYG RLFPGESIDV FTSTFSLHWL 188
gi|50929453            ---QAAAAGR DG-RQSRRYF AAAVPGSFHD RLFPERSINV FTSTFSLHWL 167
gi|50929459            ---HATAAAG DG--SERRYF AAAVPGSFHD RLFPKRSINV FTSTFSLHWL 169
gi|54290518            ---H-AASSG DG--SGRRYF AAAVPGSFHD RLFPERSIDV FTSTFCLHWL 135
gi|50929461            ---RGAASSG ECGRGRRHVF AAAVPGSFHD RLFPERSIDV FTSTFCLHWL 167

Consensus              ------AA-- -G--S-RRYF AAAVPGSFHD RLFP-RSIDV FTSTFSLHWL 200
```

```
gi|10177828              SQIPEKVLEK ESRTWNKGKT WIEGAKKEVV EAYAEQSDKD LDDFMSCRKE  212
Lead-CeresClone37493     SQVPESVTDR RSAAYNRGRV FIHGAGEKTT TAYKRQFQAD LAEFLRARAA  225
gi|50929439              SQVPEEVGDS ASPAYNGGRV FVHRATEAVA AAYKRQFQAD LARFLRSRAR  238
gi|50929453              SQVPKRVVDK QSPAYNKGKV FVHGASEETG TAYQRQFRSD MMRFLHCRAA  217
gi|50929459              SQVPEGVADK RSAAYNKDKV FVHGASQATG AAYRRQFQSD MARFLRCRAT  219
gi|54290518              SQVPDEVADT RSPAYNKGKV FVQGSSEETG TAYRRQFQSD MARFLRCRAA  185
gi|50929461              SQVPEEVADK WSPAYNKEKV FVHGGSEETG AAYRRQFQSD MARFLRCRAA  217

Consensus                SQVPE-V-DK -SPAYNKGKV FVHGASEETG -AYRRQFQSD MARFLRCRAA  250

gi|10177828              EMVKGGVLFV LMAGRPS--G SSSQFGDQDT RAKHPFITTM EQAWQDLIEE  260
Lead-CeresClone37493     EVKRGGAMFL VCLGRTS--V DPTDQG---- GAGLLFGTHF QDAWQDLVRE  269
gi|50929439              EMKRGGAMFL ACLGRSS--G DPADQG---- GAGLLFGTHF QDAWQDLVQE  282
gi|50929453              EMKPGGAIFI VSLGRLSSTR GPTEQG---- YIYEVYCSMF EDSLRDLIEE  263
gi|50929459              ELKAGGVMFL VCLGRPSLHA CPTNQG---- RVQLLYGAMF EESWGDLVEE  265
gi|54290518              ELKPGGAMFL VFVGRPSS-A GPTDQG---- RSLNLLGTMF EESWRDLVDE  230
gi|50929461              ELKPGGAMFL VFLGRPSS-A GPTDQG---- RSLSQFGAMF EESWRDLVCE  262

Consensus                E-K-GGAMFL V-LGRPS--- -PTDQG---- RA--LFGTMF E-SWRDLVEE  300

gi|10177828              GLIDEEIRDG FNIPAYMRSP EEVTAGIDRC GGFKIGKMDF LKIV-EYSDE  309
Lead-CeresClone37493     GLVAAEKRDG FNIPVYAPSL QDFKEVVDAN GSFAIDKLVV YKGGSPLVVN  319
gi|50929439              GVVEGEKRDS FNIPVYAPSL QEFRDVVRAD GAFAIDRLEL VRGGSPLVVD  332
gi|50929453              EMVDGEKMDN FNVPLYAATV EEFKEAVDAD GSFKINQLEL VMGS-PPVVD  312
gi|50929459              GTIGREIMGS FNVPVYAATL EEFGEAVGAD GLFEINRLEL VIIS-PLAVD  314
gi|54290518              GLIDGGRMDS FNIPSYAATL EEFRESVDAD GSFAVNRLEH VMGG-RLAVD  279
gi|50929461              GLIDGERMDS FNVPSYAATL EEFREVVDAD GSFEVNRLEL VMGS-PLAVD  311

Consensus                GLIDGEKMDS FNIPVYAATL EEFRE-VDAD GSF-INRLEL VMG--PLAVD  350

gi|10177828              KQEEWKKDPV SYGRARTNLV QAAIRPMVDA YLGPDLSHEL FKRYENRVST  359
Lead-CeresClone37493     EPD----DAS EVGRAFASSC RSVAGVLVEA HIGEELSNKL FSRVESRATS  365
gi|50929439              RPD----DAA EVGRAMANSC KAVAGVLVDA HIGERRGAQL FERLERRAAR  378
gi|50929453              DPA----NRG VVGRMVANYM RALFGPLVNT HIGGAMADEL FIRMQCRAEI  358
gi|50929459              -------DPI RDRRAVANYV RSLLGPLVDA HVGRAVADEI FVRMQRRAEA  357
gi|54290518              DDPHD--DRC AVGRRVANNQ RSIFGPLVEA HIGRALADEL FVRMERRAEE  327
gi|50929461              DDDDDSHDRR AVGRTVANNQ RSVFGPLVEA HIGKELADEL FVRVQSRAEA  361

Consensus                --D----D-- -VGRAVAN-- RSV-GPLV-A HIG--LADEL FVRME-RAE-  400
```

| | | | |
|---|---|---|---|
| gi\|10177828 | -NDEFLHI TC | F-YGVVVFSA DRV | 380 |
| Leod-CeresClone37493 | HAKDYLVNLQ | F-FHI VASLS FT- | 386 |
| gi\|50929439 | HARELVEKMH | F-FHVVCSLS LAP | 400 |
| gi\|50929453 | RAEELVDEMC | F-AHI LCSLS LV- | 379 |
| gi\|50929459 | RAEELVDEMR | F-PHI VCSLS LA- | 378 |
| gi\|54290518 | LSDELVDEMG | VRFHI LCSLS LV- | 349 |
| gi\|50929461 | LDDELVDEMR | VHI HI VCSLS LV- | 383 |
| Consensus | -A-ELVDEM- | F-FHI VCSLS L-- | 423 |

| | | | | | | |
|---|---|---|---|---|---|---|
| Leod-CeresClone37229 | ---MAAMAAK | LQLSAKSDQS | SVRLPRVI -- | NLSRDPTTRV | SF-PRNGSVC | 44 |
| gi\|46402460 | ---MAAMAAK | LHISTKSDQS | NVRLPRLI -- | NLSRDPTARV | LF-PRNGSVS | 44 |
| CeresClone:1190836 | ------MAAK | LHISTKSDQS | NVRLPRLI -- | NLSRDPTARV | LF-PRNGSVS | 41 |
| CeresClone:565532 | ------MAML | RLSPLSGQNH | VLSFPSSPSP | PPPKLQNRPL | YLTNLPHLPQ | 44 |
| CeresClone:513688 | ---MAAMAML | RLSPLSGQNH | ALSFPSSPS- | PPPKLQNRPL | YLTNLPHLPQ | 46 |
| CeresClone:928014 | MAAPTAFAAA | RFLPSA---H | LDSSARLA-- | PLRAAPTSNL | AFSPLPASSS | 45 |
| CeresClone:285684 | --PPQTKNRR | QVLP------ | --RAPRLL-- | PAHRAPPRRA | HREPLLLPAL | 38 |
| CeresClone:279840 | -MASTAFAAA | KYFPA----H | LDSSPRIA-- | PRRAAPTASL | SFSPLSASPS | 43 |
| gi\|56785038 | -MASMAFTAA | KFLPATAPTH | LDSSPRLS-- | PPRA---GSL | SFSPLSSSSS | 44 |
| Consensus | -----AMAA- | R-LP-----H | -VS-PRL--- | P--R-PT--L | -FSPLN-S-S | 50 |

| | | | | | | |
|---|---|---|---|---|---|---|
| Leod-CeresClone37229 | SLHTNFSSPH | LAKPCAGGGG | GGSTG----- | -NNGGGSGSG | GGGGGFGGSG | 88 |
| gi\|46402460 | SLHTNFSSPN | IMVPCAGGGG | GGSIG----- | -NHGGGSGSG | GGGGGYGGSE | 88 |
| CeresClone:1190836 | SLHTNFSSPN | IMVPCAGGGG | GGSIG----- | -NHGGGSGSG | GGGGGYGGSE | 85 |
| CeresClone:565532 | RLKLSFAGGA | GGDGVGRGGG | SG-------- | ---GGGGGGE | SWGDDEGKSK | 83 |
| CeresClone:513688 | RLKLSFAGGD | GGDGVGRGG- | ---------- | ---GGGGGGE | SWG-DEGKPK | 81 |
| CeresClone:928014 | AL-LALRSAS | PS-PSGPGGR | LPPPP---PP | RSYGGGGGGS | GDAADSGGAG | 90 |
| CeresClone:285684 | RQPVVPAPPP | VPLPVRPGGQ | AAPAPAASAP | VSHAQHRTRA | IPSRPDRHGR | 88 |
| CeresClone:279840 | SL-LRLRSPC | ---PSGPGGR | LPPPP---PP | RSYGGGGGSG | GDAADSGGGR | 86 |
| gi\|56785038 | ALLLRLRSPS | PSGPSGPGGR | LPPPP----- | -RSYGGGGGS | GDAADSGGSS | 88 |
| Consensus | SL-L-F-SP- | ---P-G-GG- | ---------- | --HGGGGG-- | G-G-D-GGS- | 100 |

| | | | | | | |
|---|---|---|---|---|---|---|
| Leod-CeresClone37229 | GEASEESSPW | GPIGLFIQGW | RSRVAADPQF | PFKVLMEEIV | GLSACVLGDM | 138 |
| gi\|46402460 | ---EEESSPW | GPLGLFIQGW | RSRVAADSQF | PFKVLMEMLV | GVSANVLGDM | 135 |
| CeresClone:1190836 | ---EEESSPW | GPLGLFIQGW | RSRVAADSQF | PFKVLMEMLV | GVSANVLGDM | 132 |
| CeresClone:565532 | ---DSS---L | GILGLFLNGW | RSRVAADPQF | PFKVLMEELV | GVSACVLGDM | 127 |
| CeresClone:513688 | ---DSS---F | GILGLFLNGW | RSRVAADPQF | PFKVLMEELV | GVSACVLGDM | 125 |
| CeresClone:928014 | ---DGAGGRA | GILGMFLAGW | AARVAADPQF | PFKVLMEELV | GVTACVLGDM | 137 |
| CeresClone:285684 | ---RG----G | GILGLFLAGW | AARVAADPQF | PFKVLMEELV | GVTACVLGDM | 131 |
| CeresClone:279840 | ---RG----G | GILGLFLAGW | AARVAADPQF | PFKXLMEELV | GVTACVLGDM | 129 |
| gi\|56785038 | ---------G | GILGIFLAGW | AARVAADPQF | PFKVLMEELV | GVSACVLGDM | 129 |
| Consensus | ---D------ | GILGLFL-GW | RSRVAADPQF | PFKVLMEELV | GVSACVLGDM | 150 |

```
Lead-CeresClone37229   ASRPNFGLNE LDFVFSTLVV GSILNFVLMY MLAPTAATLG SSQT----LP   184
gi|46402460            ASRPNFGLNE LDFVFSTLVV GSILNFTLMY LLAPSAISHG SSNL----LP   181
CeresClone:1190836     ASRPNFGLNE LDFVFSTLVV GSILNFTLMY LLAPSAISHG SSNL----LP   178
CeresClone:565532      ASRPNFGLNE LDFVFSTLVV GAILNFTLMY LLAPTNTSSA SN------LP   171
CeresClone:513688      ASRPNFGLNE LDFVFSTLVV GAILNFTLMY LLAPTNTSSA ASN-----LP   170
CeresClone:928014      SSRPNFGLNE LDFVFSTLVV GSILNFVLMY MLAPTACVSA AAAAAVSSLP   187
CeresClone:285684      ASRPNFGLNE LDFVFSTLVV GSILNFVLMY LLAPTAAASS AASA----LP   177
CeresClone:279840      ASRPNFGLNE LDFVFSTLVV GSILNFVLMY LLAPTAAASS AASA----LP   175
gi|56785038            ASRPNFGLNE LDFVFSTLVV GSILNFVLMY LLAPTAGASA AASAAASGLP   179

Consensus              ASRPNFGLNE LDFVFSTLVV GSILNFVLMY LLAPTA-SSA A-------LP   200

Lead-CeresClone37229   GIFRNCPSSH MFEQGSFTVM NRFGTLVYKG MVFASVGLAA GLVGTAISNG   234
gi|46402460            GIFRSCPSSH MFEQGNFTLM NRFGTLVYKG MVFATVGLAA GLVGTAISNG   231
CeresClone:1190836     GIFRSCPSSH MFEQGNFTLM NRFGTLVYKG MVFATVGLAA GLVGTAISNG   228
CeresClone:565532      ALFASCPKSH MFEPGAFSLL DRLGTLVYKG TIFSVVGFGA GLVGTTLSNG   221
CeresClone:513688      ALFASCPKSH MFEPGAFSLL DRLGTLVYKG TIFSVVGFGA GLVGTTLSNG   220
CeresClone:928014      --------SH MFEPGPYSLG SRFATLLSKG TTFAVVGFGA GLMGTAISNG   229
CeresClone:285684      --------SH MFEPGAFSLG SRVATLVSKG ATFAVVGFAA GLAGTALSNG   219
CeresClone:279840      --------SH MFEPGAFSLG SRVATLVSKG ATFAVVGFAA GLAGTALSNG   217
gi|56785038            --------SH MFEAGAYSLG SRVATLLSKG ATFAAVGFAA GLAGTAISNG   221

Consensus              -IF-SCP-SH MFEPGAFSLM -RVGTLVYKG -VFAVVGFAA GLVGTAISNG   250

Lead-CeresClone37229   LIMLRKKMDP SFETPNKPPP TVLNSLTWAT HMGVSANARY QTLNGIEFLL   284
gi|46402460            LIMLRKKIDP SFETPNKPPP TLLNSLTWAT HMGVSANVRY QTLNGAEFLL   281
CeresClone:1190836     LIMLRKKIDP SFETPNKPPP TLLNSLTWAT HMGVSANVRY QTLNGAEFLL   278
CeresClone:565532      LIKMRKKMDP TFETPNKPPP TILNALTWAA HMGISSNLRY QTLNGVEFML   271
CeresClone:513688      LIKMRKKMDP TFETPNKPPP TFLNALTWAG HMGVSSNLRY QTLNGVEFML   270
CeresClone:928014      LIAMRKRMDP AFETPNKAPP TLLNAGTWAL HMGISSNLRY QTLNGVEFLL   279
CeresClone:285684      LMAMRKRMDP AFETPNKPPP TLLNAATWAL HMAGSSNLRY QTLNGVEYML   269
CeresClone:279840      LMAMRKRMDP AFETPNKPPP TLLNAATWAL HMAGSSNLRY QTLNGVEYML   267
gi|56785038            LISLRKRMDP AFETPNKAPP TLLNAATWAI HMGVSSNLRY QTLNGVEYLL   271

Consensus              LI-MRKKMDP -FETPNKPPP TLLNALTWA- HMGVSSNLRY QTLNGVEFML   300
```

```
Lead-CeresClone37229    AKVLPPLVFK TSVI VLRCAN NVAGGMSFVL LARMTGSQSV ----------   324
gi|46402460             EKSLPPLVFK TSVI ALRVVN NVLGGMSFVT LARMTGSQSV EE--------   323
CeresClone:1190836      EKSLPPLVFK TSVI ALRVVN NVLGGMSFVT LARMTGSQSV EE--------   320
CeresClone:565532       ERVLNPLAFK SSVLVLRCVN NVLGGMSFVV LARLTGAQSV GG-----EQK   316
CeresClone:513688       ERVLNPLAFK SSVLVLRCVN NVI GGMSFVV LARLTGAQSV GG-----EQKK  316
CeresClone:928014       GNVMPPPVFK VAVI ALRCMN NVLGGMSFVL LARLTGAQKS DKPA--SSDS   327
CeresClone:285684       GKVAPAPVFK ASVVVLRCLN NVLGGVSFVL LARLTGAQKS DKP---ATVA   316
CeresClone:279840       GKVAPAPVFK ASVVVLRCLN NVLGGVSFVL LARLTGAQKS DKP---ATVA   314
gi|56785038             ANAAPPSVFK VSVVALRCI N NVLGGMSFVL LARLTGSQKS DAPAASATAE   321

Consensus               -KVLPPLVFK -SVI VLRCVN NVLGGMSFVL LARLTGAQSV DK--------   350
```

```
Lead-CeresClone37229    EEKT EMSEI S EKEKDD---- ---------- --   340
gi|46402460             EKKI EMSEI S EKEKED---- ---------- --   339
CeresClone:1190836      EKKI EMSEI S EKEKED---- ---------- --   336
CeresClone:565532       ENEVALI AEK EKVVESEREE GLQNNQSTAP --   346
CeresClone:513688       ENEVALI AEK EKL-ESEREE GLQNNQSTAP SK   347
CeresClone:928014       EAKERLI AEG DAIAANVSTE DK-------- --   349
CeresClone:285684       EEKERLI AVG NAA-ADAI GE ARDGEEGK-- --   343
CeresClone:279840       EEKERLI AVG NAM-ADAI GE ARDGEEGK-- --   341
gi|56785038             EEKERLI AVG NDIAADAVGA GRDG-EGK-- --   348

Consensus               EEK--LI A-- EK--ED---E ------E---- --   382
```

```
gi|54292590               MSGEQRELNS WVFMVTARAP TNIAVIKYWG KRDEKLILPI NDSISVTLDP   50
CeresClone:696587         ---MGATEPQ WVLMATGRSP TNIAVIKYWG KRDETLILPV NDSISVTLDP   47
gi|50252009               --MAAAEEGQ WVLMATGRSP TNIAVIKYWG KRDEALILPV NDSISVTLDP   48
CeresClone:244285         ---MAAAEGQ WVLMATGRTP TNIAVIKYWG KRDEALILPI NDSISVTLDP   47
CeresClone:224503         ---------- ---------- ---------- ---------- ----------    0
Lead-CeresClone35493      ------MAEEK WVVMVTAQTP TNIAVIKYWG KRDEVRILPI NDSISVTLDP  45
CeresClone:37377          ---------- ---------- ---------- ---------- ----------    0
gi|21593243               ------MATEK WVFMVTAQTP TNIAVIKYWG KRHEVRILPV NDSISVTLDP  45
gi|18410026               ------MATEK WVFMVTAQTP TNIAVIKYWG KRDEVRILPV NDSISVTLDP  45
gi|6822071                ------MATEK WVFMVTAQTP TNIAVIKYWG KRDEVRILPV NDSISVTLDP  45
gi|16417950               -------MAES WVIMVTAQTP TNIAVIKYWG KRDEKLILPV NDSISVTLDP  44
CeresClone:464546         --MMASESQN WVFMVTAQTP TNIAVIKYWG KRDETLILPV NDSISVTLDP   48

Consensus                 --------EK WV-MVTAQTP TNIAVIKYWG KRDE-LILPV NDSISVTLDP   50

gi|54292590               DHLSATTTVA VSPSFSSDRM WLNGKEVSLG GERYQNCLRE IRSRGRDVMD  100
CeresClone:696587         DHLSATTTVA ASPSFPSDRM WLNGKEIALS GGRFQSCLRE IRKRARDVED   97
gi|50252009               DHLSATTTVA VSPSFPSDRM WLNGKEISLS GGRFQSCLRE IRKRAQDVED   98
CeresClone:244285         DHLSATTTVA VSPSFPSDRM WLNGKEISLL GGRFQSCLRE IRKRARDFED   97
CeresClone:224503         ---------- ---------- --MARRFSLL GGRFQSCLRE IRKRARDFED   28
Lead-CeresClone35493      DHLCTLTTVA VSPSFDRDRM WLNGKEISLS GSRYQNCLRE IRSRADDVED   95
CeresClone:37377          ---------- ---------- ---------- ---------- ----------    0
gi|21593243               DHLCTVTTVA VSPAFDRDRM WLNGKEISLS GSRYQNCLRE IRGRAGDVED   95
gi|18410026               DHLCTVTTVA VSPAFDRDRM WLNGKEISLS GSRYQNCLRE IRGRAGDVED   95
gi|6822071                DHLCTVTTVA VSPAFDRDRM WLNGKEISLS GSRYQNCLRE IRGRAGDVED   95
gi|16417950               AHLCTTTTVA VSPSFAQDRM WLNGKEISLS GGRYQNCLRE IRARACDVED   94
CeresClone:464546         SHLCTTTTAA VSPAFHQDRM WLNGKEISLS GGRFQSCLRE IRARACDVED   98

Consensus                 DHLCTTTTVA VSPSF-RDRM WLNGKEISLS GGRYQNCLRE IR-RA-DVED  100
```

| | | |
|---|---|---|
| gi\|54292590 | EKSGTLI KKE DWQTLHLHI A SHNNFPTAAG LASSAAGFAC LVYALAKLMD | 150 |
| CeresClone:696587 | EKKGI KI KKE DWEKLHVHI A SYNNFPTAAG LASSAAGLAC LVFTLGKLMN | 147 |
| gi\|50252009 | EKKGI RI KKE DWGKLHVHI A SFNNFPTAAG LASSAAGLAC FVFTLGKLMN | 148 |
| CeresClone:244285 | KEKGVKI KKE DWDKLHVHI A SYNNFPTAAG LASSAAGLAC FVFTLGKLMN | 147 |
| CeresClone:224503 | KEKGVKI KKE DWDKLHVHI A SYNNFPTAAG LASSAAGLAC FVFTLGKLMN | 78 |
| Lead-CeresClone35493 | KEKGI KI AKK DWEKLHLHI A SHNNFPTAAG LASSAAGFAC LVFALAKLMN | 145 |
| CeresClone:37377 | MEKGI KI RKK DWEKLNLHI A SHNNFPTAAG LASSAAGFAC LVFSLAKLMN | 50 |
| gi\|21593243. | MEKGI KI RKK DWEKLNLHI A SHNNFPTAAG LASSAAGFAC LVFSLAKLMN | 145 |
| gi\|18410026 | MEKGI KI RKK DWEKLNLHI A SHNNFPTAAG LASSAAGFAC LVFSLAKLMN | 145 |
| gi\|6822071 | MEKGI KI RKK DWEKLNLHI A SHNNFPTAAG LASSAAGFAC LVFSLAKLMN | 145 |
| gi\|16417950 | KERGI KI SKK DWEKLYVHI A SYNNFPTAAG LASSAAGFAC LVFALAKLMN | 144 |
| CeresClone:464546 | ETKGI KI TKE DWGKLHVHI A SYNNFPTAAG LASSAAGFAC LAYALGKLMN | 148 |
| Consensus | -EKGI KI KK- DWEKLH-HI A SHNNFPTAAG LASSAAGFAC LVF-LAKLMN | 150 |

| | | |
|---|---|---|
| gi\|54292590 | I EERYAGELS AI ARQGSGSA CRSLYGGFVK WDMGKERDGS DSI AVQLATE | 200 |
| CeresClone:696587 | VNEDY-GELS SI ARQGSGSA CRSI YGGFVK WCMGKNDDGS DSMAVQLADE | 196 |
| gi\|50252009 | VKEDH-GELS SI ARQGSGSA CRSI YGGFVK WCMGKNNDGS DSI AVQLADE | 197 |
| CeresClone:244285 | AKEDY-GELS SI ARQGSGSA CRSI YGGFVK WCMGEKDDGS DSI AVQLADE | 196 |
| CeresClone:224503 | VKEDY-GELS SI ARQGSGSA CRSI YGGFVK WCMGEKDDGS DSI AVQLADE | 127 |
| Lead-CeresClone35493 | VNEDP-SQLS AI ARQGSGSA CRSLFGGFVK WNMGNKEDGS DSVAVQLVDD | 194 |
| CeresClone:37377 | VDEDP-SHLS AI ARQGSGSA CRSLFGGFVK WTMGSKEDGS DSVAVQLADE | 99 |
| gi\|21593243 | VDEDP-SHLS AI ARQGSGSA CRSLFGGFVK WTMGSKEDGS DSVAVQLADE | 194 |
| gi\|18410026 | VDEDP-SHLS AI ARQGSGSA CRSLFGGFVK WTMGSKEDGS DSVAVQLADE | 194 |
| gi\|6822071 | VDEDP-SHLS AI ARQGSGSA CRSLFGGFVK WTMGSKEDGS DSVAVQLADE | 194 |
| gi\|16417950 | AKEDN-SELS AI ARQGSGSA CRSLFGGFVK WKMGKVEDGS DSLAVQVVDE | 193 |
| CeresClone:464546 | VKEDE-SQLS AI ARQGSGSA CRSLFGGFVK W MGKEDNGS DSLAVQLTDE | 197 |
| Consensus | V-ED--SELS AI ARQGSGSA CRSLFGGFVK W-MGKKEDGS DSI AVQLADE | 200 |

| | | | | | | |
|---|---|---|---|---|---|---|
| gi\|54292590 | EHWEELVI LV | AVVSSRQKET | SSTTGMRESV | ETSELLHHRA | QEVVPKRI VQ | 250 |
| CeresClone:696587 | SHWDDLVI I I | AVVSSKQKET | SSTSGMRDTV | ETSPLLQYRA | QTVVPSRI LK | 246 |
| gi\|50252009 | AHWNDLVI I I | AVVSSKQKET | SSTSGMRDSV | ETSPLLQYRA | QTVVPERVLK | 247 |
| CeresClone:244285 | THWNDLVI I I | AVVSSKQKET | SSTSGMRDSV | ETSPLLQYRA | QTVVPGRVLK | 246 |
| CeresClone:224503 | THWNDLVI I I | AVVSSKQKET | SSTSGMRDSV | ETSPLLQYRA | QTVVPGRVLK | 177 |
| Lead-CeresClone35493 | KHWDDLVI I I | AVVSSRQKET | SSTSGMRESV | ETSLLLQHRA | KEVVPVRI LQ | 244 |
| CeresClone:37377 | KHWDDLVI I I | AVVSSRQKET | SSTSGMRESV | ETSLLLQHRA | KEVVPKRI LQ | 149 |
| gi\|21593243 | KHWDDLVI I I | AVVSSRQKET | SSTSGMRESV | ETSLLLQHRA | KEVVPKRI LQ | 244 |
| gi\|18410026 | KHWDDLVI I I | AVVSSRQKET | SSTSGMRESV | ETSLLLQHRA | KEVVPKRI LQ | 244 |
| gi\|6822071 | KHWDDLVI I I | AV------ET | SSTSGMRESV | ETSLLLQHRA | KEVVPKRI LQ | 238 |
| gi\|16417950 | KHWDDLVI I I | AVVSSRQKET | SSTTGMRETV | ETSLLLQHRA | KEI VPKRI VQ | 243 |
| CeresClone:464546 | KHWDDLVI VI | AVVSSRQKET | SSTTGMRESV | ETSLLLQHRA | KEI VPKRI LQ | 247 |
| Consensus | KHWDDLVI I I | AVVSSRQKET | SSTSGMRESV | ETSLLLQHRA | KEVVPKRI LQ | 250 |

| | | | | | | |
|---|---|---|---|---|---|---|
| gi\|54292590 | MQEAI ANHDF | ASFARI TCVD | SNQFHAVCLD | ASPPI FYMND | TSHRI I NQI E | 300 |
| CeresClone:696587 | MEDAI KNRDF | ESFARLTCAD | SNQFHAVCLD | TSPPI FYMND | TSHRI I SLVE | 296 |
| gi\|50252009 | MEEAI KSRNF | ESFARLTCAD | SNQFHAVCLD | TSPPI FYMND | TSHRI I SLVE | 297 |
| CeresClone:244285 | MEEAI KNRDF | ESFAKLTCAD | SNQFHAVCLD | TSPPI FYMND | TSHRI I SLVE | 296 |
| CeresClone:224503 | MEEAI KNRDF | ESFAKLTCAD | SNQFHAVCLD | TSPPI FYMND | TSHRI I SLVE | 227 |
| Lead-CeresClone35493 | MEEAI KNRDF | TSFTKLTCSD | SNQFHAVCMD | TSPPI FYMND | TSHRI I SLVE | 294 |
| CeresClone:37377 | MEEAI KNRDF | ASFTQLTCTD | SNQFHAVCLD | TSPPI FYMND | TXHRI I SLVE | 199 |
| gi\|21593243 | MEEAI KNRDF | ASFTQLTCTD | SNQFHAVCLD | TSPPI FYMND | TSHRI I SLVE | 294 |
| gi\|18410026 | MEEAI KNRDF | ASFTQLTCTD | SNQFHAVCLD | TSPPI FYMND | TSHRI I SLVE | 294 |
| gi\|6822071 | MEEAI KNRDF | ASFTQLTCTD | SNQFHAVCLD | TSPPI FYMND | TSHRI I SLVE | 288 |
| gi\|16417950 | MEESI KNRNF | ASFAHLTCAD | SNQFHAVCMD | TCPPI FYMND | TSHRI I SCVE | 293 |
| CeresClone:464546 | MEEAI KNRDF | ASFSQLTCAD | SNQFHAVCLD | TCPPI FYMND | TSHRI I SI VE | 297 |
| Consensus | MEEAI KNRDF | ASFAQLTCAD | SNQFHAVCLD | TSPPI FYMND | TSHRI I SLVE | 300 |

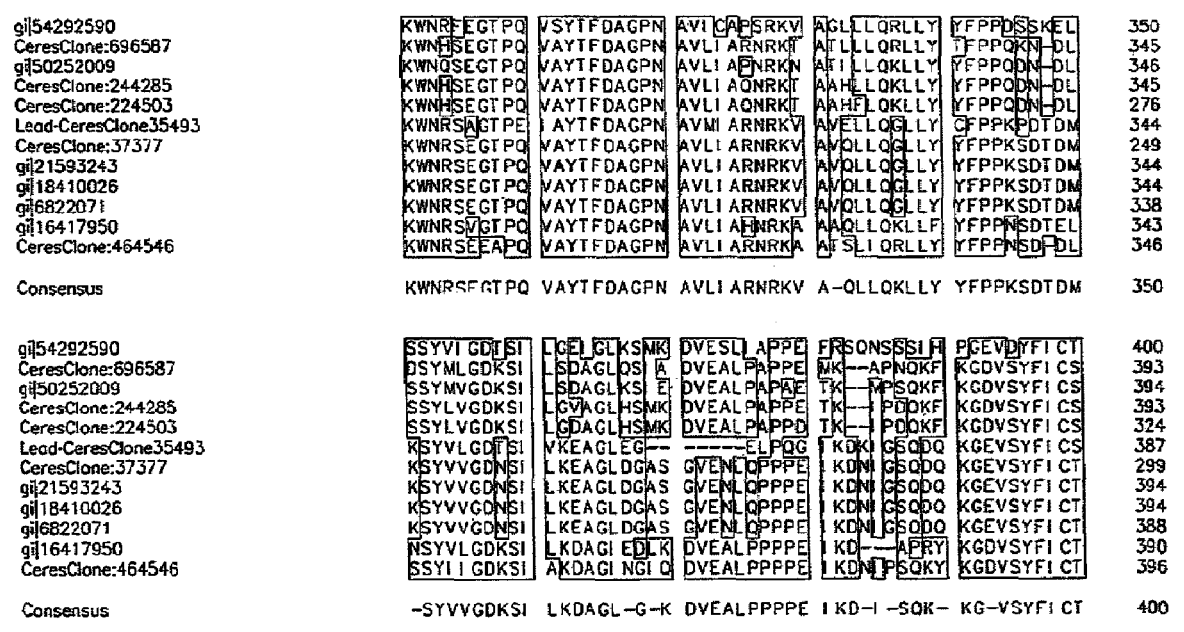

```
gi|54292590            KWNRFEGTPQ VSYTFDAGPN AVICAPSRKV AGLLLQRLLY YFPPDSSKEL  350
CeresClone:696587      KWNHSEGTPQ VAYTFDAGPN AVLIARNRKT ATLLLQRLLY TFPPQKN-DL  345
gi|50252009            KWNQSEGTPQ VAYTFDAGPN AVLIAPNRKN ATILLQKLLY YFPPQDN-DL  346
CeresClone:244285      KWNHSEGTPQ VAYTFDAGPN AVLIAQNRKT AAHLLQKLLY YFPPQDN-DL  345
CeresClone:224503      KWNHSEGTPQ VAYTFDAGPN AVLIAQNRKT AAHFLQKLLY YFPPQDN-DL  276
Lead-CeresClone35493   KWNRSAGTPE IAYTFDAGPN AVMIARNRKV AVELLQGLLY CFPPKPDTDM  344
CeresClone:37377       KWNRSEGTPQ VAYTFDAGPN AVLIARNRKV AVQLLQGLLY YFPPKSDTDM  249
gi|21593243            KWNRSEGTPQ VAYTFDAGPN AVLIARNRKV AVQLLQGLLY YFPPKSDTDM  344
gi|18410026            KWNRSEGTPQ VAYTFDAGPN AVLIARNRKV AVQLLQGLLY YFPPKSDTDM  344
gi|6822071             KWNRSEGTPQ VAYTFDAGPN AVLIARNRKV AVQLLQGLLY YFPPKSDTDM  338
gi|16417950            KWNRSVGTPQ VAYTFDAGPN AVLIAHNRKA AAQLLQKLLF YFPPNSDTEL  343
CeresClone:464546      KWNRSEEAPQ VAYTFDAGPN AVLIARNRKA ATSLIQRLLY YFPPNSD-DL  346

Consensus              KWNRSEGTPQ VAYTFDAGPN AVLIARNRKV A-QLLQKLLY YFPPKSDTDM  350

gi|54292590            SSYVIGDTSI LGELGLKSMK DVESLLAPPE FRSQNSSSIH PGEVDYFICT  400
CeresClone:696587      DSYMLGDKSI LSDAGLQSIA DVEALPAPPE MK--APNQKF KGDVSYFICS  393
gi|50252009            SSYMVGDKSI LSDAGLKSIE DVEALPAPAE TK--MPSQKF KGDVSYFICS  394
CeresClone:244285      SSYLVGDKSI LGVAGLHSMK DVEALPAPPE TK--IPDQKF KGDVSYFICS  393
CeresClone:224503      SSYLVGDKSI LGDAGLHSMK DVEALPAPPD TK--IPDQKF KGDVSYFICS  324
Lead-CeresClone35493   KSYVLGDTSI VKEAGLEG-- ------ELPQG IKDKIGSQDQ KGEVSYFICS  387
CeresClone:37377       KSYVVGDNSI LKEAGLDGAS GVENLQPPPE IKDNIGSQDQ KGEVSYFICT  299
gi|21593243            KSYVVGDNSI LKEAGLDGAS GVENLQPPPE IKDNIGSQDQ KGEVSYFICT  394
gi|18410026            KSYVVGDNSI LKEAGLDGAS GVENLQPPPE IKDNIGSQDQ KGEVSYFICT  394
gi|6822071             KSYVVGDNSI LKEAGLDGAS GVENLQPPPE IKDNIGSQDQ KGEVSYFICT  388
gi|16417950            NSYVLGDKSI LKDAGIEDLK DVEALPPPPE IKD---APRY KGDVSYFICT  390
CeresClone:464546      SSYIIGDKSI AKDAGINGIQ DVEALPPPPE IKDNIPSQKY KGDVSYFICT  396

Consensus              -SYVVGDKSI LKDAGL-G-K DVEALPPPPE IKD-I-SQK- KG-VSYFICT  400
```

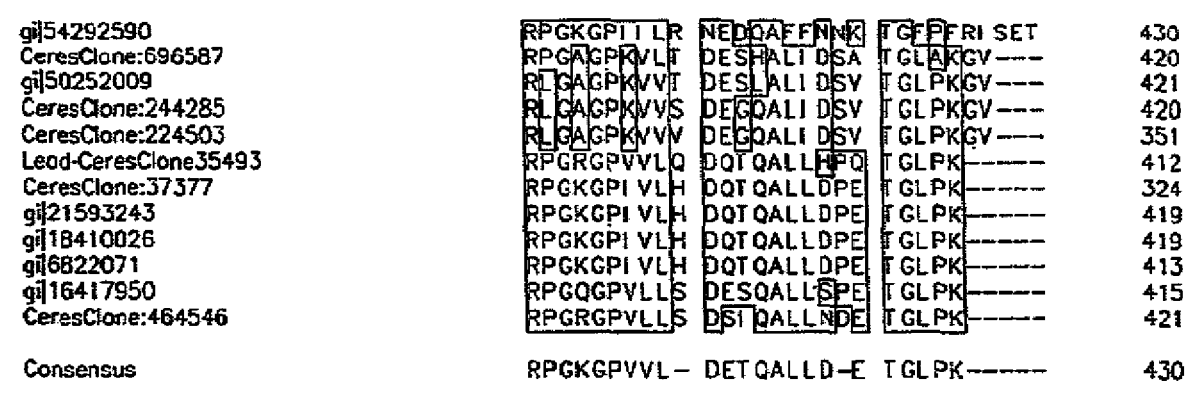

| | | |
|---|---|---|
| gi\|54292590 | RPGKGPI I LR NEDQAFFNNK TGFPFRI SET | 430 |
| CeresClone:696587 | RPGAGPKVLT DESHALI DSA TGLAKGV--- | 420 |
| gi\|50252009 | RLGAGPKVVT DESLALI DSV TGLPKGV--- | 421 |
| CeresClone:244285 | RLGAGPKVVS DEGQALI DSV TGLPKGV--- | 420 |
| CeresClone:224503 | RLGAGPKVVV DEGQALI DSV TGLPKGV--- | 351 |
| Lead-CeresClone35493 | RPGRGPVVLQ DQTQALLHPQ TGLPK------ | 412 |
| CeresClone:37377 | RPGKGPI VLH DQTQALLDPE TGLPK------ | 324 |
| gi\|21593243 | RPGKGPI VLH DQTQALLDPE TGLPK------ | 419 |
| gi\|18410026 | RPGKGPI VLH DQTQALLDPE TGLPK------ | 419 |
| gi\|6822071 | RPGKGPI VLH DQTQALLDPE TGLPK------ | 413 |
| gi\|16417950 | RPGQGPVLLS DESQALLSPE TGLPK------ | 415 |
| CeresClone:464546 | RPGRGPVLLS DSIQALLNDE TGLPK------ | 421 |
| Consensus | RPGKGPVVL- DETQALLD-E TGLPK------ | 430 |

```
Lead-CeresClone3618    MESPRNHGGS E-----EEEYS SCESGWTMYI EDAFHGNDQS SVVVDDDDDD   46
CeresClone:1171157     MEPFG----- ------AEGCH SSESGWTMYI GSPIDDAGHS S---DNDDKN   37
CeresClone:301153      MESSSHITGG DDDAGGEGCN SCESGWTMYL ASPMHMHGHD D---DDDAGG   47
gi|50947055            MES-SHITGD D-----GEGCN SSESGWTMYL ASPMH----- G---DDDGGG   37

Consensus              MES-SHITG- D-----GEGCN S-ESGWTMY- ASPMH--GHS S---DDDD--   50

Lead-CeresClone3618    -----TQVKEA DDGY------E NNDGDTSDDG GDEESDDSMA SDASSGPS--   85
CeresClone:1171157     ----------- --------KKG TQAHPQDDDD DDDESDDSMA SDASSGPS--   68
CeresClone:301153      --SANQGSSV DDGYGYM SG GGNKKQDYDD DDG-DGDSLA SDASTGPAKA   94
gi|50947055            KRSGSEGSNV DDGYGY-I SG RGSRKEYEDD GDGDDDDSLA SDASTGPAKV   86

Consensus              --S--QGS-V DDGYGY-I SG -G--KQDDDD -D-E-DDS-A SDAS-GP-K-   100

Lead-CeresClone3618    ---------- NQLPKHINKH AARKNGSKQV Y-LQKRQHFE KTIGNEG---   121
CeresClone:1171157     ---------- HHHGFADFRR DAEEENDENK YCLEKKAGKT QHKQMEG---   105
CeresClone:301153      ANKSPSPPPE HKHGKEDDDR GHRGGGGGGK EETKLATSSR KKAAAAGNGK   144
gi|50947055            --KVPSAPDG DDAGGRRKHD GDEDGGGKGE EEEEEDHGLH TKFSMSS---   131

Consensus              --K-PS-P-- H-HGK-D--R GA---GGGKGK -ELEK---G-- KK-SM-G---   150

Lead-CeresClone3618    ------EKSD LKARTRTSA- -ASRVQSRGK VSKTK----- -   148
CeresClone:1171157     ------KKVE KKGMLIVDSK DKSPVQGGGK VRKNYFVGKR K   140
CeresClone:301153      LMDKAAAAAA GGGEGNSSRR GHGKGGGGGS SRRSFFLW-- -   182
gi|50947055            --GKKAGKTE KGGEGKSSKK GQNK----RGS SSRTRFFW-- -   164

Consensus              ---K-A-K-E K-GEG-TS-K G-SKVQGRG- ---T-F-W-- -   191
```

| | | | | | | |
|---|---|---|---|---|---|---|
| CeresClone:602291 | ---------- | ---------- | ---MLLGKRP | RPP------- | MKRTTSMSEM | 20 |
| Lead-CeresClone6082 | ---------- | ---------- | ---MLLGKRQ | RPP------- | INRTTSLSEI | 20 |
| CeresClone:1068042 | SPLSLFPRSL | FRAKSRAHIH | TLAMLLGKRQ | RPP------- | INRTTSLSEI | 43 |
| CeresClone:894286 | ---------- | ---------- | ---------- | ---------- | MRRTTSLREV | 10 |
| gi\|50945605 | ---------- | ---------- | --MMMMGKRG | GRKNP----- | MRRTTSMTEF | 23 |
| CeresClone:347137 | ---------- | ---------- | ---MMLGKRS | GRPSPTARQH | MRRTTSLTEF | 27 |
| Consensus | ---------- | ---------- | ---MLLGKR- | RPP------- | MRRTTSLSEI | 50 |

| | | | | | | |
|---|---|---|---|---|---|---|
| CeresClone:602291 | TLDLNTA--- | -------ADA | AAAADQQ--- | ---------- | ---------R | 38 |
| Lead-CeresClone6082 | KFDLNLP--- | -------SES | EPSNQQK--- | ---------- | -PTVASPYGS | 46 |
| CeresClone:1068042 | KFDLNLP--- | -------SES | EVPSTHQ--- | -------SPN | QNTVVGPSGS | 73 |
| CeresClone:894286 | APPESVL--- | -------AVV | LEDEDEDEQA | KAVVQAEEGG | AGGGQDWLAA | 49 |
| gi\|50945605 | APPVDVLVGG | RVADEAEAEA | EADEATELEV | SGGGEVEEED | AAVEEASYGW | 73 |
| CeresClone:347137 | AAPDKVL--- | -------ADV | AEEEDEELDL | LPA----HAE | AAELEGPYGW | 63 |
| Consensus | A--LNVL--- | -------AE- | E-D-D---Q- | ---------- | A--VE-PYGS | 100 |

| | | | | | | |
|---|---|---|---|---|---|---|
| CeresClone:602291 | SGVGPSAAA- | ------DQTT | RMLASPKL-L | RRHSSYFG-- | DARHFLRACS | 78 |
| Lead-CeresClone6082 | NGQAVTAAVD | QNRGFLDQRL | LSMVTPRGNL | RRHSGDFS-- | DACHFLRSCA | 94 |
| CeresClone:1068042 | NGQHVAAAV- | ------DPRF | LAMVSPRGNL | RRHSGEFS-- | DAGHFLRSCS | 114 |
| CeresClone:894286 | LGGGSGAPG- | -TDWLAAYRA | RAAPARAG-L | RRNSADYSKV | ETAAFLRHCG | 96 |
| gi\|50945605 | FGAGADCACV | RADWLAAYRA | RAAPALAG-L | RRNSADFSAV | ETAAFLRACG | 122 |
| CeresClone:347137 | AIGGAAAAG- | RADWLAAYRA | RAAPVLAG-L | RRNSADFSAA | ETAAFLRACG | 111 |
| Consensus | -G-GA-AAG- | R-DWLA-YRA | RA-P-P-G-L | RR-SADFS-- | --A-FLRAC- | 150 |

| | | | | | | |
|---|---|---|---|---|---|---|
| CeresClone:602291 | LCKRPLVPGR | DIYMYRGDSA | FCSLECRQQQ | INQDERKEKF | VMASKKK--- | 125 |
| Lead-CeresClone6082 | LCERLLVPGR | DIYMYRGDKA | FCSSECRQEQ | MAQDERKEKG | KSAAPAK--E | 142 |
| CeresClone:1068042 | LCERLLVPGR | DIYMYRGDTA | FCSSECREQQ | MTQDEGKEK- | ---------- | 153 |
| CeresClone:894286 | LCRRLLGPGR | DTFMYKGEAA | FCSLECRQQH | ITHEEWKDKC | TPRSMSEAAA | 146 |
| gi\|50945605 | LCNRRLGPGR | DTFMYKGDTA | FCSLECRQQH | ITHEEWKEKR | ALALATAAAA | 172 |
| CeresClone:347137 | LCNRRLGPGR | DTFVYRGDTA | FCSLECRQQH | ITIEEWKEKC | ALATPPA-SD | 160 |
| Consensus | LC-RLL-PGR | D--MYRGDTA | FCSLECRQQ- | ITQ-EWKEK- | -MAS--K-A- | 200 |

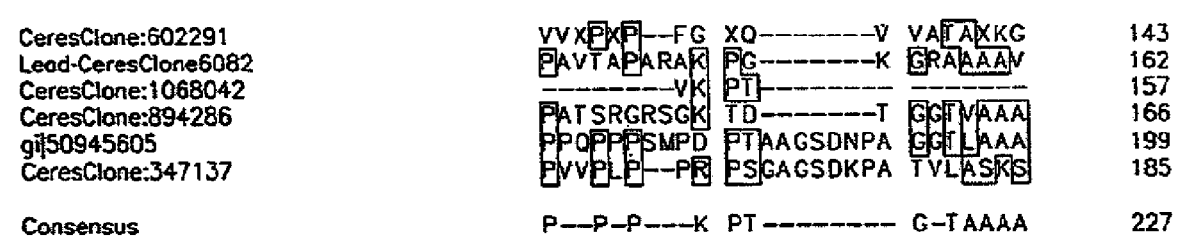

| | | | | |
|---|---|---|---|---|
| CeresClone:602291 | VVXPXP--FG | XQ--------V | VATAXKG | 143 |
| Lead-CeresClone6082 | PAVTAPARAK | PG--------K | GRAAAAV | 162 |
| CeresClone:1068042 | --------VK | PT--------- | ------- | 157 |
| CeresClone:894286 | PATSRGRSGK | TD--------T | GGTVAAA | 166 |
| gi\|50945605 | PPQPPPSMPD | PTAAGSDNPA | GGTLAAA | 199 |
| CeresClone:347137 | PVVPLP--PR | PSGAGSDKPA | TVLASKS | 185 |
| Consensus | P--P-P---K | PT--------- | G-TAAAA | 227 |

```
Lead-CeresClone32811   MALHGSGVFC KVSNMVEITS PFGGSMRLLH LPKSYPIHCN MVSASNTFGS   50
CeresClone:1004568     ---MSAAQAA SAILRPSAST PLREAAFFF- TDNHNPSPAR LCLRRCSAER   46
CeresClone:322953      --------MA LAAATATTTS PARASWRPT- VPATSASAAG VCFRVGA--K   39
gi|50915438            ---------- --MAAAAAST PARAWWRAA- APASASTAAV SCFRVGA--K   35
gi|51979387            ---MAAPNPS ATMAAAAAST PARAWWRAA- APASASTAAV SCFRVGA--K   44

Consensus              -----A---A --MA-A-AST PARASWR--- -PAS-S-AA- -CFRVGA--K   50

Lead-CeresClone32811   AHL-KLQNKE PC-SRLR--- ---PCRVKRE ENNQTADVES ISM-----DE   87
CeresClone:1004568     TFA-GLQIAA SNFNRSR--- ---ICHVKSG EADGYPQTEE DQLA----DE   85
CeresClone:322953      RFSPGLRTAS TCRHRHRGRT RLTTAHVKSG EAEGRPSTEE SATGIGGPDE   89
gi|50915438            SLT-GLQMTS TRANKVR--- ---TVHVKSG EAEGSPSTES ITR-----DE   73
gi|51979387            SLT-GLQMTS TRANKVR--- ---TVHVKSG EAEGSPSTES ITR-----DE   82

Consensus              S---GLQM-S T--NRVR--- ---T-HVKSG EAEGSPSTES I-------DE   100

Lead-CeresClone32811   NTLKQDLETA VQEENYVEAA KIRDKLKELQ EDNKASVLSA NSRFYQSFRN   137
CeresClone:1004568     ETLQRNLDRA IREEDYARAA KIRDDLRVLH EDTEASVLAA NTRFYNAFKN   135
CeresClone:322953      DSLRRELETA IEEEDYARAA ALRDELRVLQ EDCRAAVLAA NARFYAAFKD   139
gi|50915438            ETLQRDLQTA IQEENYAQAA KLRDELRVLQ EDSRSAVLAA NARFYNAFKN   123
gi|51979387            ETLQRDLQTA IQEENYAQAA KLRDELRVLQ EDSRSAVLAA NARFYNAFKN   132

Consensus              ETLQRDL-TA IQEENYA-AA KLRDELRVLQ EDSRAAVLAA NARFYNAFKN   150

Lead-CeresClone32811   GDLAAMQSLW SKSGNPCCVH PGAKGITGYD YVMESWELV- WMNYEFPLLI   186
CeresClone:1004568     GDFTAMYSIW AKGDHVYVVH PGAGRISGYD VVLQSWEMVC NADYEFPLNI   185
CeresClone:322953      GDLAAMRRAW ARGDHVYVVH PSAGRISGYE MVMQSWEMVC DAGYEFPLQV   189
gi|50915438            GDLVAMHSAW AKGDHVYVVH PSAGRISGYD MVMQSWEMVC DADYEFPLQI   173
gi|51979387            GDLVAMHSAW AKGDHVYVVH PSAGRISGYD MVMQSWEMVC DADYEFPLQI   182

Consensus              GDL-AMHSAW AKGDHVYVVH PSAGRISGYD MVMQSWEMVC DADYEFPLQI   200
```

```
Lead-CeresClone32811      ELKDVEVHVR GEVGYVTCME FVKTKGSSSW GAQFVSNVFE RI DGQWFI CI   236
CeresClone:1004568        DLKNI EVHVC GDLGYVTCLE LVKTKG-KSW GKQI ATNVFE KI DGTWYI CI   234
CeresClone:322953         DLQDVEVRVR GGVGYVTCLE MVRTKGSSSW GKQLATNVFE EVDGEWLMCV   239
gi|50915438               DLQDVEVHVR GDLGYVTCLE LVKTKGSSSW GRQVATNVFE KVDGKWFI CI   223
gi|51979387               DLQDVEVHVR GDLGYVTCLE LVKTKGSSSW GRQVATNVFE KVDGKWFI CI   232

Consensus                 DLQDVEVHVR GDLGYVTCLE LVKTKGSSSW G-QI ATNVFE KVDGKWFI CI   250

Lead-CeresClone32811      HHASPVDI     244
CeresClone:1004568        HHASHI-EE    242
CeresClone:322953         HHASHFDE     247
gi|50915438               HHASHFDE     231
gi|51979387               HHASHFDE     240

Consensus                 HHASHFDE     258
```

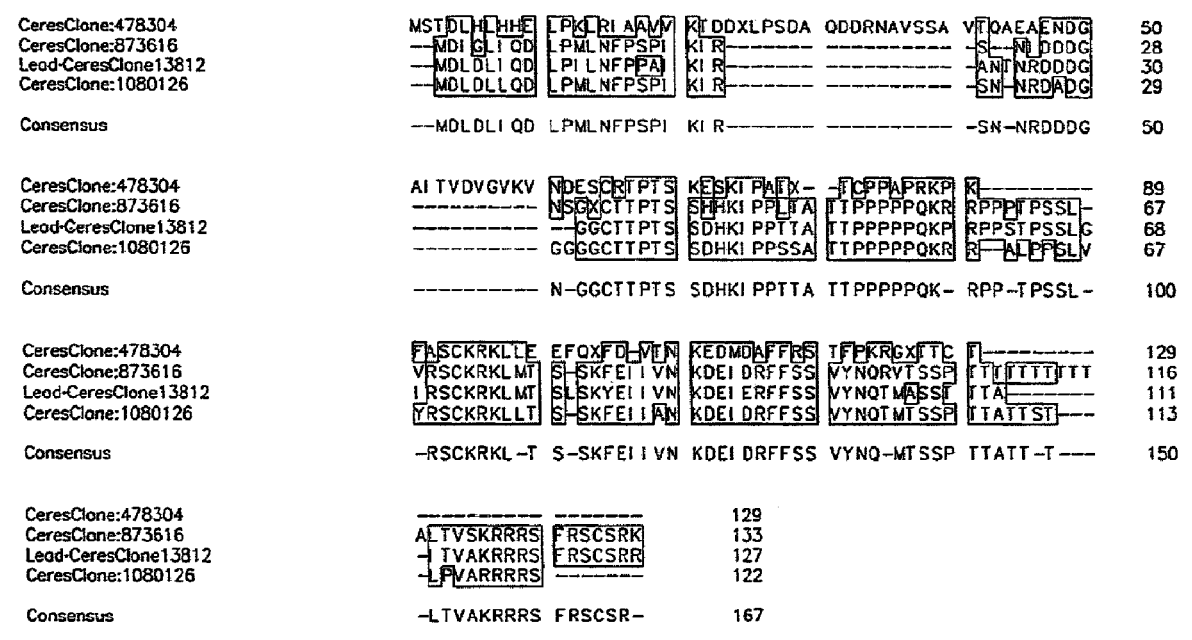

```
CeresClone:478304        MSTDLHLHHE LPKLRIAAVV KTDDXLPSDA QDDRNAVSSA VTQAEAENDG   50
CeresClone:873616        --MDIGLIQD LPMLNFPSPI KIR------- ---------- -S--NIDDDG   28
Lead-CeresClone13812     --MDLDLIQD LPILNFPPAI KIR------- ---------- -ANTNRDDDG   30
CeresClone:1080126       --MDLDLLQD LPMLNFPSPI KIR------- ---------- -SN-NRDADG   29

Consensus                --MDLDLIQD LPMLNFPSPI KIR------- ---------- -SN-NRDDDG   50

CeresClone:478304        AITVDVGVKV NDESCRTPTS KESKIPAIX- -TCPPAPRKP KI--------   89
CeresClone:873616        ---------- NSGXCTTPTS SHHKIPPLTA TTPPPPPQKR RPPPTPSSL-   67
Lead-CeresClone13812     ---------- --GGCTTPTS SDHKIPPTTA TTPPPPPQKP RPPSTPSSLG   68
CeresClone:1080126       ---------- GGGGCTTPTS SDHKIPPSSA TTPPPPPQKR R--ALPPSLV   67

Consensus                ---------- N-GGCTTPTS SDHKIPPTTA TTPPPPPQK- RPP-TPSSL-  100

CeresClone:478304        FASCKRKLLE EFQXFD-VTN KEDMDAFFRS TFPKRGXTTC T---------  129
CeresClone:873616        VRSCKRKLMT S-SKFEIIVN KDEIDRFFSS VYNQRVTSSP TTTTTTTTTT  116
Lead-CeresClone13812     IRSCKRKLMT SLSKYEIIVN KDEIERFFSS VYNQTMASST TTA-------  111
CeresClone:1080126       YRSCKRKLLT S-SKFEIIAN KDEIDRFFSS VYNQTMTSSP TTATTST---  113

Consensus                -RSCKRKL-T S-SKFEIIVN KDEIDRFFSS VYNQ-MTSSP TTATT-T---  150

CeresClone:478304        ---------- -------    129
CeresClone:873616        ALTVSKRRRS FRSCSRK    133
Lead-CeresClone13812     -ITVAKRRRS FRSCSRR    127
CeresClone:1080126       -LPVARRRRS -------    122

Consensus                -LTVAKRRRS FRSCSR-    167
```

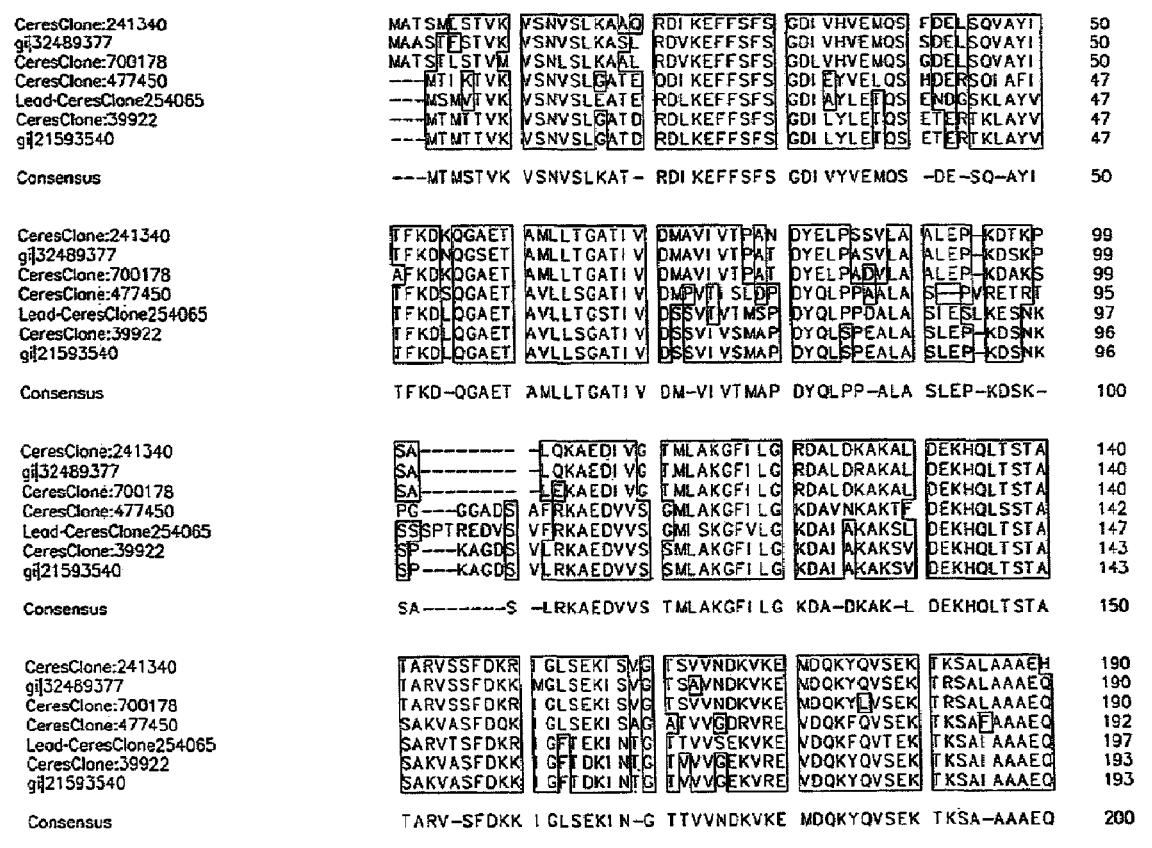

```
CeresClone:241340         MATSMLSTVK VSNVSLKAAQ RDIKEFFSFS GDIVHVEMQS FDELSQVAYI   50
gi|32489377               MAASTFSTVK VSNVSLKASL RDVKEFFSFS GDIVHVEMQS SDELSQVAYI   50
CeresClone:700178         MATSILSTVM VSNLSLKAAL RDVKEFFSFS GDLVHVEMQS GDELSQVAYI   50
CeresClone:477450         ---MTIKTVK VSNVSLGATE DDIKEFFSFS GDIEYVELQS HDERSQIAFI   47
Lead-CeresClone254065     ---MSMVTVK VSNVSLEATE RDLKEFFSFS GDIAYLETQS ENDGSKLAYV   47
CeresClone:39922          ---MTMTTVK VSNVSLGATD RDLKEFFSFS GDILYLETQS ETERTKLAYV   47
gi|21593540               ---MTMTTVK VSNVSLGATD RDLKEFFSFS GDILYLETQS ETERTKLAYV   47

Consensus                 ---MTMSTVK VSNVSLKAT- RDIKEFFSFS GDIVYVEMQS -DE-SQ-AYI   50

CeresClone:241340         TFKDKQGAET AMLLTGATIV DMAVIVTPAN DYELPSSVLA ALEP-KDTKP   99
gi|32489377               TFKDNQGSET AMLLTGATIV DMAVIVTPAT DYELPASVLA ALEP-KDSKP   99
CeresClone:700178         AFKDKQGAET AMLLTGATIV DMAVIVTPAT DYELPADVLA ALEP-KDAKS   99
CeresClone:477450         TFKDSQGAET AVLLSGATIV DMPVTISLDP DYQLPPAALA S--PVRETRT   95
Lead-CeresClone254065     TFKDLQGAET AVLLTGSTIV DSSVIVTMSP DYQLPPDALA SIESLKESNK   97
CeresClone:39922          TFKDLQGAET AVLLSGATIV DSSVIVSMAP DYQLSPEALA SLEP-KDSNK   96
gi|21593540               TFKDLQGAET AVLLSGATIV DSSVIVSMAP DYQLSPEALA SLEP-KDSNK   96

Consensus                 TFKD-QGAET AMLLTGATIV DM-VIVTMAP DYQLPP-ALA SLEP-KDSK-  100

CeresClone:241340         SA-------- -LQKAEDIVG TMLAKGFILG RDALDKAKAL DEKHQLTSTA  140
gi|32489377               SA-------- -LQKAEDIVG TMLAKGFILG RDALDRAKAL DEKHQLTSTA  140
CeresClone:700178         SA-------- -LEKAEDIVG TMLAKGFILG RDALDKAKAL DEKHQLTSTA  140
CeresClone:477450         PG---GGADS AFRKAEDVVS GMLAKGFILG KDAVNKAKTF DEKHQLSSTA  142
Lead-CeresClone254065     SSSPTREDVS VFRKAEDVVS GMISKGFVLG KDAIAKAKSL DEKHQLTSTA  147
CeresClone:39922          SP---KAGDS VLRKAEDVVS SMLAKGFILG KDAIAKAKSV DEKHQLTSTA  143
gi|21593540               SP---KAGDS VLRKAEDVVS SMLAKGFILG KDAIAKAKSV DEKHQLTSTA  143

Consensus                 SA-------S -LRKAEDVVS TMLAKGFILG KDA-DKAK-L DEKHQLTSTA  150

CeresClone:241340         TARVSSFDKR IGLSEKISVG TSVVNDKVKE MDQKYQVSEK TKSALAAAEH  190
gi|32489377               TARVSSFDKK MGLSEKISVG TSAVNDKVKE MDQKYQVSEK TRSALAAAEQ  190
CeresClone:700178         TARVSSFDKR IGLSEKISVG TSVVNDKVKE MDQKYLVSEK TRSALAAAEQ  190
CeresClone:477450         SAKVASFDQK IGLSEKISAG AITVVGDRVRE VDQKFQVSEK TKSAFAAAEQ  192
Lead-CeresClone254065     SARVTSFDKR IGFTEKINTG TTVVSEKVKE VDQKFQVTEK TKSAIAAAEQ  197
CeresClone:39922          SAKVASFDKK IGFTDKINTG TVVVGEKVRE VDQKYQVSEK TKSAIAAAEQ  193
gi|21593540               SAKVASFDKK IGFTDKINTG TVVVGEKVRE VDQKYQVSEK TKSAIAAAEQ  193

Consensus                 TARV-SFDKK IGLSEKIN-G TTVVNDKVKE MDQKYQVSEK TKSA-AAAEQ  200
```

| | | | | | | | |
|---|---|---|---|---|---|---|---|
| CeresClone:241340 | SVSTAGSAI M | KNRYVLTGAA | WVTGAFSKVI | SAANEAGAKA | KEKI AVEQEH | 240 |
| gi\|32489377 | SVSTAGSAI M | KNRYVLTGAA | WVTGAFNKVA | NAANDVGTKA | KEKI ASEQEH | 240 |
| CeresClone:700178 | GVSTAGSAI M | KNRYVLTGAA | WVTGAFSKVA | NTANDVGAKA | KEKI AAEQEG | 240 |
| CeresClone:477450 | TVSNAGSAI M | KNRYVLTGAS | WVTGAFSKVS | KAAGEVGQKT | KEKVESAEE- | 241 |
| Lead-CeresClone254065 | TVSNAGSAI M | KNRYVLTGAT | WVTGAFNRVS | KAAEEVGQKA | KEKVGLAEEE | 247 |
| CeresClone:39922 | TVSNAGSAI M | KNRYVLTGAT | WVTGAFNKVA | KAAEEVGQKA | KEKVGMAEE- | 242 |
| gi\|21593540 | TVSNAGSAI M | KNRYVLTGAT | WVTGAFNKVA | KAAEEVGQKA | KEKVGMAEE- | 242 |
| Consensus | TVSNAGSAI M | KNRYVLTGA- | WVTGAFNKVA | KAA-EVGQKA | KEKV-MAEE- | 250 |

| | | | | | | | |
|---|---|---|---|---|---|---|---|
| CeresClone:241340 | KNAEGGPAQA | NI SETHEAHR | GLDGGFSRLH | DSETPEDI PI | STASVPAVT- | 289 |
| gi\|32489377 | KTVELESAEP | NSSEGHGTQK | DVDGEFAKI Q | VSESPEDI PI | STTATVPI TD | 290 |
| CeresClone:700178 | KTVAAGHAQA | DMSDAREKPR | DLDGEVTKI H | VSENPEDI PI | STAAVFPI TV | 290 |
| CeresClone:477450 | ---------- | ------QQKR | KVEDQYAQV- | LSESPKA--- | AEASEQKSS- | 270 |
| Lead-CeresClone254065 | E--------- | ------EEKK | KVVDEMAIVH | LTESPKA--- | LDQSEQDSKL | 279 |
| CeresClone:39922 | ---------- | ------EDKR | KVVDEFARVH | LSESPKAASS | TQEAERESKL | 276 |
| gi\|21593540 | ---------- | ------EDKR | KVVDEFARVH | LSESPKAASS | TQEAERESKL | 276 |
| Consensus | K--------- | ------E-KR | KVDDEFARVH | LSESPKA--- | S--AE-ESTL | 300 |

| | | | | | | |
|---|---|---|---|---|---|---|
| CeresClone:241340 | ---------- | ---------- | ---DEEPSKG | FSTSWCS | 303 |
| gi\|32489377 | EDSSQASP-- | ----PAAS-- | -PKKPEPAQG | LI L---- | 314 |
| CeresClone:700178 | DDSSDASP-- | ----PPPATA | LPKKPEPAQG | LF L---- | 317 |
| CeresClone:477450 | ---------- | ---------- | ---KPAPAQG | LI L---- | 280 |
| Lead-CeresClone254065 | PES------- | ---------- | ---KSQPHKE | LNASVV- | 295 |
| CeresClone:39922 | SESPEAKKDS | EHLEPQSKPL | QQQSPPPMAS | APAPAQP | 313 |
| gi\|21593540 | SESPEAKKDS | EHLEPQSKPL | QQQSPPPMAS | APAPAQP | 313 |
| Consensus | -ES-EA---- | ----P----- | ---KPEPAQG | L------ | 337 |

```
CeresClone:1074247        MAQPPAPATP AAAYGCAACG ADLNLSASNL YPAGTYFEAG NKGTLSFSWV  50
Lead-CeresClone224062     ------MASAP ADSYGCAACG APLNLSAAHL YPADFYFEAG NKGTLSFSWV  45
CeresClone:1490254        ------MASAP ADSYGCAACG ALLDLSAAHL YPADFYFEAG NKGTLSFSWV  45
CeresClone:592780         ----------M ASVYSCTECG SNLNLNSAHA YPPDFYFEAG NKGSVSFSVA  41
CeresClone:1036315        ---------MA FTMYSCKECG SDLNLNPNDL FPPDFYFEAG NKATISFAAV  42
gi|30680080               ---------MA STIYTCKECG SDLNLNPNDL FPPDFYFEAG NKGTLSFAAV  42
CeresClone:20269          ---------MA STIYTCKECG SDLNLNPNDL FPPDFYFEAG NKGTLSFAAV  42
gi|50058911               ---------MA STIYTCKECG SDLNLNPNDL FPPDFYFEAG NKGTLSFAAV  42

Consensus                 ---------MA ATIYTCKECG SDLNLN-NDL -PPDFYFEAG NKGTLSF-AV  50

CeresClone:1074247        DESRLRFAAE DRIRPFFETL DYWGIQRKRT RVSCDACGRL LGHVYDDGPP  100
Lead-CeresClone224062     DESRLRFAPE DRIRPFFETL NYWGIQRKRT RISCDACGHL LGHVYDDGPP  95
CeresClone:1490254        DESRLRFAPE DRIRPFFETL NYWGIQRKRT RISCDACGHL LGHVYDDGPP  95
CeresClone:592780         DPTKFKFEKE DKLRPFFETV NYWGIQRKRT KIKCNTCDCL LGYVYDDGPP  91
CeresClone:1036315        DADKFRFEKE DKIMPFFETL NYWGIQRKRT KIKCHSCGHL VGYIYDDGPP  92
gi|30680080               DAEKFRFEKE DKIMPFFETL NYWGIQRKRT KIKCTSCNHL IGYIYDDGPP  92
CeresClone:20269          DAEKFRFEKE DKIMPFFETL NYWGIQRKRT KIKCTSCNHL IGYIYDDGPP  92
gi|50058911               DAEKFRFEKE DKIMPFFETL NYWGIQRKRT KIKCTSCNHL IGYIYDDGPP  92

Consensus                 DA-KFRFEKE DKI-PFFETL NYWGIQRKRT KIKC-SC-HL LGY-YDDGPP  100

CeresClone:1074247        LMDGTSQLGM GPSQVVPRRP RYRFKVKAVT AAGSSSAAAA R---   141
Lead-CeresClone224062     AMQGTGQFGM GPSQVIPRRP RYRFKIKAIA ASSSAPAAAA YEK-   138
CeresClone:1490254        AMQGTGQFGM GPSQVIPRRP RYRFKIKAIA ASSSAPAAAA AYGK   139
CeresClone:592780         LTDSPGQFHM GPSQVIPRAP RYRFKTKTLR ITST------ ----   125
CeresClone:1036315        LTGGIGQYGF GPSQVVPRAP RYRFKTKTLL ISSQT----- ----   127
gi|30680080               LTGGIGQYGF GPSQVIPRAP RYRFKTKARQ DGWQYGGLTA FWN-   135
CeresClone:20269          LTGGIGQYGF GPSQVIPRAP RYRFKTKAVQ VSSQT----- ----   127
gi|50058911               LTGGIGQYGF GPSQVIPRAP RYRFKTKAVQ VSSQT----- ----   127

Consensus                 LTGGIGQYG- GPSQVIPRAP RYRFKTKAIQ -SS-------A ----   144
```

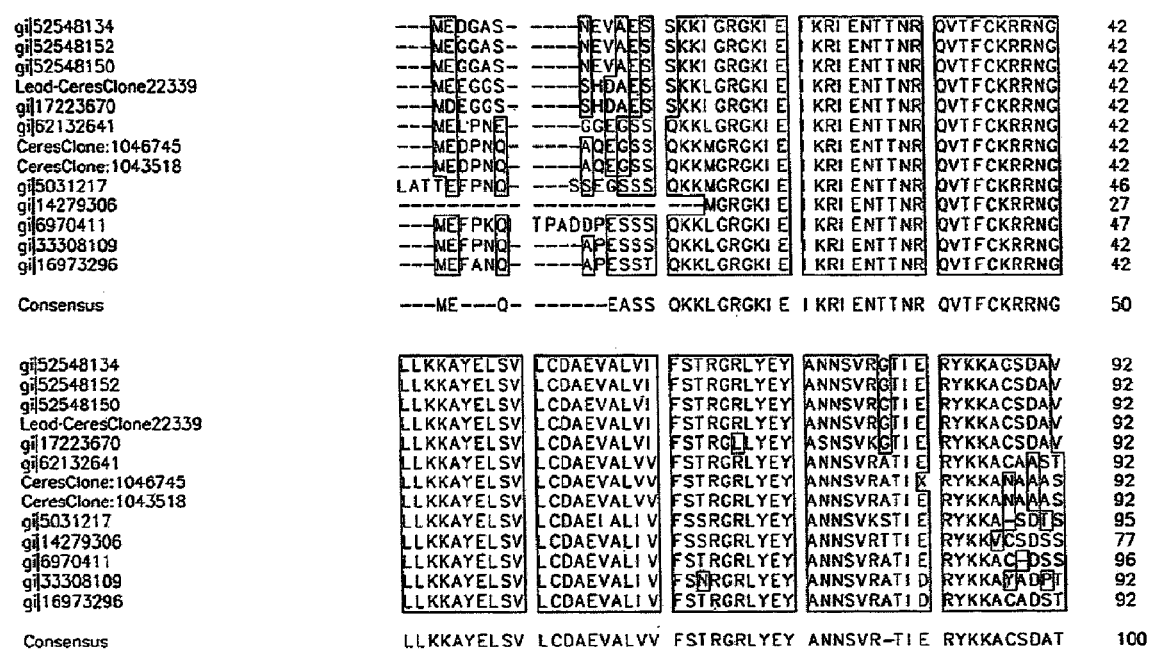

```
gi|52548134            ---MEDGAS- -----NEVAES SKKIGRGKIE IKRIENTTNR QVTFCKRRNG  42
gi|52548152            ---MEGGAS- -----NEVAES SKKIGRGKIE IKRIENTTNR QVTFCKRRNG  42
gi|52548150            ---MEGGAS- -----NEVAES SKKIGRGKIE IKRIENTTNR QVTFCKRRNG  42
Lead-CeresClone22339   ---MEEGGS- -----SHDAES SKKLGRGKIE IKRIENTTNR QVTFCKRRNG  42
gi|17223670            ---MDEGGS- -----SHDAES SKKIGRGKIE IKRIENTTNR QVTFCKRRNG  42
gi|62132641            ---MELPNE- -----GGEGSS QKKLGRGKIE IKRIENTTNR QVTFCKRRNG  42
CeresClone:1046745     ---MEDPNQ- -----AQEGSS QKKMGRGKIE IKRIENTTNR QVTFCKRRNG  42
CeresClone:1043518     ---MEDPNQ- -----AQEGSS QKKMGRGKIE IKRIENTTNR QVTFCKRRNG  42
gi|5031217             LATTEFPNQ- ---SSEGSSS QKKMGRGKIE IKRIENTTNR QVTFCKRRNG  46
gi|14279306            ---------- ---------- ---MGRGKIE IKRIENTTNR QVTFCKRRNG  27
gi|6970411             ---MEFPKQ TPADDPESSS QKKLGRGKIE IKRIENTTNR QVTFCKRRNG  47
gi|33308109            ---MEFPNQ- -----APESSS QKKLGRGKIE IKRIENTTNR QVTFCKRRNG  42
gi|16973296            ---MEFANQ- -----APESST QKKLGRGKIE IKRIENTTNR QVTFCKRRNG  42

Consensus              ---ME---Q- ------EASS QKKLGRGKIE IKRIENTTNR QVTFCKRRNG  50

gi|52548134            LLKKAYELSV LCDAEVALVI FSTRGRLYEY ANNSVRGTIE RYKKACSDAV  92
gi|52548152            LLKKAYELSV LCDAEVALVI FSTRGRLYEY ANNSVRGTIE RYKKACSDAV  92
gi|52548150            LLKKAYELSV LCDAEVALVI FSTRGRLYEY ANNSVRGTIE RYKKACSDAV  92
Lead-CeresClone22339   LLKKAYELSV LCDAEVALVI FSTRGRLYEY ANNSVRGTIE RYKKACSDAV  92
gi|17223670            LLKKAYELSV LCDAEVALVI FSTRGLLYEY ASNSVKGTIE RYKKACSDAV  92
gi|62132641            LLKKAYELSV LCDAEVALVV FSTRGRLYEY ANNSVRATIE RYKKACAAST  92
CeresClone:1046745     LLKKAYELSV LCDAEVALVV FSTRGRLYEY ANNSVRATIK RYKKANAAAS  92
CeresClone:1043518     LLKKAYELSV LCDAEVALVV FSTRGRLYEY ANNSVRATIE RYKKANAAAS  92
gi|5031217             LLKKAYELSV LCDAEIALIV FSSRGRLYEY ANNSVKSTIE RYKKA-SDTS  95
gi|14279306            LLKKAYELSV LCDAEVALIV FSSRGRLYEY ANNSVRTTIE RYKKVCSDSS  77
gi|6970411             LLKKAYELSV LCDAEVALIV FSTRGRLYEY ANNSVRATIE RYKKAC-DSS  96
gi|33308109            LLKKAYELSV LCDAEVALIV FSNRGRLYEY ANNSVRATID RYKKAYADPT  92
gi|16973296            LLKKAYELSV LCDAEVALIV FSTRGRLYEY ANNSVRATID RYKKACADST  92

Consensus              LLKKAYELSV LCDAEVALVV FSTRGRLYEY ANNSVR-TIE RYKKACSDAT 100
```

| | | | | | | |
|---|---|---|---|---|---|---|
| gi\|52548134 | NPPTITEANT | QYYQQEASKL | RRQIRDIQNL | NRHILGESLG | SLNFKELKNL | 142 |
| gi\|52548152 | NPPTITEANT | QYYQQEASKL | RRQIRDIQNL | NRHILGESLG | SLNFKELKNL | 142 |
| gi\|52548150 | NPPTITEANT | QYYQQEASKL | RRQIRDIQNL | NRHILGESLG | SLNFKELKNL | 142 |
| Lead-CeresClone22339 | NPPSVTEANT | QYYQQEASKL | RRQIRDIQNS | NRHIVGESLG | SLNFKELKNL | 142 |
| gi\|17223670 | NPPTVTEANT | KHYQQEASKL | RRQIRDIQNS | NRHIVGESLG | SLNFKELKNL | 142 |
| gi\|62132641 | NAESVSEANT | QFYQQESSKL | RRQIRDIQNL | NRHILGEALG | SLSLKELKNL | 142 |
| CeresClone:1046745 | NAESVSEANT | QFYQQESSXL | RRQIRDIQNL | NRHILGEALG | SLSLKELKNL | 142 |
| CeresClone:1043518 | NAESVSEANT | QFYQQESSKL | RRQIRDIQNL | NRHILGEALG | SLSLKELKNL | 142 |
| gi\|5031217 | NPGSVSETNA | QFYQQESSKL | RRQIRDIQNL | NRHIMGEALS | SLTFRELKNL | 145 |
| gi\|14279306 | NTGSVSEANA | QFYQQEASKL | RRQIRDIQNL | NRHILGEALS | SLNFKELKNL | 127 |
| gi\|6970411 | NTGSVTETNV | QFYQQEASKL | RRQIREIQNS | NRHILGEALS | TLNVKELKNL | 146 |
| gi\|33308109 | NSGSVSEANT | QFYQQEASKL | RRQIREIQNS | NRHILGEALS | SLNAKELKNL | 142 |
| gi\|16973296 | DGGSVSEANT | QFYQQEASKL | RRQIREIQNS | NRHILGESLS | TLKVKELKNL | 142 |
| Consensus | N--SVIEANT | QFYQQEASKL | RRQIRDIQNL | NRHILGEALG | SLNFKELKNL | 150 |

| | | | | | | |
|---|---|---|---|---|---|---|
| gi\|52548134 | ESRLEKGISR | VRSKKHEMLV | AEIEYMQKRE | IELQNDNMYL | RSKITERTG- | 191 |
| gi\|52548152 | ESRLEKGISR | VRSKKHEMLV | AEIEYMQKRE | IELQNDNMYL | RSKITERTG- | 191 |
| gi\|52548150 | ESRLEKGISR | VRSKKHEMLV | AEIEYMQKRE | IELQNDNMYL | RSKITERTG- | 191 |
| Lead-CeresClone22339 | EGRLEKGISR | VRSKKNELLV | AEIEYMQKRE | MELQHNNMYL | RAKIAEGARL | 192 |
| gi\|17223670 | EGRLEKGISR | VRSKKSELLV | AEIEYMQKRE | MELQHVNMYL | RAKIEQGARL | 192 |
| gi\|62132641 | EGRLEKGLSR | VRSRKHETLF | ADVEFMQKRE | IELQNHNNYL | RAKIAEHER- | 191 |
| CeresClone:1046745 | EGRLEKGLSR | VRSRKHETLF | ADIEFMQKRE | IELQNHNNFL | RAKIAENER- | 191 |
| CeresClone:1043518 | EGRLEKGLSR | VRSRKHETLF | ADVEFMQKRE | IELQNHNNYL | RAKIAEHER- | 191 |
| gi\|5031217 | EGRLEKGISR | IRSKKNELLF | AEIEYMQKRE | IELQNANMYL | RAKIAENER- | 194 |
| gi\|14279306 | ETRLEKGISR | IRSKKNELLF | AEIEYMQKRE | IELQNSNLFL | RAQIAENER- | 176 |
| gi\|6970411 | EGRLEKGISR | IRSKKNEMLF | AEIEYMQKRE | IELQNHNNFL | RAKIAENDR- | 195 |
| gi\|33308109 | EGRLEKGISR | IRSKKNEMLF | SEIEFMQKRE | TELQHHNNFL | RAKIAENER- | 191 |
| gi\|16973296 | EGRLEKGISR | IRSKKNEILF | SEIEFMQKRE | TELQHHNNFL | RAKIAESER- | 191 |
| Consensus | EGRLEKGISR | VRSKK-EMLF | AEIEYMQKRE | IELQN-NMYL | RAKIAENER- | 200 |

```
gi|52548134            LQQQESSVIH QGT--VYESG VTSSH-QSGQ YN-RNYIAVN LLEPNQN--S    235
gi|52548152            LQQQESSVIH QGT--AYESG VTSSH-QSGQ YN-RNYIAVN LLEPNQN--S    235
gi|52548150            LQQQESSVIH QGT--VYESG VTSSH-QSGQ YN-RNYIAVN LLEPNQN--S    235
Lead-CeresClone22339   NPDQQESSVI QGT-TVYESG V-SSHDQSQH YN-RNYIPVN LLEPNQQ--F    237
gi|17223670            NPEQHGSGVI QGT-AVYESG LSSSHDQSQH YN-RNYIPVN LLEPNQQ--F    238
gi|62132641            AQQQ-QQNLM PET--MCESL --PSQ----T YD-RNFFPVN LLCSDQQE-Y    230
CeresClone:1046745     AQQR-QQDMI PGT--ECESI IPNSQ----S YD-RNFFPVN LIDSNNNQ-Y    232
CeresClone:1043518     AQQQ-QSNMM SGT--LCESL --PSQ----S YD-RNFFPVN LIASDDQQQY    231
gi|5031217             NQQQ--TELM PGS--VYET- MPSSQ----P YD-RSFLVAN LLEPPNHH-Y    233
gi|14279306            AQQQ--MNLM PGS--QYESV --PQQ----P YDSQNLLPVN LLDPNHH--Y    214
gi|6970411             AQQQ-QANMM PGTLSAYDQS MPPPQ----S YD-RSFLPV- ILESNHHYNR    238
gi|33308109            EEQQ-HTHMM PGT--SYDQS M-PSH----S YD-RNFLPAV ILESNNNH-Y    231
gi|16973296            EQQQQQTHMI PGT--SYDPS M-PSN----S YD-RNFFPV- ILESNNNH-Y    231

Consensus              -QQQ--SNMM PGT--VYES- --SSH----- YD-RNFIPVN LLEPNNN--Y    250

gi|52548134            SNQDQPPLQL V    246
gi|52548152            SNQDQPPLQL V    246
gi|52548150            SNQDQPPLQL V    246
Lead-CeresClone22339   SGQDQPPLQL V    248
gi|17223670            SGQDQPPLQL V    249
gi|62132641            SRQDQTALQL V    241
CeresClone:1046745     SRQDQTALQL V    243
CeresClone:1043518     SSQDHTALQL V    242
gi|5031217             SRQDQTPLQL V    244
gi|14279306            SRHDQTALQL V    225
gi|6970411             QGQNQTPLQL V    249
gi|33308109            PHQVQTALQL V    242
gi|16973296            PRQGQTALQL V    242

Consensus              S-QDQTPLQL V    261
```

```
gi|37718893                  --------MW NFASSAWCSG LGKKNTP-NC TPSNCDCSDD EASSCTSREE   41
CeresClone:1549251           --------MW GFASNAMAAG LEKRSFP-NR TSSSAAYSDD EASSCTSREE   41
Lead-CeresClone100319        MLSI PDTRMW NLASSYLTGN I GPKNDI RRP VHAHAECSDD DVSSVGSKDE   50
CeresClone:937503            --------MW SFASNAI AGS I KKKVQPSKG SLSNHDCSDD DGSSCASREE   42
CeresClone:1246429           --------MW NFASSLI AGS VGLKNDSPKP THSASEFSDD E-TSNVSREE   41
CeresClone:625275            --------MW NFASNCI AGT VGLKNDS-KP THSASECSDD E-NSVI GREE   40

Consensus                    --------MW NFAS-AI AGS -GKKNDP-KP THS---ECSDD E-SS--SREE   50

gi|37718893                  GLECPI CWES FNI VENVPYV LWCGHTMCKN CI LGLQWAI I KVPTVPI QLP   91
CeresClone:1549251           GLECPI CWES FNI VENVPYA LWCGHTMCKN CI LGLQWAVI KVPTVPI QLP   91
Lead-CeresClone100319        GLECPI CWES FNI VENVPYV LWCGHTMCKN CI LGLQWAI V KLPTHPVQLP   100
CeresClone:937503            GLECPI CCES FNI VENVPYV LWCGHTMCKN CI LGLQWAVV KFPTLPI QLP   92
CeresClone:1246429           RLECPI CWES FNI VENVPYV LWCGHTLCKN CI LGLQWAVV NFPTLPI RLP   91
CeresClone:625275            GLECPI CWES FNI VENVPYV LWCGHTLCKN CI LGLQWAVV KFPTLPVQLP   90

Consensus                    GLECPI CWES FNI VENVPYV LWCGHTMCKN CI LGLQWAVV K-PTLPI QLP   100

gi|37718893                  FFVSCPWCNL LSLRI I YKGN LAFPRKNYFL LWMVECMNGE RARSRSAI HS   141
CeresClone:1549251           FFI CCPWCNL LSPRVLYKGN LTFPRKNYFL LWMVECMNGE RARSRPAI RS   141
Lead-CeresClone100319        LFI SCPWCNL LSFRLVFRGT LRFPHKNYFV LWMVERMNGE RRNSPGGAQT   150
CeresClone:937503            LFVSCPWCNL LSFRLVYKGN LKFPRKNYFL LWMVESMNGD RAKFHSSGHE   142
CeresClone:1246429           LFI SCPWCNL LSLRLVYQGN LKFPHKNYFL LWMVESMNGD RVKSHSTVCG   141
CeresClone:625275            LFI SCPWCNL LSFRLVYRGN LKFPRKNYFL LWMVESMNGD RGKSHSPFCG   140

Consensus                    LFI SCPWCNL LSFRLVYKGN LKFPRKNYFL LWMVESMNG- RAKSHS-I -S   150

gi|37718893                  EQQTTWL-SS SSRASCNECY SNPI RRPLPP P-VETQSPSV NHANHGV-PI   188
CeresClone:1549251           EQHTPWLSSS SSVANGNAGC SNPTRRHLPP PSVDTSPTNA NHANHGGSPL   191
Lead-CeresClone100319        D--------GN NDHTRETPSP CLHNRHHRSQ P--EPSRSVN DHR-------   184
CeresClone:937503            ERQSVCP--- --SSGGTSSS CHHRRTPTAR A--ETSSSAR DRNAAAN--T   183
CeresClone:1246429           DHQPVWPI I D SLTNGSQVSH DSLQGGQVCH P--ESSSSNH YHGDTSN--Y   187
CeresClone:625275            DNQQHSI-KD NLTMCSQVSH CNLRRGLVRH P--ETSSSNQ YHGNTGN--H   185

Consensus                    -QQT-WL--- N-T-GG--SH -N-RR----- P--ETSSSN- -H-N-GN---   200
```

| | | |
|---|---|---|
| gi\|37718893 | LNAERVQALL RKSLSFLVHL TAKFPLVFIF LLIVLYAIPA SAAVLLLYIL | 238 |
| CeresClone:1549251 | LNAGRVQASL RKSLSFLVHL TAKFPLVFVF LLIVLYAIPA SAAVLLLYIL | 241 |
| Lead-CeresClone100319 | IPRDNIQTSL RKSLVFFVQL TAKFPLVVIF LLIILYAIPT SAAILAMYIL | 234 |
| CeresClone:937503 | PNTASV--SL QKLMVCFVQL TAKFPLVIMF LLIVLYAVPA SAAVLLLYVL | 231 |
| CeresClone:1246429 | LSIETLHTSL RKSLVLFVHL TAKFPLIIIF LLIVLYAIPV TAAILALYIL | 237 |
| CeresClone:625275 | LNTERFHVYL RKSLIFFVQL TAKFPLVIIF LLIVLYAIPA SAAILALYVL | 235 |
| Consensus | LN-E-VQ-SL RKSLVFFV-L TAKFPLVIIF LLIVLYAIPA SAA-L-LYIL | 250 |

| | | |
|---|---|---|
| gi\|37718893 | ITVLFALPSF LILYFAYPSL DWLVREIFA | 267 |
| CeresClone:1549251 | ITVLFALPSF LILYFAYPSL DWLVREIFA | 270 |
| Lead-CeresClone100319 | VTLLEALPSF LILYFAYPCL DWLVREIVT | 263 |
| CeresClone:937503 | VTFLFALPSF LILYFAYPTL DWLVREIFT | 260 |
| CeresClone:1246429 | VTILFALPSF LILYFAYPSL DWLVREIIT | 266 |
| CeresClone:625275 | VTILFALPSF LILYFSYPSL DWLVREIIT | 264 |
| Consensus | VT-LFALPSF LILYFAYPSL DWLVREI-T | 279 |

| | | |
|---|---|---|
| Lead-CeresClone288251 | MAKHHPDLI M CRKQPGI AI G RLCEKCDGKC VVCDSYVRPC TLVRVCDECN | 50 |
| CeresClone:1053778 | ---------M CRKQPGI AI G RLCEKCDGKC VI CDSYVRPC TLVRVCDECN | 41 |
| CeresClone:94739 | ---------M CRKQPGI AI G RLCEKCDGKC VI CDSYVRPC TLVRI CDECN | 41 |
| CeresClone:35872 | ---------M CRKQPGI AI G RLCEKCDGKC VI CDSYVRPC TLVRI CDECN | 41 |
| CeresClone:22599 | ---------M CRKQPGI AI G RLCEKCDGKC VI CDSYVRPC TLVRI CDECN | 41 |
| CeresClone:855135 | ---------M CRKQPGI AI G RLCEKCDGKC VI CDSYVRPC TLVRVCDECN | 41 |
| Consensus | ---------M CRKQPGI AI G RLCEKCDGKC VI CDSYVRPC TLVR-CDECN | 50 |
| Lead-CeresClone288251 | YGSFQGRCVI CGGVGI SDAY YCKECTQQEK DRDGCPKI VN LGSAKTDLFY | 100 |
| CeresClone:1053778 | YGSFQGRCVI CGGVGI SDAY YCKKCTQQEK DRDGCPKI VN LGSAKTDLFY | 91 |
| CeresClone:94739 | YGSFQGRCVI CGGVGI SDAY YCKECTQQEK DRDGCPKI VN LGSAKTDLFY | 91 |
| CeresClone:35872 | YGSFQGRCVI CGGVGI SDAY YCKECTQQEK DRDGCPKI VN LGSAKTDLFY | 91 |
| CeresClone:22599 | YGSFQGRCVI CGGVGI SDAY YCKECTQQEK DRDGCPKI VN LGSAKTDLFY | 91 |
| CeresClone:855135 | YGSFQGRCVI CGGVGI SDAY YCKECTQQEK DRDGCPKI VN LGSAKTDLFY | 91 |
| Consensus | YGSFQGRCVI CGGVGI SDAY YCKECTQQEK DRDGCPKI VN LGSAKTDLFY | 100 |
| Lead-CeresClone288251 | ERKKYGFKKR | 110 |
| CeresClone:1053778 | ERKKYGFKKR | 101 |
| CeresClone:94739 | ERKKYGFKKR | 101 |
| CeresClone:35872 | ERKKYGFKKR | 101 |
| CeresClone:22599 | ERKKYGFKKR | 101 |
| CeresClone:855135 | ERKKYG---- | 97 |
| Consensus | ERKKYGFKKR | 110 |

| | | | | | | |
|---|---|---|---|---|---|---|
| gi\|50929507 | ---------- | ---------- | -MVGGEVMCE | AAA------- | ------PRYR | 16 |
| CeresClone:273307 | ---------- | ---------- | -MRRRGVAAA | DAD------- | -GD-VELRFR | 20 |
| Lead-CeresClone124720 | ---------- | ---------- | MRKGRGSSVV | GPA--LPVTA | GGSVKEPRYR | 28 |
| CeresClone:975672 | FHQLQTHRSL | LNHITSGSPT | MRKGRGSSAV | PPA--LP--- | -GSVKEPRYR | 44 |
| gi\|57012880 | ---------- | ---------- | MRRGRAAAAP | APVTGEPNGS | GGS-KELRFR | 29 |
| gi\|56384582 | ---------- | ---------- | MGRGGATTAA | AAV--EPV-- | -FF-KEPRYR | 24 |
| CeresClone:1044385 | ---------- | -------MVK | EKKNVVVKNK | KPN------- | -NNADELHFR | 25 |
| gi\|55419650 | ---------- | --------MA | PRSKPSPISP | NPD------- | -PNSKEIRYR | 24 |
| Consensus | ---------- | ---------- | MR-GR-S-A- | -P----P--- | -G--KE-RYR | 50 |

| | | | | | | |
|---|---|---|---|---|---|---|
| gi\|50929507 | GVRKRPWGRF | AAEIRDPAKR | ARVWLGTYDS | AEAAARAYDV | AARNLRGPLA | 66 |
| CeresClone:273307 | GVRKRPWGRY | AAEIRDPAKK | ARVWLGTFDS | AEDAARAYDA | AARMLRGPKA | 70 |
| Lead-CeresClone124720 | GVRKRPWGRF | AAEIRDPLKK | SRVWLGTFDS | AVDAARAYDT | AARNLRGPKA | 78 |
| CeresClone:975672 | GVRKRPWGRF | AAEIRDPLKK | SRVWLGTFDS | AEEAARAYDA | AARNLRGPKA | 94 |
| gi\|57012880 | GVRKRPWGRF | AAEIRDPMKK | TRVWLGTFDS | AEDAARAYDA | AARALRGPKA | 79 |
| gi\|56384582 | GVRKRPWGRF | AAEIRDPLKK | ARVWLGTFDT | AEEAARAYDT | AARNLRGPKA | 74 |
| CeresClone:1044385 | GVRKRPWGRY | AAEIRDPGKK | TRVWLGTFDT | AEDAARAYDA | AARNFRGPKA | 75 |
| gi\|55419650 | GVRKRPWGRY | AAEIRDPRKK | TRVWLGTFDT | AEEAARAYDA | KAREFRGAKA | 74 |
| Consensus | GVRKRPWGRF | AAEIRDP-KK | -RVWLGTFDS | AEDAARAYDA | AARNLRGPKA | 100 |

| | | | | | | |
|---|---|---|---|---|---|---|
| gi\|50929507 | RTNFPLVSSL | PLP-SPHYHL | PGKA------ | ---------- | ---------- | 89 |
| CeresClone:273307 | RTNFPLPAA- | ----AALHHP | HMPAAAA--- | --AAAPPYTT | YPTATG---- | 106 |
| Lead-CeresClone124720 | KTNFPIDCSP | SSPLQPLTYL | HNQNLCSPPV | IQNQIDPFMD | HRLYGGGNFQ | 128 |
| CeresClone:975672 | KTNFQIDCSP | SSPLQPLHHR | ---------- | --NQIDPFMD | HRLYGG---- | 128 |
| gi\|57012880 | KTNFPLP--- | ----YAHHHQ | FNQGHN---- | --PNNDPFVD | SRFYP----- | 111 |
| gi\|56384582 | KTNFPLA--- | ----QPFYQN | P--------- | --EAGNPFGE | LRFYAGG--- | 103 |
| CeresClone:1044385 | KTNFPVPPD- | ----DNNNNN | VNVNKNKSVN | VKSHSPS--- | ---------- | 107 |
| gi\|55419650 | KTNFA----- | ----DNNAND | F--------- | --TRSPS--- | ---------- | 91 |
| Consensus | KTNFPL--S- | -----P-HH- | ---------- | ----SDPF-D | -R-Y-G---- | 150 |

```
gi|50929507             -AAAAPPVAG PACSA-SSTV ESSSGPRG-- ---------- --PRPAATAA   123
CeresClone:273307       -VVSTPPVAR PACSSLSSTV ESFSGARP-- ---------- ---RPVLPP-   139
Lead-CeresClone124720   EQQQQI I SR PASSSMSSTV KSCSGPRP-- ---------- --MEAAAASS   164
CeresClone:975672       -EQEVVI LSR PASSSMSSTV KSCSGVRP-- ---------- --ASSSVAKA   163
gi|57012880             -QDNPI I SQR PTSSSMSSTV ESFSGPRP-- ---------- --PPAPRQQT   146
gi|56384582             AGEGFQDHRR PTSSGMSSTV ESFGGPRP-- ---------- --VRPPMPPS   139
CeresClone:1044385      -QSSTVESAT PEREATRRST SAAI DRFPFL PI QQQI LMTH PVAAPMRPVF   156
gi|55419650             -QSSTVESSS P--PPLDLTL ASPCSSLP-- ---------- --VTAQRPVY   124

Consensus               -Q-S-V---R PASSSMSSTV ES-SGPRP-- ---------- -------P--   200

gi|50929507             AV-----PRR RVPRPAPPAP DAGCHSDCAS SASVVD---- -------DADD   158
CeresClone:273307       ---------- RFPP--PSIP DGDCRSDCGS SASVVD---- ----DDCTDA   169
Lead-CeresClone124720   SVAKPLHAIK RYPRT-PPVA PEDCHSDCDS SSSVI D---- ------DGDD   203
CeresClone:975672       -------ATK RYPRT-PPVA PEDCRSDCDS SSSVVE---- ------DGXD   195
gi|57012880             TA-----SSR KYTRS-PPVV PDDCHSDCDS SSSVVDHGDC EKENDNDNDN   190
gi|56384582             AV-----TGR RYPRT-PPVA PGDCRSDCDS SSSVVD---- -----DADNDN  175
CeresClone:1044385      FLDRAHFMTQ SFP---LRFE PGPVQSDSDS SSVVVD---- -------CQP-  192
gi|55419650             FFDAFATGGS GCP------A SGFAQSDSDS SSSVVD---- ------FEGG-  158

Consensus               -V-------R RYPRT-PPVA PGDCRSDCDS SSSVVD---- ------D-DD   250

gi|50929507             AST-----VR SRVAAFDLNL PPPLDRDHVD L--------- CTDLRL   190
CeresClone:273307       AASASC---- PFPLPFDLNL PPGCGCAGVG FYADEEDELR LTALRL   211
Lead-CeresClone124720   IASSSS--RR KTPFQFDLNF PPLDG---VD LFAGGIDDLH CTDLRL   244
CeresClone:975672       IASSSS--RR KPPFEFDLNF XPLDG---VD LFVGA-DDXX CTDLXL   235
gi|57012880             IASSSF---- RKPLLFDLNL PPP------- MDDAGADDLH CTALCL   225
gi|56384582             AASSTMLSFK RQPLPFDLNA PPLEE---GD VANGLGEDLH CTLLCL   218
CeresClone:1044385      ---------- KREINLDLNL APPN------ EY-------- ------   208
gi|55419650             --------VR RRVFDLDLNQ LPAE------ MD-------- ------   176

Consensus               -ASSS----R -RPL-FDLNL PP------VD M-----DDL- CT-L-L   296
```

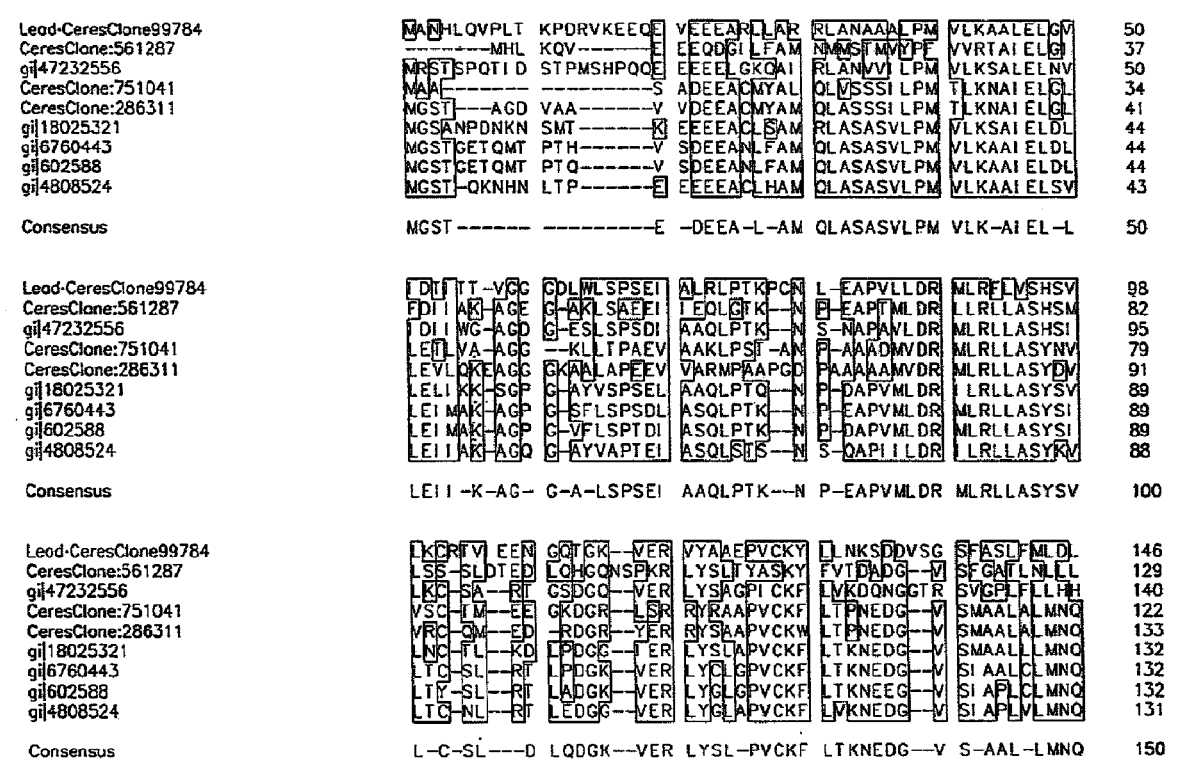

```
Lead-CeresClone99784   MANHLQVPLT KPDRVKEEQE VEEEARLLAR RLANAAALPM VLKAALELGV   50
CeresClone:561287      -------MHL KQV------E EEQDGILFAM NMMSTMVYPF VVRTAIELGI   37
gi|47232556            MRSTSPQTID STPMSHPQQE EEEELGKQAI RLANVVILPM VLKSALELNV   50
CeresClone:751041      MAA------- ---------S ADEEACMYAL QLVSSSILPM TLKNAIELGL   34
CeresClone:286311      MGST---AGD VAA------V VDEEACMYAM QLASSSILPM TLKNAIELGL   41
gi|18025321            MGSANPDNKN SMT------K EEEEACLSAM RLASASVLPM VLKSAIELDL   44
gi|6760443             MGSTGETQMT PTH------V SDEEANLFAM QLASASVLPM VLKAAIELDL   44
gi|602588              MGSTGETQMT PTQ------V SDEEANLFAM QLASASVLPM VLKAAIELDL   44
gi|4808524             MGST-QKNHN LTP------E EEEEACLHAM QLASASVLPM VLKAAIELSV   43

Consensus              MGST------ ---------E -DEEA-L-AM QLASASVLPM VLK-AIEL-L   50

Lead-CeresClone99784   IDIITT-VGG GDLWLSPSEI ALRLPTKPCN L-EAPVLLDR MLRFLVSHSV   98
CeresClone:561287      FDIIAK-AGE G-AKLSAEEI IEQLGTK--N P-EAPTMLDR LLRLLASHSM   82
gi|47232556            IDIIWG-AGD G-ESLSPSDI AAQLPTK--N S-NAPAVLDR MLRLLASHSI   95
CeresClone:751041      LETLVA-AGG --KLLTPAEV AAKLPST-AN P-AAADMVDR MLRLLASYNV   79
CeresClone:286311      LEVLQKEAGG GKAALAPEEV VARMPAAPGD PAAAAAMVDR MLRLLASYDV   91
gi|18025321            LELIKK-SGP G-AYVSPSEL AAQLPTQ--N P-DAPVMLDR ILRLLASYSV   89
gi|6760443             LEIMAK-AGP G-SFLSPSDL ASQLPTK--N P-EAPVMLDR MLRLLASYSI   89
gi|602588              LEIMAK-AGP G-VFLSPTDI ASQLPTK--N P-DAPVMLDR MLRLLASYSI   89
gi|4808524             LEIIAK-AGQ G-AYVAPTEI ASQLSTS--N S-QAPIILDR ILRLLASYKV   88

Consensus              LEII-K-AG- G-A-LSPSEI AAQLPTK--N P-EAPVMLDR MLRLLASYSV  100

Lead-CeresClone99784   LKCRTVIEEN GQTGK--VER VYAAEPVCKY ILNKSDDVSG SFASLFMLDL  146
CeresClone:561287      LSS-SLDTED LQHGQNSPKR LYSLTYASKY FVTDADG--V SFGATLNLLL  129
gi|47232556            LKC-SA--RT GSDGQ--VER LYSAGPICKF LVKDQNGGTR SVGPLFLLHH  140
CeresClone:751041      VSC-IM--EE GKDGR--LSR RYRAAPVCKF LTPNEDG--V SMAALALMNQ  122
CeresClone:286311      VRC-QM--ED -RDGR--YER RYSAAPVCKW LTPNEDG--V SMAALALMNQ  133
gi|18025321            LNC-TL--KD LPDCG--IER LYSLAPVCKF LTKNEDG--V SMAALLLMNQ  132
gi|6760443             LTC-SL--RT LPDGK--VER LYCLGPVCKF LTKNEDG--V SIAALCLMNQ  132
gi|602588              LTY-SL--RT LADGK--VER LYGLGPVCKF LTKNEEG--V SIAPLCLMNQ  132
gi|4808524             LTC-NL--RT LEDGG--VER LYGLAPVCKF LVKNEDG--V SIAPLVLMNQ  131

Consensus              L-C-SL---D LQDGK--VER LYSL-PVCKF LTKNEDG--V S-AAL-LMNQ  150
```

```
Lead-CeresClone99784   SDVFIKTWTH LKDVI LAGRD AFSSAHGMKL FEYI QADERF GKVFNRAMLE  196
CeresClone:561287      DKVFLESWIE LKGAI LEGGV AFNRVHSMHS FEYPAVDPRF NDVFNKAMFN  179
gi|47232556            DKVFMEGWFH LNDAI LEGGI PFNRAYGMTA FEYPETDERF NRVFNQANSN  190
CeresClone:751041      DKVLWESWYY LKDAVLDGGI PFNKAYGMSA FEYHGTDPRF NRVFNEGMKN  172
CeresClone:286311      DKVLWESWYY LKDAVLDGGI PFNKAYGMTA FEYHGTDSRF NRVFNEGMKN  183
gi|18025321            DKVLMESWYH LKDAVLEGGI PFNKAYGMTA FEYHGKDPRF NKVFNQGMSN  182
gi|6760443             DKVLVESWYH LKDAVLDGGI PFNKAYGMTA FDYHGTDPRF NKVFNKGMAD  182
gi|602588              DKVLLESWYH LKDAVLEGGI PFNKAYGMTA FEYHGTDPRF NKVFNRGMAD  182
gi|4808524             DKVLMESWYH LKDAVLDGGI PFNKAYGMTA FEYHGTDPRF NKVFNRGMAD  181

Consensus              DKVLMESWYH LKDAVL-GGI PFNKAYGMTA FEYHGTDPRF NKVFN-GMAN  200

Lead-CeresClone99784   SSTMVIEKVL KFYEGFKDVK TLVDVGGGLG NFLGLITSKY PHLIGINFDL  246
CeresClone:561287      LITIVMKRVL EFYEGFKNIN RLVDVGGGLG INLNLITSKY PHVQGVNFDL  229
gi|47232556            HTTLILKKIL DVYRGFEGIN VLVDVGGGIG VILNLITNKY PHIKGINFDL  240
CeresClone:751041      HSIIITKKLL EVYKGFEGLG TIVDVGGGVG ATVGAITAAY PAIKGINFDL  222
CeresClone:286311      HSVIITKKLL DFYTGFEGVS TLVDVGGGVG ATLHAITSRH PHISGVNFDL  233
gi|18025321            HSTIIMKKIL EIYQGFQGLK TVVDVGGGTG ATLNMIVSKY PSIKGINFDL  232
gi|6760443             HSTITMKKIL ETYKGFEGLK SIVDVGGGTG AVVNMIVSKY PSIKGINFDL  232
gi|602588              HSTITMKKIL ETYKGFEGLT SVVDVGGGTG AVLNMIVSKY PSIKGINFDL  232
gi|4808524             HSTITMKKLL ELYKGFEGLK SVVDVGGGTG ATINMIVTKH PTIKGINFDL  231

Consensus              HSTIVMKKIL E-YKGFEGL- TIVDVGGG-G ATLNMITSKY PSIKGINFDL  250

Lead-CeresClone99784   APVLANAHSY PGVNHVAGDM FIKIPKGDAI FMKWILHDWT DEQCVAILKN  296
CeresClone:561287      PHVIEHAPTY PGIEHVGGDM FESVPNGDAI FMKWILHDWS DEQCLKLLKN  279
gi|47232556            PHVLADAPSY PGVEHVGGDM FKSVPQGDAI FMKWILHDWS DEHCLTLLKN  290
CeresClone:751041      PHVISEAQPF PGVTHVGGDM FQKVPSGDAI LMKWILHDWS DEHCATLLKN  272
CeresClone:286311      PHVISEAPPF PGVRHVGGDM FASVPAGDAI LMKWILHDWS DAHCATLLKN  283
gi|18025321            PHVIEDAPSY PGVDHVGGDM FVSVPKGDAI FMKWICHDWS DAHCLKFLKN  282
gi|6760443             PHVIEDAPQY PGVQHVGGDM FVSVPKGNAI FMKWICHDWS DEHCIKFLKN  282
gi|602588              PHVIEDAPQY PGVEHVGGDM FVSVPKGDAI FMKWICHDWS DEHCLKFLKN  282
gi|4808524             PHVIDDAPAY PGVEHIGGDM FVSVPKGDAI FMKWILHDWS DEHSVKFLKN  281

Consensus              PHVIEDAPSY PGVEHVGGDM FVSVPKGDAI FMKWILHDWS DEHCLKLLKN  300
```

```
Lead-CeresClone99784   CWKSLEENGK LIIVEMVIPV EAKSGDICSN IXFGMDMIML TQCSGGKERS   346
CeresClone:561287      CHKAIPSDGK VIVVDLILPI LPES-TVTAK SGFQADLLMM TQNSGGKERT   328
gi|47232556            CCKSLPSSGK VIFVESILPE VPDS-TVTSN IVCEQDLLMF TQNPGGKERT   339
CeresClone:751041      CYDALPAHGK VVLVECILPV NPEA-TPKAQ GVFHVDMIML AHNPGGRERY   321
CeresClone:286311      CYDALPENGK VIVVECVLPV NTEA-TPKAQ GVFHVDMIML AHNPGGKERY   332
gi|18025321            CHEALPENGK VILAECLLPE APDS-TLSTQ NTVHVDVIML AHNPGGKERT   331
gi|6760443             CYAALPDDGK VILAECILPV APDT-SLATK GVVHMDVIML AHNPGGKERT   331
gi|602588              CYAALPDNGK VILGECILPV APDS-SLATK GVVHIDVIML AHNPGGKERT   331
gi|4808524             CYESIPADGK VIIVESILPV YPET-NLASN ACFQLDNIML AHNPGGKERT   330

Consensus              CY-ALPENGK VIIVECILPV -P-S-TL--- -VFHVD-IML AHNPGGKERT   350

Lead-CeresClone99784   LYEFENLAYA SGFSRCAIVC AVYPFSVIEL YK--   378
CeresClone:561287      QHEFMELALS SGFSGIKIVC SVSGFWVMEF YK--   360
gi|47232556            KKEYEALALK SGFSRLEVVC SAYNSWVMEF HK--   371
CeresClone:751041      EREFEALAKG AGFKAIKTTY IYANAFAIEF TK--   353
CeresClone:286311      EREFRELAKG AGFSGFKATC IYANAWAIEF IK--   364
gi|18025321            EKEFEALAKG AGFRGFIKVC CAYNSWIMEL LK--   363
gi|6760443             EQEFEALAKG SGFQGIRVCC DAFNTYVIEF LKKI   365
gi|602588              EQEFOALAKG AGFQGFNVAC SAFNTYVIEF LKKN   365
gi|4808524             EKDFEALSAK AGFTGFKIVC GAFGSWVMEF CK--   362

Consensus              EKEFEALAKG AGFSG-K-VC -A-NSWVMEF -K--   384
```

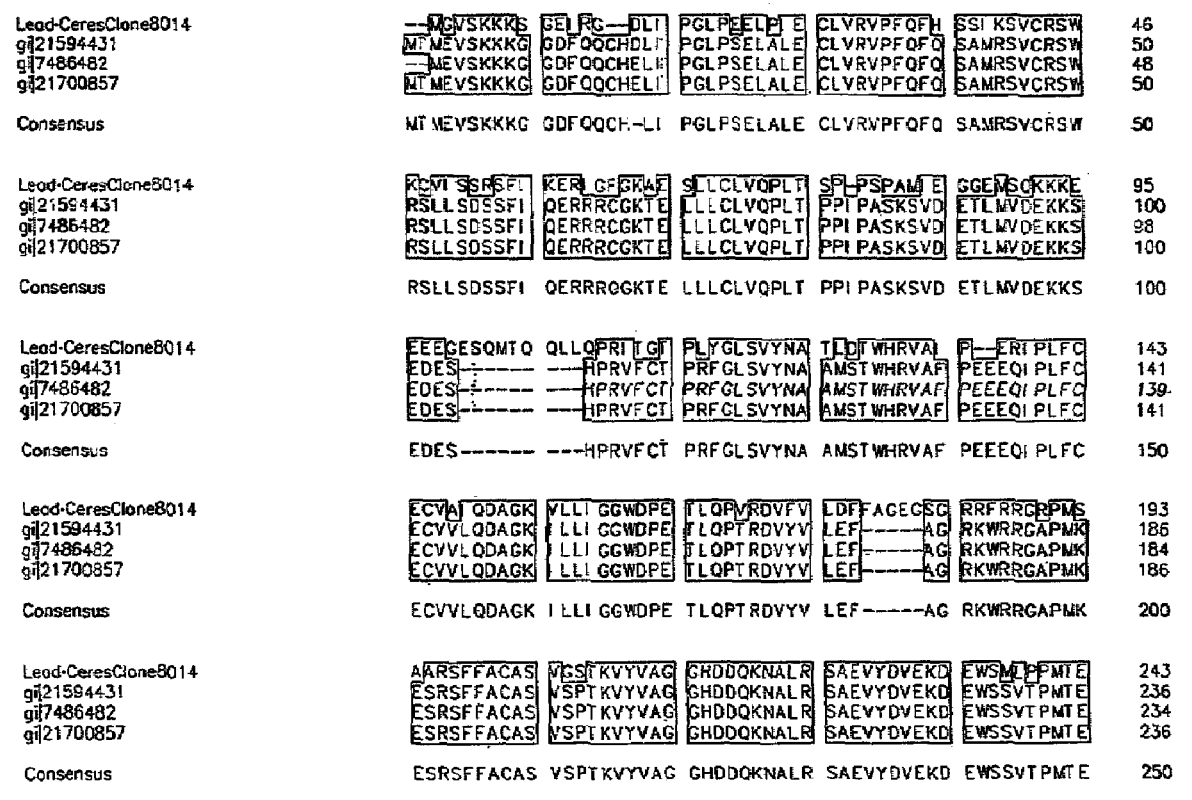

```
Lead-CeresClone8014   --MGVSKKKS GELRG--DLI PGLPEELPIE CLVRVPFQFH SSIKSVCRSW   46
gi|21594431           MTMEVSKKKG GDFQQCHDLI PGLPSELALE CLVRVPFQFQ SAMRSVCRSW   50
gi|7486482            --MEVSKKKG GDFQQCHELI PGLPSELALE CLVRVPFQFQ SAMRSVCRSW   48
gi|21700857           MTMEVSKKKG GDFQQCHELI PGLPSELALE CLVRVPFQFQ SAMRSVCRSW   50

Consensus             MTMEVSKKKG GDFQQCH-LI PGLPSELALE CLVRVPFQFQ SAMRSVCRSW   50

Lead-CeresClone8014   KCVISSRSFL KERLGFGKAE SLLCLVQPLT SP-PSPAMIE GGEMSCKKKE   95
gi|21594431           RSLLSDSSFI QERRRCGKTE LLLCLVQPLT PPIPASKSVD ETLMVDEKKS  100
gi|7486482            RSLLSDSSFI QERRRCGKTE LLLCLVQPLT PPIPASKSVD ETLMVDEKKS   98
gi|21700857           RSLLSDSSFI QERRRCGKTE LLLCLVQPLT PPIPASKSVD ETLMVDEKKS  100

Consensus             RSLLSDSSFI QERRRCGKTE LLLCLVQPLT PPIPASKSVD ETLMVDEKKS  100

Lead-CeresClone8014   EEEGESQMTQ QLLQPRITGT PLYGLSVYNA TLDTWHRVAI P--ERIPLFC  143
gi|21594431           EDES------ ---HPRVFCT PRFGLSVYNA AMSTWHRVAF PEEEQIPLFC  141
gi|7486482            EDES------ ---HPRVFCT PRFGLSVYNA AMSTWHRVAF PEEEQIPLFC  139
gi|21700857           EDES------ ---HPRVFCT PRFGLSVYNA AMSTWHRVAF PEEEQIPLFC  141

Consensus             EDES------ ---HPRVFCT PRFGLSVYNA AMSTWHRVAF PEEEQIPLFC  150

Lead-CeresClone8014   ECVAIQDAGK VLLIGGWDPE TLQPVRDVFV LDFFAGEGSG RRFRRGRPMS  193
gi|21594431           ECVVLQDAGK ILLIGGWDPE TLQPTRDVYV LEF-----AG RKWRRGAPMK  186
gi|7486482            ECVVLQDAGK ILLIGGWDPE TLQPTRDVYV LEF-----AG RKWRRGAPMK  184
gi|21700857           ECVVLQDAGK ILLIGGWDPE TLQPTRDVYV LEF-----AG RKWRRGAPMK  186

Consensus             ECVVLQDAGK ILLIGGWDPE TLQPTRDVYV LEF-----AG RKWRRGAPMK  200

Lead-CeresClone8014   AARSFFACAS VGSTKVYVAG GHDDQKNALR SAEVYDVEKD EWSMLPPMTE  243
gi|21594431           ESRSFFACAS VSPTKVYVAG GHDDQKNALR SAEVYDVEKD EWSSVTPMTE  236
gi|7486482            ESRSFFACAS VSPTKVYVAG GHDDQKNALR SAEVYDVEKD EWSSVTPMTE  234
gi|21700857           ESRSFFACAS VSPTKVYVAG GHDDQKNALR SAEVYDVEKD EWSSVTPMTE  236

Consensus             ESRSFFACAS VSPTKVYVAG GHDDQKNALR SAEVYDVEKD EWSSVTPMTE  250
```

| | | | | | | |
|---|---|---|---|---|---|---|
| Lead-CeresClone8014 | GRDECHGFSM | ATDPGFCVLS | GYGTETQGQF | RSDGEIYDP | TNSWSTIENV | 293 |
| gi\|21594431 | GRDECQGFAV | CTGLRFCVLS | GYGTESQGRF | RSDGEIYDPA | TNSWSRIDNV | 286 |
| gi\|7486482 | GRDECQGFAV | GMGLRFCVLS | GYGTESQGRF | RSDGEIYDPA | TDSWSRIDNV | 284 |
| gi\|21700857 | GRDECQGFAV | GMGLRFCVLS | GYGTESQGRF | RSDGEIYDPA | TDSWSRIDNV | 286 |
| Consensus | GRDECQGFAV | G-GLRFCVLS | GYGTESQGRF | RSDGEIYDPA | T-SWSRIDNV | 300 |
| Lead-CeresClone8014 | WPFPDLSPRG | RTAAAAAEFP | GDFRGCR-LW | CFLDSERQSQ | PHWEVEDDSM | 342 |
| gi\|21594431 | WRFPDTSPRG | RTA------- | GDFRSSSTLW | CFTDTDLQSE | RRWETNDDSR | 329 |
| gi\|7486482 | WRFPDTSPRG | RTA------- | GDFRSSSTLW | CFTDTDLQSE | RRWETNDDSR | 327 |
| gi\|21700857 | WRFPDTSPRG | RTA------- | GDFRSSSTLW | CFTDTDLQSE | RRWETNDDSR | 329 |
| Consensus | WRFPDTSPRG | RTA------- | GDFRSSSTLW | CFTDTDLQSE | RRWETNDDSR | 350 |
| Lead-CeresClone8014 | KWKVLMDTIR | LPVTTM-TSVF | AGSLSGQAVA | MIGG----GG | EESGTMMVKI | 388 |
| gi\|21594431 | NLKLDLQSIQ | LPMTG-SSVF | AGSLGGESVV | MIGGKRESEG | EGEGGVMNKM | 378 |
| gi\|7486482 | NLKLDLQSIQ | LPMTG-SSVF | AGSLGGESVV | MIGGKRESEG | EGEGGVMNKM | 376 |
| gi\|21700857 | NLKLDLQSIQ | LPMTG-SSVF | AGSLGGESVV | MIGGKRESEG | EGEGGVMNKM | 378 |
| Consensus | NLKLDLQSIQ | LPMTG-SSVF | AGSLGGESVV | MIGGKRESEG | EGEGGVMNKM | 400 |
| Lead-CeresClone8014 | TAEKNGGKWS | H-VNIPSGFS | SLPFSCSSIY | V | 418 | |
| gi\|21594431 | TTEKKMGKWS | HHVHIPCDFS | TLPFSHASIY | V | 409 | |
| gi\|7486482 | TTEKKMGKWS | HHVHIPCDFS | TLPFSHASIY | V | 407 | |
| gi\|21700857 | TTEKKMGKWS | HHVHIPCDFS | TLPFSHASIY | V | 409 | |
| Consensus | TTEKKMGKWS | HHVHIPCDFS | TLPFSHASIY | V | 431 | |

| | | | | | | |
|---|---|---|---|---|---|---|
| CeresClone:996136 | MADGEDI QPL | VCDNGTGMVK | AGFAGDDAPR | AVFPSI VGRP | RHT GVMVGMG | 50 |
| Lead-CeresClone292789 | MADGEDI QPL | VCDNGTGMVK | AGFAGDDAPR | AVFPSI VGRP | RHT GVMVGMG | 50 |
| gi\|62732981 | MADGEDI QPL | VCDNGTGMVK | AGFAGDDAPR | AVFPSI VGRP | RHT GVMVGMG | 50 |
| gi\|9965319 | MADGEDI QPL | VCDNGTGMVK | AGFAGDDAPR | AVFPSI VGRP | RHT GVMVGMG | 50 |
| gi\|24496452 | MADGEDI QPL | VCDNGTGMVK | AGFAGDDAPR | AVFPSI VGRP | RHT GVMVGMG | 50 |
| gi\|53759189 | MADGEDI QPL | VCDNGTGMVK | AGFAGDDAPR | AVFPSI VGRP | RHT GVMVGMG | 50 |
| gi\|32186890 | MADGEDI QPL | VCDNGTGMVK | AGFAGDDAPR | AVFPSI VGRP | RHT GVMVGMG | 50 |
| gi\|15076949 | MADGEDI QPL | VCDNGTGMVK | AGFAGDDAPR | AVFPSI VGRP | RHT GVMVGMG | 50 |
| *Consensus* | MADGEDI QPL | VCDNGTGMVK | AGFAGDDAPR | AVFPSI VGRP | RHT GVMVGMG | 50 |

| | | | | | | |
|---|---|---|---|---|---|---|
| CeresClone:996136 | QKDAYVGDEA | QSKRGI LTLK | YPI EHGI VNN | WDDMEKI WHH | TFYNELRVAP | 100 |
| Lead-CeresClone292789 | QKDAYVGDEA | QSKRGI LTLK | YPI EHGI VSN | WDDMEKI WHH | TFYNELRVAP | 100 |
| gi\|62732981 | QKDAYVGDEA | QSKRGI LTLK | YPI EHGI VSN | WDDMEKI WHH | TFYNELRVAP | 100 |
| gi\|9965319 | QKDAYVGDEA | QSKRGI LTLK | YPI EHGI VSN | WDDMEKI WHH | TFYNELRVAP | 100 |
| gi\|24496452 | QKDAYVGDEA | QSKRGI LTLK | YPI EHGI VSN | WDDMEKI WHH | TFYNELRVAP | 100 |
| gi\|53759189 | QKDAYVGDEA | QSKRGI LTLK | YPI EHGI VSN | WDDMEKI WHH | TFYNELRVAP | 100 |
| gi\|32186890 | QKDAYVGDEA | QSKRGI LTLK | YPI EHGI VSN | WDDMEKI WHH | TFYNELRVAP | 100 |
| gi\|15076949 | QKDAYVGDEA | QSKRGI LTLK | YPI EHGI VSN | WDDMEKI WHH | TFYNELRVAP | 100 |
| Consensus | QKDAYVGDEA | QSKRGI LTLK | YPI EHGI VSN | WDDMEKI WHH | TFYNELRVAP | 100 |

| | | | | | | |
|---|---|---|---|---|---|---|
| CeresClone:996136 | EEHPVLLTEA | PLNPKANREK | MTQI MFETFN | VPAMYVAI QA | VLSLYASGRT | 150 |
| Lead-CeresClone292789 | EEHPVLLTEA | PLNPKANREK | MTQI MFETFN | VPAMYVAI QA | VLSLYASGRT | 150 |
| gi\|62732981 | EEHPVLLTEA | PLNPKANREK | MTQI MFETFN | VPAMYVAI QA | VLSLYASGRT | 150 |
| gi\|9965319 | EEHPVLLTEA | PLNPKANREK | MTQI MFETFN | VPAMYVAI QA | VLSLYASGRT | 150 |
| gi\|24496452 | EEHPVLLTEA | PLNPKANREK | MTQI MFETFN | VPAMYVAI QA | VLSLYASGRT | 150 |
| gi\|53759189 | EEHPVLLTEA | PLNPKANREK | MTQI MFETFN | VPAMYVAI QA | VLSLYASGRT | 150 |
| gi\|32186890 | EEHPVLLTEA | PLNPKANREK | MTQI MFETFN | VPAMYVAI QA | VLSLYASGRT | 150 |
| gi\|15076949 | EEHPVLLTEA | PLNPKANREK | MTQI MFETFN | VPAMYVAI QA | VLSLYASGRT | 150 |
| Consensus | EEHPVLLTEA | PLNPKANREK | MTQI MFETFN | VPAMYVAI QA | VLSLYASGRT | 150 |

```
CeresClone:996136         TGIVLDSGDG VSHTVPIYEG YALPHAILRL DLAGRDLTDS LMKILTERGY  200
Lead-CeresClone292789     TGIVLDSGDG VSHTVPIYEG YALPHAILRL DLAGRDLTDS LMKILTERGY  200
gi|62732981               TGIVLDSGDG VSHTVPIYEG YALPHAILRL DLAGRDLTDS LMKILTERGY  200
gi|9965319                TGIVLDSGDG VSHTVPIYEG YALPHAILRL DLAGRDLTDS LMKILTERGY  200
gi|24496452               TGIVLDSGDG VSHTVPIYEG YALPHAILRL DLAGRDLTDS LMKILTERGY  200
gi|53759189               TGIVLDSGDG VSHTVPIYEG YALPHAILRL DLAGRDLTDS LMKILTERGY  200
gi|32186890               TGIVLDSGDG VSHTVPIYEG YALPHAILRL DLAGRDLTDA LMKILTERGY  200
gi|15076949               TGIVLDSGDG VSHTVPIYEG YALPHAILRL DLAGRDLTDA LMKILTERGY  200

Consensus                 TGIVLDSGDG VSHTVPIYEG YALPHAILRL DLAGRDLTDS LMKILTERGY  200

CeresClone:996136         SFTTSAEREI VRDIKEKLAY VALEYDQELE NAKSSSSVEK SYELPDGQVI  250
Lead-CeresClone292789     SFTTTAEREI VRDIKEKLAY VALDYDQELE NAKSSSSVEK SYELPDGQVI  250
gi|62732981               SFTTTAEREI VRDIKEKLAY VALDYEQELE AAKSSSSVEK SYELPDGQVI  250
gi|9965319                SFTTTAEREI VRDIKEKLAY VALDYEQELE TAKTSSSVEK SYELPDGQVI  250
gi|24496452               SFTTTAEREI VRDIKEKLAY VALDYEQELE TAKNSSSVEK SYELPDGQVI  250
gi|53759189               SFTTSAEREI VRDIKEKLAY IALDYEQELE TAKNSSSVEK SYELPDGQVI  250
gi|32186890               MFTTTAEREI VRDMKEKLAY VALDYEQELE TAKSSSSVEK NYELPDGQVI  250
gi|15076949               SFTTTAEREI VRDIKEKLAY VALDYEQELE NAKSSSSVEK SYELPDGQVI  250

Consensus                 SFTTTAEREI VRDIKEKLAY VALDYEQELE TAKSSSSVEK SYELPDGQVI  250

CeresClone:996136         TIGAERFRCP EVLFQPSFIG MEAPGIHETT YNSIMKCDVD IRKDLYGNIV  300
Lead-CeresClone292789     TIGAERFRCP EVLFQPSFIG MEAPGIHETT YNSIMKCDVD IRKDLYGNIV  300
gi|62732981               TIGAERFRCP EVLFQPSFIG MEAPGIHETT YNSIMKCDVD IRKDLYGNIV  300
gi|9965319                TIGAERFRCP EVLFQPSFIG MESPGIHETT YNSIMKCDVD IRKDLYGNIV  300
gi|24496452               TIGAERFRCP EVLFQPSMIG MESSGIHETT YNSIMKCDVD IRKDLYGNIV  300
gi|53759189               TIGAERFRCP EVLFQPSMIG MEAAGIHETT YNSIMKCDVD IRKDLYGNIV  300
gi|32186890               TIGAERFRCP EVLFQPSFIG MEAAGIHETT YNSIMKCDVD IRKDLYGNIV  300
gi|15076949               TIGAERFRCP EVLFQPSLIG MEAAGIHETT YNSIMKCDVD IRKDLYGNIV  300

Consensus                 TIGAERFRCP EVLFQPSFIG MEA-GIHETT YNSIMKCDVD IRKDLYGNIV  300
```

| | | | | | | | |
|---|---|---|---|---|---|---|---|
| CeresClone:996136 | LSGGTTMFPG | IADRMSKEIT | ALAPSSMKIK | VVAPPERKYS | VWIGGSILAS | | 350 |
| Lead-CeresClone292789 | LSGGTTMFPG | IADRMSKEIT | ALAPSSMKIK | VVAPPERKYS | VWIGGSILAS | | 350 |
| gi|62732981 | LSGGSTMFPG | IADRMSKEIT | ALAPSSMKIK | VVAPPERKYS | VWIGGSILAS | | 350 |
| gi|9965319 | LSGGSTMFPG | IADRMSKEIT | ALAPSSMKIK | VVAPPERKYS | VWIGGSILAS | | 350 |
| gi|24496452 | LSGGTTMFPG | IADRMSKEIT | ALAPSSMKIK | VVAPPERKYS | VWIGGSILAS | | 350 |
| gi|53759189 | LSGGSTMFPG | IADRMSKEIT | SLAPSSMKIK | VVAPPERKYS | VWIGGSILAS | | 350 |
| gi|32186890 | LSGGSTMFPG | IADRMSKEIT | ALAPSSMKIK | VVAPPERKYS | VWIGGSILAS | | 350 |
| gi|15076949 | LSGGTTMFPG | IADRMSKEIT | ALAPSSMKIK | VVAPPERKYS | VWIGGSILAS | | 350 |
| Consensus | LSGG-TMFPG | IADRMSKEIT | ALAPSSMKIK | VVAPPERKYS | VWIGGSILAS | | 350 |

| | | | | |
|---|---|---|---|---|
| CeresClone:996136 | LSTFQQMWIS | KAEYDESGPG | IVHRKCF | 377 |
| Lead-CeresClone292789 | LSTFQQMWIS | KAEYDESGPA | IVHRKCF | 377 |
| gi|62732981 | LSTFQQMWIS | KGEYDESGPA | IVHRKCF | 377 |
| gi|9965319 | LSTFQQMWIS | KGEYDESGPA | IVHRKCF | 377 |
| gi|24496452 | LSTFQQMWIS | KDEYDESGPA | IVHRKCF | 377 |
| gi|53759189 | LSTFQQMWIS | KEEYDESGPA | IVHRKCF | 377 |
| gi|32186890 | LSTFQQMWIS | KGEYDESGPS | IVHRKCF | 377 |
| gi|15076949 | LSTFQQMWIS | KGEYEESGPS | IVHRKCF | 377 |
| Consensus | LSTFQQMWIS | KGEYDESGPA | IVHRKCF | 377 |

```
CeresClone:40501            --MSQSRAVQ RSS------- ---------S PNEDRGENQL VVYDLKCND-  31
gi|21593605                 MSMSQSRAVQ RSS------- ---------S PNEDRGENQL VVYDLKGND-  33
Lead-CeresClone283597       METSKSPQSS KNSHIVVPSD SNGPRFDNDG FSSEAASNQM VVFNSEAGDK  50
gi|13936312                 MESSKSPQSS KNSRIVVPSD SNRSRFDNDG FSSETASNQM VVFNSEAAD-  49
CeresClone:225383           ---------- ---------- ---------- ---------M VVFNSEAAD-  10
CeresClone:407007           ---------- ---------- ---------- ---------M VVFNSEAAD-  10

Consensus                   M--S-S---- --S------- ---------- -------NQM VVFNSEAAD-  50

CeresClone:40501            ---DIEEEVL PVQSDPLSSR TQCPSIGAFT VQCASCFKWR LMPSMQKYEE  78
gi|21593605                 ---DIEEEVL PVQSDPLSSR TQCPSIGAFT VQCASCFKWR LMPSMQKYEE  80
Lead-CeresClone283597       EQDELGENRL ---QKSIITR GISPSIGAFT VQCAKCFKWR LIPTKEKYEE  97
gi|13936312                 ---ELGENRL ---QKSVITK GISPSIGAFT VQCAKCFKWR LIPTKEKYEE  93
CeresClone:225383           ---ELGENRL ---QKSVITK GISPSIGAFT VQCAKCFKWR LIPTKEKYEE  54
CeresClone:407007           ---ELGENRL ---QKSVITK GISPSIGAFT VQCAKCFKWR LIPTKEKYEE  54

Consensus                   ---ELGENRL ---QKSIIT- GISPSIGAFT VQCAKCFKWR LIPTKEKYEE  100

CeresClone:40501            IREQLLENPF FCDTAREWKP DISCDVPADI YQDGTRLWAI DKPNISRPPA  128
gi|21593605                 IREQLLENPF FCDTAREWKP DISCDVPADI YQDGTRLWAI DKPNISRPPA  130
Lead-CeresClone283597       IRERIIEEPF VCKRAREWRP DVTCNDPEDI SQDGSRLWAI DKPNIAQPPR  147
gi|13936312                 IRERIIQEPF VCKRAREWRP DITCNDPEDI SQDGSRLWAI DKPNIAQPPH  143
CeresClone:225383           IRERIIQEPF VCKRAREWRP DITCNDPEDI SQDGSRLWAI DKPNIAQPPH  104
CeresClone:407007           IRERIIQEPF VCKRAREWRP DITCNDPEDI SQDGSRLWAI DKPNIAQPPH  104

Consensus                   IRERII-EPF VCKRAREWRP DITCNDPEDI SQDGSRLWAI DKPNIAQPPH  150

CeresClone:40501            GWQRLLRIRG EGGTRFADVY YVAPSGKKLR STVEVQKYLN DNSEYIGECV  178
gi|21593605                 GWQRLLRIRG EGGTRFADVY YVAPSGKKLR STVEVQKYLN DNSEYIGECV  180
Lead-CeresClone283597       GWERQIRIRG EGGTKFADVY YTSPTGRKLR SLVEVDRFLQ ENPEYGAQGV  197
gi|13936312                 GWERQIRIRG EGGTKFADVY YTSPTGRKLR SLVEVDRFLQ ENPEHVAQGV  193
CeresClone:225383           GWERQIRIRG EGGTKFADVY YTSPTGRKLR SLVEVDRFLQ ENPEHVAQGV  154
CeresClone:407007           GWERQIRIRG EGGTKFADVY YTSPTGRKLR SLVEVDRFLQ ENPEHVAQGV  154

Consensus                   GWERQIRIRG EGGTKFADVY YTSPTGRKLR SLVEVDRFLQ ENPE-VAQGV  200
```

```
CeresClone:40501          KLSQFSFQI P  KPLQQDYVRK  RPARLLDSI D  NTNTPVAK--  ---EANPLAW   223
gi|21593605               KLSQFSFQI P  KPLQQDYVRK  RPARLLDSL D  NTNTPVAK--  ---EANPLAW   225
Lead-CeresClone283597     TLAQFSFQI P  RPLRQDYVKK  KP-KLI NPSD  EASMIASKSF  QPEEVKPI AW   246
gi|13936312               TLAQFSFQI P  RPLRQDYVKK  KP-KLI NASD  EASTI TSKSS  EPEEVNPI AW   242
CeresClone:225383         TLAQFSFQI P  RPLRQDYVKK  KP-KLI NASD  EASTI TSKSY  EPEEVNPI AW   203
CeresClone:407007         TLAQFSFQI P  RPLRQDYVKK  KP-KLI NASD  EASTI TSKSS  EPEEVNPI AW   203

Consensus                 TLAQFSFQI P  RPLRQDYVKK  KP-KLI NASD  EASTI TSKS-  EPEEVNPI AW   250

CeresClone:40501          I SPDDHI --S  LQLGTPTESG  LNNSHYQPSK  KKKTSTLSI F  GS--NDELAD   269
gi|21593605               I SPDDHI --S  LQLGTPTESG  LNNSHYQPSK  KKKTSTLSI F  GS--NDELAD   271
Lead-CeresClone283597     AVAITKHEGDA  SEEASLTDEA  PTSEVMLARK  RKAGSSLSI E  PNHLSDELEP   296
gi|13936312               AVPTKHEGDA  SEEASFADET  LASEVVLTRK  RKI GSSLSVE  PNHLSDELEP   292
CeresClone:225383         AVPTKHEGDA  SEEASFADET  LASEVVLTRK  RKI GSSLSVE  PNHLSDELEP   253
CeresClone:407007         AVPTKHEGDA  SEEASFADET  LASEVVLTRK  RKI GSSLSVE  PNHLSDELEP   253

Consensus                 AVPTKHEGDA  SEEASF-DET  LASEVVLTRK  RKI GSSLS-E  PNHLSDELEP   300

CeresClone:40501          R----   270
gi|21593605               R----   272
Lead-CeresClone283597     KLEDA   301
gi|13936312               KLEDA   297
CeresClone:225383         KLEDA   258
CeresClone:407007         KLEDA   258

Consensus                 KLEDA   305
```

```
Lead-CeresClone101250   ----MAERGV ERGGDRGDFG RGFG-GRGGG RGGPRGRGRR AGRAPEEEKW   45
CeresClone:295792       MAERGGERGG ERGGERGGFG RGFGRGGRGD RGGRRG-GRR GGRQQEEEKW   49
CeresClone:285704       MAERGGERGG ERGGERGGFG RGFGRGGRGD RGGRRG-GRR GGRQQEEEKW   49
CeresClone:557178       MADRGGERGG DRGGERGGFG RGFGRGGRGD RGGRRG-GRR GPR-QEEEKW   48
CeresClone:754768       MADRGGERGG DRGGERGGFG RGFGRGGRGD RGGRRG-GRR GPR-QEEEKW   48

Consensus               MA-RGGERGG ERGGERGGFG RGFGRGGRGD RGGRRG-GRR GGR-QEEEKW   50

Lead-CeresClone101250   VPVTKLGRLV KEGKITKIEQ IYLHSLPVKE YQIIDLLVGP SLKDEVMKIM   95
CeresClone:295792       VPVTKLGRLV KENRINKIEE IYLHSLPVKE HQIVETLV-P GLKDEVMKIT   98
CeresClone:285704       VPVTKLGRLV KENRINKIEE IYLHSLPVKE HQIVETLV-P GLKDEVMKIT   98
CeresClone:557178       VPVTKLGRLV KEGRFTKMEE LYLHSLPIKE HQIVEQLC-P GLKDEVMKIT   97
CeresClone:754768       VPVTKLGRLV KEGRFTKMEE LYLHSLPIKE HQIVEQLC-P GLKDEVMKIT   97

Consensus               VPVTKLGRLV KEGRITKIEE IYLHSLPVKE HQIVE-LV-P GLKDEVMKIT   100

Lead-CeresClone101250   PVQKQTRAGQ RTRFKAFIVV GDSNGHVGLG VKCSKEVATA IRGAIILAKL   145
CeresClone:295792       PVQKQTRAGQ RTRFKAFVVV GDGDGHVGLG VKCAKEVATA IRGAIILAKL   148
CeresClone:285704       PVQKQTRAGQ RTRFKAFVVV GDGDGHVGLG VKCAKEVATA IRGAIILAKL   148
CeresClone:557178       PVQKQTRAGQ RTRFKAFVVV GDSNGHVGLG VKCAKEVATA IRGAIILAKL   147
CeresClone:754768       PVQKQTRAGQ RTRFKAFVVV GDSNGHVGLG VKCAKEVATA IRGAIILAKL   147

Consensus               PVQKQTRAGQ RTRFKAFVVV GDSNGHVGLG VKCAKEVATA IRGAIILAKL   150

Lead-CeresClone101250   SVVPIRRGYW GNKIGKPHTV PCKVTGKCGS VTVRMVPAPR GSGIVAARVP   195
CeresClone:295792       SVVPVRRGYW GNKIGQPHTV PCKVTGKCGS VTVRMVPAPR GSGIVAARVP   198
CeresClone:285704       SVVPVRRGYW GNKIGQPHTV PCKVTGKCGS VTVRMVPAPR GSGIVAARVP   198
CeresClone:557178       SIVPVRRGYW GNKIGLPHTV PCKVTGKCGS VTVRMVPAPR GSGIVAARVP   197
CeresClone:754768       SIVPVRRGYW GNKIGLPHTV PCKVTGKCGS VTVRMVPAPR GSGIVAARVP   197

Consensus               SVVPVRRGYW GNKIGQPHTV PCKVTGKCGS VTVRMVPAPR GSGIVAARVP   200
```

```
Lead-CeresClone101250   KKVLQFAGID DVFTSSRGST KTLGNFVKAT FDCLQKTYGF LTPEFWKETR 245
CeresClone:295792       KKVLQFAGIE DVFTSSRGST KTLGNFVKAT FDCLMKTYGF LTPEFWAETK 248
CeresClone:285704       KKVLQFAGIE DVFTSSRGST KTLGNFVKAT FDCLMKTYGF LTPEFWAETK 248
CeresClone:557178       KKVLQFAGID DVFTSSRGST KTLGNFVKAT FDCLMKTYGF LTPDFWRETT 247
CeresClone:754768       KKVLQFAGID DVFTSSRGST KTLGNFVKAT FDCLMKTYGF LTPDFWRETT 247

Consensus               KKVLQFAGID DVFTSSRGST KTLGNFVKAT FDCLMKTYGF LTPEFWRETK 250

Lead-CeresClone101250   FSKSPYQEHT DFLLIPPGVK ISEVVVDKSV E 276
CeresClone:295792       YAKTPFQEFT DLLAKPTKGL LIEAPTETVE A 279
CeresClone:285704       YAKTPFQEFT DLLAKPTKGL LIEAPTETVE A 279
CeresClone:557178       FTKAPYQEFT DILVKPTKAL MLDAPAEKIE A 278
CeresClone:754768       FTKAPYQEFT DILAKPTKAL MLDAPAEKIE A 278

Consensus               F-K-PYQEFT D-LAKPTK-L --EAP-EK-E A 281
```

```
gi|1052956               MKGGKSKAKS ---DNKLAVK KRGC------ ETKKSKKSVK DPNKPKRPPS  41
CeresClone:1060767       MKGGKSKTET RSSKLSVAKK PAKA------ -AGRSKAAAK DPNKPKRPAS  43
gi|729737                MKGGKSKGES KKAETKLAVN KKGAAATKGG KKPAKGKEPK DPNKPKRPPS  50
gi|436424                MKGGKSKGES KKAETKLAVN KKGAPATKGG KKPAKGKEPK DPNKPKRPPS  50
CeresClone:721511        MKGGKSKTES KRADAKLAVN KKGA-ATKTR KPAGKGKAAK DPNKPKRPPS  49
CeresClone:641329        M--------- ---------- ---------- ---------- ----------   1
gi|18645                 MKGGKSKTES KRADPKLAVN KKGA-ATKAR KPAGKGKAAK DPNKPKRPPS  49
CeresClone:782784        M--------- ---------- ---------- ---------- ----------   1
Lead-CeresClone16204     MKDNQTEVES RSTDDRLKVR GNKV------ -----GKKTK DPNRPKKPPS  39
CeresClone:956177        MKGGESKAQA KSTDERLKTR GKKA------ -----GKKVK DPNKPKRPPS  39

Consensus                MKGGKSK-ES K--D-KLAV- KKGA------ K----GK--K DPNKPKRPPS  50

gi|1052956               AFFVFMEDFR KTYKEKHPNN KSVAAVGKAG GDKWKQLTDA EKAPFIAKAE  91
CeresClone:1060767       AFFVFMEDFR QTYKKDHPNN KSVAAVGKAG GEKWKSLSDS EKAPFVAKAD  93
gi|729737                AFFVFMADFR EQYKKDHPNN KSVAAVGKAC GEEWKSLSEE EKAPYVDRAL 100
gi|436424                AFFVFMEDFR KQFKKGNADN KAVSAVGKAA GAKWKSMTEA EKAPYAAKAE 100
CeresClone:721511        AFFVFMEEFR KVFNKEHPDN KAVSAVGKAA GAKWKTMSDA EKAPYVAKSE  99
CeresClone:641329        ------EEFR KVFNKEHPDN KAVSAVGKAA GAKWKTMSDA EKAPYVAKSE  45
gi|18645                 AFFVFMEEFR KVFNKEHPEN KAVSAVGKAA GAKWKTMSDA EKAPYVAKSE  99
CeresClone:782784        ------EEFR KVFNKEHPEN KAVSAVGKAA GAKWKTMSDA EKAPYVAKSE  45
Lead-CeresClone16204     PFFVFLDDFR KEFNLANPDN KSVGNVGRAA GKKWKTMTEE ERAPFVAKSQ  89
CeresClone:956177        AFFVFLEGFR KEFNLANPDN KSVGAVGKAA GAKWKSMTAE DKAPYVAKAE  89

Consensus                AFFVFMEDFR K-FNKEHPDN K-VSAVGKAA GAKWKTMSDA EKAPYVAK-E 100

gi|1052956               KRKQEYEKSM QAYNRKQAGE A---ADEEES DKSRSEVNOD EEDEDGSAED 138
CeresClone:1060767       KRKVEYEKTM KAYNKKLEEG PK--EDEEES DKSVSEVNDE DDADDGSDEE 141
gi|729737                KKKEEYETTL QAYNKKLEGK ----DDEEGS DKSKSEVNDE DEDEE-DEED 145
gi|436424                KRKAEYEKSM KSYNKKQAEG PAAVEEEEES EKSESEVHDE NDDEEESEEE 150
CeresClone:721511        KRKVEYEKNM RAYNKKQAEG PTG-GDEEES EKSVSEVNDE DDDEEGSGEE 148
CeresClone:641329        KRKVEYEKNM RAYNKKQAEG PTG-GDEEES EKSVSEVNDE DDDEEGSGEE  94
gi|18645                 KRKVEYEKNM RAYNKKQAEG PTG-GDEEES EKSVSEVNDE DDDEEGSGEE 148
CeresClone:782784        KRKVEYEKNM RAYNKKQAEG PTG-GDEEES EKSVSEVNDE DDDEEGSGEE  94
Lead-CeresClone16204     SKKTEYAVTM QQYNMELANG NKTTGDDEKD EKAA------ ---------- 123
CeresClone:956177        TKKTEYAKTM QKYNMKLANG TST-AGDDDS DKSKSEVNDE EDAA--SDEE 136

Consensus                KRKVEYEK-M -AYNKKQAEG P---GDEEES EKSVSEVNDE DDDEEGS-EE 150
```

| | | |
|---|---|---|
| gi\|1052956 | DDDDDDDE | 146 |
| CeresClone:1060767 | EDDD---- | 145 |
| gi\|729737 | EDDD---- | 149 |
| gi\|436424 | DDDE---- | 154 |
| CeresClone:721511 | EDDD---- | 152 |
| CeresClone:641329 | EDDD---- | 98 |
| gi\|18645 | EDDD---- | 152 |
| CeresClone:782784 | EDDD---- | 98 |
| Lead-CeresClone16204 | --DD---- | 125 |
| CeresClone:956177 | EDDD---- | 140 |
| Consensus | EDDD---- | 158 |

| | | | | | | |
|---|---|---|---|---|---|---|
| gi\|7677036 | ---------- | -ENTMNRQVT | FFKRRNGLLK | KAHEISVLCD | ADVALIVFST | 39 |
| gi\|62510920 | MGRGPVQLRR | FENKINRQVT | FSKRRNGLLK | KAHEISVLCD | ADVALIVFST | 50 |
| gi\|6175371 | MGRGPVQLRR | IENKINRQVT | FSKRRNGLLK | KAHEISVLCD | ADVALIVFST | 50 |
| gi\|9367307 | MGRGPVQLRR | IENKINRQVT | FSKRRSGLLK | KAHEISVLCD | AEVALIVFST | 50 |
| Lead-CeresClone246416 | MGRGPVQLRR | IENKINRQVT | FSKRRNGLLK | KAHEISVLCD | AEVALIVFST | 50 |
| gi\|1483232 | MGRGRVQLKR | IENKINRQVT | FSKRRSGLLK | KAHEISVLCD | AEVALIVFST | 50 |
| gi\|33355661 | MGRGRVQLKR | IENTINRQVT | FSKRRAGLLK | KANEISVLCD | AEVALIIFST | 50 |
| gi\|33391153 | MGRGRVELKR | IENTINRQVT | FSKRRGGLLK | KANEISVLCD | ADVAIIIFST | 50 |
| gi\|6467974 | MGRGRVQLKR | IENKINRQVT | FSKRRSGLLK | KAHEISVLCD | AEVALIVFSN | 50 |
| gi\|32478105 | -----VQLKR | MENKINRQVT | FSKRRGGLLK | KAHEISILCD | AEIALIIFST | 45 |
| gi\|33309864 | MGRGRVQLRR | IENKINRQVT | FSKRRSGLLK | KAHEISVLCD | AEVALIIFST | 50 |
| gi\|39843110 | MGRGKVQLKR | IENKINRQVT | FSKRRSGLLK | KAHEISVLCD | AEVGLIIFST | 50 |
| gi\|30090030 | MGRGKVQLKR | IENKINRQVT | FSKRRSGLLK | KAHEISVLCD | AEVGLIIFST | 50 |
| CeresClone:1314092 | MGRGKVQLKR | IENKINRQVT | FSKRRSGLLK | KAHEISVLCD | AEVGLIIFST | 50 |
| Consensus | MGRGRVQLKR | IENKINRQVT | FSKRRSGLLK | KAHEISVLCD | AEVALI-FST | 50 |

| | | | | | | |
|---|---|---|---|---|---|---|
| gi\|7677036 | KGKLYEFSS- | HSSMEGILER | YQRYSFDERA | VLEPNTEDQE | NWGDEYGILK | 88 |
| gi\|62510920 | KGKLYEFSS- | HSSMEGILER | YQRYSFDERA | VLEPNTEDQE | NWGDEYGILK | 99 |
| gi\|6175371 | KGKLYEFSS- | HSSMEGILER | YQRYSFDERA | VLEPNTEDQE | NWGDEYGILK | 99 |
| gi\|9367307 | KGKLYEYSSQ | DSSMDVILER | YQRYSFEERA | VLDPSIGDQA | NWGDEYGSLK | 100 |
| Lead-CeresClone246416 | KGKLYEYSS- | HSSMEGILER | YQRYSFEERA | VLNPSIEDQA | NWGDEYVRLK | 99 |
| gi\|1483232 | KGKLFEYST- | DSCMERILER | YERYSYADRQ | LLANDLEQNG | SWTLEHAKLK | 99 |
| gi\|33355661 | KGKLSEYST- | DARMESILER | YDRYSSAERA | IVAPDPDSQE | SWRDEYGRLK | 99 |
| gi\|33391153 | KGKLSEYST- | DARMESILER | YDRYSCAERD | IVAPDPDSQE | SWRDEYGRLK | 99 |
| gi\|6467974 | KGKLYEYST- | DSSMEKILER | YERYSYAERA | LFSNEANPQA | DWRLEYNKLK | 99 |
| gi\|32478105 | KGKLYEYAT- | NSKMDNILER | YERYSYAEKA | LTSSDPDIQG | NWCQEYAKLK | 94 |
| gi\|33309864 | KGKLYEYAT- | DSCMERILER | YERYTYAEKA | LISSGPELQG | NWCHEFGKLK | 99 |
| gi\|39843110 | KGKLYEYAT- | DSCMDKILER | YERYSYAEKV | LISAESETQG | NWCHEYRKLK | 99 |
| gi\|30090030 | KGKLYEFST- | ESCMDKILER | YERYSYAEKV | LVSSESEIQG | NWCHEYRKLK | 99 |
| CeresClone:1314092 | KGKLYEFST- | ESCMDKILER | YERYSYAEKV | LVSSESEIQG | NWCHEYRKLK | 99 |
| Consensus | KGKLYEYST- | DS-ME-ILER | YERYSYAERA | LLS---E-Q- | NW-DEYGKLK | 100 |

| | | | | | | |
|---|---|---|---|---|---|---|
| gi\|7677036 | SKLDALQKSQ | RQLLGEQLDT | LTTKELQQLE | HQLEYSLKHI | RSKKNQLLFE | 138 |
| gi\|62510920 | SKLDALQKSQ | RQLLGEQLDT | LTTKELQQLE | HQLEYSLKHI | RSKKNQLLFE | 149 |
| gi\|6175371 | SKLDALQKSQ | RQLLGEQLDT | LTTKELQQLE | HQLEYSLKHI | RSKKNQLLFE | 149 |
| gi\|9367307 | TKLDALQKSQ | RQLLGEQLDP | LTTKELQQLE | QQLDSSLKHI | RSRKNQLLFE | 150 |
| Lead-CeresClone246416 | SKLDALQKSQ | RQLLGEQLSS | LTTKELQQLE | QQLDSSLKHI | RSRKNQLMFD | 149 |
| gi\|1483232 | ARIEVLQRNQ | KHFVGEDLDS | LSLKELQQLE | QQLDSALKHI | RSRKNQLMYE | 149 |
| gi\|33355661 | AKLEALQTSQ | RHLMGAQLDM | LSVKELQQLE | QQLENALKNI | RTRKNQLMFD | 149 |
| gi\|33391153 | AKLEALQTSQ | RHLMGAQLDM | LSAKELQQLE | QQLENALKNI | RSRKNQLLFD | 149 |
| gi\|6467974 | ARVESLQKSQ | RHLMGEQLDS | LSIKELQRLE | QQLESSLKFI | RSRKTQLILH | 149 |
| gi\|32478105 | SKVEALCKSQ | RHLMGEQLET | LNLKELQQLE | QQLEGSLKHV | RSRKTQVMLD | 144 |
| gi\|33309864 | AKVEALQKSQ | RHLMGEQLEP | LNLKELQQLE | QQLESSLKHI | RTRKCQLMFE | 149 |
| gi\|39843110 | AKVETIQKCQ | KHLMGEDLES | LNLKELQQLE | QQLESSVKHI | RSRKSQLMLE | 149 |
| gi\|30090030 | AKVETTQKCQ | KHLMGEDLES | LNLKELQQLE | QQLESSLKHI | RSRKNQLMHE | 149 |
| CeresClone:1314092 | AKVETTQKCQ | KHLMGEDLES | LNLKELQQLE | QQLESSLKHI | RSRKNQLMHE | 149 |
| Consensus | AKLEALQKSQ | RHLMGEQLDS | L-LKELQQLE | QQLESSLKHI | RSRKNQLMFE | 150 |

| | | | | | | |
|---|---|---|---|---|---|---|
| gi\|7677036 | SISELQKKEK | SLKNQNNVLQ | KLM-ETEKEK | NNAI N-TNR | EEQN------ | 180 |
| gi\|62510920 | SISELQKKEK | SLKNQNNVLQ | KLM-ETEKEK | NNAI N-TNR | EEQN------ | 191 |
| gi\|6175371 | SISELQKKEK | SLKNQNNVLQ | KLM-ETEKEK | NNAI N-TNR | EEQN------ | 191 |
| gi\|9367307 | SISELQKKEK | SLKDQNGVLQ | KHLVETEKEK | NNVLSNIHHR | EQLNEATNIH | 200 |
| Lead-CeresClone246416 | SISALQKKEK | ALTDQNGVLQ | KFM-EAEKEK | NKALMNAQLR | EQQN------ | 192 |
| gi\|1483232 | SISELQRKDK | ALQEQNNVLA | KKV----KEK | EKELAQQAQW | EQQS------ | 189 |
| gi\|33355661 | SISELQKKEK | TLVSQNKDLE | KKL--TEKEK | GKAMAQQGHW | DQQG------ | 191 |
| gi\|33391153 | SISELLKKEK | TLTTQNKDME | MKL--IEKKK | VKSMA----- | -RQG------ | 185 |
| gi\|6467974 | SISELQKMEK | ILLEQNKTLE | KEI--IAKEK | AKALVQHAPW | EKQN------ | 191 |
| gi\|32478105 | SISELQRKEK | SLEEQNKNLE | KEI--LEKQK | IKALAQQAHW | EHQN------ | 186 |
| gi\|33309864 | SISELQKKEK | SLQEQNKMLE | KEL--MEKQK | VKALNQQAPW | EQQG------ | 191 |
| gi\|39843110 | SISELQKKEK | SLQEENKVLQ | KEL--VEKQQ | VHKRL--VQW | DQTQ------ | 189 |
| gi\|30090030 | SISELQKKER | SLQEENKVLQ | KEL--VEKQK | AHA----AQQ | DQTQ------ | 187 |
| CeresClone:1314092 | SISELQKKER | SLQEENKVLQ | KEL--VEKQK | AQA----AQQ | DQTQ------ | 187 |
| Consensus | SISELQKKEK | SLQEQNKVLQ | KEL---EKEK | -KAL-----R | EQQN------ | 200 |

```
gi|7677036                -------GATP STSSPTPVTA PDPIPTTNN- SQSQPRGSG- -ESEAQPSPA  221
gi|62510920               -------GATP STSSPTPVTA PDPIPTTNN- SQSQPRGSG- -ESEAQPSPA  232
gi|6175371                -------GATP STSSPTPVTA PDPIPTTNN- SQSQPRGSG- -ESEAQPSPA  232
gi|9367307                HQEQLSGATT SSPSPTPPTA QDSMAPPNI- GPYQSRGGG- -DPEPQPSPA  247
Lead-CeresClone246416     -------GAST SSPSLSPPIV PDSMPTLNI- GPCQHRGAAE SESEPSPAPA  235
gi|1483232                ---------H TLDSVPSLLP QPLQSSLNIG GSQQARGNGR VDEGTPPHR-  229
gi|33355661               -------QQYT ESSSPPSLLI QDPFPSLTI- GINPASGSSE EDYEARPLP-  233
gi|33391153               -------QQYT ESSSPPSLLI QDPFPSLTI- GINPASGSSE EDNEARLLP-  227
gi|6467974                -------QSQY SSAL--PPVI SDSVPTPTS- RTFQARANE- -EESPQPQL-  229
gi|32478105               -------QPAP RGSPPRPFVI AESHPTLNI- GHFQGRTNAV EAEENQQPXM  229
gi|33309864               -------PPQT SSSSPTSFLI GDSLPTLNI- GTYQCSGNEH GEEAAQPQV-  233
gi|39843110               -------PQTS SSSS--SFMM REALPTTNI- SIYAAAAGER AEDAAGQPQI  230
gi|30090030               -------PQTS SSSS--SFML RDAPPAANT- SIHPAAAGER AEDAAVQPQ-  227
CeresClone:1314092        -------PQTS SSSS--SFMM RDAPPAAAT- SIHPAAAGER AGDAAVQPQ-  227

Consensus                 ---------TT SSSSP---LV QDSMPT-NI- G--QARGN-- -E-EAQP-P-  250

gi|7677036                QAGNSKLPPW MLRTSHT-   238
gi|62510920               QAGNSKLPPW MLRTSHT-   249
gi|6175371                QAGNSKLPPW MLRTSHT-   249
gi|9367307                QANNSNLPPW MLRTIGNR   265
Lead-CeresClone246416     QANRGNLPPW MLRTVK--   251
gi|1483232                --ANALLPPW NLRHLNQ-   244
gi|33355661               PANSNRLPPW MIRSANE-   250
gi|33391153               PVNRNRLPPW MVRSANE-   244
gi|6467974                RVSNTLLPPW MLSHMNGQ   247
gi|32478105               RICSSLLPPW ML------   241
gi|33309864               RIGNSLLPPW MLSHLNG-   250
gi|39843110               HIG---LPPW MVSHING-   244
gi|30090030               APPRTGLPPW MVSHING-   244
CeresClone:1314092        APPRTGLPLW MVSHLNG-   244

Consensus                 Q--NS-LPPW MLRTIN--   268
```

```
CeresClone:636116          MPLDFAAATT TASR------ ---------- --PISPLPQP QQQHHHHYP-   31
Lead-CeresClone154031      MSIPDPNSSA SLTV------ -SPSLSTASE T-PVTPVNTV RPPPSQPPPA   42
CeresClone:286081          MSSPPRGQPA TAAVPAVAAA TSPQLPAASH TLPRAFLATS SPRAIVAAPA   50

Consensus                  MS-PP----A TA-V------ -SP-L--AS- T-P--PL-T- -P------PA   50

CeresClone:636116          -------SQQ QTLPILAPNP H--------- ---------- -------FVY   48
Lead-CeresClone154031      PPPLPPPTYR PIAPLRHPNP FQQQSAYSNN LYAHSIPVRR QIQDPSAVLY   92
CeresClone:286081          PPLF---TGR PL----NPNP PAHGSSV--- ---------- ----PHGILY   76

Consensus                  PP-----T-R P--P---PNP ----S----- ---------- ----P---LY  100

CeresClone:636116          PFAPKGVRAA DH-------- ----AGVSAA FPP-PSMMY- SGGVRGVPLD   84
Lead-CeresClone154031      PFALPGRGFS ARPVRGFVAD PSVTAGNLSG YPPRPSFTYD PGPYEDRQME  142
CeresClone:286081          P-VLKSASTS NSAAAAVTAQ LRRVPPMAVG YPRTHAVAI- --PIADQQ--  120

Consensus                  PFALKG---S --------A- ----AG---G YPP-PS--Y- -GP--Q-Q--  150

CeresClone:636116          YFSHALHVGR PPTHVPFPHA A--------- --PAASPPV- --KKAAARSA  120
Lead-CeresClone154031      SLLQQFIRER NPQIRPLPRL GLGSPVGLG- --PIRASPQF LQPRVAP-PP  188
CeresClone:286081          ---QPLVHAQ PRSFAAVPR- ALVIGVSTGS EQPPRGVPIG SQPKVNPVPP  166

Consensus                  ---Q-L---R PP---P-PR- AL---V--G- --P-R--P-- -QPKVAP-PP  200

CeresClone:636116          VADVNGGKDT NTREKSS-ED TFIVVRDRKV RVTD--DASL YALCRSWLRN  167
Lead-CeresClone154031      TSILDTSRNR KARSK---DG ALAVVRGRKV RITEG-SSSL YSLGRSWLKN  234
CeresClone:286081          VGPSNEQSNP KDREKSREEP FVVVINDRKV NLLDSESCSF YALCRSWVRN  216

Consensus                  V---N---N- K-REKS--E- T--VVRDRKV R-TD--S-SL YALCRSWLRN  250

CeresClone:636116          GINEESQPQQ KDVIKALPKP LPASMVASYL SNKKEDEKDE DEKEENEQ--  215
Lead-CeresClone154031      GAHVGLQPQR SGIMKPLPKP LPVDLTTETS VPDDPDEESA DEDKEDEE--  282
CeresClone:286081          GVPHESQPSF GNGEPLLPRP LPASVVDSRI SDKDDNDVAG EDSDEEPQKN  266

Consensus                  G---ESQPQ- ----K-LPKP LPAS-V-S-- S-KD-DE--- DE--E-EQ--  300
```

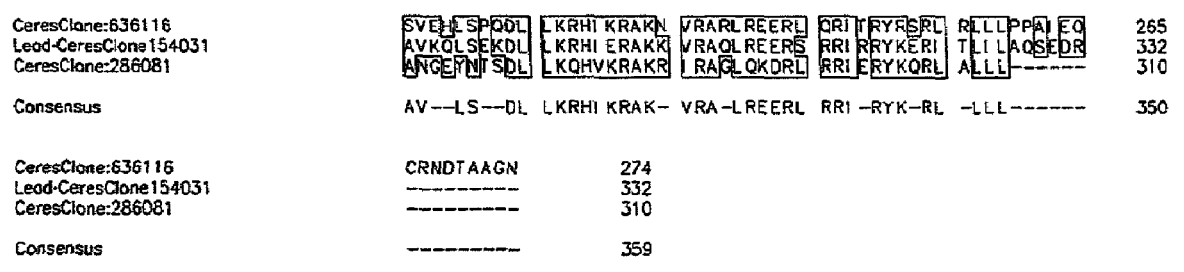

| | | |
|---|---|---|
| CeresClone:636116 | SVEHLSPQDL LKRHIKRAKN VRARLREERL QRITRYRSRL RLLLPPAIEQ | 265 |
| Lead-CeresClone154031 | AVKQLSEKDL LKRHIERAKK VRAQLREERS RRIRRYKERI TLILAQSEDR | 332 |
| CeresClone:286081 | ANGEYNTSDL LKQHVKRAKR IRAGLQKDRL RRIERYKQRL ALLL------ | 310 |
| Consensus | AV--LS--DL LKRHIKRAK- VRA-LREERL RRI-RYK-RL -LLL------ | 350 |

| | | |
|---|---|---|
| CeresClone:636116 | CRNDTAAGN | 274 |
| Lead-CeresClone154031 | --------- | 332 |
| CeresClone:286081 | --------- | 310 |
| Consensus | --------- | 359 |

```
CeresClone:291623        -------MAF ALAGAFKGLS LV----PATT SSFPRGDRA- SLSVGGAA--   36
gi|50904335              ----MASMAF TLVGAFKGMS LSSPCHSSSS ASFLRADRV- SLSVGGVGM    45
CeresClone:543435        MATASMCMSF NLATAFKGLS LS------SS SSFFGGSSG- SLRAGPASVV   43
gi|282960                -----MAVSF SLVGAFKGLS LA------SS SSFLKGDFGA AFPVAPKFSV   39
Lead-CeresClone152076    ---MATSMSL NLIGAFKGLS LS------ST SSFLRGEL-- SFSPKTTFTV   39
gi|21436345              -MAMATSMSL NLIGAFKGLS LS------ST SSFLRGDL-- SFSPKTSFTV   41

Consensus                ----A-SMSF NL-GAFKGLS LS------S- SSFLRGD--- S-SVG--FTV   50

CeresClone:291623        GVPV-----P VPARRLTIQM AHKKGAGSTK NGRDSKGQRL GVKIYGDQLA   81
gi|50904335              GVPM-----T MPVRRLTIQM AHKKGAGSTK NGRDSPGQRL GVKIYGDQVA   90
CeresClone:543435        SLPR-----R CP---LTIEN AHKKGAGSTK NGRDSQGKRL GVKIYGDQVA   85
gi|282960                SFPL-----K SP---LTIES AHKKGAGSTK NGRDSPGQRL GVKIFGDQVA   81
Lead-CeresClone152076    TLPLENLQAP VP---LTIES AHKKGAGSTK NGRDSPGQRL GVKIYGDQVA   86
gi|21436345              TLPLENLQAP IP---LTIES AHKKGAGSTK NGRDSPGQRL GVKIYGDQVA   88

Consensus                -LPL-----P VP---LTIES AHKKGAGSTK NGRDSPGQRL GVKIYGDQVA  100

CeresClone:291623        KPGAIIIRQR GTRVYPGNNV GMGKDHTLFS LIDGLVKFEK YGPDKKKVSV  131
gi|50904335              KPGAIIIRQR GTRVYPGNNV GMGKDHTLFS LIDGLVKFEK YGPDKKKVSV  140
CeresClone:543435        KPGSIIVRQR GTKFHAGKNV GLGKDYTIFS LIDGVVKFEK YGPDRKKVSV  135
gi|282960                KPGSIIVRQR GTKFHPGKNV GLGKDHTIFS LIDGLVKFEK FGPDRKKISV  131
Lead-CeresClone152076    KPGAIIVRQR GTKFHAGKNV GIGKDHTIFS LIDGLVKFEK FGPDRKKISV  136
gi|21436345              KPGAIIVRQR GTKFHAGKNV GIGKDHTIFS LIDGLVKFEK FGPDRKKISV  138

Consensus                KPGAIIVRQR GTKFH-GKNV G-GKDHTIFS LIDGLVKFEK -GPDRKK-SV  150

CeresClone:291623        YPYEKEPENP NSYRARKREY FRMRRERKKA RAEG----AA EPQLVLAAVD  177
gi|50904335              YPYEKQPENP NSYRARKREY FRMQRERKKA RAEG----IV EVQLVLAAAD  186
CeresClone:543435        YPREVQPENP NSYRARKREY FRVRXERKKA RQGA----IL KSQLVLASAD  181
gi|282960                YPREVQPENP NSYRNRKRES FRLQRERRKA RREG------ ----VILQSS  171
Lead-CeresClone152076    YPREIVPENP NSYRARKREN FRLQREKKKA RRENYTYTLP TPELVLASAS  186
gi|21436345              YPREIVPENP NSYRARKREN FRLQREKKKA RRENYSYTLP TPELVLASAS  188

Consensus                YPRE-QPENP NSYRARKRE- FRMQRERKKA RREG------ EPQLVLASA-  200
```

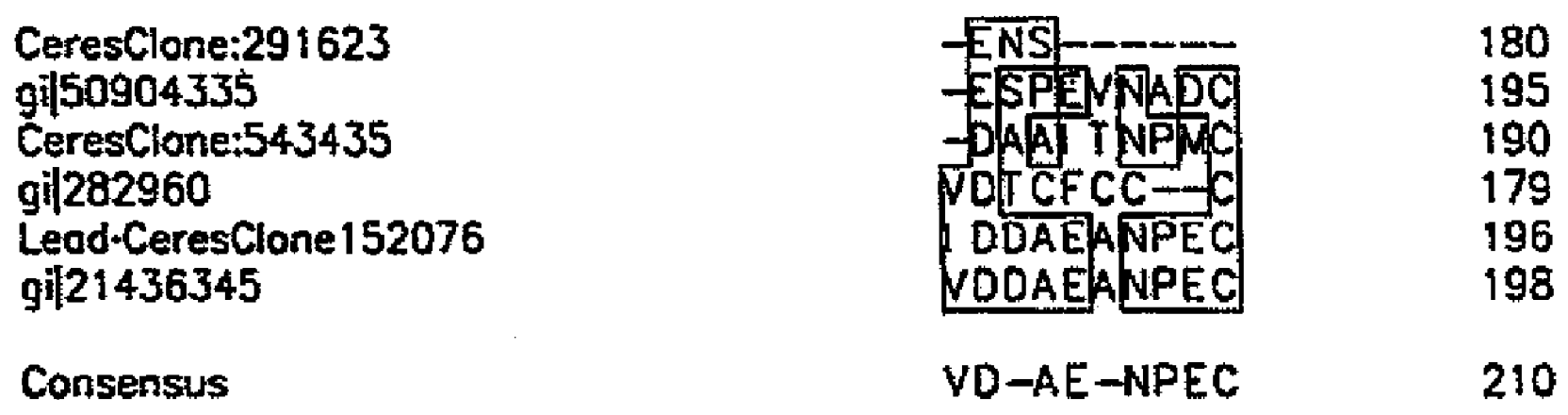

| | | |
|---|---|---|
| CeresClone:291623 | -ENS------ | 180 |
| gi\|50904335 | -ESPEVNADC | 195 |
| CeresClone:543435 | -DAAITNPMC | 190 |
| gi\|282960 | VDTCFCC--C | 179 |
| Lead-CeresClone152076 | IDDAEANPEC | 196 |
| gi\|21436345 | VDDAEANPEC | 198 |
| Consensus | VD-AE-NPEC | 210 |

```
CeresClone:467982          MSQNLLT--- -TLNHQCHPH PPHVPKPHPK PXLHP----- HPPYVPKPPV   41
CeresClone:541495          ---------- --------PK PPVVPV---- ---------- TPPYIPKPPV   18
Lead-CeresClone150798      MDSSKLSSLS LCLFLICIIY LPQHS--LAC GSCNPRKGGK HSPKLPVPPV   48
CeresClone:814247          MESSKIY--- -AYLFLCMIF LSSATPILGC GYCG------ KPPKKHKPG-   39

Consensus                  M-SSKL---- --L---C--- -P-V---L-C G-C-P----- HPP--PKPPV   50

CeresClone:467982          VKPPYXPKP- --PV--VNPP YVPKPPVVPV TPPYVPKPPI VNPPYVPKP-   85
CeresClone:541495          VTPPYVPKP- --PVVPVTPP YVPKPPVVPV TPPYVPKPPI VKPPIVYPP-   64
Lead-CeresClone150798      TVPKLPVPPV TVPKLPVPPV TVPKLPVPPV ETPKLPVPPV TVPKLPVPPV   98
CeresClone:814247          ---------- ---------- ---------- ---------- ----------   39

Consensus                  V-PPY-PKP- --PV-PV-PP YVPKPPVVPV TPPYVPKPPI V-PP-V-PP-  100

CeresClone:467982          --PVVPVRPP YIPKPPVVPV TPPYVPKPPI VYPPVVPTPP IV-TPPIVYP  132
CeresClone:541495          ---------- VVPKPPI--V TPPYVPKPPI VKPPI-VYPP VVPTPPIVYP  101
Lead-CeresClone150798      TVPKLPVPPV TVPKLPVPPV TVPKLPVPPV TVPKL-PVPP VI-VPKLPLP  146
CeresClone:814247          ---------- KTPKTPKTPV VKPPVTIPPI NVPPV-VLPP IV-KPPGILP   77

Consensus                  --P--PV-P- -VPKPPV-PV TPPYVP-PPI VVPPV---PP -V-TPPIV-P  150

CeresClone:467982          PV--VPVPPL --P------- ----PIVTPP NPPSETPCPP PPPPPVVPYP  167
CeresClone:541495          PV--VPTPPV VTP------- ----PVVTPP SPPSETPCPP -PPPPVVPYP  137
Lead-CeresClone150798      PISGLPIPPV VGPNLPLPPL PIVGPILPPG TTPPATGGKD CPPPPGSVKP  196
CeresClone:814247          PI-------- ---------- ----PIINPP TTPGKGGNTP CPPP----KS  101

Consensus                  P---VP-PPV V-P------- ----PIVTPP T-PSET-CPP CPPPPVVP-P  200

CeresClone:467982          PP--AQPTCP IDSLKLGACV DVLGGLIHIG IGSSAKQTCC PVLAGLVDLD  215
CeresClone:541495          PP--AQPTCP IDTLKLGACV DVLGGLIHIG IGSSAQQTCC PVLAGLVDLD  185
Lead-CeresClone150798      PSGGGKATCP IDTLKLGACV DLLGGLVKIG LGDPAVNKCC PLLKGLVEIE  246
CeresClone:814247          P---AQATCP IDTLKLGACV DLLGGLVHIG LGDPVANQCC PVLQGLVEVE  148

Consensus                  PP--AQ-TCP IDTLKLGACV D-LGGL-HIG -G--A---CC PVL-GLV-L-  250
```

| | | | | | | |
|---|---|---|---|---|---|---|
| CeresClone:467982 | AAVCLCTTIR | AKILNINIII | PIALQLLIDC | GKTPPDGFKC | ADS | 258 |
| CeresClone:541495 | AAVCLCTTIR | AKILNINIII | PIALQLLIDC | GKTPPDGFKC | ADS | 228 |
| Lead-CeresClone150798 | AAACLCTTLK | LKALDLNLYV | PDALQLLLTC | GKNPPPGYTC | SF - | 288 |
| CeresClone:814247 | AAVCLCTTLK | LKLLNLNIYV | PLALQLLVTC | GKSPPPGYTC | SL - | 190 |
| Consensus | AAVCLCTT-- | -KILN-NI-- | PIALQLLI-C | GKTPP-G--C | --S | 293 |

```
Leod-CeresClone147593   -MEVVERKTE MA-------- ------EEGC T-------TP RSTMYRI PVA   28
CeresClone:1090124      MEEVVERTTE MA-------- -------EEGC T-------TP RSSKYRI PVS   29
gi|8778541              MEEKNYDDGD TVTVDD---- ----DYQMGC T-------TP TRDDCRI PAY   35
CeresClone:937009       MAMESGAXAA AAAAAG---- ----YYGGNC -GWE----TP KREECRI PAT   37
CeresClone:1052536      MAMESGSEAA AAA--G---- ----YYGGTC -GWE----TP KREECRI LAT   35
CeresClone:297709       MESSVGIEKA AAVAVGAGVG GG--GGGYGC GGWE----TP KREECRI PAT   44
gi|34908220             MESKAEALAA AAAAAAAAAS AASTGGGHAC GGWE----TP KREECRI PAT   46
CeresClone:912191       MEVEVPMEYG VTTTTV---- ----AEEQ-- -GWE----TP RREDCRI PAL   35
CeresClone:630011       ME-------- ---------- ---------- --WEDECRTP RLVQNQI PAV   20

Consensus               ME-E---E-- -A-------- ---------C -GWE----TP -REECRI PA-   50

Leod-CeresClone147593   SVCPPPPRKK LM---VVR-- -KRDPPRNGY FQPPDLEFLF YAQPRRE---   69
CeresClone:1090124      LVCPPPPRKK SM---VAR-- -KRDPPR--- ---------- ----------   50
gi|8778541              PPCPPPVRRK RSLLGFGK-- -KREPPKKGY FQPPDLDLFF SVVAASQ---   79
CeresClone:937009       LPCPAAPRKA AAD--FGT-- -PRRPPXNGY FQPPDLEALF ALAPRRQ---   79
CeresClone:1052536      LPCPAAPRKA AAD--FGT-- -PRRPPKNGY FQPPDLEALF ALAPRRQ---   77
CeresClone:297709       LPCPAAPRKA VPD--FGK-- -RRSPPKNGY FQPPDLEALF ALAPRRQ---   86
gi|34908220             LPCPAAPRKA VPD--FGK-- -RRGPPKNGY FQPPDLEALF ALAPRRQ---   88
CeresClone:912191       PTCPPPPPRK KPAAELGRAA PRRGPPKGGY FQPPDIESLF LLAPPRRHAA   85
CeresClone:630011       FICPPPPPRK KPV--AGK-- -RRPPPKEGY FHPPDLDSLF SV-PARK---   61

Consensus               LPCPPPPRKK -----FGK-- -RR-PPKNGY FQPPDLE-LF ALAPRRQ---   100

Leod-CeresClone147593   -ASA   72
CeresClone:1090124      ----   50
gi|8778541              -AAT   82
CeresClone:937009       AXCA   83
CeresClone:1052536      ASCA   81
CeresClone:297709       AFCA   90
gi|34908220             ASSY   92
CeresClone:912191       STCA   89
CeresClone:630011       EACV   65

Consensus               A-CA   104
```

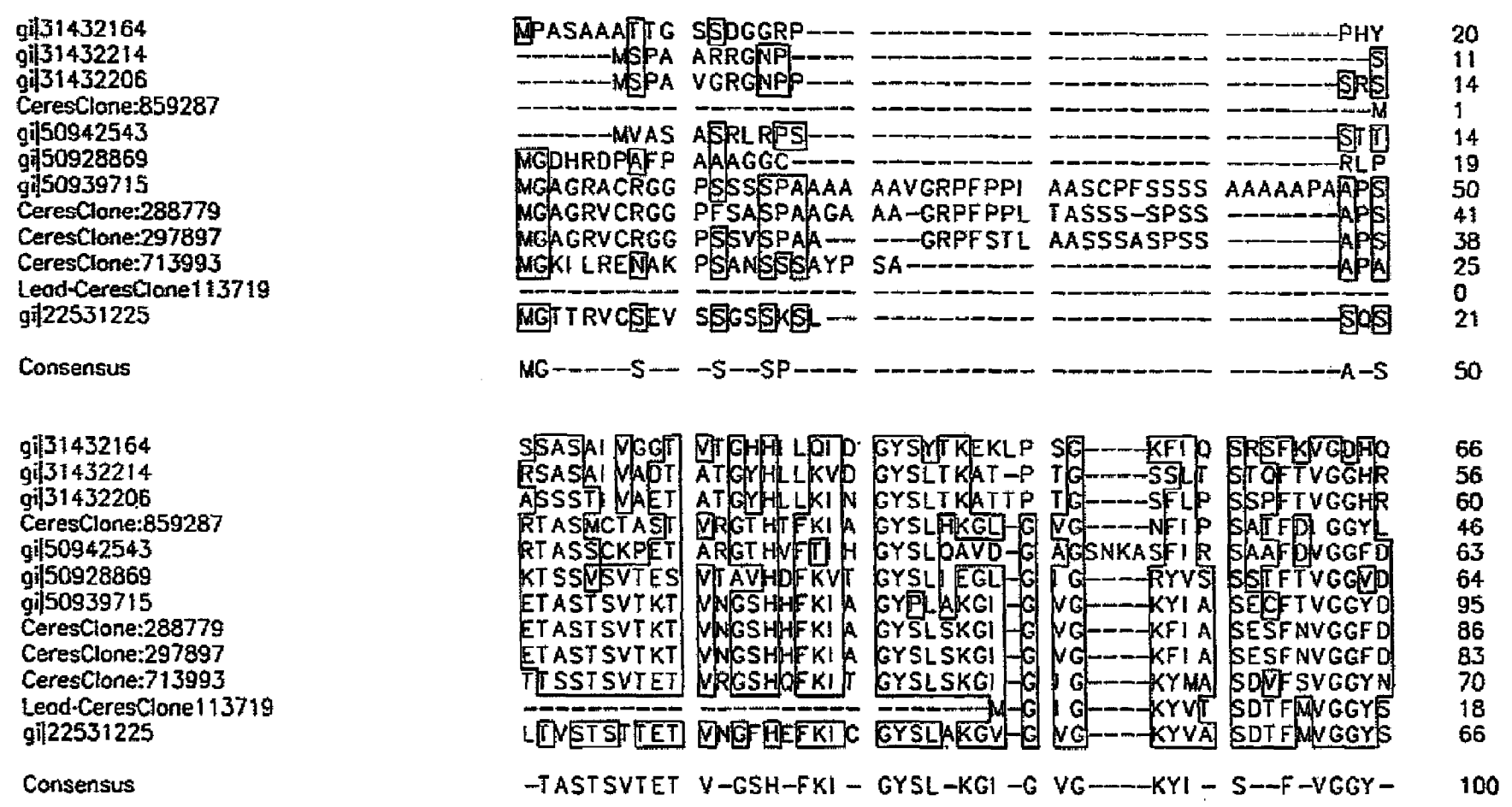

```
gi|31432164             MPASAAATTG SSDGGRP--- ---------- ---------- -------PHY  20
gi|31432214             ------MSPA ARRGNP---- ---------- ---------- ---------S  11
gi|31432206             ------MSPA VGRGNPP--- ---------- ---------- -------SRS  14
CeresClone:859287       ---------- ---------- ---------- ---------- ---------M   1
gi|50942543             ------MVAS ASRLRPS--- ---------- ---------- -------STT  14
gi|50928869             MGDHRDPAFP AAAGGC---- ---------- ---------- -------RLP  19
gi|50939715             MGAGRACRGG PSSSSPAAAA AAVGRPFPPI AASCPFSSSS AAAAAPAAPS  50
CeresClone:288779       MGAGRVCRGG PFSASPAAGA AA-GRPFPPL TASSS-SPSS -------APS  41
CeresClone:297897       MGAGRVCRGG PSSVSPAA-- ---GRPFSTL AASSSASPSS -------APS  38
CeresClone:713993       MGKILRENAK PSANSSSAYP SA-------- ---------- -------APA  25
Lead-CeresClone113719   ---------- ---------- ---------- ---------- ----------   0
gi|22531225             MGTTRVCSEV SSGSSKSL-- ---------- ---------- -------SDS  21

Consensus               MG-----S-- -S--SP---- ---------- ---------- -------A-S  50

gi|31432164             SSASAIVGGT VTGHHLQID  GYSYTKEKLP SG----KFIQ SRSFKVGDHQ  66
gi|31432214             RSASAIVADT ATGYHLLKVD GYSLTKAT-P TG----SSLT STQFTVGGHR  56
gi|31432206             ASSSTIVAET ATGYHLLKIN GYSLTKATTP TG----SFLP SSPFTVGGHR  60
CeresClone:859287       RTASMCTAST VRGTHTFKIA GYSLHKGL-G VG----NFIP SATFDIGGYL  46
gi|50942543             RTASSCKPET ARGTHVFTIH GYSLQAVD-G AGSNKASFIR SAAFDVGGFD  63
gi|50928869             KTSSVSVTES VTAVHDFKVT GYSLIEGL-G IG----RYVS SSTFTVGGVD  64
gi|50939715             ETASTSVTKT VNGSHHFKIA GYPLAKGI-G VG----KYIA SECFTVGGYD  95
CeresClone:288779       ETASTSVTKT VNGSHHFKIA GYSLSKGI-G VG----KFIA SESFNVGGFD  86
CeresClone:297897       ETASTSVTKT VNGSHHFKIA GYSLSKGI-G VG----KFIA SESFNVGGFD  83
CeresClone:713993       TTSSTSVTET VRGSHQFKIT GYSLSKGI-G IG----KYMA SDVFSVGGYN  70
Lead-CeresClone113719   ---------- ---------- --------M- G IG----KYVT SDTFMVGGYS  18
gi|22531225             LIVSTSTTET VNGFHEFKIC GYSLAKGV-G VG----KYVA SDTFMVGGYS  66

Consensus               -TASTSVTET V-GSH-FKI- GYSL-KGI-G VG----KYI- S--F-VGGY- 100
```

```
gi|31432164            WRLSYFPNVK GS-DYADYIS VYLCL----V E-GQPVKARA TFSLLDRAGQ  110
gi|31432214            WRIKYYPNGD SA-DSADYIS IYLLLDEKAS L-DLKVEAKY LISFADQVKT  104
gi|31432206            WNIKYYPNGD DV-KTADYIS FFLVLEEEET NMGLTVQAKF KFSFANQVKK  109
CeresClone:859287      WRVLYYPDGE MEMENGDHAS VFLDL---VS E-DTEARAFF EVRLVDKTNK  92
gi|50942543            WCLRYYHNGN IESDD-DYIS VFLEL---MI K-DAEVRTIF DIRMLDQYTD  108
gi|50928869            WAVRFYPDGS IV-TCLGNAS AFLYY---CG R-EKEVRTRF TLNLLGKDGK  109
gi|50939715            WAIYFYPDGK SPEDGAAYVS LFIAL---AS E-GTDVRALF ELTLVDQSGK  141
CeresClone:288779      WAIYFYPDGK SGEDGAAYVS LFIAL---AS E-GIDVRALF ELTLVDQSGK  132
CeresClone:297897      WAIYFYPDGK SAEDGAAYVS LFIAL---AS E-GTDVRALF ELTLVDQSGK  129
CeresClone:713993      WAIYFYPDGK SVEDNATYVS LFIAL---AS E-GTDVRALF ELTLLDQSGK  116
Lead-CeresClone113719  WAIYFYPDGK SPEDNSVYVS LFIAL---AS E-GADVRALF ELTLVDQSGN  64
gi|22531225            WAIYFYPDGK SPEDNSSYVS LFIAL---AS E-GADVRALF ELTLVDQSGN  112

Consensus              WAIYFYPDGK S-EDNA-YVS LF-AL---AS E-G-DVRALF ELTLVDQSGK  150

gi|31432164            PAP--ASASY YTRDMPMGRF AVSDIG--FG YHQFIKRELL EKSGHVRDDG  156
gi|31432214            QPS--LKYRT VRTFHRQGSM T-------WG YGKFIKREDF EKSDHLRDDS  145
gi|31432206            QPS------- -LKYRPIKTF NLEDSCG-WG YVEFIKRVDL EKSDDLRDDS  150
CeresClone:859287      LPPSVVLS-- -----QKTPY VFNSN----G RRSSVGDDFL QPSAYLLDDS  131
gi|50942543            DSSCVLVSTT NNTRRVFGTT NFKSKCLVWG SKNFIRRSEL FGSVYLRDDR  158
gi|50928869            LSQ--VTNSY MKHTFSPASD N-------WG FLKFAEKSKL QSSPFLHNDC  150
gi|50939715            GQD--KVHTH FGRSLEGGPY TLKYRGSMWG YKRFFKRSAL ETSDYLKDDC  189
CeresClone:288779      GQD--KVHTH FGRSLESGPY TLKYRGSMWG YKRFFKRVAL ETSDYLKDDC  180
CeresClone:297897      GQD--KVHTH FGRSLESGPY TLKYRGSMWG YKRFFKRTAL ETSDYLKDDC  177
CeresClone:713993      ERH--KVHSH FERTLESGPY TLKYRGSMWG YKRFFKRTAL ETSDYLKDDC  164
Lead-CeresClone113719  ERH--KVHSH FGRTLESGPY TLKYRGSMWG YKRFFKRSLL ESSDYLKDNG  112
gi|22531225            GKH--KVHSH FGRALDSGPY TLKYRGSMWG YKRFFRRSSL ESSDYLKENS  160

Consensus              -Q---KVHTH F-R-LE-GPY TLKYRGSMWG YKRFFKRS-L ETSDYLKDD-  200
```

```
gi|31432164              FAI RCDVTVV TE--LRTEDR T------PPLV EVPPPDLRRH LGGLLESGDG  199
gi|31432214              FTI RCDI LVV HK--I HTKET AEI LPVETFV SVPPSDMNQQ FGDLLETEKG  193
gi|31432206              FTI RCDI VVV RE--I RTEET TEI LPVESFV PVPPSDMDQQ FGDLLETEKG  198
CeresClone:859287        LVLECDVTVL R-------ESK VTLTATTFDL QVPPSDLGEH FRELLEKEEE  175
gi|50942543              LMI ECNLTVI KTPLVKTEER AAMPGDI HF QVPPTNLSRD LGKLLEDNVG  208
gi|50928869              LFI RCLLTVV RE--SHTKDV E-----VNSV VVPPSNLHTD FENMLQDGEG  193
gi|50939715              LLVNCTVGVV QS---HTEGP K-----I YTI PVPPSNMSQH I GQLLTDGKR  231
CeresClone:288779        LLVNCTVGVV QS---HTEGP K-----I YTI PVPRSNMALH I GQLLTSGKR  222
CeresClone:297897        LLVNCTVGVV QS---HTEGP K-----I YTI PVPRSNMALH I GQLLTSGKR  219
CeresClone:713993        LSVNCSVGVV RS---HTEGP K-----I YTI AI PPSSI GQK FGQLLESGKG  206
Lead-CeresClone113719    LLVRCCVGVV KS---RTEGP R-----CYNI PVPVSGLGQQ FGKLLESGKG  154
gi|22531225              LLVRCRVGVV KS---VTEGP R-----YYNI PVPVSNLGQQ LGNLLESGKG  202

Consensus                LLI RC-VGVV RS---HTEGP K-----I Y-I PVPPSNM-Q- -G-LLESGKG  250

gi|31432164              ADVTFHVAGE EVRAHRYI LA ARSPVFKAEL FGQMKESSSS NTVVNVDDME  249
gi|31432214              ADVVLEVGGQ TFAAHRCVLA ARSPVFRAEL YGLMKEGDTA G-VVCI EEME  242
gi|31432206              ADVVFEVGGQ TFAAHRCVLA ARSPVFRAAL YGSMKEGDTD G-VVHI EDME  247
CeresClone:859287        ADVVFEVEGE VFPAHKI VVA GRSPVFKAQL FGPMSDRAKQ --RI TVEDMQ  223
gi|50942543              ADLSFEVGGD VFPAHSVVLA ARSPVFMAEL YGPMRAKRGE --RI AI QDMQ  256
gi|50928869              SDVTFTVGGQ EFRAHKCVLA FRSPVFKAEL FGPMKENGTQ --CI KI DDME  241
gi|50939715              TDI TFEVDGE VFPAHKVVLA ARSPVFRAQL FGPMKDKNMK --RI TI EDME  279
CeresClone:288779        TDI AFEVDGE MFPAHKVI LS ARSPVFRAQL FGPMKDKDMK --CI KI EDME  270
CeresClone:297897        TDI AFEVDGE MFPAHKVI LS ARSPVFRAQL FGPMKDKDMK --CI KI EDME  267
CeresClone:713993        SDVNFEVNGD LFAAHKLVLA ARSPVFRAQL FGPMKDQNTQ --RI KVEDME  254
Lead-CeresClone113719    ADVTFEVDGE TFPAHKLVLA ARSAVFRAQL FGPLRSENTN --CI I EDVQ  202
gi|22531225              CDVVFQVDGE TFNAHKLVLA TRSPVFNAQL FGPLGDRNTK --CI TI EDME  250

Consensus                ADV-FEVDGE VFPAHKI VLA ARSPVFRAQL FGPMKDK-T- ---I -I EDME  300
```

```
gi|31432164                 AEVFRALLVF IYTNAL-PEL KTKANQEDEL V----IAQHLL VAADRYGMER   295
gi|31432214                 AQVFKVLLRF LYTDSL-PEM KEEEDV---- -----MCQHLL VAADRYNLER   283
gi|31432206                 AQVFKLLLRF VYTDSL-PEM ETEEDV---- -----VCQHLL VTADRYDLHR   288
CeresClone:859287           PAVFKALLHF IYTDSL-PSM EKLDGDEGKE -----MVKHLL VAADRYAMER   268
gi|50942543                 PVVFKALLHF MYTDSFSPAI NDDLSRDERQ E----LAKHLL VAADRYAVEG   303
gi|50928869                 PEVFEALLHF IYTDRL-PD- ----SCRDGKA A----AMQHLL VAADRYGVDR   283
gi|50939715                 ASVFKALLHF MYWDEL-PDI EELTGLNITW VSTLMAQHLL AAADRYALER   328
CeresClone:288779           APVFKALLHF MYWDEL-PDL EELTGVNITW VSTLMAQHLL AAADRYALER   319
CeresClone:297897           APVFKALLHF MYWDEL-PDI EELTGVNITW VSTLMAQHLL AAADRYALER   316
CeresClone:713993           APVFKALLHF IYWDSL-PDM QELTGLNSKW ASTLMAQHLL AAADRYGLER   303
Lead-CeresClone113719       API FKMLLHF IYWDEM-PDM QDLIGTDLKW ASTLVAQHLL AAADRYALER   251
gi|22531225                 API FKVLLHF IYWDEL-PDM QELIGTDSTL ASTLVAQHLL AAADRYALER   299

Consensus                   A-VFKALLHF IY-DSL-PDM EEL-GV--K- -STLMAQHLL -AADRYALER   350

gi|31432164                 LKLLCEEKLV EYIDRGSAVM LMALAEQHHC HGLKEVCFRF LESKETLSAV   345
gi|31432214                 LKLI CEEKLC KYI SVGTVSN ILALADQHHC DGLKKACFNF LGSPANLSAV   333
gi|31432206                 LKLMCENRLC KYI GVSTVSN ILALADQHHC DGLKKACFSF LGSPANLSAV   338
CeresClone:859287           MKVMCESILC KSLDVENVTA TLALADQHHC SNLRDACLEF ITSTDRMDDV   318
gi|50942543                 LKTI CEKALC MSLSVDNVAT IVALADQHNC GRLKEACVKF IASSNRLDDV   353
gi|50928869                 LRLI CERRLS ETIDVETVAT TLVLAEQHHC SQLRQACI GF VASPNMLGPV  333
gi|50939715                 LKLLCELKLC EDVAI NTVAN TLALAEQHHC YQLKTVCLRF VALPENLKAV   378
CeresClone:288779           LKLLCELKLC EDVAI NTVAN TLALAEQHHC YQLKTVCLKF VALPENLKAV   369
CeresClone:297897           LKLLCELKLC EDVAI NTVAN TLALAEQHHC YQLKTVCLKF VALPENLKAV   366
CeresClone:713993           LRLMCEASLC EDVAI NTVAT TLALAEQHHC FQLKAVCLKF IATSENLRAV   353
Lead-CeresClone113719       LRTI CESKLC EGI SI NTVAT TLALAEQHHC FQLKATCLKF IALPENLKAV  301
gi|22531225                 LKAI CESKLC EGVAI NTVAT TLALAEQHHC LQLKAVCLKF VALPENLKAV   349

Consensus                   LKLLCE-KLC E--SI NTVA- TLALAEQHHC YQLK-VCLKF IASPENLKAV   400
```

| | | | | | | | |
|---|---|---|---|---|---|---|---|
| gi\|31432164 | MATDGFLHLM | QSCPSLVKEL | L---FRVVDH | SLEITH---- | ---------- | 378 |
| gi\|31432214 | VAGDGFKHLS | KICPSLMEEL | VVVLALPGSS | ---------- | ---------- | 363 |
| gi\|31432206 | VASDGFKHLS | RSCPSLMEEL | VVMLALPPSH | A--------- | ---------- | 369 |
| CeresClone:859287 | MASDGYAHLK | RSCPSIVIDV | LEKAKK---- | ---------- | ---------- | 344 |
| gi\|50942543 | VETEGYGRLK | TSCPSILLDV | IEMATK---- | ---------- | ---------- | 379 |
| gi\|50928869 | IESDGFKHLV | ESCPLIMKEI | LSKVSHWI D | KSC------- | ---------- | 366 |
| gi\|50939715 | MQTDGFDYLQ | QSCPSLLTEL | LEYVAKVGEH | SVSPCLYSNE | VL-DGGDANG | 427 |
| CeresClone:288779 | MQTDGFDYLQ | QSCPSLLTEL | LEYVAKIGEH | SVSPCLYSTE | VL-DGGDANG | 418 |
| CeresClone:297897 | MQTDGFDYLQ | QSCPSLLTEL | LEYVAKAGEH | SVSPCLYSTE | VL-DGGDANG | 415 |
| CeresClone:713993 | MQTDGFEYLK | ESCPSVLTEL | LEYVARFTEH | SDI MCKHRNE | ALLDGSDING | 403 |
| Lead-CeresClone113719 | METDGFDYLK | ESCPSLLSEL | LEYVARLSEH | SLITSSGHRKE | LFADGCDLNG | 351 |
| gi\|22531225 | MQTDGFDYLK | ESCPSLLTEL | LQYVARLSEH | SVI VSGHRKE | IFADGCDASG | 399 |
| Consensus | MQTDGF-HLK | -SCPSLLTEL | LEYVAK--EH | SV-------E | ---DG-D-NG | 450 |

| | | |
|---|---|---|
| gi\|31432164 | ---VVRL- | 382 |
| gi\|31432214 | -------- | 363 |
| gi\|31432206 | -------- | 369 |
| CeresClone:859287 | ---SRKI- | 348 |
| gi\|50942543 | ---SRKIN | 384 |
| gi\|50928869 | -------- | 366 |
| gi\|50939715 | RRVKPRI- | 434 |
| CeresClone:288779 | RRVKPRI- | 425 |
| CeresClone:297897 | RRVKPRI- | 422 |
| CeresClone:713993 | RRVKQRL- | 410 |
| Lead-CeresClone113719 | RRVKQRLH | 359 |
| gi\|22531225 | RRVKPRLH | 407 |
| Consensus | RRVK-RI- | 458 |

| | | | | | | |
|---|---|---|---|---|---|---|
| CeresClone:1606960 | --MASAI MSS | LPQFNGLKAT | SPSPSPVQNM | VAL-QPMKP- | -KGKGALGVR | 45 |
| CeresClone:1605870 | -------MSS | LPQFTGLKAT | SLSLSPVQNM | VSL-QPMKPK | GKGKGALSVR | 42 |
| CeresClone:1608365 | --MATAVMSS | LPQFTGLKAT | SSSLSPVQNM | VSM-QPMKPK | AKGKGALGVR | 47 |
| CeresClone:653284 | -------MTT | LPQFSGLR-P | QXSAAPVKNL | VAVQQPMRP- | -KGKGALGAR | 40 |
| CeresClone:1054986 | MASQLSAMTS | VPQFHGLR-- | --SYSSPRSI | ATL-PSLRK- | -RSQG----IR | 40 |
| Lead-CeresClone28979 | --MASTMMTT | LPQFNGLRAT | KI SAAPVQGL | ASV-QPMRR- | -KGNGALGAK | 45 |
| CeresClone:302875 | ---------- | ---------- | ---------- | ---------- | ---------- | 0 |
| CeresClone:1347193 | ---------- | ---------- | ---------- | ---------- | ---------- | 0 |
| CeresClone:1084062 | -------MTT | LPQFNGLRAS | KI SAAPVQGL | ATV-VPMRR- | -KGNGALGAK | 40 |
| Consensus | -------MTS | LPQF-GLRAT | --S-SPVQN- | -S--QPMR-- | -KGKGALG-R | 50 |

| | | | | | | |
|---|---|---|---|---|---|---|
| CeresClone:1606960 | CDFI GSSTNL | I MVTSTTLML | FAGRFGLAPS | ANRKATAGLK | LEVRDSGLQT | 95 |
| CeresClone:1605870 | CDFI GSSTNL | I MVTSTTLML | FAGRFGLAPS | ANRKATAGLK | LEVRDSGLQT | 92 |
| CeresClone:1608365 | CDFI GSSTNL | I MVTSTTLML | FAGRFGLAPS | ANRKATAGLK | LEVRDSGLQT | 97 |
| CeresClone:653284 | CDYI GSSTNL | I MVASTTLML | FAGRFGLAPS | ANRKATAGLK | LEVRDSGLQT | 90 |
| CeresClone:1054986 | CDYI GSSTNI | I MVTTTTLML | FAGRFGLAPS | ANRKATAGLK | LEARESGLQT | 90 |
| Lead-CeresClone28979 | CDFI GSSTNL | I MVTSTTLML | FAGRFGLAPS | ANRKATAGLR | LEARDSGLQT | 95 |
| CeresClone:302875 | ---------- | -MVTTTTLML | FAGRFGLAPS | ANRKATAGLK | LEARDSGLQT | 39 |
| CeresClone:1347193 | ---------- | -MVTTTTLML | FAGRFGLAPS | ANRKATAGLK | LEARDSGLQT | 39 |
| CeresClone:1084062 | CDFI GSSTNL | I MVTSTTLML | FAGRFGLAPS | ANRKATAGLK | LEARDSGLQT | 90 |
| Consensus | CDFI GSSTNL | I MVTSTTLML | FAGRFGLAPS | ANRKATAGLK | LEARDSGLQT | 100 |

| | | | | | |
|---|---|---|---|---|---|
| CeresClone:1606960 | GDPAGFTLAD | TLACGTVGHI | I GVGVVLGLK | NI GAI----- | 130 |
| CeresClone:1605870 | GDPAGFTLAD | TLACGTVGHI | I GVGVVLGLK | NI GAI----- | 127 |
| CeresClone:1608365 | GDPAGFTLAD | TLACGTVGHI | I GVGVVLGLK | NI GAI----- | 132 |
| CeresClone:653284 | GDPAGETLAD | TLACGSVGHI | I GVGVVLGLK | NI GAL----- | 125 |
| CeresClone:1054986 | GDPAGFTLAD | TLACGSFGHI | LGVGI VLGLK | NTGVLDQI I G | 130 |
| Lead-CeresClone28979 | GDPAGFTLAD | TLACGTVGHI | I GVGVVLGLK | NI GAI----- | 130 |
| CeresClone:302875 | GDPAGFTLAD | TLACGAVGHI | LGVGI VLGLK | NTGALDQI I G | 79 |
| CeresClone:1347193 | GDPAGFTLAD | TLACGAVGHI | LGVGI VLGLK | NTGALDQI I G | 79 |
| CeresClone:1084062 | GDPAGFTLAD | TLACG----- | ---------- | ---------- | 105 |
| Consensus | GDPAGFTLAD | TLACG-VGHI | I GVGVVLGLK | NI GA------ | 140 |

```
Lead-CeresClone19481   MTTKDCGNHG GCGG-----GC TASRICGV I GFI I I VLITI FLVWI I LQPT   46
CeresClone:699425      MAVKDCGGHK GGGCECHRRR LYRKCCGALL ALVLLALFI  LIVYLVLRPH   50
CeresClone:1279273     ---------- ---------- -----MASCLL ALVLIVAFVS LVVYLALRPS   26
CeresClone:632710      -MSKDCGNHG EDDI-----RR ICRRFLAFLF FLALVVAVIA LIVYLVLRPT   45
CeresClone:342958      ---------- ---------- ---------- -MALLVGVVA LIVYLVLRPT   19
CeresClone:443426      -MGKDCGNHG DDDF-----RQ SCRRLLAI LL TMALLVGVVA LIVYLVLRPT   45

Consensus              ---KDCGNHG --------RR T-RR--A-LL -L-LIV-IVA LIVYLVLRPT   50

Lead-CeresClone19481   KPRFILQDAT VYA-FNLSQP N------LLT SNFQITIASR NRNSRIGIYY   89
CeresClone:699425      KPRFYLQDLA VLC-LNVTPP TSA----YLF ITMQATVAAR NPNDRVGVYY   95
CeresClone:1279273     KPSFYLQDLQ LRRPISLGDP S-------LT ASAQVTLAAR NPNDRVGIFY   69
CeresClone:632710      HPRFYLQDAS LRQ-LDVLTA NASAAAGVLS TVLQVTVASR NPNDRVGVYY   94
CeresClone:342958      HPRFYLQDAA LRQ-LDLSNG SAP-----LLS TAAQVTVASR NPNGRVGVYY   64
CeresClone:443426      HPRFYLQDAA LRQ-LDLSNG SAP-----LLS TAAQVTVASR NPNGRVGVYY   90

Consensus              -PRFYLQDAA LRQ-LDLSNP NA------LLS T-AQVTVASR NPNDRVGVYY  100

Lead-CeresClone19481   DRLHVYATYR NQQITLRTAI PPTYQGHKED NVWSPFV-YG NSVPIAPFNA  138
CeresClone:699425      DEADMYAQYK GVAITVPTRL PVAYQGHRDQ SVWSPYLRSM DSVVLPPQLA  145
CeresClone:1279273     KRLDVFVTYR DFAVTVPVSL PPQYQGHRDF TVWSPVL-SA ESVPVAAYVA  118
CeresClone:632710      DRLDVYASYK YQQITLASAL PPVYQGHGDV EVWSPVL-SG PNVPFAPYLA  143
CeresClone:342958      DRLDVYATYK YQQVTLASRL PAVYQGHGDV DVWSPVL-AG PAVPFAPFLA  113
CeresClone:443426      DRLDVYATYK YQQVTLASRL PITVYQGHGDV DVWSPVL-AG PAVPFAPFLA  139

Consensus              DRLDVYATYK YQQ-TLAT-L PPVYQGH-DV DVWSPVL-SG -SVP-APYLA  150

Lead-CeresClone19481   VALGDEQNRG FVILIIRADG RVRWKVGTLI TGKYHLHVRC QAFINL----  184
CeresClone:699425      VALAQDETAG YVLVDVRVDG QVRWKVGTWI SGHYHLRVNC PALIRVNEGK  195
CeresClone:1279273     DAMKQDVAAG FVALQVKVDG RVKWKVGSWV SGSYHLFVSC PAVL------  162
CeresClone:632710      DALAKDVQAG YLILQVKIDG RVRWKVGSWI SGHYHIFVTC PAFLI-----  188
CeresClone:342958      DALAKDLAAG YLVLQLRIDG RVRWKVGSWV SGHYHMFVTC PAYF-I SSGA  162
CeresClone:443426      DALAKDLAAG YLVLQLRIDG RVRWKVGSWV SGHYHMFVTC PAYF-I SSGA  188

Consensus              DALAKD-AAG Y-VLQIRVDG RVRWKVGSW- SGHYHLFVTC PA---I S-G-  200
```

| | | |
|---|---|---|
| Lead-CeresClone19481 | ADKAAGVHVG ENAVKYMLI N KCSVNV | 210 |
| CeresClone:699425 | GSYGATTGGG PDYFRFQQAA ACAVDV | 221 |
| CeresClone:1279273 | SAGYPGVNNT VSSLKFAQPT GCSVEV | 188 |
| CeresClone:632710 | GT GGNGA-PG ANGLRFQTAT YCHVEV | 213 |
| CeresClone:342958 | GSGYRGA-VG AHGLRFQTTT YCRVEV | 187 |
| CeresClone:443426 | GSGYRGA-VG AHGLRFQTTT YCRVEV | 213 |
| Consensus | GSGY-GA-VG A-GLRFQT-T YCSVEV | 226 |

```
Lead-CeresClone4289   ---------- -----MPTNS N-HQHHLQHQ LNENGSIISG HGLVLSHQLP  34
gi|3927829            MVFSSVSSFL DPPINWPQSA NPNNHPHHHQ LQENGSLVSG HHQVLSHHFP  50
gi|30684022           MVFSSVSSFL DPPINWPQSA NPNNHPHHHQ LQENGSLVSG HHQVLSHHFP  50

Consensus             MVFSSVSSFL DPPINWPQSA NPNNHPHHHQ LQENGSLVSG HHQVLSHHFP  50

Lead-CeresClone4289   PLQANPNPNH HHVAISAGL- --PSRMGGSM AERARQAL-N PPLAGPLKCP  80
gi|3927829            Q---NPNPNH HHVETAAATT VDPSSLNGQA AERARLAKNS QPPEGALKCP  97
gi|30684022           Q---NPNPNH HHVETAAATT VDPSSLNGQA AERARLAKNS QPPEGALKCP  97

Consensus             Q---NPNPNH HHVETAAATT VDPSSLNGQA AERARLAKNS QPPEGALKCP  100

Lead-CeresClone4289   RCDSSNTKFC YYNNYNLTQP RYFCKGCRRY WTQGGALRNV PVGGGCRRNN  130
gi|3927829            RCDSANTKFC YFNNYNLTQP RHFCKACRRY WTRGGALRNV PVGGGCRR-N  146
gi|30684022           RCDSANTKFC YFNNYNLTQP RHFCKACRRY WTRGGALRNV PVGGGCRR-N  146

Consensus             RCDSANTKFC YFNNYNLTQP RHFCKACRRY WTRGGALRNV PVGGGCRR-N  150

Lead-CeresClone4289   KKGKNGNLKS SSSSSKQSSS --VNAQSPSS G---QLRTNH QFPFSPTLYN  175
gi|3927829            KKGKSGNSKS SSSSQNKQST SMVNATSPTN TSNVQLQTNS QFPFLPTLQN  196
gi|30684022           KKGKSGNSKS SSSSQNKQST SMVNATSPTN TSNVQLQTNS QFPFLPTLQN  196

Consensus             KKGKSGNSKS SSSSQNKQST SMVNATSPTN TSNVQLQTNS QFPFLPTLQN  200

Lead-CeresClone4289   LTQLGGIGLN LAAINGNNQA HQIGSSLMMS DLGFLHGRNT STPMTGNIHE  225
gi|3927829            LTQLGGIGLN LAAINGNNGG N--------- ---------- -GPVMG----  222
gi|30684022           LTQLGGIGLN LAAINGNNGG NGNTSSSFLN DLGFFHGGNT SGPVMG----  242

Consensus             LTQLGGIGLN LAAINGNNGG N---SS---- DLGF-HG-NT SGPVMG----  250

Lead-CeresClone4289   NNNNNNNENN LMASVGSLSP FALFDPTIGL YAFQNDGNIG NNVGISGSST  275
gi|3927829            ----NNNENN LMTSLGSSSH FALFDRTMGL YNFPNEVNMG --------LS  260
gi|30684022           ----NNNENN LMTSLGSSSH FALFDRTMGL YNFPNEVNMG --------LS  280

Consensus             ----NNNENN LMTSLGSSSH FALFDRTMGL YNFPNEVNMG --------LS  300
```

```
Lead-CeresClone4289   SMVDSRVYQT PPVKMEEQPN LANLSRPVSG LTSPGNQTNQ YFWPGSDFSG   325
gi|3927829            SI GATRVSQT AQVKMEDN-H LGNI SRPVSG LTSPGNQSNQ Y-WTGQGLPG   308
gi|30684022           SI GATRVSQT AQVKMEDN-H LGNI SRPVSG LTSPGNQSNQ Y-WTGQGLPG   328

Consensus             SI GATRVSQT AQVKMEDN-H LGNI SRPVSG LTSPGNQSNQ Y-WTGQGLPG   350

Lead-CeresClone4289   PSND------ L    331
gi|3927829            SSSNDHHHQH LM   320
gi|30684022           SSSNDHHHQH LM   340

Consensus             SSSNDHHHQH LM   362
```

```
Lead-CeresClone10857   ---------- ---------- ---MEDVKGK EIIDDAPIDN KVSDEM---E   24
CeresClone:1334970     ---------- ---------- ---------- ---------- ---------ME   2
CeresClone:632050      ---------- -MSEKPSDET TGQVRPEGDV SDVKVETADQ NKGNEMPSAQ   39
CeresClone:399368      ---------- ---------- ---------- -------MDQ TEDNSMPSAQ   13
CeresClone:617857      ---------- ---------- MKDANAAGHD NVGNSEPMDQ SGDNAMPSAQ   30
CeresClone:1102596     ---------- ---------- ---------- ---------- -----MPSSQ   5
CeresClone:648816      MSDAKVEDLK KEEEVGDDSP RNEVDSEKSA DDLKDSDNDK SDGNPMPSSQ   50

Consensus              ---------- ---------- ---------- --------DQ S--N-MPSAQ   50

Lead-CeresClone10857   SEENAIKKKY GGLLPKKIPL ISKDHERAFF DSADWALGK- --QKG--QKP   69
CeresClone:1334970     SEENAIKKKY GGLLPKKIPL ISEDHERAFF DSADWALGK- --QKG--QKP   47
CeresClone:632050      QEEAVIKKKY GGVLPKKSPL ISKDHERAYF DSADWALGK- --QGGHPQKP   86
CeresClone:399368      QQEEAIKKKF GGLMPKKPPL ISKDHERAYF DSADWALGK- --QGV--AKP   58
CeresClone:617857      QQEQVIKKKF GGLIPKKPPL ISKDHERAYF DSADWALGKS GQQGV--AKP   78
CeresClone:1102596     QEEAAVKSKY GGLMPKKPPL ISEDHERAYF DSADWALGK- --QGV--AKP   50
CeresClone:648816      QEEAAVKKKY GGMLPKKPPL ISKDHERAYF DSTDWALGK- --QGA--QKP   95

Consensus              QEE-AIKKKY GGLLPKKPPL ISKDHERAYF DSADWALGK- --QG---QKP   100

Lead-CeresClone10857   KGPLEALRPK LQPTPQQ-QP RARRMAYSSG EIEDIEIDNN EA-PDDQACA   117
CeresClone:1334970     KGPLEALRPK LQPTPQQ-QP RARRMAYSSG EIEDSEIDNI XXXGRTRXXA   96
CeresClone:632050      KGPLEALRPK LQPTQQ--QA RSRRFLHAST DSDEGANSPI EA---TTPNQ   131
CeresClone:399368      KGPLEALRPK LQPTRQQQQQ RARRPIYTSS ENEDGDGAGA E---------   99
CeresClone:617857      KGPLEALRPK LQPTRQQ-QQ RSRSSIYSSS ENEDGDGAGS E---------   118
CeresClone:1102596     KGPLEALRPK LQPTQQ--QT RYKK------ ---------- ----------   72
CeresClone:648816      KGPLEALRPK LQPTQQ--HA RSRRSAYAPA DDNEVDGCNS DA---SAEHQ   140

Consensus              KGPLEALRPK LQPTQQQ-Q- R-RR--YSSS E-ED-D---- E---------   150

Lead-CeresClone10857   SAVDSTNLKD DGGAKDNIKS   137
CeresClone:1334970     SVVDSTNLKD DGGAKDNIKS   116
CeresClone:632050      EFTEEAKAAE N----KESTE   147
CeresClone:399368      ---------- -----DMNIN   104
CeresClone:617857      ---------- -----DMNIN   123
CeresClone:1102596     ---------- -------SXC   75
CeresClone:648816      SATEEVGGDK SDTAQDQSCH   160

Consensus              ---------- -----D-S--   170
```

```
Lead-CeresClone7925   -MAAVAAPIA SKPRGSKAES FVDNKRREDI RFANINSARA VSDAVRTSLG   49
CeresClone:326385     MAAAVAAPAP SR----KTET YTDTKRRDDV RGANIAAARA VADAVRTSLG   46
Consensus             M-AAVAAP-- S-PRGSK-E- --D-KRR-D- R-ANI--ARA V-DAVRTSLG   50

Lead-CeresClone7925   PKGMDKMIST AN--GEVIIT NDGATILNKM EVLQPAAKML VELSKSQDSA   97
CeresClone:326385     PRGMDKMIAS GDQAQEVIIT NDGATILSRM ALLQPAARML AELSRSQDAA   96
Consensus             P-GMDKMI-- --QA-EVIIT NDGATIL--M --LQPAA-ML -ELS-SQD-A   100

Lead-CeresClone7925   AGDGTTTVVV IAGALLKECQ SLLTNGIHPT VISDSLHKAC GKAIDILTAM   147
CeresClone:326385     AGDGTTTVVV LAGSLLRRAQ SLLSAGAHPT AAADALHRLA TRAVEILHAM   146
Consensus             AGDGTTTVVV -AG-LL---Q SLL--G-HPT ---D-LH--- --A--IL-AM   150

Lead-CeresClone7925   AVPVELTDRD SLVKSASTSL NSKVVSQYST LLAPLAVDAV LSVIDPEKPE   197
CeresClone:326385     AIPIELSDRE SLVKSASTAL NSKVVSQYST LLSPLAVDAA LSVVDPAHPD   196
Consensus             A-P-EL-DR- SLVKSAST-L NSKVVSQYST LL-PLAVDA- LSV-DP--P-   200

Lead-CeresClone7925   IVDLRDIKIV KKLGGTVDDT HTVKGLVFDK KVSRAAGGPT RVENAKIAVI   247
CeresClone:326385     LLDLRDIRIV KKLGGTVDDT ELIPGLIFDK KASHAAGGPT RMENAKIAVI   246
Consensus             --DLRDI-IV KKLGGTVDDT ----GL-FDK K-S-AAGGPT R-ENAKIAVI   250

Lead-CeresClone7925   QFQISPPKTD IEQSIVVSDY TQMDRILKEE RNYILGMIKK IKATGCNVLL   297
CeresClone:326385     QFQISPPKTD IEQSVIVSDY AQMDRILREE RNYILGMVKK IKAAGCNVLL   296
Consensus             QFQISPPKTD IEQS--VSDY -QMDRIL-EE RNYILGM-KK IKA-GCNVLL   300

Lead-CeresClone7925   IQKSILRDAV TDLSLHYLAK AKIMVIKDVE RDEIEFVTKT LNCLPIANIE   347
CeresClone:326385     IQKSILRDAV TDLSLHYLAK AKILVVKDVE RDEMEFITKT LNCLPIANIE   346
Consensus             IQKSILRDAV TDLSLHYLAK AKI-V-KDVE RDE-EF-TKT LNCLPIANIE   350
```

```
Lead-CeresClone7925   HFRAEKLGHA DLVEEASLGD GKILKITGIK DMGRTTSVLV RGSNQLVLDE  397
CeresClone:326385     HFRTDKFGYA DVVEEVSVGE GKVVKITGIK DM-------- ----------  378

Consensus             HFR--K-G-A D-VEE-S-G- GK--KITGIK DMGRTTSVLV RGSNQLVLDE  400

Lead-CeresClone7925   AERSLHDALC VVRCLVSKRF LIAGGCAPEI ELSRQLGAWA KVLHGMEGYC  447
CeresClone:326385     ---------- ---------- -----VGPQL YLSGDLTNW- ----------  392

Consensus             AERSLHDALC VVRCLVSKRF LIAGG--P-- -LS--L--WA KVLHGMEGYC  450

Lead-CeresClone7925   VKSFAEALEV IPYTLAENAG LNPIAIVTEL RNKHAQGEIN AGINVRKGQI  497
CeresClone:326385     ---------- ---------- ---------- ---------- ----------  392

Consensus             VKSFAEALEV IPYTLAENAG LNPIAIVTEL RNKHAQGEIN AGINVRKGQI  500

Lead-CeresClone7925   TNILEENVVQ PLLVSTSAIT LATECVRMIL KIDDIVTVR   536
CeresClone:326385     ---------- -LLMKLNAVS M--------- ----MHSVS   407

Consensus             TNILEENVVQ PLL----A-- -ATECVRMIL KIDD---V-   539
```

```
gi|5532505              MFSAQNKI HK  DKGVAPTEFE  ERVAQAFFDL  ENTNQELKSD  LKDLYI NQAV   50
CeresClone:1070069      MFSAQNKI KK  DKNAEPTECD  VQVAQALFDL  ENTNQELKSE  LKDLYI NQAV   50
Lead-CeresClone23518    MFSAQNKI NK  DKNAEPTECE  EQVAQALFDL  ENTNQELKSE  LKDLYI NQAV   50
gi|4128206              MYTALQKI HK  DKDAEPTEFE  ENVAQALFDF  ENTNQEI KSD  LKDLYI NSAL   50
CeresClone:553599       MYTSRKKI HK  DKDAEPTEFE  ETVAQYLFDL  ENTNQDLKSD  LKDLYI NQAI   50
gi|55167942             MYTARRKI QK  DKGLEPTEFE  DTVAQAFFDL  ENGNQELKSD  LKDLYI NGAV   50
gi|22671664             MYTARRKI QK  DKGLEPTEFE  DTVAQAFFDL  ENGNQELKSD  LKDLYI NGAV   50
gi|57471724             MYTARKKI QK  DKGVEPSEFE  DTVAQAFFDL  ENGNQELKSD  LKDLYI NTAI   50
CeresClone:1283519      MYTARKKI QK  EKGLEPSEFE  DSVAQAFFDL  ENGNQELKSD  LKDLYI NNAI   50
CeresClone:283165       MYTARKKI QK  DKGLEPSEFE  DSVAQAFFDL  ENGNQELKSD  LKDLYI NGAI   50
CeresClone:259723       MYTARKKI QK  DKGLEPSEFE  DSVAQAFFDL  ENGNQELKSD  LKDLYI FGAI   50

Consensus               MYTARKKI QK  DKGLEPTEFE  D-VAQAFFDL  ENGNQELKSD  LKDLYI N-A-   50

gi|5532505              SMDI AGNRKA  VVI YVPFRLR  KAFRKI HSRL  VRELEKKFSG  NDVI FVATRR  100
CeresClone:1070069      NMDI CGNRKA  I VI YVPFRLR  KAFRKI HPRL  VRELEKKFSG  KDVI FVATRR  100
Lead-CeresClone23518    HMDI SGNRKA  VVI YVPFRLR  KAFRKI HPRL  VRELEKKFSG  KDVI FVITRR  100
gi|4128206              QI DVSGGKKA  VVI HVPYRLR  KSFRKI HPRL  VRELEKKFSG  KEVVLI ATRR  100
CeresClone:553599       QMDVAGNRKA  VVI YVPFRLR  KAFRKI HLRL  VRELEKKFSG  KDVVFI ATRR  100
gi|55167942             QMDLPGNRKA  VI I YVPYRLR  KAYKKI HVRL  VRELEKKFSG  KDVVLVATRR  100
gi|22671664             QMDLPGNRKA  VI I HVPYRLR  KAYKKI HVRL  VRELEKKFSG  KDVVLVATRR  100
gi|57471724             QMDVVGNRKA  VVI HVPYRLR  KPFRKI HVRL  VRELEKKFSG  KDVVFVATRR  100
CeresClone:1283519      QMDVTGSRKA  VVI HVPYRLR  KAFRKI HVRL  VRELEKKFSG  KDVVI VATRR  100
CeresClone:283165       QLDVAGSRKA  VVI HVPYRLR  KAFRKI HVRI  VRELEKKFSG  KDVVI VATRR  100
CeresClone:259723       QLDVAGSRKA  VVI HVPYRLR  KAFRKI HVRI  VRELEKKFSG  KDVVI VATRR  100

Consensus               QMDV-GNRKA  VVI HVPYRLR  KAFRKI HVRL  VRELEKKFSG  KDVV-VATRR  100
```

```
gi|5532505              I MRPPKKGSA VQRPRNRTLT SVHEAMLEDV AYPAEI VGKR TRYRVDGTKI   150
CeresClone:1070069      I MRPPKKGAA VQRPRNRTXT SVHEAMLEDV AYPAEI VGKR TRYRLDGSKV   150
Lead-CeresClone23518    I MRPPKKGAA VQRPRNRTLT SVHEAMLEDV AFPAEI VGKR TRYRLDGSKI   150
gi|4128206              I LRPPKKGSA VQRPRSRTLT AVHDAMLEDI VYPAEI VGKR VRYRLDGSKI   150
CeresClone:553599       I VRPPKKGSA VQRPRTRTLT AVHDAMLEDV VYPAEI VGKR VRXRI DGSKI   150
gi|55167942             I VRPPKKGSA VVRPRTRTLT AVHDGI LEDV VYPAEI VGKR VRYHLDGRKI   150
gi|22671664             I VRPPKKGSA VVRPRTRTLT AVHDGI LEDV VYPAEI VGKR VRYHLDGRKI   150
gi|57471724             I VRPPKKGSA VQRPRTRTLT AVHDGI LEDV VYPAEI VGKR VRYRLDGAKV   150
CeresClone:1283519      I VRPPKKGSA VLRPRTRTLT AVHDGI LEDV VYPAEI VGKR VRYRLDGSKI   150
CeresClone:283165       I VRPPKKGSA VQRPRTRTLT AVHDGI LEDV VFPAEI VGKR VRYRLDGAKI   150
CeresClone:259723       I VRPPKKGSA VQRPRTRTLT AVHDGI LEDV VFPAEI VGKR VRYRLDGAKI   150

Consensus               I VRPPKKGSA VQRPRTRTLT AVHDGMLEDV VYPAEI VGKR VRYRLDGSKI   150

gi|5532505              MKVYLEPKER NNTEYKLETM VGVYRKLTGK DVVFEYPVAD P-   191
CeresClone:1070069      MKVYLEAKER NNXEYKLETM VGVYRKLTGK DVTFEYPVEA --   190
Lead-CeresClone23518    MKVFLDAKEK NNTEYKLETM VGVYRKLTGK DVVFEYPVEA --   190
gi|4128206              MKVFLDPKAK NDTENKLETF AGVYRKLSGK DVVFEFPLTE --   190
CeresClone:553599       MKVFLDPKER NNTEYKLETF XGVYRKLTGK DVVFEYPI SE A-   191
gi|55167942             MKI FLDPKER NNTEYKLDTF SSVYRRLCGK DVVFDYPMTE TA   192
gi|22671664             MKI FLDPKER NNTEYKLDTF SSVYRRLCGK DVVFDYPMTE TA   192
gi|57471724             I KI YLDPKER NNTEYKLETF SAVYRRLCGK DVVFEYPVTE TA   192
CeresClone:1283519      I KI FLDPKER NNTEYKLETC TAVYRRLCGK DVVFEYPMTE NA   192
CeresClone:283165       I KI FLDPKER NNTEYKLDTY TTVYRRLCGK DVVFEYPMAE NA   192
CeresClone:259723       I KI FLDPKER NNTEYKLDTY TTVYRRLCGK DVVFEYPMAE NA   192

Consensus               MKI FLDPKER NNTEYKLETF --VYRRLCGK DVVFEYPM-E -A   192
```

```
Lead-CeresClone18857   -----MNWLP ---------- -----EAEAE DDFKGLLSGD F-----FDDL   25
CeresClone:1334990     ---------- ---------- ---------- ---------- ----------    0
gi|20466045            -----MNWLP ---------- -----EAEAE EHLKGLLSGD F-----FDGL   25
gi|12711287            -MMTMVGHCG ---------- --------YL DGIPTGPVVD ED----FDDI   27
CeresClone:473814      ---------- ---------- ---------MD MELLDLP--- ----------    9
CeresClone:305252      --MAQLEWLS ---------- -----GLFDD ASIPHEPA-- ------FPGA   25
CeresClone:938230      MEATAPDYYA RDK------- --KGSDLFVV DDLLALPCDD EEEEEEGVGD   41
gi|52353703            MEVAAADYAG GVRVKKEAGG CGGSGDMFLV DDLLDLPCDE EEEETGLCGA   50

Consensus              -----M---- ---------- ---------- DDL--LP--D ------F-G-   50

Lead-CeresClone18857   INHLDVPLDD IDITNGEGDW VDRFQD-LEP PPMDMFPTLP SDLTSCGSG-   73
CeresClone:1334990     ---------- ---------- ---------- ----MFPALP SDLTSCPKGA   16
gi|20466045            TNHLDCPLED IDSTNGEGDW VARFQD-LEP PPLDMFPALP SDLTSCPKGA   74
gi|12711287            LNFLDFPLES LEEDGQGVEW DASESKFLGP IPMDAL---- MAFPPVPQG-   72
CeresClone:473814      ---LDFEDVE TDAVE-EQDW DAQLKLLEDP PPPLGVFPLQ QSSAFCGQT-   54
CeresClone:305252      APIIKSSALA ACALL-PPDK MGDALLFRSS SPISVLEHGS FNNANGGGG-   73
CeresClone:938230      APFLPANAAS AAAVV-VKQE AGFGNASADS STVTALDSCS NSFSGLADG-   89
gi|52353703            YG-GGGAGLG AGVVGGGGDD RAAGNASADS STVTAVDSCS NSFSGLADG-   98

Consensus              ---LD----- -D-V----DW -A------DP -P--ML--L- S---SC--G-  100

Lead-CeresClone18857   ---MAKAPRV DIQRNIPALK QSYSSEALSS ILHQSSAPPE IKVSKL----  116
CeresClone:1334990     ARVRIPNNMI PALKQSCSSE A---LSGINS TPHQSSAPPD IKVSYL----   59
gi|20466045            ARVRIPNNMI PALKQSCSSE A---LSGINS TPHQSSAPPD IKVSYL----  117
gi|12711287            ---NIGNGRV KAEPNSNHPI K---VTEGQG SGI------- ----------   99
CeresClone:473814      ---RNENAKL GSKSFSASLA K---TVRPAY GKTIPVQKVS LKGKQLLQ--   96
CeresClone:305252      ---GCSASSE SSSASSSSES F---SGSGSG EGHAWS---- ----------  103
CeresClone:938230      ---DFSGGLC EPYDQLAELE W---LSNYMG EGEESFATED LHKLQLSGI   133
gi|52353703            ---DFSGGLC EPYEQLAELE W---VSTYMG EETLPI--ED LRKLQLSGI   140

Consensus              ------N--- EA-KQS-SLE ----LS---G T-HQSSA--D -K---L----  150
```

```
Lead-CeresClone18857    -----FQSLS PVSVLENSYG SLSTHNNGSQ RLAFPVKGMR SKRKRPTTLR   161
CeresClone:1334990      -----FQSLT PVSVLENSYG SLSTQNSGSQ RLAFPVKGMR SKRRRPTTVR   104
gi|20466045             -----FQSLT PVSVLENSYG SLSTQNSGSQ RLAFPVKGMR SKRRRPTTVR   162
gi|12711287             -----FQTQS PVSVLESSNS CSGGKSI SI K HDI AI PVRPR SKRPRSSALN   144
CeresClone:473814       -----FQTNS PVSVFESSSS SPSVENSNFE LPVI PTKRPR TKRRRLSNLS   141
CeresClone:305252       ------APVS PPPVL----- ---------- ----VI PARAR SKRSRPSAFT   129
CeresClone:938230       PSGGFPSANG PPAPAATAA- --TAQPGVFL PEGPVPAKAR SKRSRVAPGN   180
gi|52353703             P----AAPRA PPALAVSAVQ LPAGGAGALP TEAPVPGKAR SKRSRVAPCS   186

Consensus               -----FQSLS PVSVLE-S-- S-S-QNS--Q --A--PKR-R SKRRRP----   200

Lead-CeresClone18857    L--SYLFPSE PRKP------ -----EKSTP GKPESECYFS SEQHAKKKRK   198
CeresClone:1334990      L--SYLFPFE PRKS------ --------TP GESVTEGYYS SEQHAKKKRK   138
gi|20466045             L--SYLFPFE PRKS------ --------TP GESVTEGYYS SEQHAKKKRK   196
gi|12711287             P-----WLLM PPI S----- ---------S TRFASKKTCD ARKGKEKKRK   174
CeresClone:473814       L--LYSI PFI LTSPAFQKFQ RMDFSKSDI Q TQPSGELLCK FKKK-QRKKD   188
CeresClone:305252       RAGAEAPTI L VPTPMYSSGP SHSDPESI AE SSPHPAPPMK KKKKAKKPPA   179
CeresClone:938230       W--SSRLLVL PPAPASPPSP ASMAI SPAES GVSAQAFHVK KPSKPAKKKE   228
gi|52353703             W--SSRLMVL PPPPASPPSP ASAVI SPSES GTAAPAFPAK KAAKSAKKKD   234

Consensus               L--SY-FPVL PP-P------ ---------- G-SA-E-Y-K S--KAKKKRK   250

Lead-CeresClone18857    IHLTT----R TVSSTLEASN SDGI V----- RKCTHCETTK TPQWREGPSG   239
CeresClone:1334990      IHLIT----H TESSTLESSK SDGI V----- RICTHCETI T TPQWRQGPSG   179
gi|20466045             IHLIT----H TESSTLESSK SDGI V----- RICTHCETI T TPQWRQGPSG   237
gi|12711287             MSLLSVPQI A DVTKKKTI SG QQFSF----- KKCTHCQVTK TPQWREGPLG   219
CeresClone:473814       IPLPT----N KI EMKRSSSQ ESVAP----- RKCLHCEVTK TPQWREGPMG   229
CeresClone:305252       PPAPASSDDN DGDADYEEGG ERTEPQGCAV RRCTHCQI EK TPQWRAGPLG   229
CeresClone:938230       VPPQAQAQAQ TQSVSAPTAP SGVTAAANEG RRCLHCETDK TPQWRTGPMG   278
gi|52353703             GPSPA----- -------PAP NAAAQAAAEG RRCLHCETDK TPQWRTGPMG   272

Consensus               IPL-T----- T-SST-ESS- S--------- R-CTHCET-K TPQWREGPMG   300
```

```
Lead-CeresClone18857   PKTLCNACGV RFRSGRLVPE YRPASSPTFI PAVHSNSHRK IIEMRRKDD- 288
CeresClone:1334990     PKTLCNACGV RFKSGRLVPE YRPASSPTFI PSVHSNSHRK IIEMRKKDD- 228
gi|20466045            PKTLCNACGV RFKSGRLVPE YRPASSPTFI PSVHSNSHRK IIEMRKKDD- 286
gi|12711287            PKTLCNACGV RYRSGRLFPE YRPAASPTFV PTLHSNSHRK VVEMRKKAIY 269
CeresClone:473814      PKTLCNACGV RYRSGRLFAE YRPASSPTFV ASLHSNSHKK VLEIRNRAT- 278
CeresClone:305252      PKTLCNACGV RYKSGRLFPE YRPAASPTFV PSIHSNSHKK VVEMRQKAV- 278
CeresClone:938230      PKTLCNACGV RYKSGRLVPE YRPAASPTFV TSRHSNSHRK VLELRRQREM 328
gi|52353703            PKTLCNACGV RYKSGRLVPE YRPAASPTFV VSKHSNSHRK VVELRRQKEM 322

Consensus              PKTLCNACGV RYKSGRLVPE YRPA-SPTFV PSVHSNSHRK V-EMR-K-D- 350

Lead-CeresClone18857   -----EQFDSS MIRAVISRG- ---------- ---------- ---------- 303
CeresClone:1334990     -----EFDTS MIRSDIQKVK QGRKKMV--- ---------- ---------- 250
gi|20466045            -----EFDTS MIRSDIQKVK QGRKKMV--- ---------- ---------- 308
gi|12711287            GETSALEEPH NVIVEGPPMS PAPEFVPMSS YLFDVY---- ---------- 305
CeresClone:473814      ---------- ---QVTVR-- ---------- ---------- ---------- 283
CeresClone:305252      -----RSGDPS CDLLQFIRRR D--------- ---------- ---------- 295
CeresClone:938230      ---HHHHQPS QLQQHAVAGG VGRIMHMESH LLFDGP-AAP PILGGGDDFL 374
gi|52353703            QLLHHHQQPP PHVGAGGGGA AGGLLHVTSP LLFDGPTSSA PLFAGADEFL 372

Consensus              -------DPS -IR----R-- -G----V--- ---------- ---------- 400

Lead-CeresClone18857   ---------- -----  303
CeresClone:1334990     ---------- -----  250
gi|20466045            ---------- -----  308
gi|12711287            ---------- -----  305
CeresClone:473814      ---------- -----  283
CeresClone:305252      ---------- -----  295
CeresClone:938230      IHHRLGTADY RQQLI  389
gi|52353703            IHNRI-SPDY RRQAT  386

Consensus              ---------- -----  415
```

```
Lead-CeresClone156655   MPRPRV----  S-----ELSQR  QAPR-----LR  SS--S--SIS  DSNHSNRLIT   34
CeresClone:1342938      MPKPRLGI RG  S-----ELPQR  QSPR-----LR  TSLLS--TSS  DPHHLSRPI-   39
gi|51451351             MHVKFFGELN  DRAVFEMPHR  TSPRAPVRSK  TTAAAPAAAG  SEHHRDRVV-   49
CeresClone:302736       MPRSR----G  N-----EPPLR  TSQRAPLHLK  TTACS--EAN  GAHH--RPV-   37

Consensus               MPRPR-G--G  S-----ELPQR  -SPRAP--L-  T-A-S---AS  D-HH--R---   50

Lead-CeresClone156655   TDQSFKPGVD  RKSPRSGGPN  SDPLGQKKLG  G-----RI SD  LESQLGQAQE   79
CeresClone:1342938      TDRSPKLGLD  RRSPRSGGPH  TDPLSQKKLG  S-----RI SG  LESQLGQAQE   84
gi|51451351             ------VGAG  GGAARGTVCM  VACLQKKPAG  GGAAVSRVAE  LEAKLGKAEG   93
CeresClone:302736       --------AD  RSSPRVSPRS  PLPEKKHAAG  T-----RVAE  LEGKLGKVQE   74

Consensus               TD-S-K-G-D  R-SPRS-GP-  -DPL--KK-G  ------R--E  LES-LG-AQE  100

Lead-CeresClone156655   ELRLLKEQLA  NAEAVKKQAQ  DELH-KKSK-  ----------  ----------  107
CeresClone:1342938      ELRLLKQQLA  KAEAAKKRAQ  EELHRKKSK-  ----------  ----------  113
gi|51451351             QLAEMREQLA  AAEKARKDAR  AALVESKKRF  SAAKKRVATA  GAASSSAAA-  142
CeresClone:302736       ELKKLREQLA  SAEAXKKDAQ  VALEEAKKRV  GTKGSPASTT  TTTPLSPPSP  124

Consensus               ELR-L-EQLA  -AEAAKK-AQ  --LHE-K---  --------T-  -----S----  150

Lead-CeresClone156655   ----------  -KPNPLARVE  ESATEAERI D  RDEI----PG  DVQKET----  138
CeresClone:1342938      ----------  -KPN------  -----TPAPE  RDDI----PG  DGHQET----  133
gi|51451351             ---------E  QTPPQAVSDE  KCGVI SPACD  VPEA--AEPG  DAQGEETKEM  181
CeresClone:302736       GVEI AKKTEE  LKLPQPAAEE  ESSI NVPATD  VFEVVRAESG  DKENQSAAEV  174

Consensus               ---------E  -KP-Q-A--E  ES-----PA-D  -DEI --AEPG  D-Q-ET--E-  200

Lead-CeresClone156655   -DVFEVPVEK  I AV--EEEEL  RSGNDEA---  EKLVAKEDEI  KMLKARLYQM  182
CeresClone:1342938      -DVFEVLDEK  AK---ESEKT  KN--------  DELASKEDQI  NVLKARLYDL  171
gi|51451351             ADDDEVNSVT  AAI VGDLEGN  KGGQEVEQLR  TKLMEKDMEV  YELKAKLTAM  231
CeresClone:302736       CEVVSCGGGK  AAV--DVAEN  EETEEEE---  TKKMI GEDNS  AAVESDGADK  219

Consensus               -DVFEV--EK  AAV-----EEN  K-G-EEE---  -KLM-KEDEI  --LKARLYQM  250
```

```
Lead-CeresClone156655    EKEHESL--- ----GKENES LKNQLSDSAS EI SNVKANED EM--------   217
CeresClone:1342938       EKERVSL--- ----SEENET LKDQLKKTDT EMSCAKAKED EI--------   206
gi|51451351              DAEADDLRAS LATKGMEIDE LRAKLTSKDA DI AAVEADNA ELMKMAEEAS   281
CeresClone:302736        E--------- ----SPEVVE LKAKLAEKDT EI AALTAENA ELKKQAEEAA   256

Consensus                EKE--SL--- ------E-E- LK--L---DT EI -AVKA--- EL-K-AEEA-   300

Lead-CeresClone156655    ---------- VSKVSRI GEE LEESRAKT-A HLKEKLESME EAKDALEAEM   256
CeresClone:1342938       ---------- ASKVSQI GEE LEESNETT-A KLKKKLESVE EAKETLEAEM   245
gi|51451351              HAVKET---- ATKARDTEHA LRESAAREAA RVAERLRASE RAREALEAEL   327
CeresClone:302736        EAAKKAEEGP ASRAAKAEHE LKEGAARE-A RVGEQLRASX XXRXALDGEL   305

Consensus                -A-K------ ASK-S-I --E LEESAAR--A R-KEKL---E EA-EALEAE-   350

Lead-CeresClone156655    KKLRVQTEQW RKAADAAAAV LSGEFEMNGR --DRSGSTEK YYAGGFFDPS   304
CeresClone:1342938       KKLKVQTEQW RKAADAAAAV LSGGVEMNGR FSEQCGSMEK HFAG------   289
gi|51451351              QRGRAQSEQW RKAAEEAAAV LAAVEHGAGA --PAADVEWR RHSS------   369
CeresClone:302736        RRLRVQTEQW RKAAEAAAAV LGGDNHLTGL ----AGN--- ----------   338

Consensus                K-LRVQTEQW RKAA-AAAAV LSG---MNGR ----AGS-EK --AG------   400

Lead-CeresClone156655    AGFMDPPGMA DDYDDGLGSG KRKSSG--MK MFGELWRKKG QK   344
CeresClone:1342938       -RFVGSPGMA DDSDDG--SG KRKSSG--KK MFGDLWKKKG QK   326
gi|51451351              -GAAAGERVA KDTDEHHVSG GKRNSGGAMR MLSELWKKKA QK   410
CeresClone:302736        -GWGSPATMP DDGDDEGFGG KRKGAG--I R VLGDLWKRKG SK   377

Consensus                -GF--PPGMA DD-DDG--SG KRKSSG--M- M-G-LWKKKG QK   442
```

```
gi|22854916          MLKQESN---  -WAQACDTCR  SAACTVYCRA  DSAYLCTSCD  AQIHAANRLA   46
gi|22854908          MLKQESN---  -WAQACDTCR  SAACTVYCRA  DSAYLCTSCD  AQIHAANRLA   46
gi|22854910          MLKQESN---  -WAQACDTCR  SAACTVYCRA  DSAYLCTSCD  AQIHAANRLA   46
gi|22854918          MLKQESN---  -WAQACDTCR  SAACTVYCRA  DSAYLCTSCD  AQIHAANRLA   46
gi|22854966          MLKQESN---  -WAQACDTCR  SAACTVYCRA  DSAYLCTSCD  AQIHAANRLA   46
gi|22854950          MLKQESN---  -WAQACDTCR  SAACTVYCRA  DSAYLCTSCD  AQIHAANRLA   46
gi|22854970          MLKQESN---  -WAQACDTCR  SAACTVYCRA  DSAYLCTSCD  AQIHAANRLA   46
gi|22854982          MLKQESN---  -WAQACDTCR  SAACTVYCRA  DSAYLCTSCD  AQIHAANRLA   46
gi|22854934          MLKQESN---  -WAQACDTCR  SAACTVYCRA  DSAYLCTSCD  AQIHAANRLA   46
gi|22854942          MLKQESN---  -WAQACDTCR  SAACTVYCRA  DSAYLCTSCD  AQIHAANRLA   46
Lead-CeresClone949   MLKEESNESG  TWARACDTCR  SAACTVYCEA  DSAYLCTTCD  ARVHAANRVA   50
gi|40787165          MLKEESNESG  -GTRACDTCR  SAACTIYREA  DSTYLCTTCD  ARVHAA----   45
gi|33943521          MLKEESNESG  -GTRACDTCR  SAACTIYREA  DSTYLCTTCD  ARVHAA----   45

Consensus            MLKQESN---  -WAQACDTCR  SAACTVYCRA  DSAYLCTSCD  AQIHAANRLA   50

gi|22854916          SRHERVRVCE  SCERAPAVFF  CQADAASLCT  ACDSQIHSAN  PLARRHQRVP   96
gi|22854908          SRHERVRVCE  SCERAPAAFF  CKADAASLCT  ACDSQIHSAN  PLARRHQRVP   96
gi|22854910          SRHERVRVCE  SCERAPAAFF  CKADAASLCT  ACDSQIHSAN  PLARRHQRVP   96
gi|22854918          SRHERVRVCE  SCERAPAAFF  CKADAASLCT  ACDSQIHSAN  PLARRHQRVP   96
gi|22854966          SRHERVRVCE  SCERAPAAFF  CKADAASLCT  ACDSQIHSAN  PLARRHQRVP   96
gi|22854950          SRHERVRVCE  SCERAPAAFF  CKADAASLCT  ACDSQIHSAN  PLARRHQRVP   96
gi|22854970          SRHERVRVCE  SCERAPAAFF  CKADAASLCT  ACDSQIHSAN  PLARRHQRVP   96
gi|22854982          SRHERVRVCE  SCERAPAAFF  CKADAASLCT  ACDSQIHSAN  PLARRHQRVP   96
gi|22854934          SRHERVRVCE  SCERAPAAFF  CKADAASLCT  ACDSQIHSAN  PLARRHQRVP   96
gi|22854942          SRHERVRVCE  SCERAPAAFF  CKADAASLCT  ACDSQIHSAN  PLARRHQRVP   96
Lead-CeresClone949   SRHERVRVCQ  SCESAPAAFL  CKADAASLCT  ACDAEIHSAN  PLARRHQRVP  100
gi|40787165          ---KRVRVCD  SCESAPAAFF  CKADAAPLCT  ACDAEIHSAN  PLARRHQRVP   92
gi|33943521          ---KRVRVCD  SCESAPAAFF  CKADAASLCT  ACDAEIHSAN  PLARRHQRVP   92

Consensus            SRHERVRVCE  SCERAPAAFF  CKADAASLCT  ACDSQIHSAN  PLARRHQRVP  100
```

```
gi|22854916         I LPI SGCVAT  NHHSSETTEP  ENI VVVGQEE  EDEAEAASWL  LPSSVKNCGD   146
gi|22854908         I LPI SGCVAT  NHHSSETTEP  ENI VVVGQEE  EDEAEAASWL  LPSSVKNCGD   146
gi|22854910         I LPI SGCVAT  NHHSSETTEP  ENI VVVGQEE  EDEAEAASWL  LPSSVKNCGD   146
gi|22854918         I LPI SGCVAT  NHHSSETTEP  ENI VVVGQEE  EDEAEAASWL  LPSSVKNCGD   146
gi|22854966         I LPI SGCVAT  NHHSSETTEP  ENI VVVGQEE  EDEAEAASWL  LPSSVKNCGD   146
gi|22854950         I LPI SGCVAT  NHHSSETTEP  ENI VVVGQEE  EDEAEAASWL  LPSSVKNCGD   146
gi|22854970         I LPI SGCVAT  NHHSSETTEP  ENI VVVGQEE  EDEAEAASWL  LPSSVKNCGD   146
gi|22854982         I LPI SGCVAT  N-HSSKTTEP  ENI VVVGQEE  EDEAEAASWL  LPSSVKNCGD   145
gi|22854934         I LPI SGCVAT  N-HSSKTTEP  ENI VVVGQEE  EDEAEAASWL  LPSSVKNCGD   145
gi|22854942         I LPI SGCVAT  NHHSSETTEP  ENI VVVGQEE  EDEAEAASWL  LPSSVKNCGD   146
Lead-CeresClone949  I LPLSANSCS   SMAPSETD--  ------ADND  EDDREVASWL  LPNPGKNIGN   142
gi|40787165         ITS-NSC---    --GSMATDGD  NNVMMVSEEK  EDADEVASWL  MLNP----GK   132
gi|33943521         ITS-NSC---    --GSMATDGD  NNVMMVSEEK  EDADEVASWL  MLNP----GK   132

Consensus           I LPI SGCVAT  NHHSSETTEP  ENI VVVGQEE  EDEAEAASWL  LPSSVKNCGD   150

gi|22854916         NN----NNTE  NNRFSVGEEY  LDLVDYSSSI  DKRFTGQTNQ  YQQDYNVPQR   192
gi|22854908         NN----NNTE  NNRFSVGEEY  LDLVDYSSSI  DKRFTGQTNQ  YQQDYNVPQR   192
gi|22854910         NN----NNTE  NNRFSVGEEY  LDLVDYSSSI  DKRFTGQTNQ  YQQDYNVPQR   192
gi|22854918         NN----NNTE  NNRFSVGEEY  LDLVDYSSSI  DKRFTGQTNQ  YQQDYNVPQR   192
gi|22854966         NN----NNTE  NNRFSVGEEY  LDLVDYSSSI  DKRFTGQTNQ  YQQDYNVPQR   192
gi|22854950         NN----NNTE  NNRFSVGEEY  LDLVDYSSSI  DKRFXGQTNQ  YQQDYNVPQR   192
gi|22854970         NN----NNTE  NNRFSVGEEY  LDLVDYSSSI  DKRFTGQTNQ  YQQDYNVPQR   192
gi|22854982         NNNNNNNNSE  NNRFSVGEEY  LDLVDYSSSI  DKRFTGQSNQ  YQQDYNVPQR   195
gi|22854934         NNNNNNNNSE  NNRFSVGEEY  LDLVDYSSSI  DKRFTGQSNQ  YQQDYNVPQR   195
gi|22854942         NN-NNNNNSE  NNRFSVGEEY  LDLVDYSSSM  DKRFTGQSNQ  YQQDYNVPQR   195
Lead-CeresClone949  QN--------  -NGFLFGVEY  LDLVDYSSSM  DNQFEDN---  ---QYTHYQR   177
gi|40787165         NN-------Q  NNGFLFGVEY  LDLVDYSSSI  DNQFEDQYNH  YQRSFGGGE-   174
gi|33943521         NN-------Q  NNGFLFGVEY  LDLVDYSSSI  DNQFEDQYSK  YHRSFGGGE-   174

Consensus           NN----NNTE  NNRFSVGEEY  LDLVDYSSSI  DKRFTGQTNQ  YQQDYNVPQR   200
```

```
gi|22854916          SYVADGVVPL QVGV-SKGHM HHEQHNFQFG FTNVSSEAHQ ISNGSPI HM-   240
gi|22854908          SYVADGVVPL QVGV-SKGHM HHEQHNFQFG FTNVSSEAHQ ISNGSPI HM-   240
gi|22854910          SYVADGVVPL QVGV-SKGHM HHEQHNFQFG FTNVSSEAHQ ISNGSPI HM-   240
gi|22854918          SYVADGVVPL QVGV-SKGHM HHEQHNFQFG FTNVSSEAHQ ISNGSPI HM-   240
gi|22854966          SYVADGVVPL QVGV-ANGHM HHEKHNFQFG FTNVSSEA-- ----SPI HM-   234
gi|22854950          SYVADGVVPL QVGV-ANGHM HHEKHNFQFG FTNVSSEA-- ----SPI HM-   234
gi|22854970          SYVADGVVPL QVGV-ANGHM HHEKHNFQFG FTNVSSEA-- ----SPI HM-   234
gi|22854982          SYVADGVVPL QVGV-ANGHM HHEQHNFQFG FTNVSSEA-- ----SPI HM-   237
gi|22854934          SYVADGVVPL QVGV-ANGHM HHEQHNFQFG FTNVSSEA-- ----SPI HM-   237
gi|22854942          SYVADGVVPL QVGV-ANGHM HHEQHNFQFG FTNVSSEA-- ----SPI HM-   237
Lead-CeresClone949   SFGGDGVVPL QVEE-STSHL QQSQQNFQLG INYGFSSGAH YNNNSLKDLN   226
gi|40787165          ----DGVVPL QLEE-STSHM QQSQHNFHLG VNYGFSTEPH YSY-------   212
gi|33943521          ----DGVVPL QLEESSTSHM QQSQHNFHLG VNYGYSTEPQ YSY-------   213

Consensus            SYVADGVVPL QVGV-S-GHM HHEQHNFQFG FTNVSSEA-- -S--SPI HM-   250

gi|22854916          ---------V SLVPESVTSD ATVSHQRSPK AGTEELPEAP VQM---LSPM   278
gi|22854908          ---------V SLVPESVTSD ATVSHQRSPK AGTEELPEAP VQM---LSPM   278
gi|22854910          ---------V SLVPESVTSD ATVSHQRSPK AGTEELPEAP VQM---LSPM   278
gi|22854918          ---------V SLVPESVTSD ATVSHQRSPK AGTEELPEAP VQM---LSPM   278
gi|22854966          ---------V SLVPESVTSD ATVSHPRSPK AGTEELPEAP VQM---LSPM   272
gi|22854950          ---------V SLVPESVTSD ATVSHPRSPK AGTEELPEAP VQM---LSPM   272
gi|22854970          ---------V SLVPESVTSD ATVSHPRSPK AGTEELPEAP VQM---LSPM   272
gi|22854982          ---------V SLVPESVTSD ATVSHPRSPK AGTEELPEAP VQM---LSPM   275
gi|22854934          ---------V SLVPESVTSD ATVSHPRSPK AGTEELPEAP VQM---LSPM   275
gi|22854942          ---------V SLVPESVTSD ATVSHPRSPK AGTEELPEAP VQM---LSPM   275
Lead-CeresClone949   HSASVSSMDI SVVPESTASD ITVQHPRTTK ETIDQLSGPP TQVVQQLTPM   276
gi|40787165          ---------I SVVPESTSSD TTVQH---AK ETMDQVSGPP TQMVQQLTPA   250
gi|33943521          ---------V SVVPESL-SD TTVQH---AK ETIDQVCGPP TQMVQQLTPA   250

Consensus            ---------V SLVPESVTSD ATVSHPRSPK AGTEELPEAP VQM---LSPM   300
```

| | | |
|---|---|---|
| gi\|22854916 | ERKARVLRYR EKKKTRKFEK RI RYASRKEY AEKRPRI KGR FAKR--NEVD | 326 |
| gi\|22854908 | ERKARVLRYR EKKKTRKFEK RI RYASRKEY AEKRPRI KGR FAXR--NEVD | 326 |
| gi\|22854910 | ERKARVLRYR EKKKTRKFEK RI RYASRKEY AEKRPRI KGR FAKR--NEVD | 326 |
| gi\|22854918 | ERKARVLRYR EKKKTRKFEK RI RYASRKEY AEKRPRI KGR FAKR--NEVD | 326 |
| gi\|22854966 | ERKARVLRYR EKKKTRKFEK RI RYASRKEY AEKRPRI KGR FAKR--NEVD | 320 |
| gi\|22854950 | ERKARVLRYR EKKKTRKFEK RI RYASRKEY AEKRPRI KGR FAKR--NEVD | 320 |
| gi\|22854970 | ERKARVLRYR EKKKTRKFEK RI RYASRKEY AEKRPRI KGR FAKR--NEVD | 320 |
| gi\|22854982 | ERKARVLRYR EKKKTRKFEK RI RYASRKEY AEKRPRI KGR FAKR--NEVD | 323 |
| gi\|22854934 | ERKARVLRYR EKKKTRKFEK RI RYASRKEY AEKRPRI KGR FAKR--NEVD | 323 |
| gi\|22854942 | ERKARVLRYR EKKKTRKFEK RI RYASRKEY AEKRPRI KGR FAKR--NEVD | 323 |
| Lead-CeresClone949 | EREARVLRYR EKKKTRKFDK TI RYASRKAY AEIRPRI KGR FAKRI ETEAE | 326 |
| gi\|40787165 | DREARVLRYR EKKKRRKFEK TI RYASRKAY AEVRPRI KGR FAKRI DMEAD | 300 |
| gi\|33943521 | DREARVLRYR EKKKRRKFEK TI RYASRKAY AEVRPRI KGR FAKRI DMEAD | 300 |
| Consensus | ERKARVLRYR EKKKTRKFEK RI RYASRKEY AEKRPRI KGR FAKR--NEVD | 350 |

| | | |
|---|---|---|
| gi\|22854916 | ADQAFPTVVM FDTGYGI VPS FS | 348 |
| gi\|22854908 | ADQAFPTVVM FDTGYGI VPS FS | 348 |
| gi\|22854910 | ADQAFPTVVM FDTRYGI VPS FS | 348 |
| gi\|22854918 | ADQAFPTVVM FDTGYGI VPS FS | 348 |
| gi\|22854966 | ANHALSTMVM SDTGYGI VPS FS | 342 |
| gi\|22854950 | ADHALSTMVM FDTGYGI VPS FS | 342 |
| gi\|22854970 | ADHALSTMVM FDTGYGI VPS FS | 342 |
| gi\|22854982 | ADHALSTMVM FDTGYGI VPS FS | 345 |
| gi\|22854934 | ADQALSTMVV FDTGYGI VPS FS | 345 |
| gi\|22854942 | ADHALSTMVV FDTGYGI VPS FS | 345 |
| Lead-CeresClone949 | AEEIFSTSLM SETGYGI VPS F- | 347 |
| gi\|40787165 | AEQLFSTSLM SNTSYGI VPS F- | 321 |
| gi\|33943521 | AEQLFSTSVM SNTSYGI VPS F- | 321 |
| Consensus | ADQAFSTMVM FDTGYGI VPS FS | 372 |

```
gi|42568400           MAANFWNSSH YKQLLDPEEV DVVHDLDKER GISIDDFKLI KFHMSNHIMK  50
gi|10177354           MAANFWNSSH YKQLLDPEEV DVVHDLDKER GISIDDFKLI KFHMSNHIMK  50
Lead-CeresClone2036   MASNFWTSTH YKELKDPEEV NVVHPLDAQR GISVEDFRLI KLHMSNYISK  50
CeresClone:463096     M--------- ---------- ---------- ---------- --HMANYILK   9
CeresClone:729756     MAANFWASSH SKQLLDPEDV DVVPAADRER GITIEEFRLV KIHMSSHIWR  50
gi|7489457            MAANFWTSSH CKQLLDQEDV DKVPQADSDR GITLEEFRLV KIHMSFHIWR  50
CeresClone:615259     MAANFWTSSH SKQLLDPEEV DVVPAQDRER GVTPVEFRLV KIHMSFHIWR  50
CeresClone:385771     MAANFWTSSH CKQLLDPEDV DLVPAADRER GITPEEFRLI KIHMSFHIWR  50

Consensus             MAANFWTSSH -KQLLDPEEV DVVP--DRER GITVEDFRLI KIHMSNHIW-  50

gi|42568400           LAQHKVRQR VVATAITYMR RVYIRKSMVE FEPRLVALTC LYLASKAEES  100
gi|10177354           LAQHIKVRQR VVATAITYMR RVYIRKSMVE FEPRLVALTC LYLASKAEES  100
Lead-CeresClone2036   LAQHIKIRQR VVATAVTYMR RVYTRKSLTE YEPRLVAPTC LYLACKAEES  100
CeresClone:463096     LAQQVKVRQR VVATAVTYMR RVYTRKSMAE YDPRLVAPTC LYLASKAEES   59
CeresClone:729756     LAQQVKVRQR VIATAITYFR RVYTRKSMSE YDPRLVAPAC LYLASKVEES  100
gi|7489457            LAQQVKVRQR VIATAVTYFR RVYTRKSMTE YDPRLVAPTC LYLASKVEES  100
CeresClone:615259     LAQQVKVRQR VIATAITYFR CVYTRKSMTE YDPRLVAPAC LYLASKVEES  100
CeresClone:385771     LAQQVKVRQR VVATAISYFR RVYTRKSMSD YDPRLVAPTC LYLASKVEES  100

Consensus             LAQQVKVRQR VVATAITY-R RVYTRKSM-E YDPRLVAPTC LYLASK-EES  100

gi|42568400           IVQARNLVFY IKRLY----- -PDEYNKYEL KDILGMEMKV LEALDYYLVV  144
gi|10177354           IVQARNLVFY IKRLCNIFFF YPDEYNKYEL KDILGMEMKV LEALDYYLVV  150
Lead-CeresClone2036   VVHAKLLVFY MKKLY----- -ADEKFRYEI KDILEMEMKV LEALNFYLVV  144
CeresClone:463096     TVQARLLVFY IKKLY----- -SDDKYRYEI KDILXMEMKI LEALNYYLVV  103
CeresClone:729756     TVQARLLVFY IKKMCA---- GSDDKYRFEI KDILEMEMKL LEALDYYLVV  146
gi|7489457            TVQARLLVFY IKKMC----- ASDEKYRFEI KDILEMEMKL LEALDYYLVV  145
CeresClone:615259     TVQARLLVFY IKKMC----- GSDDKYRFEI KDILEMEMKL LEALDYYLVV  145
CeresClone:385771     TVQARLLVFY IKKMC----- GSDDKYRFEI KDILEMEMKL LEALDYYLVV  145

Consensus             TVQARLLVFY IKK-C----- -SD-KYR-EI KDILEMEMKI LEALDYYLVV  150
```

```
gi|42568400             FHPYRSLSEF LQDAALNDVN MNQITWGIVN DTYKMDLILV HPPYRIALAC  194
gi|10177354             FHPYRSLSEF LQDAALNDVN MNQITWGIVN DTYKMDLILV HPPYRIALAC  200
Lead-CeresClone2036     FHPYRSLPEF LQDSGINDTS MTHLTWGLVN DTYRMDLILI HPPFLIILAC  194
CeresClone:463096       YHPYRSLVPL LQDAGLNDLN MTQLTWGLVN DTYKMDLILV HPPHLIALAC  153
CeresClone:729756       YHPYRPLLHL LQDAGVTD-- LTQFAWGLVN DTYKMDLILV QPPYMIALAC  194
gi|7489457              YHPYRPLLQL LQDAGITD-- LTQFAWGIVN DTYKMDLILI HPPYMIALAC  193
CeresClone:615259       YHPYRPLLQL LQDAGITD-- LTQFAWGLVN DTYKMDLILI YPPYMIALAC  193
CeresClone:385771       FHPYRPLLQL LQDAGITD-- LTQFAWGLVN DTYKMDLILI YPPYMIALAC  193

Consensus               -HPYR-LL-L LQDAGI-D-N -TQ--WGLVN DTYKMDLIL- HPPYMIALAC  200

gi|42568400             IYIASVHREK DITAWFEDLH EDMNLVKNIA MEILDFYENY RI------TE  239
gi|10177354             IYIASVHREK DITAWFEDLH EDMNLVKNIA MEILDFYENY RI------TE  245
Lead-CeresClone2036     IYIASVHKEK DIKTWFEELS VDMNIVKNIA MEILDFYENH RL------FTE  239
CeresClone:463096       IYIASVLREK DTTAWFEELR VDMNVVKNIS MEILDFYESN RM------FTD  198
CeresClone:729756       IYIASVLKDK DTTSWFEELH VDMNIVKNIS MEILDFYETY KVDPQRGLSD  244
gi|7489457              IYIASVLKDK DITLWFEELR VDMNIVKNIS MEILDFYDTY KIDPQRGLPE  243
CeresClone:615259       IYIASVLKDK DTTSWFEELR VDMNIVKNIS MEILDFYDTY KIDPQRGLQE  243
CeresClone:385771       IYIASVLKDK DTTAWFEELR VDMNIVKNIS MEILDFYDTY KIDPQRGIPE  243

Consensus               IYIASVLK-K D-TAWFEELR VDMNIVKNIS MEILDFYETY -IDPQRG-TE  250

gi|42568400             EKVNSAFSKL ALKL  253
gi|10177354             EKVNSAFSKL ALKL  259
Lead-CeresClone2036     ERVHAAFNKL ATNP  253
CeresClone:463096       ERINAALQKL SLRP  212
CeresClone:729756       EKISPIMNKL PAKA  258
gi|7489457              DKIAPVMNKL PSKA  257
CeresClone:615259       DKIIPVMNKL PSKA  257
CeresClone:385771       DKISPVMNKL PAKA  257

Consensus               EKIN--MNKL --KA  264
```

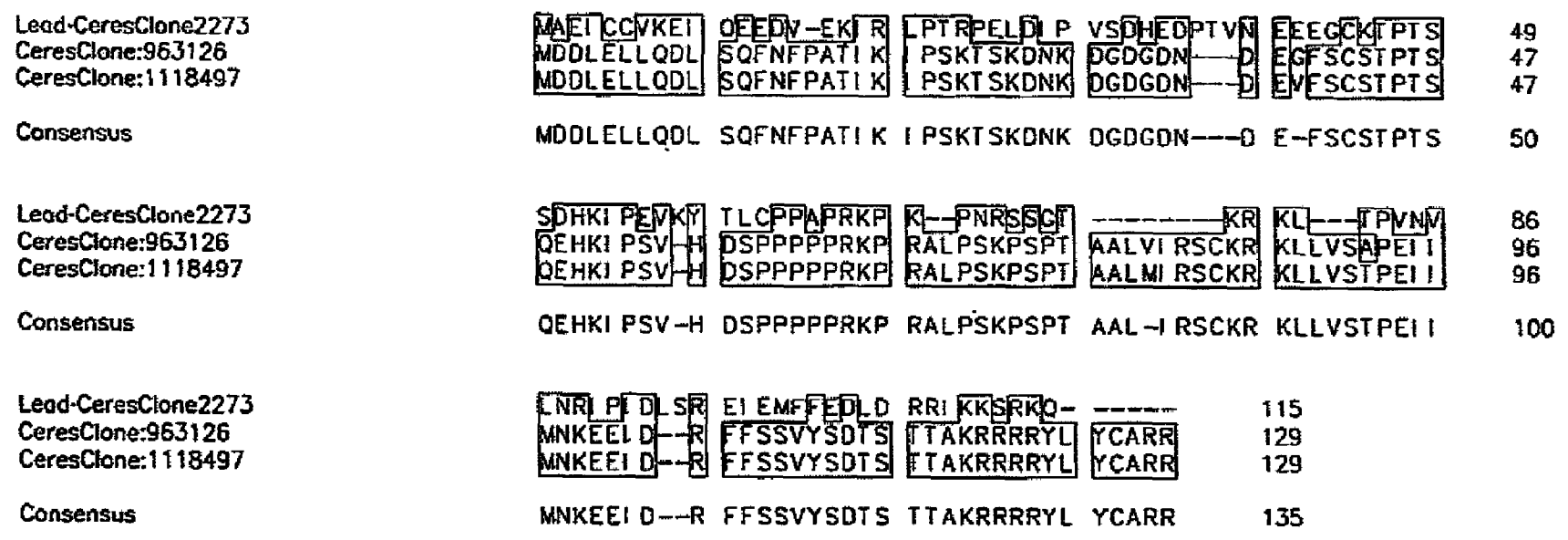

```
Lead-CeresClone2273   MAEICCVKEI OEEDV-EKI R LPTRPELDI P VSDHEDPTVN EEEGCKTPTS   49
CeresClone:963126     MDDLELLQDL SQFNFPATI K I PSKTSKDNK DGDGDN---D EGFSCSTPTS   47
CeresClone:1118497    MDDLELLQDL SQFNFPATI K I PSKTSKDNK DGDGDN---D EVFSCSTPTS   47

Consensus             MDDLELLQDL SQFNFPATI K I PSKTSKDNK DGDGDN---D E-FSCSTPTS   50

Lead-CeresClone2273   SDHKI PEVKY TLCPPAPRKP K--PNRSSCT ---------KR KL---TPVNV   86
CeresClone:963126     QEHKI PSV-H DSPPPPPRKP RALPSKPSPT AALVI RSCKR KLLVSAPEI I   96
CeresClone:1118497    QEHKI PSV-H DSPPPPPRKP RALPSKPSPT AALMI RSCKR KLLVSTPEI I   96

Consensus             QEHKI PSV-H DSPPPPPRKP RALPSKPSPT AAL-I RSCKR KLLVSTPEI I   100

Lead-CeresClone2273   LNRI PI DLSR EI EMFFEDLD RRI KKSRKQ- -----   115
CeresClone:963126     MNKEEI D--R FFSSVYSDTS TTAKRRRRYL YCARR   129
CeresClone:1118497    MNKEEI D--R FFSSVYSDTS TTAKRRRRYL YCARR   129

Consensus             MNKEEI D--R FFSSVYSDTS TTAKRRRRYL YCARR   135
```

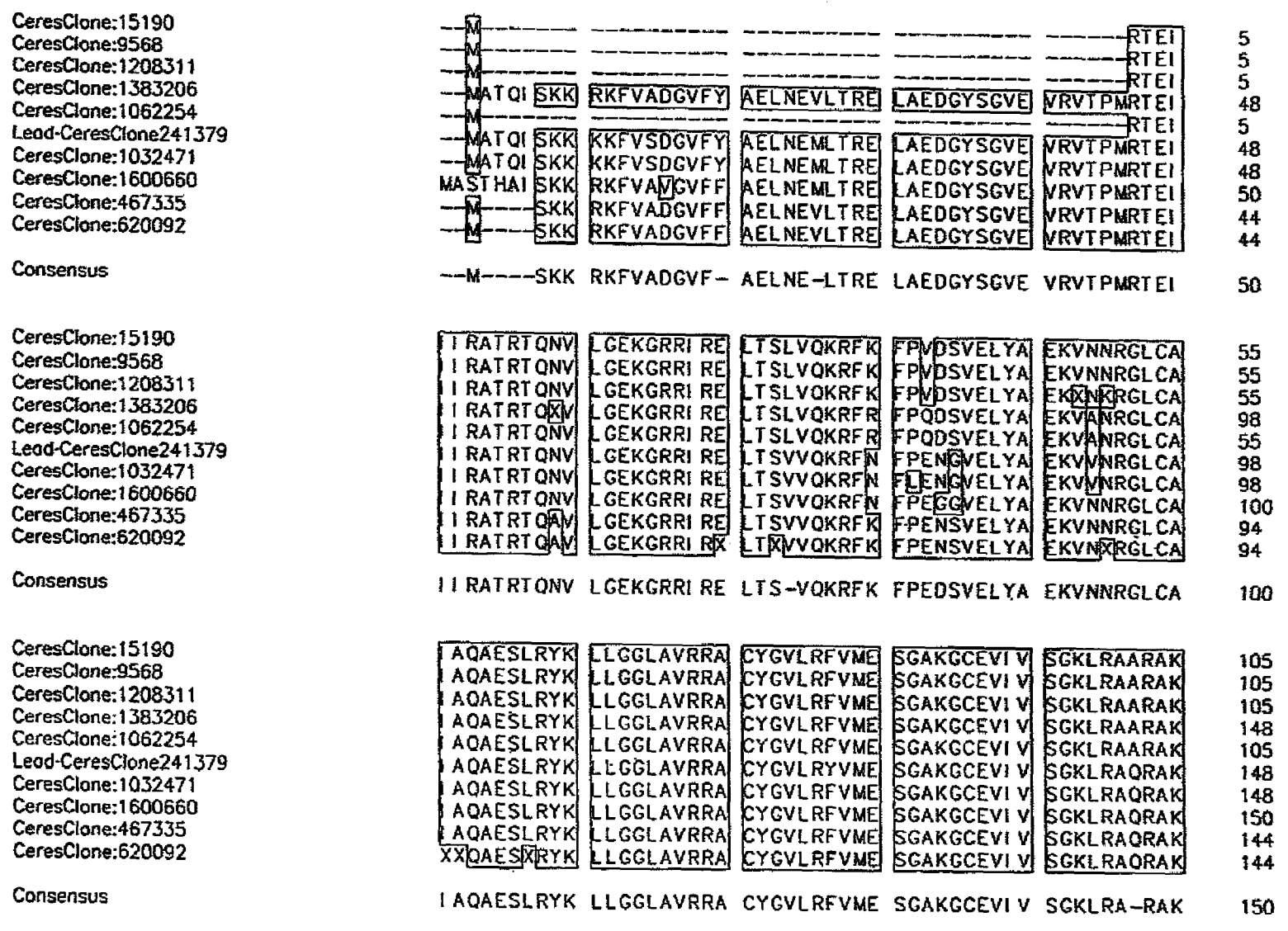

```
CeresClone:15190          --M------- ---------- ---------- ---------- ------RTEI   5
CeresClone:9568           --M------- ---------- ---------- ---------- ------RTEI   5
CeresClone:1208311        --M------- ---------- ---------- ---------- ------RTEI   5
CeresClone:1383206        --MATQISKK RKFVADGVFY AELNEVLTRE LAEDGYSGVE VRVTPMRTEI   48
CeresClone:1062254        --M------- ---------- ---------- ---------- ------RTEI   5
Lead-CeresClone241379     --MATQISKK KKFVSDGVFY AELNEMLTRE LAEDGYSGVE VRVTPMRTEI   48
CeresClone:1032471        --MATQISKK KKFVSDGVFY AELNEMLTRE LAEDGYSGVE VRVTPMRTEI   48
CeresClone:1600660        MASTHAISKK RKFVAVGVFF AELNEMLTRE LAEDGYSGVE VRVTPMRTEI   50
CeresClone:467335         --M----SKK RKFVADGVFF AELNEVLTRE LAEDGYSGVE VRVTPMRTEI   44
CeresClone:620092         --M----SKK RKFVADGVFF AELNEVLTRE LAEDGYSGVE VRVTPMRTEI   44

Consensus                 --M----SKK RKFVADGVF- AELNE-LTRE LAEDGYSGVE VRVTPMRTEI   50

CeresClone:15190          IIRATRTQNV LGEKGRRIRE LTSLVQKRFK FPVDSVELYA EKVNNRGLCA   55
CeresClone:9568           IIRATRTQNV LGEKGRRIRE LTSLVQKRFK FPVDSVELYA EKVNNRGLCA   55
CeresClone:1208311        IIRATRTQNV LGEKGRRIRE LTSLVQKRFK FPVDSVELYA EKXNKRGLCA   55
CeresClone:1383206        IIRATRTQXV LGEKGRRIRE LTSLVQKRFR FPQDSVELYA EKVANRGLCA   98
CeresClone:1062254        IIRATRTQNV LGEKGRRIRE LTSLVQKRFR FPQDSVELYA EKVANRGLCA   55
Lead-CeresClone241379     IIRATRTQNV LGEKGRRIRE LTSVVQKRFN FPENGVELYA EKVVNRGLCA   98
CeresClone:1032471        IIRATRTQNV LGEKGRRIRE LTSVVQKRFN FLENGVELYA EKVVNRGLCA   98
CeresClone:1600660        IIRATRTQNV LGEKGRRIRE LTSVVQKRFN FPEGGVELYA EKVNNRGLCA   100
CeresClone:467335         IIRATRTQAV LGEKGRRIRE LTSVVQKRFK FPENSVELYA EKVNNRGLCA   94
CeresClone:620092         IIRATRTQAV LGEKGRRIRX LTXVVQKRFK FPENSVELYA EKVNXRGLCA   94

Consensus                 IIRATRTQNV LGEKGRRIRE LTS-VQKRFK FPEDSVELYA EKVNNRGLCA   100

CeresClone:15190          IAQAESLRYK LLGGLAVRRA CYGVLRFVME SGAKGCEVIV SGKLRAARAK   105
CeresClone:9568           IAQAESLRYK LLGGLAVRRA CYGVLRFVME SGAKGCEVIV SGKLRAARAK   105
CeresClone:1208311        IAQAESLRYK LLGGLAVRRA CYGVLRFVME SGAKGCEVIV SGKLRAARAK   105
CeresClone:1383206        IAQAESLRYK LLGGLAVRRA CYGVLRFVME SGAKGCEVIV SGKLRAARAK   148
CeresClone:1062254        IAQAESLRYK LLGGLAVRRA CYGVLRFVME SGAKGCEVIV SGKLRAARAK   105
Lead-CeresClone241379     IAQAESLRYK LLGGLAVRRA CYGVLRYVME SGAKGCEVIV SGKLRAQRAK   148
CeresClone:1032471        IAQAESLRYK LLGGLAVRRA CYGVLRFVME SGAKGCEVIV SGKLRAQRAK   148
CeresClone:1600660        IAQAESLRYK LLGGLAVRRA CYGVLRFVME SGAKGCEVIV SGKLRAQRAK   150
CeresClone:467335         IAQAESLRYK LLGGLAVRRA CYGVLRFVME SGAKGCEVIV SGKLRAQRAK   144
CeresClone:620092         XXQAESXRYK LLGGLAVRRA CYGVLRFVME SGAKGCEVIV SGKLRAQRAK   144

Consensus                 IAQAESLRYK LLGGLAVRRA CYGVLRFVME SGAKGCEVIV SGKLRA-RAK   150
```

```
CeresClone:15190           SMKFKDGYMV SSGQPTKEYI DAAVRHVLLR QGVLGIKVKI MLDWDPTGKS  155
CeresClone:9568            SMKFKDGYMV SSGQPTKEYI DSAVRHVLLR QGVLGIKVKV MLDWDPKGIS  155
CeresClone:1208311         SMKFKXGYMV SSGQPTKEYI DSAVRHVLLR QGVLGIKVKV MLDWDPKGIS  155
CeresClone:1383206         SMKFKDGYMV SSGQPTKEYI DSAVRHVLLR QGVLGIKVKV MLDWDPKGVT  198
CeresClone:1062254         SMKFKDGYMV SSGQPTKDYI DSAVRHXLLR QGVLGIKVKV MLDWDPKGIN  155
Lead-CeresClone241379      SMKFKDGYMI SSGQPVNEYI DSAVRHVLLR QGVLGIKVKI MLDWDPKGKV  198
CeresClone:1032471         SMKFKDGYMI SSGQPVNEYI DAAVRHVLLR QGVLGIKVKI MLDWDPKGKL  198
CeresClone:1600660         SMKFKDGYMI SSGHPVNLYI DSAVRHVLLR QGVLGIKVKI MLDWDPKGKQ  200
CeresClone:467335          SMKFKDGYMI FSGQPVKDYI DSAVRHVLLR QGVLGIKVKI MLDWDPKGKQ  194
CeresClone:620092          SMKFKDGYMI SSGQPVKDYI DSAVRHVLLR QGVLGIKVKI MLDWDPKGKQ  194

Consensus                  SMKFKDGYM- SSGQP-KEYI DSAVRHVLLR QGVLGIKVKI MLDWDPKGKS  200

CeresClone:15190           GPKTPLPDVV IIHAPKDDVV YSAPAQAAAP VTLVQEAPLT TVDYPEMIPP  205
CeresClone:9568            GPKTPLPDVV IIHSPKEEEA IYAPAQVAAP AALVADAPLT AVDYPAMI-P  204
CeresClone:1208311         GPKTPLPDVV IIHSPKEEEA IYAPAQVAAP AALVADAPLT AVDYPAMI-P  204
CeresClone:1383206         GPKTPLPDVV IIHSPKEEEV NSAPAQVDAP AAFVPEAPLT AVDYPEMI-P  247
CeresClone:1062254         GPKTPLPDVV IIHAPKEEDV NSAPAQVAAP AALAPEAPLT AVDYPEMI-P  204
Lead-CeresClone241379      GPTTPLPDLV TIHTPKDEDE -PRPPVLAPP EV-------- ----------  229
CeresClone:1032471         GPTTPLPDLV TIHPPKEENE LRPPALVEV- ---------- ----------  227
CeresClone:1600660         GPTMPLPDLV TIHVPKEEDE FLRPLAAEIQ VA-------- ----------  232
CeresClone:467335          GPKTPLPDLV TIHTPKEEEE YARPAAVLAT NIEVPVAS-- ----------  232
CeresClone:620092          GPKTPLPDLV TIHSPKXEEE YIQPA----- ---------- ----------  219

Consensus                  GPKTPLPD-V -IHSPKEEEE --APAQVAAP -A-V-EAPLT -VDYP-MI-P  250

CeresClone:15190           VA   207
CeresClone:9568            VA   206
CeresClone:1208311         VA   206
CeresClone:1383206         VA   249
CeresClone:1062254         VA   206
Lead-CeresClone241379      --   229
CeresClone:1032471         --   227
CeresClone:1600660         --   232
CeresClone:467335          --   232
CeresClone:620092          --   219

Consensus                  VA   252
```

| | | | | | | |
|---|---|---|---|---|---|---|
| CeresClone:470787 | MQSMSTTMAS | FSPPTHFSAT | PSSSKPRLVY | KNNFFFSLRS | RSLSLSPLKA | 50 |
| CeresClone:29150 | ---M------ | ---------- | ---------- | ---------- | ---------- | 1 |
| CeresClone:1334525 | ---M------ | ---------- | ---------- | ---------- | ---------- | 1 |
| CeresClone:872284 | ---M------ | ---------- | ---------- | ---------- | ---------- | 1 |
| Lead-CeresClone159318 | ---MSISMAL | FSPPISSSLQ | NPNLIPKIST | S-----LLST | KRFSLISVPR | 42 |
| Consensus | ---M------ | ---------- | ---------- | ---------- | ---------- | 50 |
| CeresClone:470787 | AASENGVGTA | VEPPPEQA-- | ----VPVPEP | SLPPVDNSSV | GTNGSAVAVE | 94 |
| CeresClone:29150 | ---------- | ---------- | ---------- | ---------- | --------KT | 3 |
| CeresClone:1334525 | ---------- | ---------- | ---------- | ---------- | --------KT | 3 |
| CeresClone:872284 | ---------- | ---------- | ---------- | ---------- | ---------- | 1 |
| Lead-CeresClone159318 | ASSDNGTTSP | VVKIPKPASV | AVEEVPVKSP | AESSSASENG | AVGGEATDSS | 92 |
| Consensus | ---------- | ---------- | ---------- | ---------- | ---------T | 100 |
| CeresClone:470787 | SEVVKVQSSF | VDPRWVAGTW | DLKQFQKNGT | TDWDAVIDAE | ARRRKWLEDN | 144 |
| CeresClone:29150 | TESV---IKF | QDARWINGTW | DLKQFEKDGK | TDWDSVIVAE | AKRRKWLEEN | 50 |
| CeresClone:1334525 | TESV---IKF | QDARWINGTW | DLKQFEKDGK | TDWDSVIVAE | AKRRKWLEEN | 50 |
| CeresClone:872284 | ---------- | ---------- | ---------- | ---------- | ---------- | 1 |
| Lead-CeresClone159318 | TETV---IKY | QNAKWVNGTW | DLKQFEKDGK | TDWDSVIVSE | AKRRKWLEDN | 139 |
| Consensus | TESV---IKF | QDARW-NGTW | DLKQFEKDGK | TDWDSVIVAE | AKRRKWLE-N | 150 |
| CeresClone:470787 | PESSSNENPV | VFDTSIVPWW | AWMKRFHLPE | AELLNGRAAM | IGFFMAYFVD | 194 |
| CeresClone:29150 | PETTSNDEPV | LFDTSIIPWW | AWIKRYHLPE | AELLNGRAAM | IGFFMAYFVD | 100 |
| CeresClone:1334525 | PETTSNDEPV | LFDTSIIPWW | AWIKRYHLPE | AELLNGRAAM | IGFFMAYFVD | 100 |
| CeresClone:872284 | ---------- | ---------- | ---KRYHLPE | AELLNGRAAM | IGFFMAYFVD | 28 |
| Lead-CeresClone159318 | PETTSNDELV | VFDTSIIPWW | AWMKRYHLPE | AELLNGRAAM | IGFFMAYFVD | 189 |
| Consensus | PETTSNDEPV | -FDTSIIPWW | AW-KRYHLPE | AELLNGRAAM | IGFFMAYFVD | 200 |

```
CeresClone:470787          SLTGVGLVDQ MSNFFCKTLL FVAVLGVLLI RKNEDLENLK KLFDETTLYD   244
CeresClone:29150           SLTGVGLVDQ MGNFFCKTLL FVAVAGVLFI RKNEDVDKLK NLFDETTLYD   150
CeresClone:1334525         SLTGVGLVDQ MGNFFCKTLL FVAVAGVLFI RKNEDVDKLK NLFDETTLYD   150
CeresClone:872284          SLTGVGLVDQ MGNFFCKTLL FVAVAGVLFI RKNEDLDKLK GLIEETTLYD   78
Lead-CeresClone159318      SLTGVGLVDQ MGNFFCKTLL FVAVAGVLFI RKNEDLDKLK DLFDETTLYD   239

Consensus                  SLTGVGLVDQ MGNFFCKTLL FVAVAGVLFI RKNEDLDKLK NLFDETTLYD   250
```

```
CeresClone:470787          KQWQATWQDE N-------SSI SKNE   262
CeresClone:29150           KQWQAAWKND D-----DESLG SKKK   170
CeresClone:1334525         KQWQAAWKND D-----DESLG SKKK   170
CeresClone:872284          KQWQAAWKEP ESSSSSSTVS SKK-   101
Lead-CeresClone159318      KQWQAAWKEP D-----SSTVS SKK-   258

Consensus                  KQWQAAWK-D D-------S-S SKKK   274
```

```
Lead-CeresClone153053   ---MSI SMAL FSPPI-----S SSLQNPNLI P KI STSL--ST KRFSLI SVPR   42
CeresClone:470787       MQSMSTTMAS FSPPTHFSAT PSSSKPRLVY KNNFFFSLRS RSLSLSPLKA     50

Consensus               MQSMS--MA- FSPP-HFSA- -S---P-L-- K------SL-- ---SL-----    50

Lead-CeresClone153053   ASSDNGTTSP VVKI PKPASV AVEEVPVKSP AESSSASENG AVGGEATDSS   92
CeresClone:470787       AASENGVGTA VEPPPEQA-V PVPE-PSLPP VDNSSVGTNG SAVAVESE-V     97

Consensus               A-S-NG---- V---P--ASV -V-EVP---P ---SS---NG ---------S-   100

Lead-CeresClone153053   TETVI KYQNA KWVNGTWDLK QFEKDGKTDW DSVI VSEAKR RKWLEDNPET  142
CeresClone:470787       VKVQSSFVDP RWVAGTWDLK QFQKNGTTDW DAVI DAEARR RKWLEDNPES   147

Consensus               ---------- -WV-GTWDLK QF-K-G-TDW D-VI --EA-R RKWLEDNPE-   150

Lead-CeresClone153053   TSNDELVVFD TSI I PWWAWM KRYHLPEAEL LNGRAAMI GF FMAYFVDSLT 192
CeresClone:470787       SSNENPVVFD TSI VPWWAWM KRFHLPEAEL LNGRAAMI GF FMAYFVDSLT  197

Consensus               -SN---VVFD TSI -PWWAWM KR-HLPEAEL LNGRAAMI GF FMAYFVDSLT  200

Lead-CeresClone153053   GVGLVDQMGN FFCKTLLFVA VAGVLFI RKN EDLDKLKDLF DETTLYDKQW   242
CeresClone:470787       GVGLVDQMSN FFCKTLLFVA VLGVLLI RKN EDLENLKKLF DETTLYDKQW   247

Consensus               GVGLVDQM-N FFCKTLLFVA V-GVL-I RKN EDL--LK-LF DETTLYDKQW   250

Lead-CeresClone153053   QAAWKEPDSS TVSSKK    258
CeresClone:470787       QATWQDENSS TSKNE-    262

Consensus               QA-W----SS T----K    266
```

```
Lead-CeresClone39351   MAATSLTAPP SFSGLRRISP KLDAAAVSSH QSFFHRVNSS TRLVSSSSSS  50
CeresClone:1016565     ---------- ---------- ---------- ---------- ----------   0
CeresClone:687466      MAAAPSSLVS SH--LSRLAD LRRAAAPAT- ---------PT VPQQLRVGCS  39
CeresClone:343468      MAAAPSSLAS SH--LSPI-- -----AAVST- ---------PA VPHQLRIGCS  33
CeresClone:463478      ---------- ---------- ---------- ---------- ----------   0
CeresClone:1058593     ---------- ---------- ---------- ---------- ----------   0
CeresClone:985017      ---------- ---------- ---------- ---------- ----------   0
CeresClone:213850      ---------- ---------- ---------- ---------- ----------   0

Consensus              ---------- ---------- ---------- ---------- ----------  50

Lead-CeresClone39351   HRSPRGVVAM AGSGKFFVGG NWKCNGTKDS IAKLISDLNS ATLEAD--VD  98
CeresClone:1016565     ---------M AGSGKFFVGG NWKCNGTKES ISKLVSDLNA ATLESD--VD  39
CeresClone:687466      RRRAQRVVAM AGSGKFFVGG NWKCNGTKDS VSKLVSELNA ATLETD--VD  87
CeresClone:343468      RRRAGRIVAM AGSGKFFVGG NWKCNGTKDS ISKLVSELNA ATLETD--VD  81
CeresClone:463478      ---------- -MGRKFFVGG NWKCNGTTEE VKKIVTTLNE AKVPGEDVVE  39
CeresClone:1058593     ---------- -MGRKFFVGG NWKCNGTVEQ VESIVNTLNA GQIASTDVVE  39
CeresClone:985017      ---------- -MGRKFFVGG NWKCNGTTDQ VEKIVKTLNE GQVPPSDVVE  39
CeresClone:213850      ---------- -MGRKFFVGG NWKCNGTADQ VEKIVKTLNE GNVPSSDVVE  39

Consensus              ---------M A---KFFVGG NWKCNGTKD- V-K-VS-LNA ATLESDDVV- 100

Lead-CeresClone39351   VVVSPPFVYI DQVKSSLTDR IDISGQNSWV GKGGAFTGEI SMEQLKDLGC 148
CeresClone:1016565     VVVAPPFIYI DQVKSSLTGR IEVSAQNTWI GKGGAFTGEI SAEQLVDIGC  89
CeresClone:687466      VVVAPPFIYI DQVKNSLTGR IEVSAQNVWI GKGGAYTGEI SAEQLVDIGC 137
CeresClone:343468      VVVAPPFIYI DQVKNSLTGR IEVSAQNVWI GKGGAYTGEI SAEQLVDIGC 131
CeresClone:463478      VVVSPPFVFL PFVKSLLRPD FHVSAQNCWV RKGGAYTGEV SAEMLVNLGI  89
CeresClone:1058593     VVVSPPYVFL PTVKCKLRPE IQVAAQNCWV KKGGAFTGEV SAEMLVNLGV  89
CeresClone:985017      VVVSPPYVFL PVVKSQLRQE FHVAAQNCWV KKGGAFTGEV SAEMLVNLGV  89
CeresClone:213850      VVVSPPYVFL PVVKSQLRQE FQVAAQNCWV KKGGAFTGEI SAEMLVNLGV  89

Consensus              VVVSPPFV-- -QVKSSL--- IEVSAQNCWV -KGGAFTGEI SAE-LV-LG- 150
```

```
Leod-CeresClone39351   KWVILGHSER RHVIGEKDEF IGKKAAYALS EGLGVIACIG EKLEEREAGK  198
CeresClone:1016565     QWVILGHSER RHVIGEDDEF IGKKAAYALS QNLKVMACIG ELLEEREAGK  139
CeresClone:687466      QWVILGHSXR RHIIGENDEF IGKKAAYALS QNVKVIACIG ELLEEREAGK  187
CeresClone:343468      QWVILGHSER RHIIGENDEF IGKKAAYALS HCVGVIACIG ELLEEREAGK  181
CeresClone:463478      PWVIIGHSER RQLLNESNEF VGDKVAYALQ QGLKVIACIG ETLEQREAGT  139
CeresClone:1058593     PWVILGHSER RSLMGESSEF VGEKVAYALA QGLKVIACVG ETLEQREXGS  139
CeresClone:985017      PWVILGHSER RALLGESNEF VGDKVAYALS QGLKVIACVG ETLEQREAGS  139
CeresClone:213850      PWVILGHSER RALLGESNEF VGDKVAFALS QGLKVIACVG ETLEEREAGS  139

Consensus              -WVILGHSER RHIIGESDEF -GKK-AYALS QGLKVIACIG ETLEEREAG-  200

Leod-CeresClone39351   TFDVCFAQLK AFADAVPSWD NIVVAYEPVW AIGTGKVASP QQAQEVHVAV  248
CeresClone:1016565     TFDVCFKQMK AFADNITDWT NVVIAYEPVW AIGTGKVASP EQAQEVHAAV  189
CeresClone:687466      TFEVCFEQMK AFADSISNWA DVVIAYEPVW AIGTGKVATP EQAQEVHAAV  237
CeresClone:343468      TFEVCFEQMK AFADSISNWA DVVIAYEPVW AIGTGKVATP EQAQEVHAAV  231
CeresClone:463478      TTAVVAEQTK AIAAKISNWD NVVLAYEPVW AIGTGKVATP AQAQEVHADL  189
CeresClone:1058593     XMAVVXEQXK AIAGKIKDWT NVVVAYEPVW AIGTGKVATP XQAQEVHANL  189
CeresClone:985017      TMEVVAAQTK AIAEKIKDWS NVVVAYEPVW AIGTGKVATP AQAQEVHASL  189
CeresClone:213850      TMDVVAAQTK AIAEKIKDWS NVVLAYEPVW AIGTGKVATP AQAQEVHASL  189

Consensus              TF-V-FEQMK A-AD-ISDW- NVV-AYEPVW AIGTGKVATP EQAQEVHAA-  250

Leod-CeresClone39351   RGWLKKNVSE EVASKTRIIY GGSVNGGNSA ELAKEEDIDG FLVGGASLKG  298
CeresClone:1016565     RDWLKTNVSA DVASTVRIIY GGSVNAANCA ELAKKEDIDG FLVGGASLKG  239
CeresClone:687466      RDWLTINISP DVASSTRIIY GGSVNAANCA ELSKKEDIDG FLVGGASLKA  287
CeresClone:343468      RDWLTINISP DVASSTRIIY GGSVNAANCA ELAKKEDIDG FLVGGASLKA  281
CeresClone:463478      RKWVHDNVSA EVAASVRIIY GGSVNGGNCK ELAAQPDVDG FLVGGASLK-  238
CeresClone:1058593     RDWLKTNVSP EVAESTRIIY GGSVTGASCK ELAGQPDVDG FLVGGASLK-  238
CeresClone:985017      RDWLKTNVSP EVAESTRIIY GGSVTAANCK ELAAQPDVDG FLVGGASLK-  238
CeresClone:213850      RDWVKFNVSP EVSESTRIIY GGSVTAANCK ELAAQPDVDG FLVGGASLK-  238

Consensus              RDWLKTNVSP EVASSTRIIY GGSVNAANC- ELAKQ-D-DG FLVGGASLK-  300
```

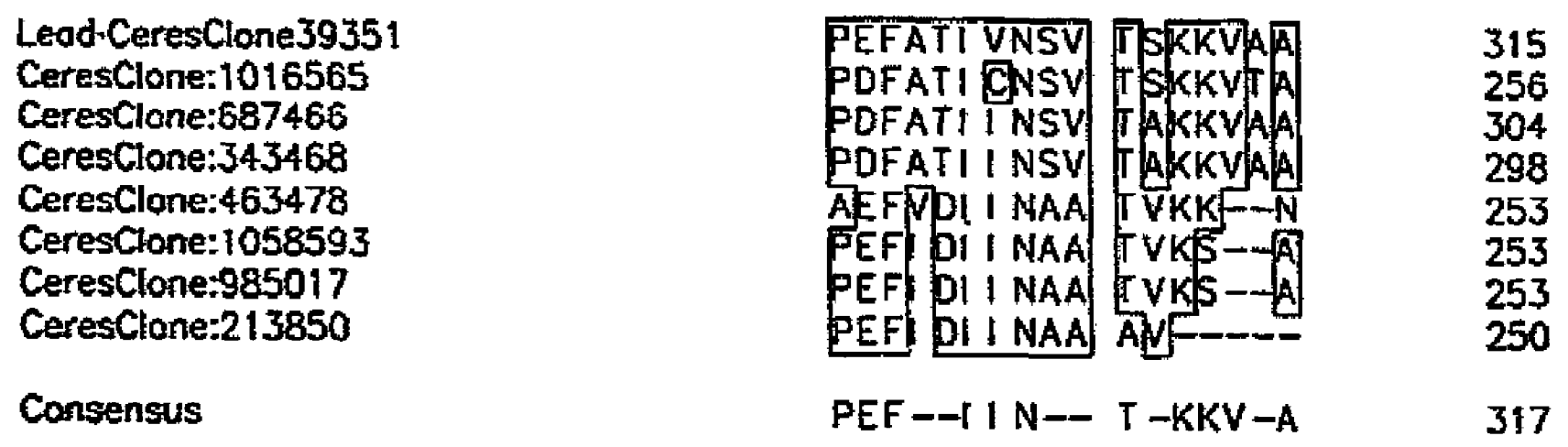

| | | |
|---|---|---|
| Lead-CeresClone39351 | PEFATI VNSV TSKKVAA | 315 |
| CeresClone:1016565 | PDFATI CNSV TSKKVTA | 256 |
| CeresClone:687466 | PDFATI I NSV TAKKVAA | 304 |
| CeresClone:343468 | PDFATI I NSV TAKKVAA | 298 |
| CeresClone:463478 | AEFVDI I NAA TVKK--N | 253 |
| CeresClone:1058593 | PEFIDI I NAA TVKS--A | 253 |
| CeresClone:985017 | PEFIDI I NAA TVKS--A | 253 |
| CeresClone:213850 | PEFIDI I NAA AV----- | 250 |
| Consensus | PEF--I I N-- T-KKV-A | 317 |

```
CeresClone:764831        MALALRCPAA ASPS------ ------RAPFP NSSSHSQSAA RPARRPAGGC   39
gi|50932981              MALALRCPAA ASPSP----- -----AKSTFP PSSSPPPS-R LPRR-PPASC   39
CeresClone:381453        MALALRCPPA ATSS------ ------RSPFL PSTSPAPAGK VPRR-PPASW   38
Lead-CeresClone38625     MATALVSPLT SQLNHEAVCS KFVLPKSPFI SGSKLFSS-N MPCSTVPRRT   49
CeresClone:576522        MSSFLSLSLS APSLH----- ------DSSFL HGTKLFPF-- -SRRVAPRR-   36

Consensus                MALALRCP-A AS-S------ ------SPFL -SSS--PS-- -PRR-PP---   50

CeresClone:764831        RCQYYHGDAP -PRSYDHI PK QFREENLKDG LMDNYKNVPQ FLYGLSPSQM   88
gi|50932981              RCYYYGDGGG FRKNYDHI PK QFREENLKDG LMDNYKNVPQ FLYGLSPAQI   89
CeresClone:381453        RCLAYYGDGG FRKNYDHI PK QFREENLKDG LMDNYKHVPQ FLYGLSAAQM   88
Lead-CeresClone38625     RRSHCFASAK -DMSFDHI PK QFRGDNLKDG VMQNFKNVPQ YFYGLNSAQM   98
CeresClone:576522        -----FNSSS AKCSLDHI PK QFRKENLKDG LMENYKNAPQ SLYGLSPSQM   81

Consensus                RC-YY---A- -RKNYDHI PK QFREENLKDG LMDNYKNVPQ FLYGLSPAQM   100

CeresClone:764831        EMFTTDDNPY NRQSKKVTEE SVAALRSY-D EFGMYSLSGT HEGPAN-YSM   136
gi|50932981              EMFMNDDNPY DRQSQRVTEE SI SASRSY-D EFGMYNLSGM HEGPAG-YSM   137
CeresClone:381453        EMFMNDDNPY NRQSQKVTEE SVSAARSY-D EFGMYTLSGM HEGPAS-YSM   136
Lead-CeresClone38625     DMFMTEDSPV RRQAEKVTEE SI SSRNNYLN NGGI WSI SGM NAADARRYSM   148
CeresClone:576522        DMFMTEDNPI RQQSERVTEE SI SSAKNYMD NGGMWSLSGM GKSDASKYSM   131

Consensus                EMFMTDDNPY NRQS-KVTEE SI SAARNY-D EFGMWSLSGM HEGPAN-YSM   150

CeresClone:764831        GMGMP----SM SMGRAGKGYR ---RMRSSAP DLPSLLLDSR I I FLGMPI VP   180
gi|50932981              GMGMG----TM SMGRAGRGYR ---RMRSSAP DLPSLLLDSR I I FLGMPI VP   181
CeresClone:381453        GMGMGGSMSM SMGRGGRGYR ---RMRSSAP DLPSLLLDSR I I FLGMPI VP   183
Lead-CeresClone38625     ---------SV QMYRGGGGCG GSERPRTAPP DLPSLLLDAR I CYLGMPI VP   190
CeresClone:576522        ---------SV SMYRGGRGTG ---RPKTAPP DLPSLLLDAR I CYLGMPI VP   170

Consensus                GMGM-----SM SMGRGGRGYR ---RMRSSAP DLPSLLLDSR I I FLGMPI VP   200
```

```
CeresClone:764831       AVTELIAAQF LWLDYDDRTK PIYLYINSTG TMDENNELVA SETDAYAIAD  230
gi|50932981             AVTELIAAQF LWLDYDDRTK PIYLYINSTG TMDENNELVA SETDAFAIAD  231
CeresClone:381453       AVTELIAAQF LWLDYDDRTK PIYLYINSTG TMDENNELVA SETDAYAIAD  233
Lead-CeresClone38625    AVTELLVAQF MWLDYDNPTK PIYLYINSPG TQNEKMETVG SETEAYAIAD  240
CeresClone:576522       AVTELIVAQF MWLDYDNPSK PIYLYINSSG TLNEKNETVG SETEAYSIAD  220

Consensus               AVTELIAAQF LWLDYDDRTK PIYLYINSTG TMDENNELVA SETDAYAIAD  250

CeresClone:764831       FINRSKAKVY TINLSMAYGQ AAMLLSLGMK GKRGVLPNSI TKLHLPKVHK  280
gi|50932981             FINRSKSKVY TINLSMAYGQ AAMLLSLGVK GKRGVLPNSI TKLYLPKVHK  281
CeresClone:381453       FINRSKSKVY TINLSMAYGQ AAMLLSLGVK GKRGVLPNSI TKLHLPKVHK  283
Lead-CeresClone38625    TISYCKSDVY TINCGMAFGQ AAMLLSLGKK GYRAVQPHSS TKLYLPKVNR  290
CeresClone:576522       MMSYVKADVY TVNCGMAFGQ AAMLLSLGTK GYRAVQPNSS TKLYLPKVNR  270

Consensus               FINRSKSKVY TINLSMAYGQ AAMLLSLGVK GKRGVLPNSI TKLYLPKVHK  300

CeresClone:764831       SGGAAIDMWI KAKELETNTD YYLELVSQGV GKPKEELAEF LRGPRYFRAQ  330
gi|50932981             SGGAAIDMWI KAKELDTNTD YYLELLSKGV GKPKEELAEF LKGPRYFRAQ  331
CeresClone:381453       SGGAAIDMWI KAKELDTNTD YYLELLSKGV GKPKEELAEF LRGPRYFRAQ  333
Lead-CeresClone38625    SSGAAIDMWI KAKELDANTE YYIELLAKGT GKSKEQINED IKRPKYLQAQ  340
CeresClone:576522       SSGAVIDMWI KAKELEANTE YYIELLAKGT GKSKEEIAKD VQRPKYLQAQ  320

Consensus               SGGAAIDMWI KAKELDTNTD YYLELLSKGV GKPKEELAEF L-GPRYFRAQ  350

CeresClone:764831       EAIDYGLADT ILH--SLDGS FKPKDLTAQL AKAQEMRQSG KRAPAGAGRW  378
gi|50932981             EAIDYGLADT ILH--SLDGS FKPKDLTAQL AKAQEMRQSG KRPAAGAGRW  379
CeresClone:381453       EALDYGLADT ILH--SLDGS FKPKDLTAQL AKAQAMRQSG KRAAAGAGRW  381
Lead-CeresClone38625    AAIDYGIADK IAD--SQDSS FEKRDYDGTL AQ-RAMRP-- -----GGGSP  380
CeresClone:576522       DAIDYGIADK IIDSSSRDVA FEKRNYDEML AQSRAMRRQG -----GGNPQ  365

Consensus               EAIDYGLADT ILH--SLDGS FKPKDLTAQL AKAQAMRQSG KR--AGAGRW  400
```

| | | |
|---|---|---|
| CeresClone:764831 | STPTAPR | 385 |
| gi\|50932981 | STPSVPR | 386 |
| CeresClone:381453 | STPTAPR | 388 |
| Lead-CeresClone38625 | AAPAGLR | 387 |
| CeresClone:576522 | AAPSGFR | 372 |
| Consensus | STP--PR | 407 |

```
gi|56201842               MAALPASPCS  SSSSPSSLFL  AP--------  NPCCWKAAPR  AT----VRAS   38
Lead-CeresClone34480      -MEMSLRLAS  SSTSNPICL.  NP---GKNLN  FPIRNHRI PK  TSKPFCVRSS   46
gi|17028170               ----------  ----------  ----------  --------PK  RAKPFCVRSS   13
gi|6069464                ---MSLNLVS  SSSSNRVFLF  NPI LSGKQVS  LFPSRHQRI PK  RAKPFCVRSS   47
CeresClone:1110310        ---MSLNLVS  SSSSNHVFLF  NPI LSGKQLS  FPSRHQRI PK  RAKPFCVRSS   47
gi|7657879                -MEMSLNLVS  SSSSNHVFLF  NPI LSGKQLS  FPSRHQRI PK  RAKPFCVRSS   49
gi|15864561               -MEMSLNLVS  SSSSNHVFLF  NPI LSGKQLS  FPSRHQRI PK  RAKPFCVRSS   49

Consensus                 ---MSLNLVS  SSSSN-VFLF  NPI LSGKQLS  FPSRHQRI PK  RAKPFCVRSS   50

gi|56201842               A------SAA  RRTLSSAWEL  PG---PSAAR  PAARKPRLEE  LDTTNMLLRQ   79
Lead-CeresClone34480      MSLSK--PLP  RQTLSSNWDV  SSFSI DSVAQ  SPSRLPSFEE  LDTTNMLLRQ   93
gi|17028170               MNMSGPRPRP  RQTLSSNWDL  SNFSVDSVAQ  SPSRLPSFEE  LDTTNMLLRQ   63
gi|6069464                MNLSG--SRP  RQTLSSNWDV  SKFSVDSVAQ  SPSRLPSFEE  LDTTNMLLRQ   95
CeresClone:1110310        MNLSG--PRP  RQTLSSDWDV  SKFSVDSVAQ  SPSRLPSFEE  LDTTNMLLRQ   95
gi|7657879                MNLSG--PRP  RQTLSSDWDV  SKFSVDSVAQ  SPSRLPSFEE  LDTTNMLLRQ   97
gi|15864561               MNLSG--PRP  RQTLSSDWDV  SKFSVDSVAQ  SPSRLPSFEE  LDTTNMLLRQ   97

Consensus                 MNLSG--PRP  RQTLSS-WDV  SKFSVDSVAQ  SPSRLPSFEE  LDTTNMLLRQ   100

gi|56201842               RI VFLGSPVD  DMSADLI I SQ  LLLLDAEDKT  KDI KLFI NSP  GGSI TAGMGV   129
Lead-CeresClone34480      RI VFLGSQVD  DMTADLVI SQ  LLLLDAEDSE  RDI TLFI NSP  GGSI TAGMGI   143
gi|17028170               RI VFLGSQVD  DMTADLVI SQ  LLLLDAQDSE  RDI TLFI NSP  GGSI TAGMGI   113
gi|6069464                RI VFLGSQVD  DMTADLVI SQ  LLLLDAQDSE  RDI TLFI NSP  GGSI TAGMGI   145
CeresClone:1110310        RI VFLGSQVD  DMTADLVI SQ  LLLLDAQDSE  RDI TLFI NSP  GGSI TAGMGI   145
gi|7657879                RI VFLGSQVD  DMTADLVI SQ  LLLLDAQDSE  RDI TLFI NSP  GGSI TAGMGI   147
gi|15864561               RI VFLGSQVD  DMTADLVI SQ  LLLLDAQDSE  RDI TLFI NSP  GGSI TAGMGI   147

Consensus                 RI VFLGSQVD  DMTADLVI SQ  LLLLDAQDSE  RDI TLFI NSP  GGSI TAGMGI   150

gi|56201842               YDAMKFCKAD  I STVCFGLAA  SMGAFLLAAG  TKGKRFCMPN  ARI MI HQPSG   179
Lead-CeresClone34480      YDAMKQCKAD  VSTVCLGLAA  SMGAFLLASG  SKGKRYCMPN  SKVMI HQPLG   193
gi|17028170               YDAMKQCKAD  VSTVCLGI AA  SMGAFLLASG  SKGKRYCMPN  SKVMI HQPLG   163
gi|6069464                YDAMKQCKAD  VSTVCLGLAA  SMGAFLLASG  SKGKRYCMPN  SKVMI HQPLG   195
CeresClone:1110310        YDAMKQCKAD  VSTVCLGLAA  SMGAFLLASG  SKGKRYCMPN  SKVMI HQPLG   195
gi|7657879                YDAMKQCKAD  VSTVCLGLAA  SMGAFLLASG  SKGKRYCMPN  SKVMI HQPLG   197
gi|15864561               YDAMKQCKAD  VSTVCLGLAA  SMGAFLLASG  SKGKRYCMPN  SKVMI HQPLG   197

Consensus                 YDAMKQCKAD  VSTVCLGLAA  SMGAFLLASG  SKGKRYCMPN  SKVMI HQPLG   200
```

```
gi|56201842              GAGGKVTEMG LQIREMMYEK IKINKILSRI TGKPEEQIDE DTKFDYFMSP 229
Lead-CeresClone34480     TAGGKATEMS IRIREMMYHK IKLNKIFSRI TGKPESEIES DTDRDNFLNP 243
gi|17028170              SAGGKATEMS IRVREMMYHK IKLNKIFSRI TGKPESEIEG DTDRDYFLNP 213
gi|6069464               SAGGKATEMS IRVREMMYHK IKLNKIFSRI TGKPESEIEG DTDRDYFLNP 245
CeresClone:1110310       SAGGKATEMS IRVREMMYHK IKLNKIFSRI TGKPESEIEG DTDRDYFLNP 245
gi|7657879               SAGGKATEMS IRVREMMYHK IKLNKIFSRI TGKPESEIEG DTDRDYFLNP 247
gi|15864561              SAGGKATEMS IRVREMMYHK IKLNKIFSRI TGKPESEIEG DTDRDYFLNP 247

Consensus                SAGGKATEMS IRVREMMYHK IKLNKIFSRI TGKPESEIEG DTDRDYFLNP 250

gi|56201842              WEAKDYGIVD SVIDEGKPGL VAPLACAVPP PKSRVWYLWN ASGPTRKIMK 279
Lead-CeresClone34480     WEAKEYGLID AVIDDGKPGL IAPIGDGTPP PKTKVWDLWK VEG-TKKDNT 292
gi|17028170              WEAKEYGLVD AVIDDGKPGL VAPIGDGTPP PNTKVWDFWK VEG-TKNDNK 262
gi|6069464               WEAKEYGLVD AVIDDGKPGL VAPIGDGTPP PNTKVWDFWK VEG-TKNDNK 294
CeresClone:1110310       WEAKEYGLVD AVIDDGKPGL VAPIGDGTPP PNTKVWDFWK VEG-TKNDNK 294
gi|7657879               WEAKEYGLVD AVIDDGKPGL VAPIGDGTPP PNTKVWDFWK VEG-TXNDNK 296
gi|15864561              WEAKEYGLVD AVIDDGKPGL VAPIGDGTPP PNTKVWDFWK VEG-TKNDNK 296

Consensus                WEAKEYGLVD AVIDDGKPGL VAPIGDGTPP PNTKVWDFWK VEG-TKNDNK 300

gi|56201842              NLPSEEKLIQ NGNGSASGDD GKFKEISTA 308
Lead-CeresClone34480     NLPSERSMTQ NGYAAIE--- --------- 309
gi|17028170              DLPTEQSRVQ NGYATPE--- --------- 279
gi|6069464               DLPTEQSRVQ NGYATPE--- --------- 311
CeresClone:1110310       DLPTEQSRVQ NGYATPE--- --------- 311
gi|7657879               DLPTEQSRVQ NGYATPE--- --------- 313
gi|15864561              DLPTEQSRVQ NGYATPE--- --------- 313

Consensus                DLPTEQSRVQ NGYATPE--- --------- 329
```

```
CeresClone:470787        MQSMSTTMAS FSPPTHFSAT PSSSKPRLVY KNNFFFSLRS RSLSLSPLKA   50
Lead-CeresClone29150     -------MAL FSPPI----SS SSLQNPNFI P KFSFSL-LSS NRFSLLSVTR   39
CeresClone:36801         ---MSISMAL FSPPI----S SSLQNPNLI P KISTSL-LST KRFSLI SVPR   42

Consensus                ---MS--MAL FSPPI----S SSLQNPNLI P K-SFSL-LSS -RFSL-SV-R   50

CeresClone:470787        AASENGVGTA V------EPP PEQAVPVPEP SLPPV---DN SSVGTNGSAV   91
Lead-CeresClone29150     ASSDSGSTSP TAAVSVEAPE PVEVI VKEPP QSTPAVKKEE TATAKNVAVE   89
CeresClone:36801         ASSDNGTTSP V----VKIPK PASVAVEEVP VKSPA---ES SSASENGAVG   85

Consensus                ASSDNG-TSP V----V--P- P--V-V-E-P ---PA---E- SS---NGAV-  100

CeresClone:470787        AVESE-VVKV QSSFVDPRWV AGTWDLKQFQ KNGTTDWDAV TDAEARRRKW  140
Lead-CeresClone29150     GEEMK-TTES VIKFQDARWI NGTWDLKQFE KDGKTDWDSV I VAEAKRRKW  138
CeresClone:36801         GEATDSSTET VIKYQNAKWV NGTWDLKQFE KDGKTDWDSV I VSEAKRRKW  135

Consensus                GEE----TE- VIKFQDARWV NGTWDLKQFE KDGKTDWDSV I VAEAKRRKW  150

CeresClone:470787        LEDNPESSSN ENPVVFDTSI VPWWAWMKRF HLPEAELLNG RAAMIGFFMA  190
Lead-CeresClone29150     LEENPETTSN DEPVLFDTSI IPWWAWIKRY HLPEAELLNG RAAMIGFFMA  188
CeresClone:36801         LEDNPETTSN DELVVFDTSI IPWWAWMKRY HLPEAELLNG RAAMIGFFMA  185

Consensus                LEDNPETTSN DEPVVFDTSI IPWWAWMKRY HLPEAELLNG RAAMIGFFMA  200

CeresClone:470787        YFVDSLTGVG LVDQMSNFFC KTLLFVAVLG VLLIRKNEDL ENLKKLFDET  240
Lead-CeresClone29150     YFVDSLTGVG LVDQMGNFFC KTLLFVAVAG VLFIRKNEDV DKLKNLFDET  238
CeresClone:36801         YFVDSLTGVG LVDQMGNFFC KTLLFVAVAG VLFIRKNEDL DKLKDLFDET  235

Consensus                YFVDSLTGVG LVDQMGNFFC KTLLFVAVAG VLFIRKNEDL DKLK-LFDET  250

CeresClone:470787        TLYDKQWQAT WQDEN----S STSKNE---- ---------- -  262
Lead-CeresClone29150     TLYDKQWQAA WKNDD--DES LGSKKK---- ---------- -  262
CeresClone:36801         TLYDKQWQAA WKEPDSSDSF FKEVNKFLQS FIFLFLLCNN L  276

Consensus                TLYDKQWQAA WK--D--D-S --SKNK---- ---------- -  291
```

```
CeresClone:467253         -MS-----SG C--------- ---------- ISTSHWPWFK QLE--QIVGN   23
CeresClone:579504         -MAAAAGVSP S---SLLRLR L-PSPHPAAS LPSPSPALLR RRPLLSVAAA   45
gi|57900163               MAAAAAAAVA CGMSTSFLIR LSPSPPASSH VPLPRSPASS ARP--RRASS   48
CeresClone:289382         -MAASAAAAG P---ATFLPR L-PSPRS--- -PSPMLPPLG RRA--HPVAA   39
CeresClone:243668         -MAASAAAAG P---ATFLPR L-PSPRS--- -PSPMLPPLG RRA--HPVAA   39
Lead-CeresClone13767      -MAIPLPLTS C---SPISTS SSISRTSFVP LTLRNRTFFS NQNYSRRMLI   46
CeresClone:1168763        -MALYTHLIS F---SSSSFL HSPSPLCLPK PLFPSFTLTV GNSISHTTSL   46

Consensus                 -MAA-A---- ----S----R L-PSP-S--- IPSP--P--- RR-----VA-   50

CeresClone:467253         SLPAKFSDED KAVISAGTSP RQSKRYGVAT PSTGGPANSM KSKALSNSRW   73
CeresClone:579504         PQRASVAAAA DSSNGNGSYS GNGSQALLMP PFSGLMLDE- SSRSKRPYKW   94
gi|57900163               VSLSTAPRPR ARAAGSDSPS NFGGQTSLMP PFSL-MLDE- GSRSKKPYRW   96
CeresClone:289382         PLCLSAKRRA CAAMGSSSSS NSGNQTSLML PFSF-TFDED SSSSRRLYRW   88
CeresClone:243668         PLCLSAKRRA CAAMGSSSSS NSGNQTSLML PFSF-TFDED SSSSRRLYRW   88
Lead-CeresClone13767      SCSSSLSSDN GSSPDSMNGN GNGNGSSLNG QSSFPRLPSF DGTSKPPLKW   96
CeresClone:1168763        AVRSSYS-EM GSSPEPINFR KPG-----IP SMSHLRL-SM NESSKPSFKW   89

Consensus                 -L-SS-S--- ----GS-S-S --GNQ-SLM- PFS---LDE- -SSSKR-YRW  100

CeresClone:467253         RRVVLKISGA ALTGSDFCNI DPKVAMLVSR EVAIASRLGV EVAIVVGGRN  123
CeresClone:579504         QRVLLKVSGE ALAGDHTENI DPKVTMAIAR EVASVTKLGV EVAIVVGGGN  144
gi|57900163               QRVLLKVSGE ALAGDHTENI DPKITMAIAR EVASVTRLGV EVAIVVGGGN  146
CeresClone:289382         KRVLLKVSGE ALAGNHTENI DPKITMAIAR EVASVTKLGV EVAIVVGGGN  138
CeresClone:243668         KRVLLKVSGE ALAGNHTENI DPKITMAIAR EVASVTKLGV EVAIVVGGGN  138
Lead-CeresClone13767      RRVLLKVSGE ALAGDEEQNI DPKVTMAIAR EVAAVTRLGI EVAIVVGGGN  146
CeresClone:1168763        RRVLLKVSGE ALAGDHSQNI DPKITMAIAR EVAAVTRLGI EVALVVGGGN  139

Consensus                 RRVLLKVSGE ALAGDHTENI DPKITMAIAR EVASVTRLGV EVAIVVGGGN  150

CeresClone:467253         FFSGEAWVNV TGLERCTAYQ VGMMATVMNS TLLQSTLEKM GVQTRVQTSV  173
CeresClone:579504         IFRGASWAGC SGLDRSSADY IGMMATVMNA IFLQATMESI GIPTRVQTAF  194
gi|57900163               IFRGASWAGC SGLDRSSADY IGMLATVMNA IFLQATMESI GIPTRVQTAF  196
CeresClone:289382         IFRGASWAGC SGLDRSSADY IGMLATVMNA IFLQATMESI GIPTRVQTAF  188
CeresClone:243668         IFRGASWAGC SGLDRSSADY IGMLATVMNA IFLQATMESI GIPTRVQTAF  188
Lead-CeresClone13767      IFRGSTWAGC SGLDRSSADY IGMLATVMNA IFLQATMESI GIPTRVQTAF  196
CeresClone:1168763        IFRGSSWAGS SGLDRSSADY IGMLATVMNA IFLQATMESI GIPTRVQTAF  189

Consensus                 IFRGASWAGC SGLDRSSADY IGMLATVMNA IFLQATMESI GIPTRVQTAF  200
```

```
CeresClone:467253        AMQEFAEPYN RQRAIRHLEK GRVVIFGGIG FGAGIPLFST DLAAALRASE 223
CeresClone:579504        RISEVAEPYI RRRAIRHLEK GRVVIFAA-- -GTGNPFFTT DTAAALRCAE 241
gi|57900163              RMSEVAEPYI RRRAVRHLEK GRVVIFAA-- -GTGNPFFTT DTAAALRCAE 243
CeresClone:289382        RMSEVAEPYI RRRAVRHLEK GRVVIFAA-- -GTGNPFFTT DTAAALRCAE 235
CeresClone:243668        RMSEVAEPYI RRRAVRHLEK GRVVIFAA-- -GTGNPFFTT DTAAALRCAE 235
Lead-CeresClone13767     RMSEVAEPYI RRRAIRHLEK GRVVIFAA-- -GTGNPFFTT DTAAALRCAE 243
CeresClone:1168763       RMSEVAEPYI RRRAVRHLEK GRVVIFAA-- -GTGNPFFTT DTAAALRCAE 236

Consensus                RMSEVAEPYI RRRAVRHLEK GRVVIFAA-- -GTGNPFFTT DTAAALRCAE 250

CeresClone:467253        LNAEAVLKGF NVDGVYDCNS RDNNFT--FE HISFRELCSR GVTSMDMSAL 271
CeresClone:579504        INAEVVLKAT NVDGVYDANP KHNPNARILE TVSYNEVISR DLSVMDMTAV 291
gi|57900163              INAEVVLKAT NVDGVYDADP KRNPNARLLE AVSYHEVQTR DLSVMDMTAI 293
CeresClone:289382        INAEVVLKAT NVDGVYDADP RQNPNARLLE TVSYHEVTTR DLSVMDMTAI 285
CeresClone:243668        INAEVVLKAT NVDGVYDADP RQNPNARLLE TVSYHEVTTR DLSVMDMTAI 285
Lead-CeresClone13767     INAEVVLKAT NVDGVFDDDP KRNPNARLLD SLTYQEITSK DLSVMDMTAI 293
CeresClone:1168763       INAEVVLKAT NVDGVFDEDP KRNPQARLFE TLTYQEVTSK DLSVMDMTAI 286

Consensus                INAEVVLKAT NVDGVYDADP KRNPNARLLE TVSYHEVTSR DLSVMDMTAI 300

CeresClone:467253        TFCEENAIPV VVFNLLEPGN ISKALCGEQV GTLFDQFGA- ---------- 310
CeresClone:579504        TLCQENNIPV VVFNLQNTGN IAKAIVGEKV GTFIGCTRNL EYRESTEGSL 341
gi|57900163              TLCQENNIPV VVFNLQKPGN IAKAIVGEKV GTFIGCTKD- --QDQIVGNA 340
CeresClone:289382        TLCQENNIPI VVFNLQEPGN IAKAIVGEKV GTFIGCTRD- --QE-LNGNT 331
CeresClone:243668        TLFQENNIPI VVFNLQEPGN IAKAIVGEKV GTFIGCTRD- --QE-LNGNT 331
Lead-CeresClone13767     TLCQENNIPV VVFNLSEPGN IAKAIKGERV GTLIGCTWN- ---------- 332
CeresClone:1168763       TLCQENNIPV VVFNLNKPGN IEKAIKGERV GTLIGATWN- ---------- 325

Consensus                TLCQENNIPV VVFNLQEPGN IAKAIVGEKV GTFIGCTR-- --QE---GN- 350

CeresClone:467253        ---------I S 312
CeresClone:579504        DQEDKILVSE W 352
gi|57900163              LDQERRLVNE L 351
CeresClone:289382        LVQERRLVNE A 342
CeresClone:243668        LVQERRLVNE A 342
Lead-CeresClone13767     ----SIVTTT S 339
CeresClone:1168763       -----STVSR T 331

Consensus                --QER-LV-E - 361
```

| | | | | | | |
|---|---|---|---|---|---|---|
| CeresClone:562212 | MAAKLTLS-S PFSFKTSFLP | KSPSFSLG-- | -------LYSP | -RTNVTGVKV | | 40 |
| CeresClone:1046446 | MAAKLTLS-S PLSFKTSFLP | KSPSFSPG-- | ------LCSP | -RTNVTGVKV | | 40 |
| Lead-CeresClone5198 | MAAKLRI SSS SFSHRTNDSK | TSSSSSYSSL | LALPQFLCPP | SPLGFPQFKL | | 50 |
| CeresClone:954882 | MAAKLHI S-S SFSHKANDSP | TSSSSSYXXF | LALPQFLCTP | FSSGFAQFKL | | 49 |
| gi\|34896996 | -MAKVALSSL LAVGGAAAFA | VQPSKKTG-- | ---SGLFRNR | -VITVRRPRI | | 43 |
| CeresClone:370168 | -MAKAAPPLL AAGSRTAI TA | QQPSSRKG-- | AAGTGLFCSR | -AIVSKRTRV | | 46 |
| CeresClone:1577130 | -MAKAAPPLL AAGSRTAI TA | QQPSSRKG-- | AAGAGLFCSR | -VIVSKRARV | | 46 |
| Consensus | MAAKL-LS-S --S--T---- | -SPSSS-G-- | -A----LCSP | --I ---R-KV | | 50 |
| | | | | | | |
| CeresClone:562212 | HAKLGGGDEQ | AKKGG-KKKF | I TREEEPQQY | WQTAGEREGE | NPMKTPLPYI | 89 |
| CeresClone:1046446 | HAKLGGGDEQ | AKNGG-KKKF | I TREEEPQQY | WQTAGEREGE | NPMKTPLPYI | 89 |
| Lead-CeresClone5198 | HAKLGGRDGE | VKPKD-KKKF | I TKEEEPEQY | WQSVGEREGE | NPMKTPLPYI | 99 |
| CeresClone:954882 | HAKLGGGDGE | VKPKE-KKKF | I TKEEEPEQY | WQSAGEREGE | NPMKTPLPYI | 98 |
| gi\|34896996 | SANLGG-DGE | VKPAGNKKKF | I TREEEPEQY | WQAAGERKGE | NPMKTPLPYI | 92 |
| CeresClone:370168 | TAKLG--DGE | LKPAG-KRKF | I TKEEEPEQY | WQTAGEREGE | NPMMTPLPYI | 93 |
| CeresClone:1577130 | TAKLG--DGE | LKPAG-KRKF | I TKEEEPEQY | WQTAGEREGE | NPMMTPLPYI | 93 |
| Consensus | HAKLGG-DGE | VKP-G-KKKF | I TKEEEPEQY | WQTAGEREGE | NPMKTPLPYI | 100 |
| | | | | | | |
| CeresClone:562212 | I I FGMSTPFV | I LAI AFANGW | I KVPVR | 115 | | |
| CeresClone:1046446 | I I FGMSTPFX | I LAI AFANGW | I KVPVR | 115 | | |
| Lead-CeresClone5198 | I I FGMSTPFV | I LAI AFANGW | I KVPI R | 125 | | |
| CeresClone:954882 | I I FGMSTPFV | I LAI AFANGW | I KVPI R | 124 | | |
| gi\|34896996 | I I FGMSTPFV | I LAI AFANGW | I KVPVR | 118 | | |
| CeresClone:370168 | I I FGMSTPFV | I LAI AFANGW | I KVPVR | 119 | | |
| CeresClone:1577130 | I I FGMSTPFV | I LAI AFANGW | I KVPVR | 119 | | |
| Consensus | I I FGMSTPFV | I LAI AFANGW | I KVPVR | 126 | | |

```
gi|55296987              MALSAAAPAN SSCFHPRAAA ASAPSSLSVG TKVFVGLKAQ TKLGSSESSC  50
Lead-CeresClone5220      MAVSFNTTLH QPSLSP---- -------SCS TKLYSGLKPQ SA-SFLASGY  38
CeresClone:476857        MAVVPYTTGS APLLSP---- ---PSTSSVA TKLYSGLKLQ AA-SPFGAAK  42

Consensus                MAVS--TT-- -P-LSP---- ---PS--SV- TKLYSGLK-Q -A-S---S--  50

gi|55296987              PNVTAGFYLA VNRRISLGLS NKRATRARIS MMPVGTPRVP YRTPGEGTWQ  100
Lead-CeresClone5220      QNLNKEFYGR VHKSLQSG-- TGKASRSRVK MMPIGTPRVP YRNREEGTWQ  86
CeresClone:476857        PNVTAEFYGK VHNTLHCRYA NHNTSMARIR MMPIGTPKVP YRTPGEGTWQ  92

Consensus                PNVTAEFYG- VH--L--G-- N--ASRARI- MMPIGTPRVP YRTPGEGTWQ  100

gi|55296987              WLDIWNALYR ERIIFIGDSI DEEFSNQVLA SMLYLDSVDN TKKILLYING  150
Lead-CeresClone5220      WVDIWNALYR ERVIFIGQNI DEEFSNQILA TMLYLDTLDD SRRIYMYLNG  136
CeresClone:476857        WVDVWNALYR ERVIFIGQEI DEEFSNQILA TMLYLDSIEN SKKLYMYING  142

Consensus                WVDIWNALYR ERVIFIGQ-I DEEFSNQILA TMLYLDS-DN SKKIYMYING  150

gi|55296987              PGGDLTPCMA LYDTMLSLKS PIGTHCLGFA FNLAGFILAA GEKGSRTGMP  200
Lead-CeresClone5220      PGGDLTPSLA IYDTMKSLKS PVGTHCVGLA YNLAGFLLAA GEKGHRFAMP  186
CeresClone:476857        PGGDLTPSMA IYDTMQSLQS PVAIHCVGYA YSLAAFLLAA GEKGNRSAMP  192

Consensus                PGGDLTPSMA IYDTM-SLKS PVGTHCVG-A YNLAGFLLAA GEKG-R-AMP  200

gi|55296987              LCRISLQSPA GAARGQADDI ENEANELIRI KNYLYSKLSE HTGHPVDKIH  250
Lead-CeresClone5220      LSRIALQSPA GAARGQADDI QNEAKELSRI RDYLFNELAK NTGQPAERVF  236
CeresClone:476857        LSRVALTSPA GAARGQADDI QNEANELLRI RDYLFNELAQ KTGQPVEKIT  242

Consensus                LSRIALQSPA GAARGQADDI QNEANEL-RI RDYLFNELA- -TGQPVEKI-  250

gi|55296987              EDLSRVKRFD AEGALEYGII DRIIRPSRIK KEGSTAQKKD LRNLGLG  297
Lead-CeresClone5220      KDLSRVKRFN AEEAIEYGLI DKIVRPPRIK ED---APRQD -ESAGLG  279
CeresClone:476857        KDLSRMKRFN AQEALEYGLI DRIVRPPRIK AD---APRKE -AGTGLG  285

Consensus                KDLSRVKRFN AEEALEYGLI DRIVRPPRIK -D---APRKD ----GLG  297
```

```
CeresClone:472119         ---MAATSFS GMQFAMSRSC IPASQKIADA GAVVLGGKSK IG-SWNKLAS  46
CeresClone:264627         MVAARPCISA SPGILTARVA VSRTDCMLST TA-------- ---TFPKISC  39
CeresClone:272165         MVAARPCISA SPGILTARVA VSRTDCMLST TA-------- ---TFPKISC  39
CeresClone:338740         ---------- -MQMATRPS IPAYRQILGS TSALS----- ---AFCRSIC  31
CeresClone:697140         MLAARPCVSA SQSMLTSRPA VSRIDLTLVA GSFA------ ---NCPRISC  41
CeresClone:36277          ----MAYSSF TLQIATRRPS MSSPSKILKA GTYIVGANPG NA-SWDKLSC  45
Lead-CeresClone11214      ---MAATAAS SLQIATRRPS MSSPSKVLKA GTYIVGANPG NA-SWDKLSC  46
gi|21281125               ---MAATAAS SLQIATRRPS MSSPSKILKA GTYIVGANPG NA-SWDKLSC  46
gi|7141083                ---MAATAAS SLQIATRRPS MSSPSKILKA GTYIVGANPG NA-SWDKLSC  46
gi|14422257               ---MAATAAS SLQFATIRPN IS--SKVVKA GTYIVGANPR NASSWDKLAF  45
CeresClone:977208         ---------- ---------- ---------- ---------- ----------   0
gi|14422255               ---MAATAAS SLQFATIRPS IS--SKVVKA GTYIVGANPR NA-SWDKLAC  44
CeresClone:1294554        ---------- ---MATTRPS ISAASS--KA RTYVVGANPR NA---YKIAC  32
CeresClone:1117994        ---------- ---MATTRAS ISAASS--KA RTCIVGANPR NA-SWDKIAC  34

Consensus                 -----A-AAS SLQIAT-RPS IS--SKILKA GTYIVGANP- NA-SWDKLSC  50

CeresClone:472119         ACHIASVQPF RRGF-TSSSI KSVKSDTKAL FEFSAQSADS GLSIDLKGKR  95
CeresClone:264627         S--------- ------WPLRF KRNDVVVRAI SEEC----GPQ GLPIDLRGKR  72
CeresClone:272165         S--------- ------WPLRF KRNDVVVRAI SEEC----GPQ GLPIDLRGKR  72
CeresClone:338740         SRTGFAISSK ATSAGPLVSS NCKRVVVRAM SQ-----RGAQ GLPIDLTGKR  77
CeresClone:697140         SRSLG----- --------SS RSGAVAVRAV SGEG---SSS GLPIDLRGKR  75
CeresClone:36277          TRQLSNLGCL RNHSAVPTCK RPFSFSTRAM SESSENKAPS GLPIDLRGKR  95
Lead-CeresClone11214      TRQLSNLGCL RNNTAVPTCK RPFSFSTRAM SESSENKAPS GLPIDLRGKR  96
gi|21281125               TRQLSNLGCL RNHSAVPTCK RPFSFSTRAM SESSENKAPS GLPIDLRGKR  96
gi|7141083                TRQLSNLGCL RNHSAVPTCK RPFSFSTRAM SESSENKAPS GLPIDLRGKR  96
gi|14422257               TRHLSKLGCL RNNSSLPTSK KSFSFSTKAM SESSENKASS GLPIDLRGKR  95
CeresClone:977208         ---------- ---------- ---------M SESSENKASS GLPIDLRGKR  21
gi|14422255               TRHLSKHGCL RNNSSLPTSK KSFSFSTKAM SESSENKASS GLPIDLRGKR  94
CeresClone:1294554        TPHLSNLGCL RNDSALPASK KSFSFSTKAM SESSESKASS GLPIDLRGKR  82
CeresClone:1117994        TPHLSNLGCL RNDSALPASK KSFSFSTKAM SEFSESKASS GLPIDLRGKR  84

Consensus                 TR-LS-LGCL RN-SA-P-SK K-FSFSTRAM SESSENKASS GLPIDLRGKR 100
```

| | | | | | | |
|---|---|---|---|---|---|---|
| CeresClone:472119 | AFI AGVADDN | GYGWAI AKAL | AAAGAEI LVG | T WVPALNI FE | SSLRRGKFDI | 145 |
| CeresClone:264627 | AFI AGVADDN | GYGWAI AKAL | AAAGAEI LVG | T WVPALNI FE | TSLRRGKFDE | 122 |
| CeresClone:272165 | AFI AGVADDN | GYGWAI AKAL | AAAGAEI LVG | T WVPALNI FE | TSLRRGKFDE | 122 |
| CeresClone:338740 | AFI AGVADDN | GYGWAI AKAL | AAAGAEI LVG | T WVPALNI FE | TSLRRGKFDE | 127 |
| CeresClone:697140 | AFI AGVADDN | GYGWAI AKAL | AAAGAEI LVG | TWVPALNI FE | TSLRRGKFDE | 125 |
| CeresClone:36277 | AFI AGI ADDN | GYGWAI AKSL | AAAGAEI LVG | TWVPALNI FE | TSLRRGKFDQ | 145 |
| Lead-CeresClone11214 | AFI AGI ADDN | GYGWAI AKSL | AAAGAEI LVG | T WVPALNI FE | TSLRRGKFDQ | 146 |
| gi\|21281125 | AFI AGI ADDN | GYGWAI AKSL | AAAGAEI LVG | T WVPALNI FE | TSLRRGKFDQ | 146 |
| gi\|7141083 | AFI AGI ADDN | GYGWAI AKSL | AAAGAEI LVG | T WVPALNI FE | TSLRRGKFDQ | 146 |
| gi\|14422257 | AFI AGI ADDN | GYGWAI AKSL | AAAGAEI LVG | T WVPALNI FE | TSLRRGKFDQ | 145 |
| CeresClone:977208 | AFI AGI ADDN | GYGWAI AKSL | AAAGAEI LVG | TWVPALNI FE | TSLRRGKFDQ | 71 |
| gi\|14422255 | AFI AGI ADDN | GYGWAI AKSL | AAAGAEI LVG | TWVPALNI FE | TSLRRGKFDQ | 144 |
| CeresClone:1294554 | AFI AGI ADDN | GYGWAVAKSL | AAAGAEI LVG | T WVPALNI FE | TSLRRGKFDQ | 132 |
| CeresClone:1117994 | AFI AGI ADDN | GYGWAI AKSL | AAAGAEI LVG | TWVPALNI FE | TSLRRGKFDQ | 134 |
| Consensus | AFI AGI ADDN | GYGWAI AKSL | AAAGAEI LVG | TWVPALNI FE | TSLRRGKFDQ | 150 |

| | | | | | | |
|---|---|---|---|---|---|---|
| CeresClone:472119 | SRI LPDGSMM | EI TKVYPLDA | VFDNPDDVPE | DI KTNKRYAG | SSKWTVQEVA | 195 |
| CeresClone:264627 | SRKLPDGSLM | DI VKVYPLDA | VYDSPDDVPE | DVKSNKRYAG | ASNWTVKEVV | 172 |
| CeresClone:272165 | SRKLPDGSLM | DI VKVYPLDA | VYDSPDDVPE | DVKSNKRYAG | ASNWTVKEVV | 172 |
| CeresClone:338740 | SRKLPDGSLM | EI AKVYPLDA | VYDTPEDVPE | DVKANKRYAG | ASNWTVKEVV | 177 |
| CeresClone:697140 | SRKLPDGSLM | EI VKVYPLDA | VYDSPEDVPE | DVKTNKRYAG | SSNWTVKEAA | 175 |
| CeresClone:36277 | SRVLPDGSLM | EI KKVYALDA | VFDNPEDVPE | DVKTNKRYAG | SSNWTVQEAA | 195 |
| Lead-CeresClone11214 | SRVLPDGSLM | EI KKVYALDA | VFDNPEDVPE | DVKTNKRYAG | SSNWTVQEAA | 196 |
| gi\|21281125 | SRVLPDGSLM | EI KKVYALDA | VFDNPEDVPE | DVKTNKRYAG | SSNWTVQEAA | 196 |
| gi\|7141083 | SRVLPDGSLM | EI KKVYALDA | VFDNPEDVPE | DVKTNKRYAG | SSNWTVQEAA | 196 |
| gi\|14422257 | SRVLPDGSLM | EI KKVYPLDA | VFDSPEDVPE | DVKANKRYAG | SSNWTVQEAA | 195 |
| CeresClone:977208 | SRVLPDGSLM | EI KKVYPLDA | VFDSPEDVPE | DVKANKRYAG | SSNWTVQEAA | 121 |
| gi\|14422255 | SRVLPDGSLM | EI KKVYPLDA | VFDSPEDVPE | DVKANKRYAG | SSNWTVQEAA | 194 |
| CeresClone:1294554 | SRVLPDGSLM | EI KKVYPLDA | VFDNPEDVPE | DVKANKRYAG | SSNWTVQEAA | 182 |
| CeresClone:1117994 | SRVLPDGSLM | EI KKVYPLDA | VFDTPDDVPE | DVKANKRYAG | SSNWTVQEAA | 184 |
| Consensus | SRVLPDGSLM | EI KKVYPLDA | VFD-PEDVPE | DVK-NKRYAG | SSNWTVQEAA | 200 |

| | | | | | | |
|---|---|---|---|---|---|---|
| CeresClone:472119 | ESVKEDFGSI | DI LVHSLANG | PEVTKPLLET | SRNGYLAAI S | ASSYSYVSLL | 245 |
| CeresClone:264627 | ESVRNDFGSI | DI LVHSLANG | PEVTKPLLET | SRRGYLAAI S | ASSYSYVSLL | 222 |
| CeresClone:272165 | ESVRNDFGSI | DI LVHSLANG | PEVTKPLLET | SRRGYLAAI S | ASSYSYVSLL | 222 |
| CeresClone:338740 | ETVKNDFGSI | DI LVHSLANG | PEVTKSLLET | SRRGYLAAI S | ASSYSYVSLL | 227 |
| CeresClone:697140 | ELVKKEYGSI | DI LVHSLANG | PEVTKPLLET | SRSGYLAAI S | ASSYSFVSLL | 225 |
| CeresClone:36277 | ECVKKDFGSI | DI LVHSLANG | PEVSKPLLET | SRKGYLAAI S | ASSYSFVSLL | 245 |
| Leod-CeresClone11214 | ECVKKDFGSI | DI LVHSLANG | PEVSKPLLET | SRKGYLAAI S | ASSYSFVSLL | 246 |
| gi\|21281125 | ECVKKDFGSI | DI LVHSLANG | PEVSKPLLET | SRKGYLAAI S | ASSYSFVSLL | 246 |
| gi\|7141083 | ECVKKDFGSI | DI LVHSLANG | PEVSKPLLET | SRKGYLAAI S | ASSYSFVSLL | 246 |
| gi\|14422257 | ECVKKDFGTI | DI LVHSLANG | PEVSKPLLET | SRKGYLAAI S | ASSYSFVSLL | 245 |
| CeresClone:977208 | ECVRKDFGTI | DI LVHSLANG | PEVSKPLLET | SRKGYLAAI S | ASSYSFVSLL | 171 |
| gi\|14422255 | ECVRKDFGTI | DI LVHSLANG | PEVSKPLLET | SRKGYLAAI S | ASSYSFVSLL | 244 |
| CeresClone:1294554 | ECVRQDFGSI | DI LVHSLANG | PEVSKPLLET | SRKGYLAAI S | ASSYSFVSLL | 232 |
| CeresClone:1117994 | ECVRQDFGSI | DI LVHSLANG | PEVSKPLLET | TRKGYLAAI S | ASSYSFVSLL | 234 |
| Consensus | ECVKKDFGSI | DI LVHSLANG | PEVSKPLLET | SRKGYLAAI S | ASSYSFVSLL | 250 |

| | | | | | | |
|---|---|---|---|---|---|---|
| CeresClone:472119 | KHFLPI LNPG | GSSI SLTYI A | SERI I PGYGG | GMSSAKAALE | SDTRVLAFEA | 295 |
| CeresClone:264627 | QHFLPI MNPG | GASI SLTYI A | SERA PGYGG | GMSSAKAALE | SDTRVLAFEA | 272 |
| CeresClone:272165 | QHFLPI MNPG | GASI SLTYI A | SERA PGYGG | GMSSAKAALE | SDTRVLAFEA | 272 |
| CeresClone:338740 | QHFLPI MNPG | GASI SLTYI A | SERI I PGYGG | GMSSAKAALE | SDTRVLAYEA | 277 |
| CeresClone:697140 | KHFLPI MNPG | GASI SLTYI A | SERT PGYGG | GMSSAKAALE | SDTKVLAFEA | 275 |
| CeresClone:36277 | RHFLPI MNPG | GASI SLTYI A | SERI I PGYGG | GMSSAKAALE | SDTRVLAYEA | 295 |
| Leod-CeresClone11214 | RHFLPI MNPG | GASI SLTYI A | SERI I PGYGG | GMSSAKAALE | SDTRVLAYEA | 296 |
| gi\|21281125 | RHFLPI MNPG | GASI SLTYI A | SERI I PGYGG | GMSSAKAALE | SDTRVLAYEA | 296 |
| gi\|7141083 | RHFLPI MNPG | GASI SLTYI A | SERI I PGYGG | GMSSAKAALE | SDTRVLAYEA | 296 |
| gi\|14422257 | RHFLPI MNPG | GASI SLTYI A | SERI I PGYGG | GMSSAKAALE | SDTRVLAFEA | 295 |
| CeresClone:977208 | RHFLPI MNPG | GASI SLTYI A | SERI I PGYGG | GMSSAKAALE | SDTRVLAFEA | 221 |
| gi\|14422255 | RHFLPI MNPG | GASI SLTYI A | SERI I PGYGG | GMSSAKAALE | SDTRVLAFEA | 294 |
| CeresClone:1294554 | SHFLPI MNPG | GASI SLTYI A | SERI I PGYGG | GMSSAKAALE | SDTRVLAFEA | 282 |
| CeresClone:1117994 | SHFLPI MNPG | GASI SLTYI A | SERI I PGYGG | GMSSAKAALE | SDTRVLAFEA | 284 |
| Consensus | RHFLPI MNPG | GASI SLTYI A | SERI I PGYGG | GMSSAKAALE | SDTRVLAFEA | 300 |

| | | | | | | | |
|---|---|---|---|---|---|---|---|
| CeresClone:472119 | GRKRKI XVNT | I SAGPPRSRA | AKAI GFI DMM | I DYSSANAPL | QKEVLAEEVG | | 345 |
| CeresClone:264627 | GRKGKI RVNT | I SAGPLGSRA | AKAI GFI EKM | I EYSYVNAPL | QKELLADEVG | | 322 |
| CeresClone:272165 | GRKGKI RVNT | I SAGPLGSRA | AKAI GFI EKM | I EYSYVNAPL | QKELLADEVG | | 322 |
| CeresClone:338740 | GRKGKI RVNT | I SAGPLGSRA | AKAI GFI EKM | I EYSYVNAPL | QKELLADEVG | | 327 |
| CeresClone:697140 | GRKGKI RVNT | I SAGPLGSRA | AKAI GFI EKM | I EYSYVNAPL | QKELLADEVG | | 325 |
| CeresClone:36277 | GRKSNI RVNT | I SAGPLGSRA | AKAI GFI DTM | I EYSYNNGPI | QKTLTADEVG | | 345 |
| Lead-CeresClone11214 | GRKSNI RVNT | I SAGPLGSRX | AKAI GFI DTM | I EYSYNNGPI | QKTLTADEVG | | 346 |
| gi\|21281125 | GRKSNI RVNT | I SAGPLGSRA | AKAI GFI DTM | I EYSYNNGPI | QKTLTADEVG | | 346 |
| gi\|7141083 | GRKSNI RVNT | I SAGPLGSRA | AKAI GFI DTM | I EYSYNNGPI | QKTLTADEVG | | 346 |
| gi\|14422257 | GRKQNI RVNT | I SAGPLGSRA | AKAI GFI DTM | I EYSYNNAPV | QKTLTADEVG | | 345 |
| CeresClone:977208 | GRKQKI RVNT | I SAGPLGSRA | AKAI GFI DTM | I EYSYNNAPV | QKTLTADEVG | | 271 |
| gi\|14422255 | GRKQKI RVNT | I SAGPLGSRA | AKAI GFI DTM | I EYSYNNAPV | QKTLTADEVG | | 344 |
| CeresClone:1294554 | GRKQNI RVNT | I SAGPLGSRA | AKAI GFI DTM | I EYSYNNAPI | QKTLTADEVG | | 332 |
| CeresClone:1117994 | GRKQNI RVNT | I SAGPLGSRA | AKAI GFI DTM | I EYSYNNAPI | QKTLTADEVG | | 334 |
| Consensus | GRK--I RVNT | I SAGPLGSRA | AKAI GFI DTM | I EYSYNNAPI | QKTLTADEVG | | 350 |

| | | | | | | |
|---|---|---|---|---|---|---|
| CeresClone:472119 | YTAAFLASPL | ASAI TGIVLY | VDNGLNAMGV | GVDSPI FKDL | NI PKDOH | 392 |
| CeresClone:264627 | NTAAFLVSSL | ASAI TGSTVY | VDNGLNTMGL | AI DSPTI TS- | ------- | 361 |
| CeresClone:272165 | NTAAFLVSSL | ASAI TGSTVY | VDNGLNTMGL | AI DSPTI TS- | ------- | 361 |
| CeresClone:338740 | NTAAFLVSPL | ASAI TGSTI Y | VDNGLNTMGL | ALDSPTLST- | ------- | 366 |
| CeresClone:697140 | NTAAFLVSPL | ASAI TGSTVY | VDNGLNTMGL | AVDSPTVSSL | L------ | 366 |
| CeresClone:36277 | NAAAFLASPL | ASAI TGATI-Y | VDNGLNAMGV | ALDSPVFKDL | NSKN--- | 389 |
| Lead-CeresClone11214 | NAAAFLASPL | ASAI TGATI-Y | VDNGLNAMGV | ALDSPVFKDL | NSKN--- | 390 |
| gi\|21281125 | NAAAFLASPL | ASAI TGATI Y | VDNGLNAMGV | ALDSPVFKDL | NSKN--- | 390 |
| gi\|7141083 | NAAAFLASPL | ASAI TGATI Y | VDNGLNAMGR | ALDSPVFKDL | NSKN--- | 390 |
| gi\|14422257 | NAAAFLVSPL | ASAI TGATI Y | VDNGLNSMGV | AI DSPVFKDL | K------ | 386 |
| CeresClone:977208 | NAAAFLVSPL | ASAI TGATI Y | VDNGLNSMGV | AI DSPVFKDL | K------ | 312 |
| gi\|14422255 | NAAAFLVSPL | ASAI TGATI Y | VDNGLNSMGV | AI DSPVFKDL | K------ | 385 |
| CeresClone:1294554 | NAAAFLVSPL | ASAI TGATI Y | VDNGLNSMGV | ALDSPVFKDL | NK----- | 374 |
| CeresClone:1117994 | NAAAFLVSPL | ASAI TGATI Y | VDNGLNSMGV | ALDSPVFKDL | NK----- | 376 |
| Consensus | NAAAFLVSPL | ASAI TGATI-Y | VDNGLN-MGV | AI DSPVFKDL | N------ | 397 |

```
Lead-CeresClone563522   MSKRVRS-PR LELRLNLSPP RAAATSI SS SELSPTESSM SSPVSVQSLE   49
CeresClone:973582       MSLRNKNGPK LELKLNLSPP PSQANLM--S LVRSPSRSNT TSPSSCVSSE   48
CeresClone:946814       MSRRNRSGPK LELKLNLSPP PSQGEQM--S MVRSPSRSNT ASPNSCVSSE   48

Consensus               MS-RNRSGPK LELKLNLSPP PSQA--M--S -VRSPSRSNT -SP-SCVSSE   50

Lead-CeresClone563522   SSCVSSEAEE TRAMLLVGCP RCLMYVMLSE VDPKCPKCKS TVLLDFLNNE   99
CeresClone:973582       TY--QEEMET TISMLLVGCP RCLMYVMLSQ DDPKCPKCKS TVLLDFLHQD   96
CeresClone:946814       PS--QEEMET PISMVLVGCP RCLMYVMLSQ DEPKCPKCKS TVLLDFFHEN   96

Consensus               -S--QEEMET TISMLLVGCP RCLMYVMLSQ DDPKCPKCKS TVLLDFLH--   100

Lead-CeresClone563522   ENNNTKKSSS E--------- ---   110
CeresClone:973582       VSAAITAPAD ITKRNKTWWN FFV   119
CeresClone:946814       ASVDTTAPAV TTKRNKSLIT NI-   118

Consensus               -S--TTAPA- -TKRNK---- ---   123
```

```
CeresClone:1589040        ---------- ---MQI RPVV AQI TLGMI L TSALI LWKGF VVVTGSESPV   37
Lead-CeresClone21563      ---------- ---------- -------MI V TSALI I WKAL I CVTGSESPV   23
gi|55296017               MGFI GDTI ES I RSMQVRQVL AQI I SLGMI V TSALI I WKGL I VVTGSESPV   50
CeresClone:528914         MGWI GETVDS I KSLQI RQVL TQAVSLGMI V TSALI I WKAL MCVTGSESPV   50
CeresClone:103157         ---------- ---------- -------MI V TSALI I WKAL MCVTGSESPV   23
gi|20465737               MGWI GETVDS I KSI QI RQLF TQAI SLGMI V TSALI I WKAL MCVTGSESPV   50
gi|62318522               MGWI GETVDS I KSI QI RQLF TQAI SLGMI V TSALI I WKAL MCVTGSESPV   50

Consensus                 MGWI GETVDS I KS-QI RQV- -Q-I SLGMI V TSALI I WKAL MCVTGSESPV   50

CeresClone:1589040        VVVLSGSMEP GFRKGDVLFL HMNKDPVRTC DI VVFNVEGR DI PI VHRVI K   87
Lead-CeresClone21563      VVVLSESMEP GFQRGDI LFL RMTDEPI RAG EI VVFSVDGR EI PI VHRAI K   73
gi|55296017               VVVLSGSMEP GFKRGDI LFL HMSKDPI RTG EI VVFNVDGR EI PI VHRVI K  100
CeresClone:528914         VVVLSGSMEP GFKRGDI LFL HMSKDPI RAG EI VVFNVDGR EI PI VHRVI K  100
CeresClone:103157         VVVLSGSMEP GFKRGDI LFL HMSKDPI RAG EI VVFNVDGR DI PI VHRVI K   73
gi|20465737               VVVLSGSMEP GFKRGDI LFL HMSKDPI RAG EI VVFNVDGR DI PI VHRVI K  100
gi|62318522               VVVLSGSMEP GFKRGDI LFL HMSKDPVRAG EI VVFNVDGR DI PI VHRVI K  100

Consensus                 VVVLSGSMEP GFKRGDI LFL HMSKDPI RAG EI VVFNVDGR DI PI VHRVI K  100

CeresClone:1589040        VHERHDTVDS DI LTKGDNNP GDDRVLYAHG QLWLQRQHI I GRGCCYLPYA  137
Lead-CeresClone21563      VHERGDTKAM DVLTKGDNND I DDI GLYAEG QLWLHRHHI M GRAVGFLPYV  123
gi|55296017               VHERQESAEV DI LTKGDNNF GDDRLLYAHG QLWLQQHHI M GRAVGFLPYV  150
CeresClone:528914         VHEREDTGEV DVLTKGDNNY GDDRLLYAHG QLWLQRHHI M GRAVGFLPYV  150
CeresClone:103157         VHERENTGEV DVLTKGDNNY GDDRLLYAEG QLWLHRHHI M GRAVGFLPYV  123
gi|20465737               VHERENTGEV DVLTKGDNNY GDDRLLYAEG QLWLHRHHI M GRAVGFLPYV  150
gi|62318522               VHERENTGEV DVLTKGDNNY GDDRLLYAEG QLWLHRHHI M GRAVGFLPYV  150

Consensus                 VHERE-TGEV DVLTKGDNNY GDDRLLYAEG QLWLHRHHI M GRAVGFLPYV  150

CeresClone:1589040        GWXTI VMTEK PVPQYLLMVH WGCWW-----  162
Lead-CeresClone21563      GWVTI I MTEK PI I KYI LI GA LGLLVI TSKD  153
gi|55296017               GWVTI I MTEK PI I KYLLI GA LGLLVI TSKE  180
CeresClone:528914         GWVTI I MTEK PI I KYI LI GA LGLLVI TSKD  180
CeresClone:103157         GWVTI I MTEK PI I KYI LI GA LGLLVI TSKD  153
gi|20465737               GWVTI I MTEK PI I KYI LI GA LGLLVI-TSKD  180
gi|62318522               GWVTI I MTEK PI I KYI LI GA LGLLVI TSKD  180

Consensus                 GWVTI I MTEK PI I KYI LI GA LGLLVI TSKD  180
```

```
Lead-CeresClone6397   -MSSSDSVNN GVNSRMYFRN PSFSNVI--L NDNWSDLPLS VDDSQDMAIY   47
gi|57012876           MYQPISI--- --EFPVYHRI SSFSSLMPCL TDTWGDLPLK VDDSEDMVIY   45
gi|3342211            MDQQLPPTNF PVDFPVYRRN SSFSRLIPCL TEKWGDLPLK VDDSEDMVIY   50

Consensus             M-Q-----N- -V-FPVY-RN SSFS-LIPCL TD-WGDLPLK VDDSEDMVIY   50

Lead-CeresClone6397   NTLRDAVSSA WTP------- -------SVP PVTSPAEEDK PPAITKASSH   83
gi|57012876           GLLSDALTTG WTPFNLISIE IKAEPREEIE PATSPVPSVA PPAETTTA-Q   94
gi|3342211            GLLKDALSVG WSPFNFTAGE VKSEPREEIE SSPEFSPS-- -PAETTAAPA   97

Consensus             GLL-DALS-G WTPFN-T--E -K-EPREEIE P-TSP-PS-- PPAETT-A--  100

Lead-CeresClone6397   APRQKGMQYR GVRRRPWGKF AAEIRDPKKN GARVWLGTYE TPEDAAVAYD  133
gi|57012876           AVVPKGRHYR GVRQRPWGKF AAEIRDPAKN GARVWLGTYE TAEEAALAYD  144
gi|3342211            AETPKGRHYR GVRQRPWGKF AAEIRDPAKN GARVWLGTYE TAEEAAIAYD  147

Consensus             A--PKGRHYR GVRQRPWGKF AAEIRDPAKN GARVWLGTYE TAEEAA-AYD  150

Lead-CeresClone6397   RAAFQLRGSK AKLNFPHLIG SCKYEPVRIR PRRR-SPEPS VS-----DQL  177
gi|57012876           KAAYRMRGSK ALLNFPHRIG LNEPEPVRLT VKRR-SPEPA SSSISPASEN  193
gi|3342211            KAAYRMRGSK AHLNFPHRIG LNEPEPVRVT AKRRASPEPA SS-----SGN  192

Consensus             KAAYRMRGSK A-LNFPHRIG LNEPEPVR-T -KRR-SPEPA SS-----S-N  200

Lead-CeresClone6397   TSEQKRESHV DDGKSSLVVP ------ELDF TVDQFYFDGS LLMDQSECSY  221
gi|57012876           SLPKRRRKAV AAKQAELEVQ SRSNVMQVGC QMEQFPVGEQ LLVS------  237
gi|3342211            GSMKRRRKAV --DKCDGEMA SRSSVMQVGC DIEQLTGVHQ LLVI------  234

Consensus             -S-KRRRKAV ---K--LEV- SRS-VMQVGC Q-EQF----Q LLV-------  250

Lead-CeresClone6397   SDNRI        226
gi|57012876           -----        237
gi|3342211            -----        234

Consensus             -----        255
```

```
CeresClone:480984        ---------- ---------MT ALVTGGSKGI GYAI VEELAQ LGATVHTCAR   32
CeresClone:1371320       ---------- ---------MT ALVTGGSKGI GYAI VEELAQ LGATVHTCAR   32
CeresClone:2618          ---------- ---------MT ALVTGGSKGI GEAVVEELAT LGARI HTCAR   32
gi|3980399               MAKTGESLRD KPRWSLVGMT ALVTGGSKGI GEAVVEELAT LGARI HTCAR   50
gi|21554716              MAKTGESLRD KPRWSLVGMT ALVTGGSKGI GEAVVEELAT LGARI HTCAR   50
gi|3980415               MAKAEENLRD KCRWSLGGMT ALVTGGSKGL GEAVVEELAM LGARVHTCAR   50
Lead-CeresClone14555     -MAKEGGLGE NSRWSLGGMT ALVTGGSKGI GEAVVEELAM LGAKVHTCAR   49
CeresClone:1339647       ---------- ---------MN ALVTGGTKGI GEAVVEELSI LGARVHTCAR   32
gi|34146804              ---------M DKRWSLQGMN ALVTGGTKGI GEAVVEELSI LGARVHTCAR   41

Consensus                ---------- --RWSL-GMT ALVTGGSKGI GEAVVEELA- LGARVHTCAR   50

CeresClone:480984        NEAELNESLN EWNTKGYRVT GSVCDVASRA ERQDLI ARVS NEFNGKLNI L   82
CeresClone:1371320       NEAELNKSLN EWNTKGYRVT GSVCDVASRA ERQDLI ARVS NEFNGKLNI L   82
CeresClone:2618          DETQLQESLR KWQAKGFQVT TSVCDVSSRD KREKLMETVS TI FEGKLNI L   82
gi|3980399               DETQLQESLR KWQAKGFQVT TSVCDVSSRD KREKLMETVS TI FEGKLNI L  100
gi|21554716              DETQLQESLR KWQAKGFQVT TSVCDVSSRD KREKLMETVS TI FEGKLNI L  100
gi|3980415               NETQLQECVR EWQAKGFEVT TSVCDVSSRD QREKLMENVA SI FQGKLNI L  100
Lead-CeresClone14555     DETQLQERLR EWQAKGFQVT TSVCDVSSRD QRVKLMETVS SLYQGKLNI L   99
CeresClone:1339647       DETQLQERLR EWQEKGFQVT TSI CDVSLRE QREKLMETVS SLFQGKLNI L   82
gi|34146804              DETQLQERLR EWQEKGFQVT TSI CDVSLRE QREKLMETVS SLFQGKLNI L   91

Consensus                DETQLQESLR EWQAKGFQVT TSVCDVSSRD QREKLMETVS SI FQGKLNI L  100

CeresClone:480984        VNNVGTNVPK HTLDVTEEDF SFLI NTNLES AYHLSQLAHP LLKASEAANI  132
CeresClone:1371320       VNNVGTNI QK ETLDFTEEDF TFLVNTNLES CFHLSQLAHP LLKASEAANI  132
CeresClone:2618          VNNVGTCI VK PTLQHTAEDF SFTMATNLES AFHLSQLAHP LLKASGSGSI  132
gi|3980399               VNNVGTCI VK PTLQHTAEDF SFTMATNLES AFHLSQLAHP LLKASGSGSI  150
gi|21554716              VNNVGTCI VK PTLQHTAEDF SFTMATNLES AFHLSQLAHP LLKASGSGSI  150
gi|3980415               VNNAGTGI TK PTTEYTAQDY SFLMATNLDS AFHLSQLAHP LLKASGSGSI  150
Lead-CeresClone14555     VNNVGTSI FK PTTEYTAEDF SFVMATNLES AFHLSQLAHP LLKASGSGSI  149
CeresClone:1339647       VNNVGTLMLK PTTEYTAEEF SFLMATNLDS AFHI SQLAHP LLKASGSGSI  132
gi|34146804              VNNVGTLMLK PTTEYTAEEF SFLMATNLDS AFHI SQLAHP LLKASGSGSI  141

Consensus                VNNVGT-I VK PTLEYTAEDF SFLMATNLES AFHLSQLAHP LLKASGSGSI  150
```

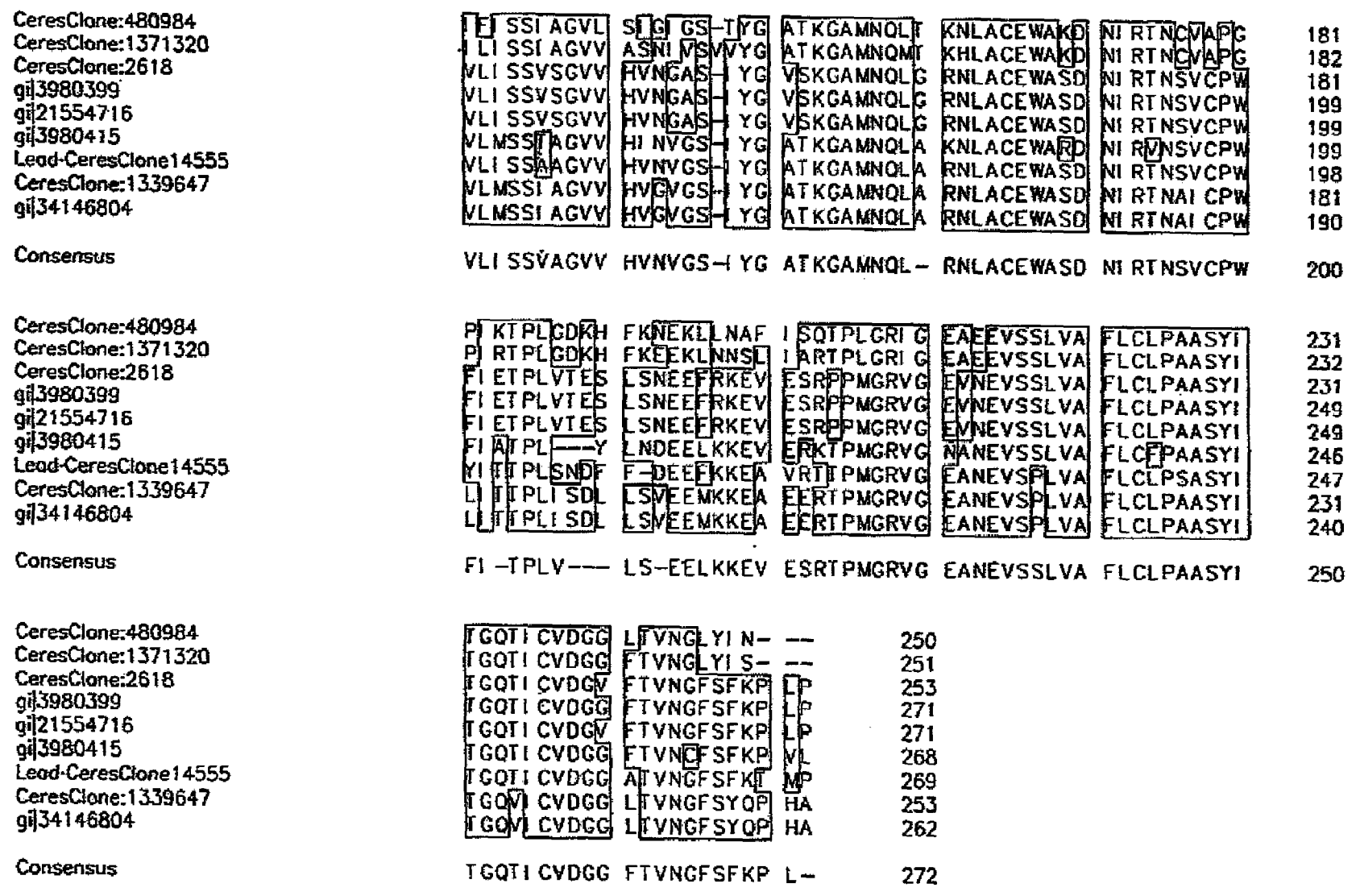

```
CeresClone:480984         TFISSIAGVL SIGIGS-TYG ATKGAMNQLT KNLACEWAKD NIRTNCVAPG  181
CeresClone:1371320        ILISSIAGVV ASNIVSVVYG ATKGAMNQMT KHLACEWAKD NIRTNCVAPG  182
CeresClone:2618           VLISSVSGVV HVNGAS-IYG VSKGAMNQLG RNLACEWASD NIRTNSVCPW  181
gi|3980399                VLISSVSGVV HVNGAS-IYG VSKGAMNQLG RNLACEWASD NIRTNSVCPW  199
gi|21554716               VLISSVSGVV HVNGAS-IYG VSKGAMNQLG RNLACEWASD NIRTNSVCPW  199
gi|3980415                VLMSSTAGVV HINVGS-IYG ATKGAMNQLA KNLACEWARD NIRVNSVCPW  199
Lead-CeresClone14555      VLISSAAGVV HVNVGS-IYG ATKGAMNQLA RNLACEWASD NIRTNSVCPW  198
CeresClone:1339647        VLMSSIAGVV HVGVGS-IYG ATKGAMNQLA RNLACEWASD NIRTNAICPW  181
gi|34146804               VLMSSIAGVV HVGVGS-IYG ATKGAMNQLA RNLACEWASD NIRTNAICPW  190

Consensus                 VLISSVAGVV HVNVGS-IYG ATKGAMNQL- RNLACEWASD NIRTNSVCPW  200

CeresClone:480984         PIKTPLGDKH FKNEKLLNAF ISQTPLGRIG EAEEVSSLVA FLCLPAASYI  231
CeresClone:1371320        PIRTPLGDKH FKEEKLNNSL IARTPLGRIG EAEEVSSLVA FLCLPAASYI  232
CeresClone:2618           FIETPLVTES LSNEEFRKEV ESRPPMGRVG EVNEVSSLVA FLCLPAASYI  231
gi|3980399                FIETPLVTES LSNEEFRKEV ESRPPMGRVG EVNEVSSLVA FLCLPAASYI  249
gi|21554716               FIETPLVTES LSNEEFRKEV ESRPPMGRVG EVNEVSSLVA FLCLPAASYI  249
gi|3980415                FIATPL---Y LNDEELKKEV ERKTPMGRVG NANEVSSLVA FLCFPAASYI  246
Lead-CeresClone14555      YITTPLSNDF F-DEEFKKEA VRTIPMGRVG EANEVSPLVA FLCLPSASYI  247
CeresClone:1339647        LITIPLISDL LSVEEMKKEA EERTPMGRVG EANEVSPLVA FLCLPAASYI  231
gi|34146804               LITIPLISDL LSVEEMKKEA EERTPMGRVG EANEVSPLVA FLCLPAASYI  240

Consensus                 FI-TPLV--- LS-EELKKEV ESRTPMGRVG EANEVSSLVA FLCLPAASYI  250

CeresClone:480984         TGQTICVDGG LTVNGLYIN- --  250
CeresClone:1371320        TGQTICVDGG FTVNGLYIS- --  251
CeresClone:2618           TGQTICVDGV FTVNGFSFKP LP  253
gi|3980399                TGQTICVDGG FTVNGFSFKP LP  271
gi|21554716               TGQTICVDGV FTVNGFSFKP LP  271
gi|3980415                TGQTICVDGG FTVNCFSFKP VL  268
Lead-CeresClone14555      TGQTICVDGG ATVNGFSFKT MP  269
CeresClone:1339647        TGQVICVDGG LTVNGFSYQP HA  253
gi|34146804               TGQVICVDGG LTVNGFSYQP HA  262

Consensus                 TGQTICVDGG FTVNGFSFKP L-  272
```

| | | | | | | |
|---|---|---|---|---|---|---|
| CeresClone:708048 | MAWR-CGSLS | RSVLSAARTI | PTRSSLSPLS | PSLRSHLLHS | RR------PL | 43 |
| CeresClone:719050 | MAFR-SGSLS | RSLMSTARAS | LRPAAPSSTL | PRLRPPPLAA | PRVQSRRFSM | 49 |
| CeresClone:966070 | MAWRNARSAA | RSFAAATARA | PSLRTPTTAL | PRLRPSXSSS | PG---XRFSF | 47 |
| gi\|21554019 | MAWRNAGSAA | RSFVSATARS | PSLRSPTTAL | PRLRPPQSSL | PS---RRFTF | 47 |
| CeresClone:41682 | MAWRNAGSAA | RSFVSATARS | PSLRSPTTAL | PRLRPPQSSL | PS---RRFTF | 47 |
| CeresClone:1345188 | MAWRNAGSAA | RSFVSATARS | PSLRSPTTAL | PRLRPPQSSL | PS---RRFTF | 47 |
| gi\|30679289 | MAWRNAGSAA | RSFVSATARS | PSLRSPTTAL | PRLRPPQSSL | PS---RRFTF | 47 |
| CeresClone:1090313 | MAWRNAGSTA | RSFVSAAARA | PSLRSPTAAL | PRLRPSPSSL | PG---RRSSF | 47 |
| CeresClone:971413 | MAWRNAGSTA | RSFVSAAARA | PSLRSPTAAL | PRLRPSPSSL | PG---RRSSF | 47 |
| Lead-CeresClone4067 | MAWR---SAA | RSFVSATARA | PSLRSPPPTL | PRLRPSQSSL | PR---RRFAS | 44 |
| CeresClone:1117707 | MAWRSAXXAA | RSFVSATARA | PSLRPPPATL | PRLRPSQSSL | PR---RRF-- | 45 |
| CeresClone:873165 | MAWRSAGSAA | RSFVSATARA | PSLRPPPATL | PRLRPSQSSL | PR---RRF-- | 45 |
| Consensus | MAWRNAGSAA | RSFVSATARA | PSLRSPT-AL | PRLRPSQSSL | P----RRF-F | 50 |

| | | | | | | |
|---|---|---|---|---|---|---|
| CeresClone:708048 | NTLPRTVG L | VCTHSLMPLH | SADASARLTS | HI SVESRACC | ELSQGT---- | 89 |
| CeresClone:719050 | -PASRNLGQL | GCTHSLLPL- | ---GITCMTS | HIAVSARACC | ELSHGTFRRS | 94 |
| CeresClone:966070 | SSPSRNLGAL | GCTQSFLPLY | SVVAASQLTS | HLNVNLRAFC | ELPNGT---- | 93 |
| gi\|21554019 | SSPSRNLGAL | GCTQSFLPLY | SVVATSQLTS | HLNVNLRAFC | ELSNGT---- | 93 |
| CeresClone:41682 | SSPSRNLGAL | GCTQSFLPLY | SVVATSQLTS | HLNVNLRAFC | ELSNGT---- | 93 |
| CeresClone:1345188 | SSPSRNLGAL | GCTQSFLPLY | SVVATSQLTS | HLNVNLRAFC | ELSNGTFQRT | 97 |
| gi\|30679289 | SSPSRNLGAL | GCTQSFLPLY | SVVATSQLTS | HLNVNLRAFC | ELSNGT---- | 93 |
| CeresClone:1090313 | SLPSRNIGAL | GCTQSFLPLY | SVVAASQLTS | HLNVNLRAFC | ELSNGT---- | 93 |
| CeresClone:971413 | SLPSRNIGAL | GCTQSFLPLY | SVVAASQLTS | HLNVNLRAFC | ELSNAI---- | 93 |
| Lead-CeresClone4067 | FTNPRNLGEL | GCTESFLPLY | NVVAAARLTS | HLNVNLRAFC | ELSNGT---- | 90 |
| CeresClone:1117707 | -TNPRNLGEL | GCTQSLLPLH | NVVASARLIS | HLNLNVRAFC | ELPNGT---- | 90 |
| CeresClone:873165 | -TNPRNLGEL | GCTQSLLPLH | NVVASARLIS | HLNLNVRAFC | ELPNGN---- | 90 |
| Consensus | STPSRNLGAL | GCTQSFLPLY | SVVA-SQLTS | HLNVNLRAFC | ELSNGT---- | 100 |

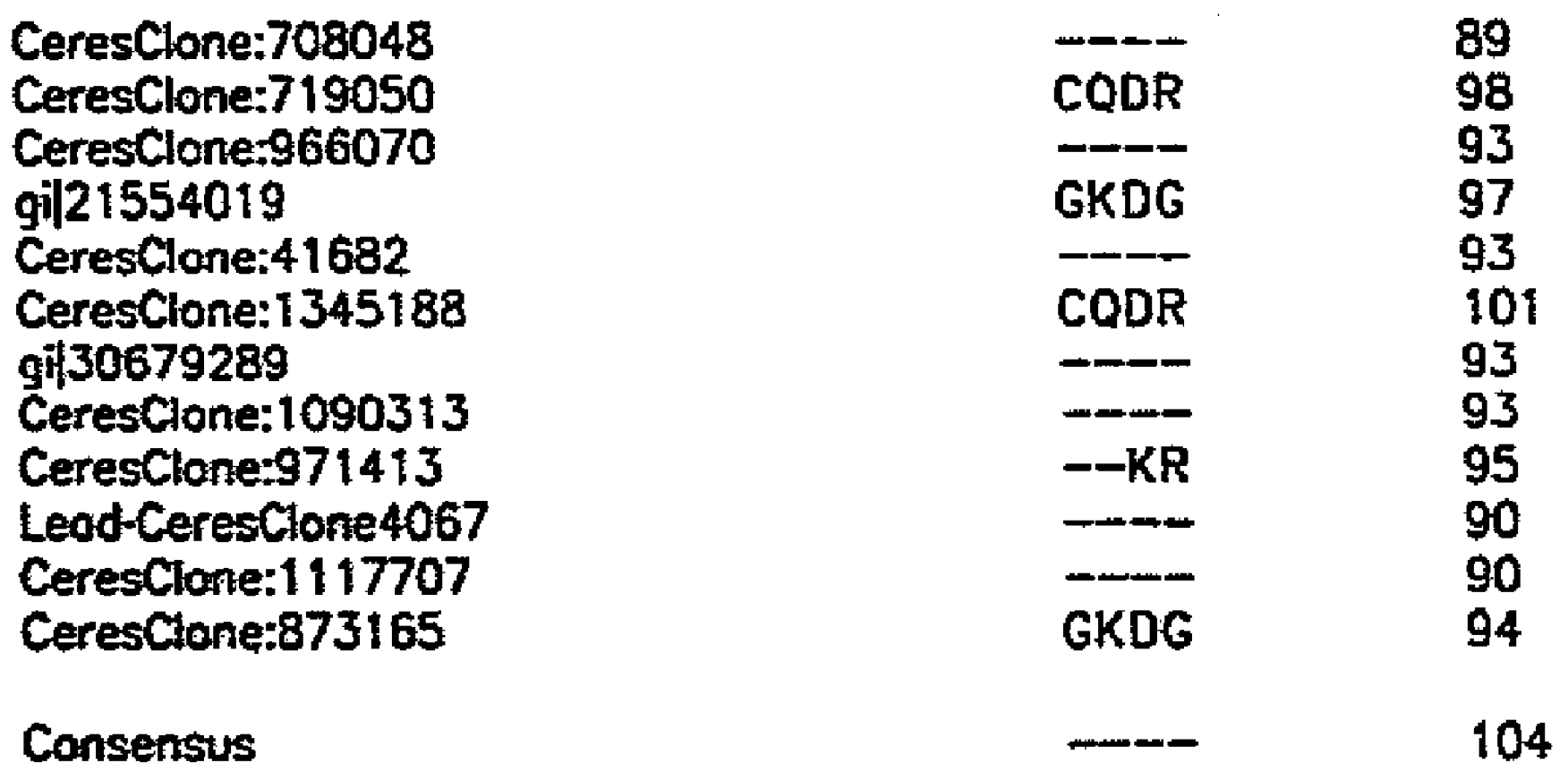

| | | |
|---|---|---|
| CeresClone:708048 | ---- | 89 |
| CeresClone:719050 | CQDR | 98 |
| CeresClone:966070 | ---- | 93 |
| gi\|21554019 | GKDG | 97 |
| CeresClone:41682 | ---- | 93 |
| CeresClone:1345188 | CQDR | 101 |
| gi\|30679289 | ---- | 93 |
| CeresClone:1090313 | ---- | 93 |
| CeresClone:971413 | --KR | 95 |
| Lead-CeresClone4067 | ---- | 90 |
| CeresClone:1117707 | ---- | 90 |
| CeresClone:873165 | GKDG | 94 |
| Consensus | ---- | 104 |

```
Lead-CeresClone733804  MSSRRSRSRQ -SGSSRI TDE QI SDLVSKLQ DLLPEARL-R G-NDRVPSSR  47
gi|28416803            MSSRRSSRSR QSGSSRI SDD QI SDLVSKLQ HLI PELRR-R R-SDKVSASK  48
CeresClone:18200       MSSRRSSRSR QSGSSRI SDD QI SDLVSKLQ HLI PELRR-R R-SDKVSASK  48
CeresClone:560681      MSSRRS--RQ QSASTRI SDD QI IDLVSKLR QLVPEI RD-R R-SDKVSASK  46
CeresClone:562428      MSSRRS--RQ QSASTRI SDD QI IDLVSKLR QLVPEI RD-R R-SDKVSASK  46
CeresClone:1247092     MSGRRSRSRQ SSG---I SED QI NDLI IKLQ QLLPELRNSR R-SDKVSASR  46
CeresClone:653656      MSSRRSRSRQ TSSSRNI TDD QI NDLVSKLQ QLLPEI RD-R R-SDKVSASK  48
CeresClone:663844      MSSRRSRSRQ TSSSRNI TDD QI NDLVSKLQ QLLPEI RD-R R-SDKVSASK  48
gi|31431968            MSGRRASGR- -------I TDD EI NELI SKLQ SLLPESSRRR GATSRSPATK  43
CeresClone:486120      M--------- ---------- --NELVSKLQ ALLPSSRRRR G-SGQASTAK  28
CeresClone:503296      MSSRRPSSRG -----NI SED EI NELI SKLQ ALLPSSRR-R G-SGQASTIK  43

Consensus              MSSRRS--RQ -S-S--I SDD QI NDLVSKLQ -LLPEI R--R R-SDKVSASK  50

Lead-CeresClone733804  VLQETCIYI R SLHREVDDLS ERLSELLATS DMSSAQAAI I RSLLM-  92
gi|28416803            VLQETCNYI R NLHREVDDLS DRLSELLAST DDNSAEAAI I RSLLNY  94
CeresClone:18200       VLQETCNYI R NLHREVDDLS DRLSELLAST DDNSAETAI I RSLLNY  94
CeresClone:560681      VLQETCNYI R SLHREVDDLS ERLSQLLATI DADSPEAAI I RSLI N-  91
CeresClone:562428      VLQETCNYI R SLHREVDDLS ERLSQLLATI DADSPEAAI I RSLI N-  91
CeresClone:1247092     VLQETCNYI R NLHREVDDLS ERLSELLANT D--TAQAALI RSLLTQ  90
CeresClone:653656      VLQETCNYI R SLHREVDDLS ERLSELLATT D--TAQAAI I RNLLMQ  92
CeresClone:663844      VLQETCNYI R SLHREVGDLS ERLSELLDTT D--TAQAAI I RNLLMQ  92
gi|31431968            LLKEMCSYI K SLHREVDDLS ERLSELMATM DSNSPQADI I RSLLR-  88
CeresClone:486120      LLKETCSYI K SLQREVDDLS DRLSDLLSTM DHNSPAAEI I RSI LRS  74
CeresClone:503296      LLKETCSYI K SLHREVDDLS DRLSDLMATM DHNSPGAEI I RSI LRS  89

Consensus              VLQETCNYI R SLHREVDDLS ERLSELLATT D-NSAQAAI I RSLL--  96
```

| | | | | | | |
|---|---|---|---|---|---|---|
| gi\|445612 | ---------- | ---------- | ---MADKAVT | IRTRKFMTNR | LLARKQFIID | 27 |
| Lead-CeresClone28643 | ---------- | ---------- | ---MAEKAVT | IKTRNFMTNR | LLARKQFVID | 27 |
| gi\|18377454 | ---------- | ---------- | ---MAEKAVT | IRTRNFMTNR | LLARKQFVID | 27 |
| CeresClone:27627 | ---------- | ---------- | ---MAEKAVT | IRTRNFMTNR | LLARKQFVID | 27 |
| CeresClone:1051017 | ---------- | ---------- | ---MAEKAVT | IRTRKFMTNR | LLSRKQFVID | 27 |
| CeresClone:1039916 | YPPLSSLPVI | FSLSLSQSAK | IATMAEKAVT | IRARKFMTNR | LLSRKQFVID | 50 |
| CeresClone:25350 | ---------- | ---------- | ---MAEKAVT | IRTRKFMTNR | LLSRKQFVID | 27 |
| gi\|21554374 | ---------- | ---------- | ---MAEKAVT | IRTRKFMTNR | LLSRKQFVID | 27 |
| CeresClone:1078224 | ---------- | ---------- | ---MSEKAVT | IRTRKFMTNR | LLSRKQFVID | 27 |
| CeresClone:1123729 | SFFSPLPTNE | RTNELKASQR | DLTMAEKAVT | IRTRKFMTNR | LLSRKQFVID | 50 |
| CeresClone:1421186 | ---FRSRSER | VANRRELGGI | AAAMAEKAVT | IRTRKFMTNR | LLSRKQFVID | 47 |
| CeresClone:1372632 | ---------- | ---------- | ---MAEKAVT | IRTRKFMTNR | LLSRKQFVID | 27 |
| CeresClone:1374198 | ---------- | ---------- | ---MAEKAVT | IRTRKFMTNR | LLSRKQFVID | 27 |
| Consensus | ---------- | ---------- | ---MAEKAVT | IRTRKFMTNR | LLSRKQFVID | 50 |

| | | | | | | |
|---|---|---|---|---|---|---|
| gi\|445612 | VLHPGRANVS | KAELKEKLAR | MYEVKDTNAI | FVFKFRTHFG | GGKSTGFGLI | 77 |
| Lead-CeresClone28643 | VLHPGRANVS | KAELKEKLAR | MYEVKDPNAI | FCFKFRTHFG | GGKSSGYGLI | 77 |
| gi\|18377454 | VLHPGRANVS | KAELKEKLAR | MYEVKDPNAI | FCFKFRTHFG | GGKSSGYGLI | 77 |
| CeresClone:27627 | VLHPGRANVS | KAELKEKLAR | MYEVKDPNAI | FCF--RTHFG | GGKSSGYGLI | 75 |
| CeresClone:1051017 | VLHPGRANVS | KAELKEKLAR | MXEVXDPNAI | FVFKFRTHFG | GGKSSGFGLI | 77 |
| CeresClone:1039916 | VLHPGRANVS | KAELKEKLAR | MYEVKDPNAI | FVFKFRTHFG | GGKSSGFGLI | 100 |
| CeresClone:25350 | VLHPGRANVS | KAELKEKLAR | MYEVKDPNAI | FVFKFRTHFG | GGKSSGFGLI | 77 |
| gi\|21554374 | VLHPGRANVS | KAELKEKLAR | MYEVKDPNAI | FVFKFRTHFG | GGKSSGFGLI | 77 |
| CeresClone:1078224 | VLHPGRANVS | KAELKEKLAR | MYEVKDPNAI | FVFKFRTHFG | GGKSSGFGLI | 77 |
| CeresClone:1123729 | VLHPGRANVS | KAELKEKLAR | MYEVKDPNAI | FVFKFRTHFG | GGKSSGFGLI | 100 |
| CeresClone:1421186 | VLHPGRANVS | KAELKEKLAR | MYEVKDPNAI | FVFKFRTHFG | GGKSSGFGLI | 97 |
| CeresClone:1372632 | VLHPGRANVS | KAELKEKLAR | MYEVKDPNAI | FVFKFRTHFG | GGKSSGFGLI | 77 |
| CeresClone:1374198 | VLHPGRANVS | KAELKEKLAR | MYEVKDPNAI | FVFKFRTHFG | GGKSSGFGLI | 77 |
| Consensus | VLHPGRANVS | KAELKEKLAR | MYEVKDPNAI | FVFKFRTHFG | GGKSSGFGLI | 100 |

| | | | | | | |
|---|---|---|---|---|---|---|
| gi\|445612 | YDSVENAKKY | EPKYRLI RNG | LDTKVEKSRK | QMKERKNRAK | KVRGVKK-KA | 127 |
| Lead-CeresClone28643 | YDTVENAKKF | EPKYRLI RNG | LDTKI EKSRK | QI KERKNRAK | KI RGVKKTKA | 127 |
| gi\|18377454 | YDTVENAKKF | EPKYRLI RNG | LDTKI EKSRK | QI KERKNRAK | KI RGVKKTKA | 127 |
| CeresClone:27627 | YDTVENAKKF | EPKYRLI RNG | LDTNI EKSRK | QI KERKNRAK | KI RGVKKTKA | 125 |
| CeresClone:1051017 | YDNVESAKKF | EPKYRLI RNG | LDTKI EKSRK | QI KERKNRAK | KI RGVXKTKA | 127 |
| CeresClone:1039916 | YDNVESAKKF | EPKYRLI RNG | LDTKI EKSRK | QI KERKNRAK | KI RGVKKTKA | 150 |
| CeresClone:25350 | YDTVESAKKF | EPKYRLI RNG | LDTKI EKSRK | QI KERKNRAK | KI RGVKKTKA | 127 |
| gi\|21554374 | YDTVESAKKF | EPKYRLI RNG | LDTKI EKSRK | QI KERKNRAK | KI RGVKKTKA | 127 |
| CeresClone:1078224 | YDNVESAKKF | EPKYRLI RNG | LDTKI EKSRK | QI KERKNRAK | KI RGVKKTKA | 127 |
| CeresClone:1123729 | YDNVESAKKF | EPKYRLI RNG | LDTKI EKSRK | QI KERKNRAK | KI RGVKKTKA | 150 |
| CeresClone:1421186 | YDNVESAKKF | EPKYRLI RNG | LDTKI EKSRK | QI KERKNRAK | KI RGVKKTKA | 147 |
| CeresClone:1372632 | YDNVESAKKF | EPKYRLI RNG | LDTKI EKSRK | QI KERKNRAK | KI RGVKKTKA | 127 |
| CeresClone:1374198 | YDNVESAKKF | EPKYRLI RNG | LDTKI EKSRK | QI KERKNRAK | KI RGVKKTKA | 127 |
| Consensus | YDNVESAKKF | EPKYRLI RNG | LDTKI EKSRK | QI KERKNRAK | KI RGVKKTKA | 150 |

| | | |
|---|---|---|
| gi\|445612 | GDAKKK | 133 |
| Lead-CeresClone28643 | GDAKKK | 133 |
| gi\|18377454 | GDTKKK | 133 |
| CeresClone:27627 | GDAKKK | 131 |
| CeresClone:1051017 | GDPKK- | 132 |
| CeresClone:1039916 | GDPKKK | 156 |
| CeresClone:25350 | GDAKKK | 133 |
| gi\|21554374 | GDAKKK | 133 |
| CeresClone:1078224 | GDPKKK | 133 |
| CeresClone:1123729 | GDPKKK | 156 |
| CeresClone:1421186 | GDPKKK | 153 |
| CeresClone:1372632 | GDPKKK | 133 |
| CeresClone:1374198 | GDPKKK | 133 |
| Consensus | GDPKKK | 156 |

| | | | | | | |
|---|---|---|---|---|---|---|
| CeresClone:703180 | MSSRRSRQQS | ASTRISDDQI | IDLVSKLRQL | VPEIRD-RRS | DKVSASKVLQ | 49 |
| CeresClone:560681 | MSSRRSRQQS | ASTRISDDQI | IDLVSKLRQL | VPEIRD-RRS | DKVSASKVLQ | 49 |
| gi\|9294226 | MSNRRSRQTS | NASRISDDQM | IDLVSKLRQF | LPEIHERRRS | DKVSASKVLQ | 50 |
| Lead-CeresClone4734 | MSNRRSRQSS | SAPRISDNQM | IDLVSKLRQI | LPEIGQRRRS | DKASASKVLQ | 50 |
| CeresClone:951040 | MSNRRSRQSS | SAPRISDDQI | IDLVTKLRQI | LPEIGQRRRS | DKVSASKVLQ | 50 |
| Consensus | MSNRRSRQSS | -ATRISDDQI | IDLVSKLRQ- | LPEI--RRRS | DKVSASKVLQ | 50 |

| | | | | | | |
|---|---|---|---|---|---|---|
| CeresClone:703180 | ETCNYIRSLH | REVDDLSERL | SQLLATIDAD | SPEAAIIRSL | IN | 91 |
| CeresClone:560681 | ETCNYIRSLH | REVDDLSERL | SQLLATIDAD | SPEAAIIRSL | IN | 91 |
| gi\|9294226 | ETCNYIRKLH | REVDNLSDRL | SQLLDSVDED | SPEAAVIRSL | LM | 92 |
| Lead-CeresClone4734 | ETCNYIRNLN | REVDNLSERL | SQLLESVDED | SPEAAVIRSL | LM | 92 |
| CeresClone:951040 | ETCNYIRNLN | REVDNLSERL | AQLLESVDED | SPQAAVIRSL | LM | 92 |
| Consensus | ETCNYIR-LH | REVDNLSERL | SQLLESVDED | SPEAAVIRSL | LM | 92 |

```
CeresClone:1061370     -MAGVRSLVL LLLVLAVALS A---SASSIA GGDHLQLGLL S--GGAGRGE   44
gi|37695573.           -MGVPSYLIV CVLVGAFFIS M---AAAGDN GSY----DWM V---PARSGE   39
gi|16566316            -MGVPSGLIL CVLIGAFFIS M---AAAGDS GAY----DWV M--PARSGGG   40
gi|42374767            -MGVPSGLIL CVLIGAFFIS M---ATAGDS GAY----DWV M--PARSGRG   40
CeresClone:706764      MANTYSWLFL AICATLLLLL S--SSPTADA GALGMEMTWI P---------   39
CeresClone:588880      MANSYTWLFL AISATLLLLL S--SSPTADA GALGMEMTWI P---------   39
gi|28628203            MAKWSSWFLI SATILI LMAM G---LSSTVQ GSGDHHLGWI P---ATRSSV   44
gi|28628205            MARLNSFFLI SATVLI LMVM GWPSTVQGNG DHHHHHLGWI PTTATTRSSI   50
CeresClone:628637      MGSSTTFCAF FLVCTI LSVH V----AQSSS STLDLDTFFL P------LKSG   41
CeresClone:628130      -MGSSTFCAF FLLCAI LAVH V----AQSSS STLDLDAFFL P------LKSG   40
CeresClone:5455        -MRGLSTKPV AIIIAI LTVH FLFAAVTSQS SG-----DFV P-----I ESK   39
Lead-CeresClone9221    ---MTNTRAI YAVIAI LAIV I---SAVEST GDFGDSLDFV RAGSSSLFSG   44
CeresClone:975562      ----MNSRAI YAVVAI LAIV I--SAVDASG FGFGHSLDFV RTGSSTLFSG   44

Consensus              -----S---I --LV-I L-I - M-------S-S G-----L-WI P-------S-   50

CeresClone:1061370     C-RGTVAEC- -GGEDAEGEL GSASAEAHRR VLQGRGYI SY GALRRGTVPC   91
gi|37695573            C-KGSI AEC- -MAEE--DEF ALDS-ESNRR I LATKKYI SY GALQKNSVPC   83
gi|16566316            C-KGSI GEC- -I AEE--EEF ELDS-ESNRR I LATKKYI SY GALQKNSVPC   84
gi|42374767            C-NGSI GEC- -MAEE--DEF ELDS-ESNRR I LATKKYI SY GALQKNSVPC   84
CeresClone:706764      ---------S- -MPME--EEF QLDS-EI SRR I LATTKYI SY GALQRNTVPC   76
CeresClone:588880      ---------S- -MPME--EEF QLDS-EI SRR I LATTKYI SY GALQRNTVPC   76
gi|28628203            C-KGSI AEC- -MAEDG-EEF EMDT-EI NRR I LATTKYVSY GALQRNNVPC   89
gi|28628205            CDKGSLAEC- -MAEEDGEEF GMDT-EI NRR I LATSRYVSY GALQKNNVPC   97
CeresClone:628637      C-RGSVAECS LLAGDDDTEF LMES-ESNRR I LAGRSYI SY GALRRNTVPC   89
CeresClone:628130      C-RGSVAKCS LLAGDD-AEF LMES-ESNRR I LAGRSYI SY GALRRNTVPC   87
CeresClone:5455        C-NGTI AECS LSTAE--EEF EMDS-EI NRR I LATTKYI SY GALRRNTVPC   85
Lead-CeresClone9221    C-TGSI AEC- -I AEE--EEM EFDS-DI SRR I LAQKKYI SY GAMRRNSVPC   88
CeresClone:975562      C-EGSI AEC- -I AEE--EEM EFDS-DI SRR I LAQKKYVSY GAMRKNSVPC   88

Consensus              C-KGSI AEC- -MAEE--EEF E-DS-EI NRR I LATKKYI SY GALQRN-VPC   100
```

| | | | | | |
|---|---|---|---|---|---|
| CeresClone:1061370 | NRRGASYYNC | RPGAQANPYH | RGCSRI TRCR | G | 122 |
| gi\|37695573 | SRRGASYYNC | KPGAQANPYT | RGCSAI TRCR | S | 114 |
| gi\|16566316 | SRRGASYYNC | KPGAQANPYS | RGCSAI TRCR | S | 115 |
| gi\|42374767 | SRRGASYYNC | KPGAQANPYS | RGCSAI TRCR | S | 115 |
| CeresClone:706764 | SRRGASYYNC | QPGAQANPYS | RGCSAI TRCR | S | 107 |
| CeresClone:588880 | SRRGASYYNC | QPGAQANPYS | RGCSAI TRCR | S | 107 |
| gi\|28628203 | SRRGASYYNC | QRGAQANPYS | RGCSRI TRCR | S | 120 |
| gi\|28628205 | SRRGASYYNC | KNGAQANPYS | RGCSRI TRCR | G | 128 |
| CeresClone:628637 | SRRGASYYNC | RPGAQANPYS | RGCSAI TRCR | R | 120 |
| CeresClone:628130 | SRRGASYYNC | RPGAQANPYS | RGCSAI TRCR | R | 118 |
| CeresClone:5455 | SRRGASYYNC | RRGAQANPYS | RGCSAI TRCR | R | 116 |
| Lead-CeresClone9221 | SRRGASYYNC | QRGAQANPYS | RGCSTI TRCR | R | 119 |
| CeresClone:975562 | SRRGASYYNC | QRGAQANPYR | RGCSTI TRCR | R | 119 |
| Consensus | SRRGASYYNC | RPGAQANPYS | RGCSAI TRCR | – | 131 |

```
CeresClone:868632       MEGKEEDVRL GANRYSEHQP IGTAAQGGGA DKKDYKEPPP APFFEAGELT   50
CeresClone:909689       ---------- ---------- -METGGGGDF AAKDYTDPPP APLIDAAELA   29
Lead-CeresClone11929    ---------- --------MT KEVVGDKRSF SGKDYQDPPP EPLFDATELG   32
CeresClone:275791       ---------- -----MGKEV DVSTLEAGGV RDRDYADPPP APLIDIDELG   35
CeresClone:546486       ---------- -------MAX DLXTEIQSCL PHKDYHDPPP XPFYDPAELR   33
CeresClone:1379318      ---------- ---------- ---------- ---------- -----MGELK    5
CeresClone:7108         ---------- ---------- ---------- ---------- -----MGELK    5
CeresClone:39154        ---------- ---------- ---------- ---------- -----MGELK    5
CeresClone:33231        ---------- ---------- ---------- ---------- -----MEELR    5
CeresClone:25220        ---------- ---------M AKDVEGPEGF QTRDYEDPPP TPFFDADELT   31

Consensus               ---------- ---------- ---------- --KDY-DPPP -P--DM-ELK   50

CeresClone:868632       SWSFYRAGIA EFLATFLFLY ISVLFVMG-- ------VVGNP SGSKCGTVGI   93
CeresClone:909689       SWSLYRAVIA EFIATLLFLY ITVATVIGYK HQTDPAVNSA ADAACGGVGV   79
Lead-CeresClone11929    KWSFYRALIA EFIATLLFLY VTIMTVIGYK SQTDPALN-P DQ--CTGVGV   79
CeresClone:275791       KWSLYRAVIA EFVATLLFLY ITVATVIGYK HQTDASAS-G PDAACSGVGI   84
CeresClone:546486       KWSFFRALIA EFVATLLFLY VTILTVIGYN HQTATAAE-P -----CSGVGV   78
CeresClone:1379318      SWSFYRALIA EFIATLLFLY VTVATVIGHK KQTGP----- -----CDGVGL   46
CeresClone:7108         SWSFYRALIA EFIATLLFLY VTVATVIGHK KQTGP----- -----CDGVGL   46
CeresClone:39154        SWSFYRALIA EFIATLLFLY VTVATVIGHK KQTGP----- -----CDGVGL   46
CeresClone:33231        KWPLYRAVIA EFVATLLFLY VSIETVIGYK AQTDATAG-G VD--CGGVGI   52
CeresClone:25220        KWSLYRAVIA EFVATLLFLY ITVLTVIGYK IQSDIKVG-G VD--CGGVGI   78

Consensus               -WSFYRALIA EFIATLLFLY VTV-TVIGYK -QTDP----- ----C-GVGI  100

CeresClone:868632       QGIAWSFGGM IFVLVYCTAG ISGGHINPAV TFGLFLARKL SLIRAVFYIV  143
CeresClone:909689       LGIAWAFGGM IFVLVYCTAG ISGGHINPAV TFGLFLARKV SLVRALLYMI  129
Lead-CeresClone11929    LGIAWAFGGM IFILVYCTAG ISGGHINPAV TFGLLLARKV TLVRAVMYMV  129
CeresClone:275791       LGIAWAFGGM IFILVYCTAG ISGGHINPAV TFGLFLARKV SLVRALLYMA  134
CeresClone:546486       LGIAWAFGGM IFVLVYCTAG ISGGHINPAV TFGLFLARKV SLIRAVGYMV  128
CeresClone:1379318      LGIAWAFGGM IFVLVYCTAG ISGGHINPAV TFGLFLARKV SLVRAVGYMI   96
CeresClone:7108         LGIAWAFGGM IFVLVYCTAG ISGGHINPAV TFGLFLARKV SLVRALGYMI   96
CeresClone:39154        LGIAWAFGGM IFVLVYCTAG ISGGHINPAV TFGLFLARKV SLVRALGYMI   96
CeresClone:33231        LGIAWAFGGM IFVLVYCTAG ISGGHINPAV TVGLFLARKV SLVRTVLYIV  102
CeresClone:25220        LGIAWAFGGM IFILVYCTAG ISGGHINPAV TFGLFLARKV SLIRAVLYMV  128

Consensus               LGIAWAFGGM IFVLVYCTAG ISGGHINPAV TFGLFLARKV SLVRAVLYMV  150
```

```
CeresClone:868632       MQCLGAICGA GVVKGFQTTL YQGNGGGANS VAPGYTKGDG LGAEIVGTFV  193
CeresClone:909689       AQCLGAMCGV GLVKAFRAPT SSGTAAAPTR SPPATPRAPA SLRRSSGTFV  179
Lead-CeresClone11929    AQCLGAICGV ALVKAFQSAY FTRYGGGANG LSDGYSIGTG VAAEIIGTFV  179
CeresClone:275791       AQSLGAICGV ALVKGFQSGF YARYGGGANE VSAGYSIGTG LAAEIIGTFV  184
CeresClone:546486       AQMLGAISGV GLVKALQKSY YNRYKGCVNM LADGYSKGTG LGAEIIGTFI  178
CeresClone:1379318      AQCLGXICGV GFVKAFMKTP YNTLGGGANT VADGYSTGTA LGAEIIGTFV  146
CeresClone:7108         AQCLGAICGV GFVKAFMKTP YNTLGGGANT VADGYSKGTA LGAEIIGTFV  146
CeresClone:39154        AQCLGAICGV GFVKAFMKTP YNTLGGGANT VADGYSKGTA LGAEIIGTFV  146
CeresClone:33231        AQCLGAICGC GFVKAFQSSY YTRYGGGANE LADGYNKGTG LGAEIIGTFV  152
CeresClone:25220        AQCLGAICGV GFVKAFQSSY YDRYGGGANS LADGYNTGTG LAAEIIGTFV  178

Consensus               AQCLGAICGV G-VKAFQS-Y Y-RYGGGANT VADGYSKGTG LGAEIIGTFV  200

CeresClone:868632       LVYTVFSATD AKRSARDSHV PILAPLPIGF AVFLVHLATI PITGTGINPA  243
CeresClone:909689       LVYTVFSATD PKRSARDSHV PVLAPLPIGF AVFMVHLATI PITGTGINPA  229
Lead-CeresClone11929    LVYTVFSATD PKRSARDSHV PVLAPLPIGF AVFIVHLATI PITGTGINPA  229
CeresClone:275791       LVYTVFSATD PKRNARDSHV PVLAPLPIGF AVFMVHLATI PITGTGINPA  234
CeresClone:546486       LVYTVFSATD PKRVARDSHV PVLAPLPIGF AVFMVHLATI PITGTGINPA  228
CeresClone:1379318      LVYTVFSATD PKRSARDSHI PVLAPLPIGF AVFMVHLATI PITGTGINPA  196
CeresClone:7108         LVYTVFSATD PKRSARDSHI PVLAPLPIGF AVFMVHLATI PITGTGINPA  196
CeresClone:39154        LVYTVFSATD PKRSARDSHI PVLAPLPIGF AVFMVHLATI PITGTGINPA  196
CeresClone:33231        LVYTVFSATD PKRNARDSHV PVLAPLPIGF AVFMVHLATI PITGTGINPA  202
CeresClone:25220        LVYTVFSATD PKRNARDSHV PVLAPLPIGF AVFMVHLATI PITGTGINPA  228

Consensus               LVYTVFSATD PKRSARDSHV PVLAPLPIGF AVFMVHLATI PITGTGINPA  250

CeresClone:868632       RSLGAAIIYN KKQAWDDHWI FWVGPFIGAA LAALYHVVVI RAI------P  287
CeresClone:909689       RSLGAAVIYN KDKAWDDQWI FWVGPMIGAA IAAFYHQYIL RAGAIKALGS  279
Lead-CeresClone11929    RSLGAAIIYN KDKAWDHHWI FWVGPFAGAA IAAFYHQFVL RAGAIKALGS  279
CeresClone:275791       RSLGAAVVYN NSKAWSDQWI FWVGPFIGAA IAALYHQFVL RASA-RGYGS  283
CeresClone:546486       RSLGPAVIFN NEKAWDDQWI FWVGPFIGAA LAAFYHQSVL MAQAAKALGS  278
CeresClone:1379318      RSFGAAVIYN NEKAWDDHWI FWVGPFVGAL AAAAYHQYIL RAAAVKALAS  246
CeresClone:7108         RSFGAAVIYN NEKAWDDQWI FWVGPFLGAL AAAAYHQYIL RASAIKALGS  246
CeresClone:39154        RSFGAAVIYN NEKAWDDQWI FWVGPFLGAL AAAAYHQYIL RASAIKAFGS  246
CeresClone:33231        RSFGAAVIYN NEKAWDDQWI FWVGPMIGAA AAAFYHQFIL RAAAIKALGS  252
CeresClone:25220        RSFGAAVIYN KSKPWDDHWI FWVGPFIGAA IAAFYHQFVL RASGSKSLGS  278

Consensus               RS-GAAVIYN NEKAWDDQWI FWVGPFIGAA IAAFYHQY-L RASAIKALGS  300
```

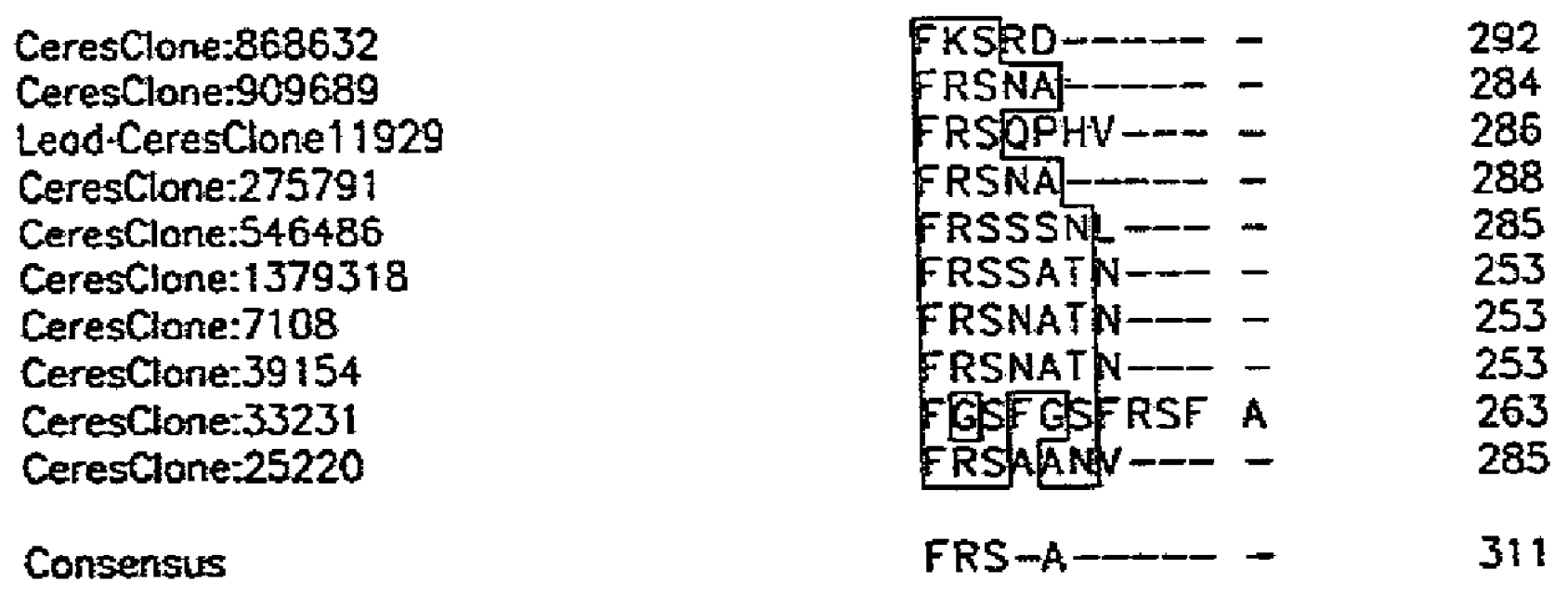

| | | |
|---|---|---|
| CeresClone:868632 | FKSRD------ - | 292 |
| CeresClone:909689 | FRSNA------ - | 284 |
| Lead-CeresClone11929 | FRSQPHV---- - | 286 |
| CeresClone:275791 | FRSNA------ - | 288 |
| CeresClone:546486 | FRSSSNL---- - | 285 |
| CeresClone:1379318 | FRSSATN---- - | 253 |
| CeresClone:7108 | FRSNATN---- - | 253 |
| CeresClone:39154 | FRSNATN---- - | 253 |
| CeresClone:33231 | FGSFGSFRSF A | 263 |
| CeresClone:25220 | FRSAANV---- - | 285 |
| Consensus | FRS-A------ - | 311 |

| | | | | | | |
|---|---|---|---|---|---|---|
| Lead-CeresClone16865 | MASKRI LKEL | KDLQKDPPTS | CSAGPVAEDM | FHWQATI MGP | AESPYSGGVF | 50 |
| CeresClone:1031152 | MASKRI LKEL | KDLQKDPPTS | CSAGPVGEDM | FHWQATI MGP | SDSPFTGGLF | 50 |
| CeresClone:437144 | MASKRI LKEL | KDLQKDPPTS | CSAGPVGEDM | FHWQATI MGP | SDSPFAGGVF | 50 |
| Consensus | MASKRI LKEL | KDLQKDPPTS | CSAGPVGEDM | FHWQATI MGP | SDSPF-GGVF | 50 |
| Lead-CeresClone16865 | LVTI HFPPDY | PFKPPKVAFR | TKVFHPNI NS | NGSI CLDI LK | EQWSPALTI S | 100 |
| CeresClone:1031152 | LVNI HFPPDY | PFKPPKVSFR | TKVFHPNI NS | NGSI CLDI LK | EQWSPALTI S | 100 |
| CeresClone:437144 | LVNI HFPPDY | PFKPPKVSFR | TKVFHPNI NS | NGSI CLDI LK | EQWSPALTI S | 100 |
| Consensus | LVNI HFPPDY | PFKPPKVSFR | TKVFHPNI NS | NGSI CLDI LK | EQWSPALTI S | 100 |
| Lead-CeresClone16865 | KVLLSI CSLL | TDPNPDDPLV | PEI AHMYKTD | RAKYKATARN | WTQKYAMG | 148 |
| CeresClone:1031152 | KVLLSI CSLL | TDPNPDDPLV | PEI AHMYKTD | RAKYESTARS | WTQKYAMG | 148 |
| CeresClone:437144 | KVLLSI CSLL | TDPNPDDPLV | PEI AHMYKTD | RAKYESTARS | WTQKYAMG | 148 |
| Consensus | KVLLSI CSLL | TDPNPDDPLV | PEI AHMYKTD | RAKYESTARS | WTQKYAMG | 148 |

```
CeresClone:1242841     MEGV-PHPI P RTVEEVFTDF KGRRAGLI KA LTTDVEKFYQ QCDPEKENLC  49
gi|12651665            MEGMAQHPVP RTVEEVFSDY KGRRAGLI KA LTTDVEKFYQ LVDPEKENLC  50
CeresClone:96978       MEGI -QHPI P RTVEEVFSDF RGRRAGLI KA LSTDVQKFYH QCDPEKENLC  49
gi|30017229            MEGI -QHPI P RTVEEVFSDF RGRRAGLI KA LSTDVQKFYH QCDPEKENLC  49
Lead-CeresClone38635   MEGI -THPI P RTVEEVFSDF RGRRAGLI KA LTNDMVKFYQ TCDPEKENLC  49
CeresClone:1375513     MEVI -THPTP RTVDEVFTDF RGRRAGLI KA LTTDMVKFYQ TCDPEKENLC  49

Consensus              MEGI -QHPI P RTVEEVFSDF RGRRAGLI KA LTTDV-KFYQ QCDPEKENLC  50

CeresClone:1242841     LYGFPNETWE VNLPVEEVPP ELPEPALGI N FARDGMQEKD WLSLVAVHSD  99
gi|12651665            LYGFPNETWE VNLPVEEVPP ELPEPALGI N FARDGMQEKD WLSLVAVHSD  100
CeresClone:96978       LYGLPNETWE VNLPVEEVPP ELPEPALGI N FARDGMQEKD WI SLVAVHSD  99
gi|30017229            LYGLPNETWE VNLPVEEVPP ELPEPALGI N FARDGMQEKD WI SLVAVHSD  99
Lead-CeresClone38635   LYGLPNETWE VNLPVEEVPP ELPEPALGI N FARDGMQEKD WVSLVAVHSD  99
CeresClone:1375513     LYGLPNETWE VNLPVEEVPP ELPEPALGI N FARDGMQEKD WVSLVAVHSD  99.

Consensus              LYGLPNETWE VNLPVEEVPP ELPEPALGI N FARDGMQEKD W-SLVAVHSD  100

CeresClone:1242841     SWLLAVAFYF GARFGFGKNE RKRLFQMI ND LPTI FELVTG SAKQSKDQPA  149
gi|12651665            SWLLAVAFYF GARFGFGKND RKRLFQMI ND LPTVFELATG TAKQSKDQLT  150
CeresClone:96978       SWLI SVAFYF GARFGFGKNE RKRLFQMI ND LPTI FEVVTG NAKQSKDQSA  149
gi|30017229            SWLI SVAFYF GARFGFGKNE RKRLFQMI ND LPTI FEVVTG NAKQSKDQSA  149
Lead-CeresClone38635   SWLLSVAFYF GARFGFGKNE RKRLFQMI NE LPTI FEVVSG NAKQSKDLSV  149
CeresClone:1375513     SWLLSVAFYF GARFGFGKNE RKKLFQMI NE LPTI FEI VTG NAKQSKDLSG  149

Consensus              SWLLSVAFYF GARFGFGKNE RKRLFQMI ND LPTI FEVVTG NAKQSKDQSA  150

CeresClone:1242841     AHNNG--SKC KSSG-KSHQS ESQAKGMKM- SAPPK----E EDESGEEEEE  191
gi|12651665            AHNNGSNSKY KSSG-KSRQS ESQTKGVKM- SAPVK----E EVDSGEEEEE  194
CeresClone:96978       NHN-S--SRS KSSGGKPRHS ESHTKASKM- SPPPR----K EDESGDEDE-  190
gi|30017229            NHN-S--SRS KSSGGKPRHS ESHTKASKM- SPPPR----K EDESGDEDE-  190
Lead-CeresClone38635   NNN-N--SKS KPSGVKSRQS ESLTKVAKMS SPPPKEEEEE EDESEDESE-  195
CeresClone:1375513     NNNTS--SKS KSNG------ ---LKVPKMS SPPPK----E EDESEDEDE-  183

Consensus              NHN-S--SKS KSSG-KSRQS ES-TK-SKM- SPPPK----E EDESGDEDE-  200
```

| | | | | | | |
|---|---|---|---|---|---|---|
| CeresClone:1242841 | -DDEQGATCG | ACGDNYGTDE | FWI CCDMCER | WFHGKCVKI T | PAKAEHI KQY | 240 |
| gi\|12651665 | DDDEQGATCG | ACGDNYGTDE | FWI CCDMCEK | WFHGKCVKI T | PAKAEHI KQY | 244 |
| CeresClone:96978 | -DDEQGAVCG | ACGDNYGGDE | FWI CCDACEK | WFHGKCVKI T | PAKAEHI KHY | 239 |
| gi\|30017229 | -DDEQGAVCG | ACGDNYGGDE | FWI CCDACEK | WFHGKCVKI T | PAKAEHI KHY | 239 |
| Lead-CeresClone38635 | -DDEQGAVCG | ACGDNYGTDE | FWI CCDACEK | WFHGKCVKI T | PAKAEHI KHY | 244 |
| CeresClone:1375513 | -DDEQGAVCG | ACGDSDGTDE | FWI CCDACEK | WFHGKCVKI T | PAKAEHI KHY | 232 |
| Consensus | -DDEQGAVCG | ACGDNYGTDE | FWI CCDACEK | WFHGKCVKI T | PAKAEHI KHY | 250 |

| | | |
|---|---|---|
| CeresClone:1242841 | KCPSC-SNKR VRV- | 252 |
| gi\|12651665 | KCPGC-SI KK PRI G | 257 |
| CeresClone:96978 | KCPSCITSKK MKA- | 252 |
| gi\|30017229 | KCPSCITSKK MKA- | 252 |
| Lead-CeresClone38635 | KCPTC-SNKR ARP- | 256 |
| CeresClone:1375513 | KCPSC-SNKR ARP- | 244 |
| Consensus | KCPSC-SNK- MR-- | 264 |

```
Leod-CeresClone107988   MASGGSKSAA FMLLMLNLGL YFVITIIASW AVNHGIERTR ESASTLSLPA   50
CeresClone:948896       MASGGSKSAA FMLLLLNLGL YFVVTIIAAW AVNHGIERAR ESASVLSLPA   50
CeresClone:705978       --------MG SALLSLNLIM YVVVAVIAGW AINYSIDESR NSLKGATPPV   42
gi|50878365             MATGGPSSMS AGLLFLNLVL YVVVAVIAGW AINYSIDESF NSLQGVSPPV   50
CeresClone:685420       --------MA SGLLFLNLIM YVVVAVIAGW AVNYSIEDSA HSLRGASPPV   42

Consensus               MASGG--SMA S-LL-LNLVL YVVVAVIAGW AVNYSIEESR NSL-GLSPPV   50

Leod-CeresClone107988   KIFPIYFPVG NMATGFFVIF TLIAGVVGMA TSLTGIINVL QWDSPNLHSA   100
CeresClone:948896       KIFPIYFPVG NMATGFFVIF TLIAGVVGMA TSLTGIMNVL EWDSPNLHSA   100
CeresClone:705978       RLFPIYFPIG NLATGFFVIF ALVTGVVGIS TSLAGLHEVS QGYPASMMSA   92
gi|50878365             RLFPIYFPIG NLATGFFVIF ALLAGVVGVS TSLTGLHDVS QGYPASMMSA   100
CeresClone:685420       RLFPVYFPMG NLATGFFVIF ALLAGAVGIS TSLTGLRDVT EGYPASMMSA   92

Consensus               RLFPIYFP-G NMATGFFVIF AL-AGVVG-S TSLTGL--VS QGYPANMMSA   100

Leod-CeresClone107988   AASSLISWSL TLLAMGLAC- --KEINIGWT EANLRTLEVL TIIVSATQLL   147
CeresClone:948896       AASSLISWSL TLLAMGLAC- --KEINIGWT EANLRTLEVM TIIVSGTQLL   147
CeresClone:705978       AASALVTWTL TVXRHGASVQ GDQPQREARE PAHLGGVHHH PDRHAAALRR   142
gi|50878365             AAASIVTWTL TLLAMGLAC- --KEISIGWR PPSLRALETF TIILAGTQLL   147
CeresClone:685420       AASALVTWTL TLLAMGLAC- --KEISIGLR PPSLRALETF TIILACTQLL   139

Consensus               AASSLVTWTL TLLAMGLAC- --KEI-IGW- PA-LR-LE-- TII-AGTQLL   150

Leod-CeresClone107988   CTGAIHAGVG ETVA---SGE RPHLGRV   171
CeresClone:948896       CTGAIHVGVG ETV----DAV RPHVGRA   170
CeresClone:705978       VAPRRRARGH PGDAYRRQSL AEVRDDS   169
gi|50878365             CAGSLHAGAH VAI------Q NPMVSRV   169
CeresClone:685420       CVGSLHAGAN AAIV---QTP MGVRARV   163

Consensus               C-G--HAG-H ---------- -PVV-RV   177
```

```
gi|50872446               MGRAPCCDKA SVKKGPWSPE EDAKLKSYIE QNGTGGNWIA LPQKIGLKRC  50
Lead-CeresClone154718     MGRAPCCDKA NVKKGPWSPE EDAKLKSYIE NSGTGGNWIA LPQKIGLKRC  50
gi|2832408                MGRAPCCDKA NVKKGPWSPE EDAKLKSYIE NSGTGGNWIA LPQKIGLKRC  50

Consensus                 MGRAPCCDKA NVKKGPWSPE EDAKLKSYIE NSGTGGNWIA LPQKIGLKRC  50

gi|50872446               GKSCRLRWLN YLRPNIKHGG FSEEEDRIIL SLYISIGSRW SIIAAQLPGR  100
Lead-CeresClone154718     GKSCRLRWLN YLRPNIKHGG FSEEEENIIC SLYLTIGSRW SIIAAQLPGR  100
gi|2832408                GKSCRLRWLN YLRPNIKHGG FSEEEENIIC SLYLTIGSRW SIIAAQLPGR  100

Consensus                 GKSCRLRWLN YLRPNIKHGG FSEEEENIIC SLYLTIGSRW SIIAAQLPGR  100

gi|50872446               TDNDIKNYWN TRLKKKLFGK QSRKDQR--- QQQHLARQAA AAASDLQIKQ  147
Lead-CeresClone154718     TDNDIKNYWN TRLKKKLINK QRKELQEACM EQQEMMVMMK RQHQQQQIQT  150
gi|2832408                TDNDIKNYWN TRLKKKLINK QRKELQEACM EQQEMMVMMK RQHQQQQIQT  150

Consensus                 TDNDIKNYWN TRLKKKLINK QRKELQEACM EQQEMMVMMK RQHQQQQIQT  150

gi|50872446               EASRGANEAD GLAAGANYTW H-HHHAMAVP VHPMSAPMVV EGGRVGDDVD  196
Lead-CeresClone154718     SFMMRQDQ-- -----TMFTW PLHHHNVQVP ALFMNQTNSF CDQE---DVK  190
gi|2832408                SFMMRQDQ-- -----TMFTW PLHHHNVQVP ALFRIKPTRF ATKK---MLS  190

Consensus                 SFMMRQDQ-- -----TMFTW PLHHHNVQVP ALFM--P--F --------DV-  200

gi|50872446               ESIRKLLFKL GGNPFAASPA PPCIPPPPMY EEAPSFVPPL ---AHGVPLN  243
Lead-CeresClone154718     PVLIKNMVKI EDQELEKTNP HHHQDSMTNA FDHLSFSQLL LDPNHNHLGS  240
gi|2832408                QCSSRTWSRS KIKNWRKQTS SSSRFN-DNA FDHLSFSQLL LDPNHNHLGS  239

Consensus                 ----K---K- ------K--- --------NA FDHLSFSQLL LDPNHNHLGS  250

gi|50872446               EGGMQCSSVL ------PALE L-DENFHFNH VKLDGLECLF GM-----GDH  281
Lead-CeresClone154718     GEGFSMNSIL SANTNSPLLN TSNDNQWFGN FQAETVNLFS GASTSTSADQ  290
gi|2832408                GEGFSMNSIL SANTNSPLLN TSNDNQWFGN FQAETVNLFS GASTSTSADQ  289

Consensus                 GEGFSMNSIL SANTNSPLLN TSNDNQWFGN FQAETVNLFS GASTSTSADQ  300
```

```
gi|50872446                ONNRWNEVSP LVCPNNAVAS SSQGMQQYCL VEEPADLGMQ   321
Lead-CeresClone154718      STI SWEDI SS LVYSDS---- ------KQFF- ----------   310
gi|2832408                 STI SWEDI SS LVYSDS---- ------KQFF- ----------   309

Consensus                  STI SWEDI SS LVYSDS---- ------KQFF- ----------   340
```

```
gi|30725634               -MCVLKVANQ EDNVG----K KAESIRDDDH RTLSEIDQWL YLFAAEDDHH   45
Lead-CeresClone691319     -MSLLTVAHQ RGSCEFIRFT ESHGGGGDDV SGDGEHG--- ---CGHDDGS   43
CeresClone:1475648        MCCAPKVANA EGRGP----C RCCAGGEED- ---------- -----DEDG-   29

Consensus                 -MC-LKVANQ EG-G------ ----GG-DD- ----E----- ------DDG-   50

gi|30725634               --------RH SFPTQQPPPS SSSSSLISGF SR-EMEMSAI VSALTHVVAG   86
Lead-CeresClone691319     GAGGSLGLNF NQVMQQGEVT MQGGSLVSGY NRGDPELREI VSALTHVVSS   93
CeresClone:1475648        ---------- ----QQPAAA WR---MLSGY ER-SREASMM VDALATVVAG   61

Consensus                 ---------- ----QQP--- ----SL-SGY -R---E-S-I VSALTHVVAG  100

gi|30725634               NVPQHQQGCG ECSC------ ---------- ---EGTSNSS SSSGQKRRRE  117
Lead-CeresClone691319     GSGQRSTELT QQSGFPMMSA SSLSRLSAFS SSSPSPSSGA SWVGHKRGRE  143
CeresClone:1475648        GATPPATAGA RQQ------- ---------- ---QVSPEGQ WWSDYYAG--   89

Consensus                 G--Q--T-G- -QSG------ ---------- ------S-G- SWSG-KRGRE  150

gi|30725634               VEEGG-AKAV KAANTLTVDQ YFSG-GSSTS KVREASSNMS GPGPTYEYTT  165
Lead-CeresClone691319     EEENSTSHNL MQQQQQSAPR LFRNIGDFMV PSQGDSSSVT EEAPTSTTTT  193
CeresClone:1475648        --------DV TPPPSLPAPA AHEH-GAARI PATAASPSSS SQAPS-----  125

Consensus                 -EE------V -----L-AP- -F---G---- P---ASSS-S --APT---TT  200

gi|30725634               TATASSETSS FSGDQPRRRY RGVRQRPWGK WAAEIRDPEK AARVWLGTFD  215
Lead-CeresClone691319     VTAVTENPP- -GGGERRRKY RGVRQRPWGK WAAEIRDPHK AARVWLGTFD  241
CeresClone:1475648        -------PSS TGSGTPRRRY RGVRQRPWGK WAAEIRDPHK AARVWLGNFD  168

Consensus                 -------PSS -GGG-PRRRY RGVRQRPWGK WAAEIRDPHK AARVWLGTFD  250

gi|30725634               NAESAARAYD EAALRFRGNK AKLNFPENVK LVRPASTEAQ PVHQTAAQRP  265
Lead-CeresClone691319     TEEAAARAYD EAALRFRGNR AKLNFPENVR AVPPIQPFQA TTRLTVSDST  291
CeresClone:1475648        TAEAAARAYD VAALRFRGSR AKLNFPESAT LAAP-----P PTAAAAAVPP  213

Consensus                 TAEAAARAYD EAALRFRGNR AKLNFPENV- LV-P------ PT--TAA--P  300
```

```
gi|30725634              TQSRNSGSTT TLLPIRPASN QSVHSQPLMQ SYNLSYSEMA R---------  306
Lead-CeresClone691319    TSQFRPLSAV APPFIQQPQI QG--SSDLIR DY-LQYSQLL QSDFQQQQIQ  338
CeresClone:1475648       PPS------- -PPPQRPEAL LE--SQALAL AGGREYSEYA R---------  244

Consensus                T-S----S-- -PPPIRP--- Q---SQ-L-- -Y-L-YSE-A R---------  350

gi|30725634              ---------- -----QQQQF QQHHQQSLDL YDQMSFPLRF G------HTGG  336
Lead-CeresClone691319    QQQQQQRQQQ QRQRQQRQQQ QQQQQQPSSL LQQLYYNAQF ASLQSPSMLS  388
CeresClone:1475648       ---------- ---------F LQCPADPPRL YDQ------- ------APAA  262

Consensus                ---------- -----Q-QQF QQ---QQP--L YDQ------F ----------  400

gi|30725634              SMMQSTSSSS SHSRPL---F SPAAVQP--- --------PP ESASEIGYLQ  372
Lead-CeresClone691319    SSPSFSSSVS PAPFPL---F TTSASFPLFS SQQMGYFQPP ESRNPAGGVP  435
CeresClone:1475648       TVPSAASGSA SSSFPVLFRF GGGGESSGAA SSQWWTQGSR SVSQEGAGSP  312

Consensus                S-PS--SSSS S-SFPL---F ---A--P--- S-Q------PP ES--E-GG-P  450

gi|30725634              DIQWPSDKTS NNYNNSPSS-  391
Lead-CeresClone691319    --EFPTSTWS DTSSQPPPSG  453
CeresClone:1475648       PASWADSAWW PAPPRDPPR-  331

Consensus                ---WP-S-WS -------PPS-  470
```

```
CeresClone:953501          -------MAN S--PTAAEQL CYIPCNFCNL VLA--VSVPC SSLFDLVTVR  39
CeresClone:888225          --------MD L--VSPSEHL CYVRCTYCNT VLALQVGVPC KRLMDTVTVK  40
gi|40645413                --------MD L--VSPSEHL CYVRCTYCNT VLA--VGVPC KRLMDTVTVK  38
Lead-CeresClone226122      --------MD M--VSQSEHL CYVRCTYCNT VLA--VGVPC KRLMDTVTVK  38
CeresClone:425913          ---------M ---------- ---------- ---------- ----------   1
gi|60649824                --------MD FL-PGSTDHL CYVRCNFCDT LLA--VGVPC RRLMDTVTVK  39
gi|58891028                --------MD L--IPSPEHL CYVRCNFCST VLA--VGIPC KRFLDTVTVK  38
CeresClone:9132            -------MTA SRASPQAEHL YYVRCSICNT ILA--VGIPL KRMLDTVTVK  41
CeresClone:545652          --------MD L--VPPSEHL CYVRCNFCNT VLA--VGIPC KRLLDTVTVK  38
gi|58891059                MNLEEKSVMD SQAPTQSEHL CYVRCNFCNT VLA--VGIPC KRMLDTVTVK  48
gi|58891213                ---------- ---VPQSEHL CYVRCNFCNT VLA--VGIPC KRLLETVTVK  35
gi|58891235                ---------- ---VPQSEHL CYVRCNFCNT VLA--VGIPC KRLLETVTVK  35
gi|58891129                --------MD L--AQTSEHL CYVRCSFCNT VLA--VGIPF KRLLDTVTVK  38
gi|41745674                --------MD MANQSSSEHL CYVRCNFCST VLA--VGIPC KRLMDTVTVK  40

Consensus                  --------MD L--V--SEHL CYVRCNFCNT VLA--VGIPC KRLMDTVTVK  50

CeresClone:953501          CGHCTNLWSV NMA-AA-LQS LSRP--NFQV TPYATPEYGS SSRGHTKISS  85
CeresClone:888225          CGHCNNLSFL SPRPPPMVQP LSPNDHHHPM GPF---QGWT -DCRRNQPLP  86
gi|40645413                CGHCNNLSFL SPR-PPMVQP LSPT--DHPL GPF---QGPCT -DCRRNQPLP  82
Lead-CeresClone226122      CGHCNNLSYL SPR-PPMVQP LSPT--DHPL GPFQCQGPCN -DCRRNQPLP  84
CeresClone:425913          ---------- -------VQP LSPT--DHPL GPFQCQGPCS -ECRRNQPLP  31
gi|60649824                CGHCSHLSFL SAR-PL-LQN QSLE--LLST -----QNFCG -DNKKS-QQS  78
gi|58891028                CGHCGNISFL STR-PP-IQG QCLD---HQV DAF--QSFRN -EYRKGQSSS  80
CeresClone:9132            CGHCGNLSFL TTT-PP-LQG -------HVS LTLQMQSFCG SDYKKGSSSS  82
CeresClone:545652          CGHCSNLSFL STR-PPSSQS QSVD--HTLS L----QGFYS -NAKKGQASS  80
gi|58891059                CGHCSNLSFL SVR-PP-LHG QCLD--HQVN LTLQTQSFCG NELKKGSSSS  94
gi|58891213                CGHCSNLSFL STR-PP-LQG QCLD--PQTS LTL--QSFCG -DFRKGTQFP  78
gi|58891235                CGHCSNLSFL STR-PP-LQG QCLD--PQTS LTL--QSFCG -DFRKGTQFP  78
gi|58891129                CGHCSNLSFL STR-PP-LQG QCFD--HQTA LQH--QAFFS -DYKKGQSSS  81
gi|41745674                CGHCSNLSFL STR-PP-IQG QYYD--HQTS LHH--QSLCS -EFKKGGSSS  83

Consensus                  CGHCSNLSFL STR-PP-LQG QS-D-----S L----QSFCS -D-RKGQ-SS 100
```

| | | | | | | |
|---|---|---|---|---|---|---|
| CeresClone:953501 | RISARTLSE- | ------QRIV | NRPPEKRQRV | PSAYNQFIKE | EIQRIKANNP | 128 |
| CeresClone:888225 | PLASPTSSD- | -ASPR-APFV | XKPPEKKHR- | ---------- | ---------- | 112 |
| gi\|40645413 | -LVSPTSNE- | -GSPR-APFV | VKPPEKKHRL | PSAYNRFMRE | EIQRIKAAKP | 128 |
| Lead-CeresClone226122 | -LASPSSTE- | -LSPR-MPFV | VKPPEKKHRL | PSAYNRFMRE | EIQRIKAAKP | 130 |
| CeresClone:425913 | -LASPTSTD- | -LTPR-MPFV | VKPPEKKHRL | PSAYNRFMRE | EIQRIKAAKP | 77 |
| gi\|60649824 | SSSSPLTPNQ | QVVPK-VPNV | VKPPEKKHRL | PSAYNRFMKE | EIKRIKAGNP | 127 |
| gi\|58891028 | -SSSSTSCGQ | PTSPNEPNYV | VKPPERKHRL | PSAYNRYMKE | EIQRIKSANP | 129 |
| CeresClone:9132 | -SSSSTSSDQ | PPSPS-PPFV | VKPPEKKQRL | PSAYNRFMRD | EIQRIKSANP | 130 |
| CeresClone:545652 | SSSSPTTSNE | SVSPKAASFV | VKPPEKKHRL | PSAYNRFMKE | EIQRIKAANP | 130 |
| gi\|58891059 | SSSSSTSSDQ | PSSPK-APFV | VKPPEKKHRL | PSAYNRFMKE | EIQRIKAANP | 143 |
| gi\|58891213 | SPSSSTSSE- | PSSPK-APFV | VKPPEKKHRL | PSAYNRFMKE | EIQRIKAANP | 126 |
| gi\|58891235 | SPSSSTSSE- | PSSPK-APFV | VKPPEKKHRL | PSAYNRFMKE | EIQRIKAANP | 126 |
| gi\|58891129 | SFSSSSSEP- | -SSPK-APFV | VKPPEKKHRL | PSAYNRFMKE | EIQRIKAANP | 128 |
| gi\|41745674 | -FSSSTSSE- | PLSPK-APFV | VKPPEKKHRL | PSAYNRFMKE | EIQRIKAANP | 130 |
| Consensus | --SSSTSS-- | --SPK-APFV | VKPPEKKHRL | PSAYNRFMKE | EIQRIKAANP | 150 |

| | | | | | | |
|---|---|---|---|---|---|---|
| CeresClone:953501 | DISHREAFST | AAKNWAHF-P | HIHFGLMLES | NKQAKLA--- | ---------- | 164 |
| CeresClone:888225 | ---------- | ---------- | ---------- | ---------- | ---------- | 112 |
| gi\|40645413 | DIPHREAFSM | AAKNWAKCDP | RCSSTVSTSN | SNPEPRVVAA | PIPHQ----- | 173 |
| Lead-CeresClone226122 | DIPHREAFSM | AAKNWAKCDP | RCSTAASTET | SNSAPAEPRV | VPTPQLTEPR | 180 |
| CeresClone:425913 | DIPHREAFSM | AAKNWAKCDP | RCSTTASTAT | SNSAPEAARV | VPTPHVTEPR | 127 |
| gi\|60649824 | EIPHREAFSM | AAKNWARFDP | QLLHGSTTST | QIEKQVKPNQ | EIHEMVTAGG | 177 |
| gi\|58891028 | EIPHREAFSS | AAKNWAKYVP | HSQAGTVSGG | KKNERVPAKE | SLDGA----- | 174 |
| CeresClone:9132 | EIPHREAFSA | AAKNWAEYIP | NSPTSITSGG | HNMIHGLGFG | EKK------- | 173 |
| CeresClone:545652 | EIPHREAFSA | AAKNWARFIP | NSPTSSVSAT | KVNAD----- | ---------- | 165 |
| gi\|58891059 | EIPHREAFSA | AAKNWARYIP | NSPPGSISAG | SSSINGFDFG | EMK------- | 186 |
| gi\|58891213 | EIPHREAFSA | AAKNWARYIP | NSPAASSVCG | SSSNEQNDNV | ---------- | 166 |
| gi\|58891235 | EIPHREAFSA | AAKNWARYIP | NSPAASSVCG | SSSNGFYENF | AGTK------ | 170 |
| gi\|58891129 | EIPHREAFSA | AAKNWARYIP | NTPNGPLSES | RNNA------ | ---------- | 162 |
| gi\|41745674 | EIPHREAFSA | AAKNWARYIP | NTPPPVPVTT | SNHNI----- | ---------- | 165 |
| Consensus | EIPHREAFSA | AAKNWARYIP | NSP--SST-- | SN-------- | ---------- | 200 |

| | | | | |
|---|---|---|---|---|
| CeresClone:953501 | ---------- | ---------- | ----- | 164 |
| CeresClone:888225 | ---------- | ---------- | ----- | 112 |
| gi\|40645413 | ----ERANEQ | VVESFDIFKQ | MERSG | 194 |
| Lead-CeresClone226122 | FDLEDRAKGQ | VIESFDIFKH | IERSI | 205 |
| CeresClone:425913 | FDLEDRAKEH | VIESFDIFKQ | IERTI | 152 |
| gi\|60649824 | RVKQEDMRQL | QAAARSQIT- | ----- | 196 |
| gi\|58891028 | ---------- | ---------- | ----- | 174 |
| CeresClone:9132 | ---------- | ---------- | ----- | 173 |
| CeresClone:545652 | ---------- | ---------- | ----- | 165 |
| gi\|58891059 | ---------- | ---------- | ----- | 186 |
| gi\|58891213 | ---------- | ---------- | ----- | 166 |
| gi\|58891235 | ---------- | ---------- | ----- | 170 |
| gi\|58891129 | ---------- | ---------- | ----- | 162 |
| gi\|41745674 | ---------- | ---------- | ----- | 165 |
| Consensus | ---------- | ---------- | ----- | 225 |

```
Lead-CeresClone109912   MAADVSSLVR ILSRFKDDRT VVKDSTGPRS TVALMTRDLL GIGGCVGGGG   50
CeresClone:966236       MTADVSSLVR LLSRYNDDRT TVKDSAROGS SVALMTRDLL GSGSCRGGGG   50

Consensus               M-ADVSSLVR -LSR--DDRT -VKDS----S -VALMTRDLL G-G-C-GGGG   50

Lead-CeresClone109912   GGDEQSLELD LDVQVPNGWE KRLDLKSGKV YLQQQCNSTS SSSSSHHHHH   100
CeresClone:966236       G--DQSLELD LDLKVPNGWE KRLDLKSGKV YLQQQNSTTS S-------HH   91

Consensus               GGD-QSLELD LD--VPNGWE KRLDLKSGKV YLQQQ---TS SSSSSHHHHH   100

Lead-CeresClone109912   HHEDQINQTV PRFQDLNVPP ISDKFPAKPL LSLFDDDDDT SLELKLVPSS   150
CeresClone:966236       RRAEQSNQTF RKFQDLNFPS ---KSPVRPL LSLF---DDT SLELKLVTSS   135

Consensus               ----Q-NQT- --FQDLN-P- ISDK-P--PL LSLFDDDDDT SLELKLV-SS   150

Lead-CeresClone109912   ISRPLPPPLS SFSPNQSLSY LSSVCTLDKV KLALERAEKD T----KKRQS   196
CeresClone:966236       SSSPASSSSS SLCVSSTSSS FQSVCTLDKV KSALERAGRV SSGTLKKRKS   185

Consensus               -S-P-----S S-------S- --SVCTLDKV K-ALERA--- -SGTLKKR-S   200

Lead-CeresClone109912   PEDDGVYDGT ASATVAASQV AAGCPGCLSY VFVAKNNPKC PRCHSFVPLP   246
CeresClone:966236       PEXEDVCDQT ASXAXXXP-V AVGCPGCLSY VLVMKNDPKC XRCHSFVALP   234

Consensus               PED--V-D-T ASA-VAA-QV A-GCPGCLSY V-V-KN-PKC PRCHSFV-LP   250

Lead-CeresClone109912   AMKKPKIDLN ISM          259
CeresClone:966236       AVKRPKIDXN I--          245

Consensus               A-K-PKIDLN ISM          263
```

| | | | | | | |
|---|---|---|---|---|---|---|
| Lead-CeresClone39155 | MTSVSVAVVA | PPHRCPFSSH | LNLNKLSLQI | PRTGWRRKQL | GFALASTAAS | 50 |
| CeresClone:676435 | M--------- | ---------- | ---------- | ---------- | ---------- | 1 |
| Consensus | MTSVSVAVVA | PPHRCPFSSH | LNLNKLSLQI | PRTGWRRKQL | GFALASTAAS | 50 |
| Lead-CeresClone39155 | ESPSEATYDP | ELRLVFELAT | DSELYELEKI | LFGPSYFSPL | LKSIPNKGGG | 100 |
| CeresClone:676435 | ---------- | ---------- | ---------- | ---------- | ---------- | 1 |
| Consensus | ESPSEATYDP | ELRLVFELAT | DSELYELEKI | LFGPSYFSPL | LKSIPNKGGG | 100 |
| Lead-CeresClone39155 | DRLMIGQDIE | VRDGFIEALE | SRFLFLAADA | RSTLRGWRPS | YRNVLLAVRN | 150 |
| CeresClone:676435 | -----GVDLG | LRXQFIAALE | SRFFFLAADA | RSTLRGWRPS | YRNVLLQIRK | 47 |
| Consensus | DRLMIG-D-- | -RD-FI-ALE | SRF-FLAADA | RSTLRGWRPS | YRNVLL--R- | 150 |
| Lead-CeresClone39155 | NLNIPCSSQL | PTEDLEAEIF | LYLVDNFSSE | ASGVFPGMWE | NSEVSEAEGS | 200 |
| CeresClone:676435 | KLNIPCSTQL | STHDLELEIF | LHLLHCNSTE | ---------- | -EESSQGQAT | 86 |
| Consensus | -LNIPCS-QL | -T-DLE-EIF | L-L----S-E | ASGVFPGMWE | N-E-S----- | 200 |
| Lead-CeresClone39155 | LELGLSKWKV | ELLAALQVGA | TEVQSMLKG | GGMITFAKVY | QLLAKKLSGK | 250 |
| CeresClone:676435 | LQHGLSQWKV | QS----KVGA | QDIPSILLKG | GGVFTLSKIY | QLLARKLSGK | 132 |
| Consensus | L--GLS-WKV | --LAAL-VGA | ----S--LKG | GG--T--K-Y | QLLA-KLSGK | 250 |
| Lead-CeresClone39155 | VFLEAANYQI | RKEMLKKGGQ | FAAINLESRA | ALLAAKHGFA | GAASRYIGLK | 300 |
| CeresClone:676435 | VLVEAANYQV | KKELVKKGGQ | LAMINLESRA | AMLAAKQGFL | XAASRYLGFR | 182 |
| Consensus | V--EAANYQ- | -KE--KKGGQ | -A-INLESRA | A-LAAK-GF- | GAASRY-G-- | 300 |
| Lead-CeresClone39155 | TAMQLLGPMM | WGTLLADLVI | QMLETDYARI | LRAIYAFAQI | RITRTYRLPC | 350 |
| CeresClone:676435 | SVVTLLGPVL | WGTFLADLVI | QMLGTDYARI | LRXIYALAQI | RVIRTYRLXS | 232 |
| Consensus | ----LLGP-- | WGT-LADLVI | QML-TDYARI | LRAIYA-AQI | R--RTYRLP- | 350 |

| | | |
|---|---|---|
| Lead-CeresClone39155 | K---- | 351 |
| CeresClone:676435 | EVTDE | 237 |
| Consensus | -VTDE | 355 |

| | | | | | | |
|---|---|---|---|---|---|---|
| gi\|37536842 | -------MAMA | KELQETSSSS | SSSA------A | STSSCSSAVT | DAWSSPARP- | 38 |
| gi\|21908034 | --------MA | QELHETSSCS | ATTT---SSC | TTSCCSSTVT | DSSSSPPSPA | 39 |
| gi\|25990951 | --------MA | QELHETSSCS | ATTT---SSC | TTSCCSSTVT | DSSSSPPSPA | 39 |
| Lead-CeresClone31044 | --------MA | RQINIESSVS | QVIF-ISSAI | PAVSSSSSIT | ASASLSSSPT | 41 |
| CeresClone:902699 | ---------- | -----MESDAG | ENLF-----G | TFSSSTTSIT | ASSSSSPTSS | 31 |
| CeresClone:709819 | TTIIKVSTMR | KRINMESDAD | FNSFATSSSS | TTPSIFFDTN | TSSTSSSSTS | 50 |
| Consensus | --------MA | -EL---SSAS | A-TF---SS- | TTSSCSS-VT | DSSSS--SP- | 50 |

| | | | | | | |
|---|---|---|---|---|---|---|
| gi\|37536842 | --NAVAGCKR | KKEVVGEADE | AAGGGAGEEE | EEEAEAAAAG | KSSAATKKRK | 86 |
| gi\|21908034 | AANAAPATRK | RQALEAEAEA | EAGGE----E | EEEEEEGCAG | NKAAPAKKRP | 85 |
| gi\|25990951 | AANAAPATRK | RQALEAEAEA | EAGGE----E | EEEEEEGCAG | NKAAPAKKRP | 85 |
| Lead-CeresClone31044 | TSSSSSSSTN | SNFIEEDNSK | RKASRRSLSS | LVSVEDDDDQ | NGGGGKRRKT | 91 |
| CeresClone:902699 | TTTSSNSCTK | HDSKISPPQN | QNTPN----- | ---------- | ------SKKRQ | 61 |
| CeresClone:709819 | PTSNSESCTK | EHSKT--PQN | DSTTSQTSLE | NGKDSKGCKK | ------RQTD | 92 |
| Consensus | --NAS-ST-K | ---LEAEA-- | EAGG------E | EEEEEEGCAG | N-AA--KKR- | 100 |

| | | | | | | |
|---|---|---|---|---|---|---|
| gi\|37536842 | RSSDG---KH | PMYRGVRMRA | WGKWVSEIRE | PRKKSRIWLG | TFPTADMAAR | 133 |
| gi\|21908034 | RGSEG---KH | PTFRGVRMRA | WGKWVSEIRE | PRKKSRIWLG | TFPTAEMAAR | 132 |
| gi\|25990951 | RGSEG---KH | PTFRGVRMRA | WGKWVSEIRE | PRKKSRIWLG | TFPTAEMAAR | 132 |
| Lead-CeresClone31044 | NGGD----KH | PTYRGVRMRS | WGKWVSEIRE | PRKKSRIWLG | TYPTAEMAAR | 137 |
| CeresClone:902699 | RSDDNENKHH | PSYRGVRMRA | WGKWVSEIRE | PRKKSRIWLG | TYPTAEMAAR | 111 |
| CeresClone:709819 | NSNQN---HH | PTYRGVRMRN | WGKWVSEIRE | PRKKSRIWLG | TYPTAEMAAR | 139 |
| Consensus | R-SDG---KH | PTYRGVRMRA | WGKWVSEIRE | PRKKSRIWLG | T-PTAEMAAR | 150 |

| | | | | | | |
|---|---|---|---|---|---|---|
| gi\|37536842 | AHDVAALAIK | GRAAHLNFPD | LAGVLPRAAS | ASPKDVQAAA | ALAAAFTTSP | 183 |
| gi\|21908034 | AHDVAALAIK | GRAAHLNFPD | LAGALPRAAS | AAPKDVQAAA | ALAAAFTS-P | 181 |
| gi\|25990951 | AHDVAALAIK | GRAAHLNFPD | LAGALPRAAS | AAPKDVQAAA | ALAAAFTS-P | 181 |
| Lead-CeresClone31044 | AHDVAALAIK | GTTAYLNFPK | LAGELPRPVT | NSPKDIQAAA | SLAAVNWQ-D | 186 |
| CeresClone:902699 | AHDVAALAVK | GHSAFLNFPN | LAQDLPRPTT | TSPKDIQAAA | AKAATTTF-F | 160 |
| CeresClone:709819 | AHDVAALAIK | GHSAYLNFPE | LAQELPRPVS | TSPKDIQAAA | AKAANTAF-- | 187 |
| Consensus | AHDVAALAIK | GRAAHLNFPD | LAGELPR-AS | ASPKD-QAAA | ALAAAFTS-P | 200 |

```
gi|37536842            SSSPSSSLSA DDVAPCVVHA DADEQPAAAA KNDDDDGSTT APVAAAAAAA  233
gi|21908034            SSEPGA--G- -------AHE EPAAKDGAAP EEAAADAQAP VPVALPPPAA  221
gi|25990951            SSEPGA--G- -------AHE EPAAKDGAAP EEAAADAQAP VPVALPPPAA  221
Lead-CeresClone31044   SVNDVS--NS EV-AEIVEAE PSRTVVAQLF SSDTSTTTTT QSQEYSEASC  233
CeresClone:902699      DDEIVN--HC Q--AEKAEQN HGEQQASPST LCMMDNSTEA EQIQAEQASS  206
CeresClone:709819      --EEVR--HC QITEE--EAE QNQAEQASSS TLSMDNPQEP ----------  221

Consensus              SSEPV----- ---AE--EHE E--A--AAA- E-A--D---P -PVA---AAA  250

gi|37536842            A--------- ADEQQLFDLP DLLFDI---- --QDCPFCFP AMWAPLADVD  268
gi|21908034            SRPGTPSSGV EDERQLFDLP DLLLDI---- --RDGFGRFP PMWAPLTDVE  265
gi|25990951            SRPGTPSSGV EDERQLFDLP DLLLDI---- --RDGFGRFP PMWAPLTDVE  265
Lead-CeresClone31044   ASTSACTDKD SEEEKLFDLP DLFTDENEMM IRNDAFCYYS STWQLCG---  280
CeresClone:902699      TQESSSSHST ADEETLFDLP DLFPDG---- --NSGLFSYS SCWHLCA---  247
CeresClone:709819      ----SSSHST IDDDTLFDLP DLFPDG---- --NNGLCSFS SSWHLCA---  258

Consensus              -R-----S--- ADE-QLFDLP DL--DI---- ----DGF--F- SMWA--ADVE  300

gi|37536842            E-VNAELRLE EPLLWDLGVT DA  289
gi|21908034            DVVNAELRLE EPLLWE---- --  281
gi|25990951            EVVNAELRLE EPLLWE---- --  281
Lead-CeresClone31044   --ADAGFRLE EPFFLS---- E-  295
CeresClone:902699      --VDSGFRLE EQFLWE---- NF  263
CeresClone:709819      --VDSGFRLE ESFFYE---- NH  274

Consensus              E-V-A--RLE EP-LWE---- --  322
```

```
CeresClone:695982          -MSAAT---G KPILYSKWFS SCSHRVRIAL NLKGVDFEYR ATN----PMT   42
CeresClone:295402          ---MAT---E KPILYNAMLS SCSHRVRIAL NLKGVDYEYK SVN----PRT   40
CeresClone:340652          ---------- --MLYSYWRS SCSHRARIAL NLKGVDYEYK AVNLLKGEQS   38
Lead-CeresClone18246       MANSGE---E KLKLYSYWRS SCAHRVRIAL ALKGLDYEYI PVNLLKGDQF   47
CeresClone:1376280         MANLGEEKKG KLKLYSYWRS SCAHRVRIAL SLKGLEYEYI PVNLLKGEQS   50

Consensus                  --N------- K-MLYSYWRS SCSHRVRIAL NLKGVDYEYK AVNLLKGEQ-   50

CeresClone:695982          DPDYEKINPV KFVPAFVDGD FVVSDSFAII LYMEDKYPQC PLLPRDLKKK   92
CeresClone:295402          DPDYEKINPI KYIPALVDGD LVVSDSLAIS LYLEDKYPEH PLLPKDLKRK   90
CeresClone:340652          DPEFVKLNPM KFVPALVDGS SVIGDSYAIT LYLEDKYPEP PLLPQDLQKK   88
Lead-CeresClone18246       DSDFKKINPM GTVPALVDGD VVINDSFAII MYLDEKYPEP PLLPRDLHKR   97
CeresClone:1376280         DPDFKKINPM GTVPALVDGD VVISDSLAII MYLDEKYPEP PLLPPDLHKR  100

Consensus                  DPDF-KINPM KFVPALVDGD IVISDSFAII LYLEDKYPEP PLLPRDLKKK  100

CeresClone:695982          ALNLQIASIV CSSIQPLQSH AVIGSYLGTM DTNESLQMVQ HYIDKGFRAI  142
CeresClone:295402          ALNLQIANIV CSSIQPLQGY AVIGLHEGRM SPDEGLHIVQ SYIDKGFRAI  140
CeresClone:340652          ALNHQIASIV ASGIQPLHNL TVLRFIDQKV GAGESVLMIQ QQIERGFTAI  138
Lead-CeresClone18246       AVNYQAMSIV LSGIQPHQNL AVIRYIEEKI NVEEKTAWVN NAITKGFTAL  147
CeresClone:1376280         AVNFQAASIV LSGIQPHQNL GVIKFIEEKI NSEEKTAWVT NAITKGFTAL  150

Consensus                  ALN-QIASIV -SGIQPLQNL AVIRFIEEK- N--E-L-WVQ N-IDKGFTAI  150

CeresClone:695982          EKL--LEGCD SKYATGDEVQ MADVFLAPQI HAGVIRFQID MSKYPILARL  190
CeresClone:295402          EKL--LEGCE SKYATGDDVQ LADVFLEPQI HAGINRFQID MSMYPILERL  188
CeresClone:340652          ENLIQLKGCA GKYATGDEVQ LADVFLAPQI YAAIERTKID MSNYPTLARL  188
Lead-CeresClone18246       EKL--LVNCA GKLATGDEIY LADLFLAPQI HGAINRFQIN MEPYPNLAKC  195
CeresClone:1376280         EKL--LVSCA GKHATGDEVY LADLFLAPQI YGAINRFQIN MEPYPTLAKC  198

Consensus                  EKL--LEGCA GKYATGDEVQ LADVFLAPQI HAAINRFQID MS-YP-LARL  200
```

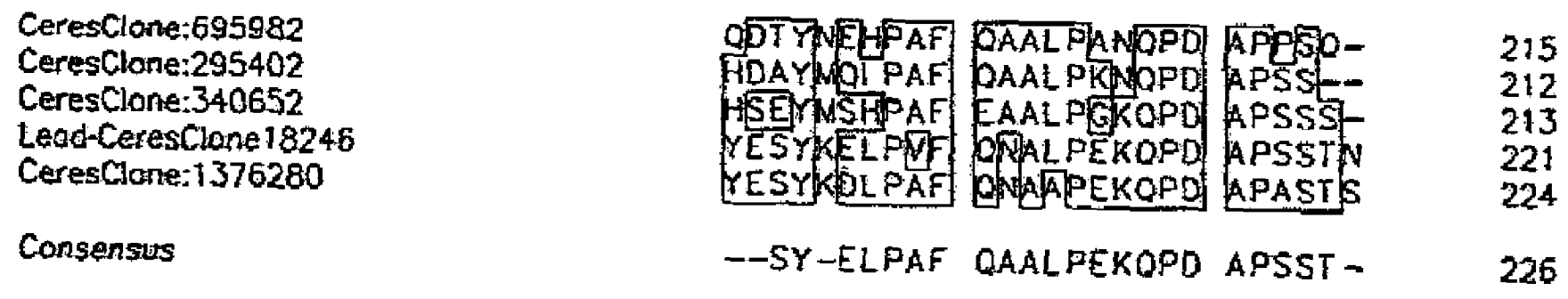

| | | | | |
|---|---|---|---|---|
| CeresClone:695982 | QDTYNEHPAF | QAALPANQPD | APPSQ- | 215 |
| CeresClone:295402 | HDAYMQI PAF | QAALPKNQPD | APSS-- | 212 |
| CeresClone:340652 | HSEYMSHPAF | EAALPGKQPD | APSSS- | 213 |
| Lead-CeresClone18246 | YESYKELPVF | QNALPEKQPD | APSSTN | 221 |
| CeresClone:1376280 | YESYKDLPAF | QNAAPEKQPD | APASTS | 224 |
| Consensus | --SY-ELPAF | QAALPEKQPD | APSST- | 226 |

```
CeresClone:686525         ---------- ---------- ---------- ---------- --NFPF-SSP    7
CeresClone:1524364        ---------- ---------- ---------- ---------- --MD------    2
CeresClone:225086         -----FLLPL PTKPSLTITS RRVVVVVISL ASASTARSPI ACWPALLAMD   45
CeresClone:608685         ---------- ---------- ---------- ---------- --MEDFNNYN    8
Lead-CeresClone13625      ---------- ---------- ---------- ---------- --MEDF---G    5
CeresClone:873093         ---------- ---------- ---------- ---------- --MEDY---N    5
CeresClone:647910         ---------- ---------- ---------- ---------- --ME-F----    3
CeresClone:663726         ---------- ---------- ---------- ---------- --MEEF----    4
CeresClone:855086         NIVVSAPHQY QSIKKTRKSS LKNKHGLPLL AANLRLFVPN PTMEEF----   46

Consensus                 ---------- ---------- ---------- ---------- --MEDF----   50

CeresClone:686525         KRSSTGGFAM ---AAADYDR AYRPYAPSSA ADYDRPYRNE IVPY--GDRR   52
CeresClone:1524364        RSKSYAGGRM ---QIEPYY- -----DGGAR PDF-RSYSYS AGGSGMGTSS   43
CeresClone:225086         RSKSYAGGRM ---QIEPYYG GGGGGGGGAR ADF-RSYSYS AGGT--GPSS   89
CeresClone:608685         KSRSHGNNGQ MMQQMERYYG GAP-PQPTRP YDL-RSYSVS SYTQ--APNN   54
Lead-CeresClone13625      RQRPYGDGGM ---QIQPYHG -----NQGG-- -DF-RSYSAS YGTR--ENNI   42
CeresClone:873093         RQRAYGDTGM ---QIQPYHG GG--PGTG-- -DF-RSYSTS YAT---ENNI   43
CeresClone:647910         RSKSCRDARL ---QIESYCG GK--VSPTSM QDL-RCYSAN NA----ASSA   43
CeresClone:663726         RSKSYGDGRM ---QIEAYRG --------ANI QDL-RCYSAS YASS--VHPT   41
CeresClone:855086         RSKSYGDGRM ---QIEAYRG --------TNM QDL-RCYSAS YASS--VHPT   83

Consensus                 RSKSYGDGRM ---QIE-YHG ---------- -DF-RSYS-S --T-------  100

CeresClone:686525         IDLVVKPPPP TRSPPPPLPV TKSGGGGGI- ----GSAWC- FSDPEVKRRR   96
CeresClone:1524364        YAY----QYE YSGAGAG-EE MKRSKS---- ----KRRWLA LADPDMERKR   80
CeresClone:225086         YSY---NQYE YGGPGAGEEE VKQSKS---- ----KRRW-- LADPDMDRKR  126
CeresClone:608685         YN-------- -----NKDLKM MKKGKSMSSR TSSISKSWSF VTDPEIQRKK   92
Lead-CeresClone13625      YD-------- ---------- VKKEKSIAR- ----SKSWG- ITDPELQRKK   68
CeresClone:873093         YN-------- ---------- IKKEKSIAR- ----SKSWG- ITDPELQRKK   69
CeresClone:647910         YAH------- --QIGSKEVK VKKGKTSATK P---SKSWS- FTDPELQRKK   80
CeresClone:663726         TTTTTTTQTQ MGGNNNNEAK FKKGKSTNGS T---SKSWS- FSDPELQRKK   87
CeresClone:855086         TT-------Q QTQMGNNDAK FKKGKSTNGS T---SKSWS- FSDPELQRKK  122

Consensus                 Y--------- ---------K VKKGKS---- ----SKSW-- --DPELQRKK  150
```

| | | |
|---|---|---|
| CeresClone:686525 | RVASYKAYSV EGKVKASFRR GFRWI KDKCT GFI HG-- | 131 |
| CeresClone:1524364 | RVAAYKAYGV EGKMKGSFRK SFKWI KDRYL NLVYGWS | 117 |
| CeresClone:225086 | RVAAYKAYGV EGRVKGSLRK SFRWVKDRYL DLVYGWS | 163 |
| CeresClone:608685 | RVASYKMYSV EGKVKGSFRK SFRWVKDRYC QVVYGWW | 129 |
| Lead-CeresClone13625 | RVASYKMYGV EGKVKGSFRN SFRWLKQRYT QVVYGWW | 105 |
| CeresClone:873093 | RVASYKMYSV EGKVKGSFRK SFRWLKQRYT QVVYGWW | 106 |
| CeresClone:647910 | RVAGYKI YAA EGKMKGSLRK SFRWI KNTYT QALYGWW | 117 |
| CeresClone:663726 | RVASYKVYAV EGKLKGSLRK SFKWLKDRCN RVVYG-- | 122 |
| CeresClone:855086 | RVASYKVYAV EGKLKGSLRK SFKWFKDRCN RVVYGW- | 158 |
| Consensus | RVASYKMY-V EGKVKGSFRK SFRW-KDRY- QVVYGW- | 187 |

```
Lead-CeresClone12071   MEGKRSQGQG YMKKKSYLVE EDMETD--TD EEEEVGRDRV RGSRGSI NRG   48
gi|62856979            MNLGKVDGSC YQKMVKKEAE EDQVSD---E ELVESGVEEE KKKKGVVGSG   47
gi|55419652            ---------- ----MQEEEE EGVGGD--HG FPDDEKKKKG YGRRCAAGGG   34
gi|1183866             MDTSKGEGKR VI KLPGSQEQ GEEEDD---- I GEDSKKTRA LTPSGKRASG   46
CeresClone:538817      MDGSMSEGKR SMSYKEEDEY EEEEEEEVSE YGDDGKKKRV VSNKRGSKAG   50
gi|30577630            MEASRAEGKR SFMEEEEDQE EEEEEE---- ---EKREMST SSSRRASGSG   43

Consensus              M--S-SEGKR -MK-KEE-EE EDEEED---E -----KK-R- -SSRGAAGSG   50

Lead-CeresClone12071   GSL--RLCQV DRCIADMKEA KLYHRRHKVC EVHAKASSVF LSGLNQRFCQ   96
gi|62856979            GK---RCCQA EKCIADLSDG KQYHKRHKVC EHHAKAQVVL VGGMRQRFCQ   94
gi|55419652            GGVSPPACQV EKCGLDLSDA KRYHRRHKVC EIHAKAPEVV VAGLRQRFCQ   84
gi|1183866             STQ--RSCQV ENCAAEMI NA KPYHRRHKVC EFHAKAPVVL HSGLQQRFCQ   94
CeresClone:538817      GSV-PPSCQV DGCNADLSEA KPYHRRHKVC EYHAKAPAVV IGDQHQRFCQ   99
gi|30577630            GSF-PPTCQV ENCNADLTDA KHYHRRHKVC ESHAKAPI VF VAGGQKRFCQ   92

Consensus              GSV-P-SCQV EKC-ADLSDA K-YHRRHKVC E-HAKAPVV- V-GL-QRFCQ   100

Lead-CeresClone12071   QCSRFHDLQE FDEAKRSCRR RLAGHNERRR KSSGESTYGE GSGRRG----   142
gi|62856979            QCSRFHELSE FDETKRSCRR RLAGHNERRR ENTAES-HAE GSSRKG--TG   141
gi|55419652            QCSRFHELPE FDEAKRSCRR RLAGHNERRR KSSAESSSAA ESSNRRGMMI   134
gi|1183866             QCSRFHELSE FDEAKRSCRR RLAGHNERRR KSSHDT-H-- ----------   131
CeresClone:538817      QCSRFHELSE FDDSKRSCRR RLAGHNERRR KNASEY-HGL ----------   138
gi|30577630            QCSRFHDLSE FDEYKKSCRK RLAGHNERRR KSSSDF-HRE GSN-------   134

Consensus              QCSRFHELSE FDEAKRSCRR RLAGHNERRR KSS-ES-H-E GSS-R-----   150

Lead-CeresClone12071   ---INGQVVM QNQERSRVEM TLPMPNSSFK RPQI R   174
gi|62856979            THQLKDI VCG QVDDRGRI QI T-I HENSTYK HFQI R   175
gi|55419652            SAQLKESHYL ADDQRARVNP MAI HGSSSFK RSQI R   169
gi|1183866             ---------- ---------- ---------- -----   131
CeresClone:538817      ---------- ---------- ---------- -----   138
gi|30577630            ---------- ---------- ---------- -----   134

Consensus              ---L------ ----R-RV-- -----NSSFK --QI R   185
```

```
CeresClone:697370      MGTLLPCHPT LTLLPLLF-- ---------- ---------- ---AAAIVGM   25
CeresClone:338717      -----MQHLA AVLLVL---- ---------- ---------- ---AATTALP   18
Lead-CeresClone641     -----MSSPA TFITFFFFFT LSSFFYITSS LQNNNNNNNK HTATVNSLNI   45
CeresClone:620977      ---------- ---------- ---------- ---------- ----------    0

Consensus              -----M-HPA -TLL-L-F-- ---------- ---------- ---AA-----   50

CeresClone:697370      RCAPVYRP-- ---------- ----EYLVDG NQLVNMQYHM GPVVSGAPFN   59
CeresClone:338717      PGAAAWRPWP PRDNATAAAG LGASKRLEGS SEFVKLEYHM GPVL-ASAIT   67
Lead-CeresClone641     PSAAAEITLV NPKLPPRSLS LTSSKKFEGS SNLVHLRYHM GPVLSSSPIN   95
CeresClone:620977      ---------- ---------- ---------- ---------M GPVL-SSPIN   10

Consensus              P-AAA-RP-- ---------- L--SK-LEGS S-LV-L-YHM GPVLSSSPIN  100

CeresClone:697370      LFLIWYGRWE APAQAVLRDF LASLSAP--A PFPAVSDWWA RTPRLYTDQS  107
CeresClone:338717      VHPIWYGPWP AAQKRTIRAF LRSLSPSAAI PSPSVSAWW- RTVRLYPDQT  116
Lead-CeresClone641     IYVIWYGQWS RPHKSLIRDF LNSISDAK-A PSPSVSEWW- RTASLYTDQT  143
CeresClone:620977      IYLIWYGKWP QSDKLLIKDF LNSISDHRAA PSPSVSDWW- RTVSLYTDQT   59

Consensus              IYLIWYG-WP --QK-LIRDF LNS-SD--AA PSPSVSDWW- RTV-LYTDQT  150

CeresClone:697370      GANVTATFAI AGEHSDAGYS HGASLKRIDM QSIIRTAVVA YPDPLPLDPY  157
CeresClone:338717      SANVSASVSL GAEKSDARMS RGARLSRMDI QAVVRDAVTA RTRPLPVDAS  166
Lead-CeresClone641     GSNVSRSVLI AGEYSDSKYS HGQHLTRLFI QEVIASAA-- RSASFPVDHK  191
CeresClone:620977      GANISRSVSI AGEYSDLRYS HGTHLTRLSV QEVIATAV-- QAKPFPVDHR  107

Consensus              GANVS-SVSI AGEYSDARYS HGAHLTRL-I Q-VI-TAV-A R--P-PVDH-  200

CeresClone:697370      NGVYLVLSSP DVQVEEFCRA MCGFHYFTFA SVVGMTVPYA WVGNSGSQCP  207
CeresClone:338717      GGVYLVLTSP DVAVDDFCGQ VCGFHYFTFA SVVGSTLPYA WVGNSARRCP  216
Lead-CeresClone641     NGMYLVLTSH DVTMQDFCRA VCGFHYFTXP SMVGYTMPYA WVGQSGKQCP  241
CeresClone:620977      NGIYLILTAE DVTMEDFCRA VCGFHYFTFP SKVGYTLPYA WVGNSGKQCP  157

Consensus              NGVYLVLTSP DVT-EDFCRA VCGFHYFTF- SVVGYTLPYA WVGNSGKQCP  250
```

```
CeresClone:697370      GRCAYPFAAP EY-GASGQGV LRPPNGDPGV DGMVLVLGHE LAELATNPLV   256
CeresClone:338717      EVCAYPFAVP AYVRGRRPE- -SPPNGDVGV DGMVSVIAHE LAEMASNPLA   264
Lead-CeresClone641     EVCAYPFALP GYMGHGGPGE LRPPNGEIGV DGMVSVIGHE LAEVVSNPLI   291
CeresClone:620977      EVCAYPFAVP GYMGGGGPGH LFPPNGDVGV DGMVSVIGHE LAELSSNPLV   207

Consensus              EVCAYPFAVP GYMGGGGPG- L-PPNGDVGV DGMVSVIGHE LAELASNPLV   300

CeresClone:697370      NAWYAGDIPT APTEIADLCL GVYGDGGGAG GFVGNVSHA- ADGSSYNVNG   305
CeresClone:338717      NAWYAGGDPS FPTEIADLCE GIYGTGGG-G AYFGQLLTDA RSGAAYNVNG   313
Lead-CeresClone641     NAWYAGEDPT APTEIGDLCE GLYGSGGG-G GYIGQVMRD- REGKTFNMNG   339
CeresClone:620977      NAWYAGEDPT APTEIGDLCE GLYGTGGG-G GYIGSVMKD- GEGRTFNLNG   255

Consensus              NAWYAGEDPT APTEI-DLCE GIYGTGGG-G GYVG-VM-D- REG-T-NVNG   350

CeresClone:697370      VNGRRFLVQW LWNPVLGACY GPNSSN-   331
CeresClone:338717      VGGRRFLVQW VWNPVLSYCS GPNALDQ   340
Lead-CeresClone641     KGGRKFLVQW IWNPNLKACS GPNSVD-   365
CeresClone:620977      RNGRKFLVQW IWSPVLKACA GPNALD-   281

Consensus              --GR-FLVQW IWNPVLKACS GPN-LD-   377
```

```
Lead-CeresClone3819   MAEADDI QPI  VCDNGTGMVK  AGFAGDDAPR  AVFPSVVGRP  RHHGVMVGMN   50
CeresClone:1073372    ----------  -------MVK  AGFAGDDAPR  AVFPSI VGRP  RHTGVMVGMG   33
CeresClone:338602     ----------  -------MVK  AGFAGDDAPR  AVFPSI VGRP  RHTGVMVGMG   33

Consensus             ----------  -------MVK  AGFAGDDAPR  AVFPSI VGRP  RHTGVMVGMG   50

Lead-CeresClone3819   QKDAYVGDEA  QSKRGI LTLK  YPI EHGVVSN  WDDMEKI WHH  TFYNELRI AP  100
CeresClone:1073372    QKDAYVGDEA  QSKRGI LTLK  YPI EHGI VSN  WDDMEN WHH  TFYNELRVAP   83
CeresClone:338602     QKDAYVGDEA  QSKRGI LTLK  YPI EHGI VSN  WDDMEKI WHH  TFYNELRVAP   83

Consensus             QKDAYVGDEA  QSKRGI LTLK  YPI EHGI VSN  WDDMEKI WHH  TFYNELRVAP  100

Lead-CeresClone3819   EEHPVLLTEA  PLNPKANREK  MTQI MFETFN  SPAMYVAI QA  VLSLYASGRT  150
CeresClone:1073372    EEHPVLLTEA  PLNPKANREK  MTH MFETFN  VPAMYVAI QA  VLSLYASGRT  133
CeresClone:338602     EEHPVLLTEA  PLNPKANREK  MTQI MFETFN  TPAMYVAI QA  VLSLYASGRT  133

Consensus             EEHPVLLTEA  PLNPKANREK  MTQI MFETFN  -PAMYVAI QA  VLSLYASGRT  150

Lead-CeresClone3819   TGI VLDSGDG  VSHTVPI YEG  FSLPHAI LRL  DLAGRDLTDY  LMKI LTERGY  200
CeresClone:1073372    TGI VLDSGDG  VSHTVPI YEG  YALPHAI LRL  DLAGRDLTDS  LMKI LTERGY  183
CeresClone:338602     TGI VLDSGDG  VSHTVPI YEG  YALPHAI LRL  DLAGRDLTDY  LMKI LTERGY  183

Consensus             TGI VLDSGDG  VSHTVPI YEG  YALPHAI LRL  DLAGRDLTDY  LMKI LTERGY  200

Lead-CeresClone3819   MFTTTAEREI  VRDI KEKLSF  VAVDYEQEME  TSKTSSSI EK  NYELPDGQVI  250
CeresClone:1073372    MFTTTAEREI  VRDI KEKLAY  VALDYEQELE  TAKSSSSVEK  NYELPDGQVI  233
CeresClone:338602     SFTTTAEREI  VRDMKEKLAY  I ALDYDQEME  TAKTSSSVEK  SYELPDGQVI  233

Consensus             MFTTTAEREI  VRDI KEKLAY  VALDYEQEME  TAKTSSSVEK  NYELPDGQVI  250

Lead-CeresClone3819   TI GAERFRCP  EVLFQPSFVG  MEAAGI HETT  YNSI MKCDVD  I RKDLYGNI V  300
CeresClone:1073372    TI GAERFRCP  EVLFQPSLVG  MEAPGI HETT  YNSI MKCDVD  I RKDLYGNI V  283
CeresClone:338602     TI GAERFRCP  EVLFQPSFI G  MEAAGI HETT  YNSI MKCDVD  I RKDLYGNI V  283

Consensus             TI GAERFRCP  EVLFQPSFVG  MEAAGI HETT  YNSI MKCDVD  I RKDLYGNI V  300
```

```
Leod-CeresClone3819     LSGGTTMFSG IADRMSKEIT ALAPSSMKIK VVAPPERKYS VWIGGSILAS 350
CeresClone:1073372      LSGGSTMFPG IADRMSKEIT ALAPSSMKIK VVAPPERKYS VWIGGSILAS 333
CeresClone:338602       LSGGTTMFPG IADRMSKEIT ALAPSSMKIK VVAPPERKYS VWIGGSILAS 333

Consensus               LSGGTTMFPG IADRMSKEIT ALAPSSMKIK VVAPPERKYS VWIGGSILAS 350

Leod-CeresClone3819     LSTFQQMWIS KAEYDEAGPG IVHRKCF 377
CeresClone:1073372      LSTFQQMWIS KGEYDESGPS IVHRKCF 360
CeresClone:338602       LSTFQQMWIA KAEYDESGPS IVHRKCF 360

Consensus               LSTFQQMWIS KAEYDESGPS IVHRKCF 377
```

```
Lead-CeresClone546490  M---------- ---------- ------ISSQ NLA-NILEVL SYLIFGLV--   22
gi|56784222            MEAVAGGGGG GGGESVGELL LRAAAMVPAE HYALAALAVV SVLAYGFLEL   50
Consensus              MEAVAGGGGG GGGESVGELL LRAAAM---- --AL--L-V- S-L--G--EL   50

Lead-CeresClone546490  --LVSILHPL SQIRFKIYYH NNEKNKKRIM QCPHIKKGIF LPTIYLLSGT   70
gi|56784222            HFLGDLLRGF RGGRVELTFH PASEIYHRVA SKCRSLHGRY LATPWLASPH  100
Consensus              HFL---L--- ---R-----H -------R-- -------G-- L-T--L-S--  100

Lead-CeresClone546490  LQAIFGKFSK LHDANIHFKE EHLELPCGGI VGMYWASQLV ETESAKA---  117
gi|56784222            LQTLFLGISG -RPPSFTYKR QLYTVHDGGT IALDW---LL ATDSKGSDGI  146
Consensus              LQ--F---S- L-------K- -------GG- ----WASQL- -T-S---DGI  150

Lead-CeresClone546490  ---KAKKVVV IMVPGLTASF KEPYIRNISS EALENGYKVV IYHNRG-NQV  163
gi|56784222            LSEDASAPLV VIVPGLTSDS AAAYVKHMAY SMATKGCNTV VSNHRGLGGV  196
Consensus              LSE-A----V --VPGLT--- ---Y------ -----G---V ----RGL--V  200

Lead-CeresClone546490  ALTLPKEGYL DYSIDLKYAV DYVVKTYPDH QIFAVGHSLG ANNLVNYLAK  213
gi|56784222            SITSDCLYNA GWTEDLREVI NYLHHKYPKA PMLCVGTSIG ANIVVKYLGE  246
Consensus              --T------- ----DL---- -Y----YP-- ----VG-S-G AN--V-YL--  250

Lead-CeresClone546490  YKDDCPIKVA ASVSNPFDF- ---HKAGEGV KDTMFDGFLA QMMQNWARRN  259
gi|56784222            EGENTPVAGA ASICSPWDLV VGDRFISRKL VQRFYDKALA FGLKGYAKLH  296
Consensus              -----P---A AS---P-D-V VGD------- -----D--LA -------A--  300

Lead-CeresClone546490  QDVLLNAPKY LDIKYELAMQ AKTLRGFDEQ ITRRLYGYPH YNDYYTGISS  309
gi|56784222            EPVLVRLANW EGIK------K SRSIREFDHH ATCMVAKYET VDTYYRRCSS  341
Consensus              --VL------ --IKYELAM- ----R-FD-- -T-----Y-- ---YY---SS  350
```

```
Lead-CeresClone546490   VFNIKDINIP LLCLNSKDDP VLNHGSICIE ECQKNENIIL IVTHNGGHVG   359
gi|56784222             ASYVGNVSVP LLCVNALDDP LCTREAIPWD ECRANKNIVL ATTPNGGHLA   391
Consensus               ---------P LLC-N--DDP ------I--- EC--N-NI-L --T-NGGH--   400

Lead-CeresClone546490   WFHGILQPKR WYPKPVIEYL ---------- ---------- --------NT   381
gi|56784222             FFQGLTAGRL WWVGAVSEFL FALLDSKYMH QQKAQDHILR SSLESSIDKS   441
Consensus               -F-G------ W----V-E-L FALLDSKYMH QQKAQDHILR SSLESSID--   450

Lead-CeresClone546490   CFEELQEEGL ---------- ---------- ---------- ----------   391
gi|56784222             PYVNVMEDGM IAPVTDDGPC DDITPSHQVN DIKQDNGDFT QQNEHTREVD   491
Consensus               ------E-G- IAPVTDDGPC DDITPSHQVN DIKQDNGDFT QQNEHTREVD   500

Lead-CeresClone546490   ---------- ---------- ---------- ---------- ----------   391
gi|56784222             DKNITEVNAM PSQSPEQSAG QQVEEHYVGK FHEAIAPVKR SINQLTRYQG   541
Consensus               DKNITEVNAM PSQSPEQSAG QQVEEHYVGK FHEAIAPVKR SINQLTRYQG   550

Lead-CeresClone546490   ---------- ---------- ---------- --------HK K   394
gi|56784222             KSVWLLAYIA FVTSWPLLGS LAFIAFRKKF RNNLLAKWLR R   582
Consensus               KSVWLLAYIA FVTSWPLLGS LAFIAFRKKF RNNLLAKW-- -   591
```

```
Lead-CeresClone545208   MSHIAVERNR RRQMNEHLKV LRSLTPCFYI KRGDQASIIG GVIEFIKELH   50
gi|6862916              MSHIAVERNR RRQMNEHLKS LRSLTPCFYI KRGDQASIIG GVIEFIKELQ   50
CeresClone:336092       ---------- ---MNEHLKV LRSLTPGLYI KRGDQASIIG GAIEFIKELQ   37
gi|57900676             MSHIAVERNR RRQMNDHLKV LRSLTPAFYI KRGDQASIIG GAIDFIKELQ   50

Consensus               MSHIAVERNR RRQMNEHLKV LRSLTPCFYI KRGDQASIIG G-IEFIKELQ   50

Lead-CeresClone545208   QVLQALESQK RRKS------ ---------- -LSPSPGP-S PRTLQPMFHQ   82
gi|6862916              QLVQVLESKK RRKT------ ---------- -LNRPSFPYD HQTIEPSSLG   83
CeresClone:336092       QVLESLEARK KRRSSGGGHS FLT------- -GSPSPTP-S PRSHLLSSVS   78
gi|57900676             TLLQSLEAQK KRRQOPQAHL ISPASISASG GGSPSPTP-S PRSLITSCSP   99

Consensus               Q-LQSLE-QK -R-S----H- ---------- --SPSPTP-S PR-L-PSS--  100

Lead-CeresClone545208   LD-------S PSMIGTN--- ------SFKEL GASCNSPVAD VEVKISGSYV  117
gi|6862916              AA-------T TRVPFSRIEN VMTTSTFKEV GACCNSPHAN VEAKISGSNV  126
CeresClone:336092       TP-------S PPV------- --------MKEL AACCNSAVAD VEAKISGSNV  109
gi|57900676             TAAAGSSAGS SSSISPKDEN KQQLQLVAEL AACCNSPMAD VEARISGANV  149

Consensus               TA-------S -SVI----EN -------KEL -ACCNSPVAD VEAKISGSNV  150

Lead-CeresClone545208   ILKVICHRIP ---GOVAKII TVLESLSFEV LHLNISSMEE TVLYQFVVKI  164
gi|6862916              VLRVVSRRIV ---GQLVKII SVLEKLSFQV LHLNISSMEE TVLYFFVVKI  173
CeresClone:336092       LLRTLSRRSS IPGGQAVRLI AVLEGLHLEV LHLNISTMED TVLHSLVLKI  159
gi|57900676             LLRTLSRRAP ------PVRII ALLESLHLEV LHLNITTMDD TVLYSFVLKI  194

Consensus               ILR-ISRR-P ---GQ-V-II AVLESL--EV LHLNIS-ME- TVLYSFV-KI  200

Lead-CeresClone545208   ELGCQLSLEE LAMEVQQSFC LDAII----A L--------- -------   191
gi|6862916              GLECHLSLEE LTLEVQKSFV SDEVI----V STN------- -------   202
CeresClone:336092       GLECQLSVED LAYEVQQIFG QDTAEQKPQA EENHHRLIYS SAMAAAI   206
gi|57900676             GLDCHLSVDD LAMEVHQSFM PPPAA----H PDNHLHS--- -------   227

Consensus               GLEC-LS-E- LAMEVQQSF- -D--I----A --NH-H---- -------   247
```

| | | | | | | |
|---|---|---|---|---|---|---|
| Lead-CeresClone99763 | MSMIPI SNRR | RLSPGDRIWE | PF--ELMNIF | LDFPSPALFL | SHHFPSLSRE | 48 |
| CeresClone:975383 | M--------- | ---------- | -------NTF | FDFPSPSLLL | SRHFPSLS-- | 22 |
| CeresClone:556334 | MSIVPI ---- | NQGDAN-GSN | PF--ASWGQF | VDFPLP-PSI | SGFFPGLE-- | 40 |
| gi\|6969974 | MSLIPNS--- | RRGSSS-VFD | PFSLNLWDPF | KDFPFPSSSS | LSAFPEFS-- | 44 |
| gi\|25809052 | MSLIPSFFGN | RR--SN-VYD | PFSLDVWDPL | KDFPFPSSAL | SASFP----- | 42 |
| CeresClone:1608166 | MSIIPSFFGR | RR--SN-VFD | PFSLDVWDPF | EGFPF----- | NNNFGSLSDQ | 42 |
| gi\|56606538 | MALIPSIFGG | RR--SN-VFD | PFSHDIWDPF | QGLS---SAL | ANARD----- | 39 |
| gi\|25044839 | MSLV------ | RR--SN-IFD | PFSLDLWEPF | EGFPFG-CAL | SFPRPSAS-- | 38 |
| CeresClone:247046 | MSLI------ | RR--SN-VFD | PFSLDLWDPF | EGFPFGSGNS | SSLFPSFP-- | 39 |
| Consensus | MSLIP----- | RR--SN-VFD | PFSLDLWDPF | EDFPFPS--L | S--FPS-S-- | 50 |
| Lead-CeresClone99763 | IFPQTSSSTV | NTQLNWTETP | TAHVFKAYLP | GVDQDEVIAF | VDEEGYLQIC | 98 |
| CeresClone:975383 | --PFSSPSTV | ETQLNWTETP | TAHVFKAYLP | GTTQDEAIVF | VDDEGYLQIC | 70 |
| CeresClone:556334 | -FGFGFGSSV | NTRVDWRETP | RAHVWKLVLP | GFSNEDVLVE | LQDERVLQVS | 89 |
| gi\|6969974 | ---RENSAFV | NTRVDWKETP | EAHVFKADVP | GLKKEEVKVE | VEDDRVLKIS | 91 |
| gi\|25809052 | ---RENSAFV | STRVDWKETP | EAHVFKADLP | GLKKEEVKVE | VEDDRVLQIS | 89 |
| CeresClone:1608166 | VRSSETSSFV | NAN DWKETA | DAHVFKADVP | GLKKEEVKVE | VEDDRVLQIS | 92 |
| gi\|56606538 | ---QETAAIA | NTRIDWKETP | EAHVFKADLP | GLKKEEIKVE | VEDGRVLQIS | 86 |
| gi\|25044839 | -FPAETASFA | GARIDWKETP | EAHVFKADLP | GVKKEEVKVE | VEEGNVLQIS | 87 |
| CeresClone:247046 | RTSSETAAFA | GARIDWKETP | EAHVFKADVP | GLKKEEVKVE | VEDGNVLQIS | 89 |
| Consensus | ----E-SSFV | NTRIDWKETP | EAHVFKADLP | GLKKEEVKVE | VED-RVLQIS | 100 |
| Lead-CeresClone99763 | TGDN------ | ---------- | --KFMSRFKL | PNNALTDQVI | AMM-EDEFLV | 129 |
| CeresClone:975383 | AGDN------ | ---------- | --KFMSRFKL | PDNALKDQVI | AMMEEDGFLV | 102 |
| CeresClone:556334 | VE-------- | ---------- | SGNFVIRFKV | PDNGNLEQLK | ANM-RHGVLV | 120 |
| gi\|6969974 | GERNVEEEDK | NDKWYRVERS | SGKFLRRFQL | PENAKVDQIK | AAM-ENGVLS | 140 |
| gi\|25809052 | GERSVEKEDK | NDEWHRVERS | SGKFLRRFRL | PENAKMGQVK | ASM-ENGVLT | 138 |
| CeresClone:1608166 | GESNKESEEK | GDTWHRVERS | SGRFMRRFRL | PENAKVDQVK | AAM-ENGVLT | 141 |
| gi\|56606538 | GERSKEQEEK | TDTWHRVERS | VGKFHRRFRL | PENAKVDQVT | ASM-ENGVLT | 135 |
| gi\|25044839 | GERTREKEEK | NDTWHRVERS | SGKFLRRFRL | PDNAKVDQVK | AAM-ENGVLT | 136 |
| CeresClone:247046 | GERNKEQEEK | TDTWHRVERS | SGRFLRRFRL | PENAKTEQIT | AAM-ENGVLT | 138 |
| Consensus | GERN-E-EEK | -D-WHRVERS | SGKFMRRFRL | PENAKVDQVK | A-M-ENGVLT | 150 |

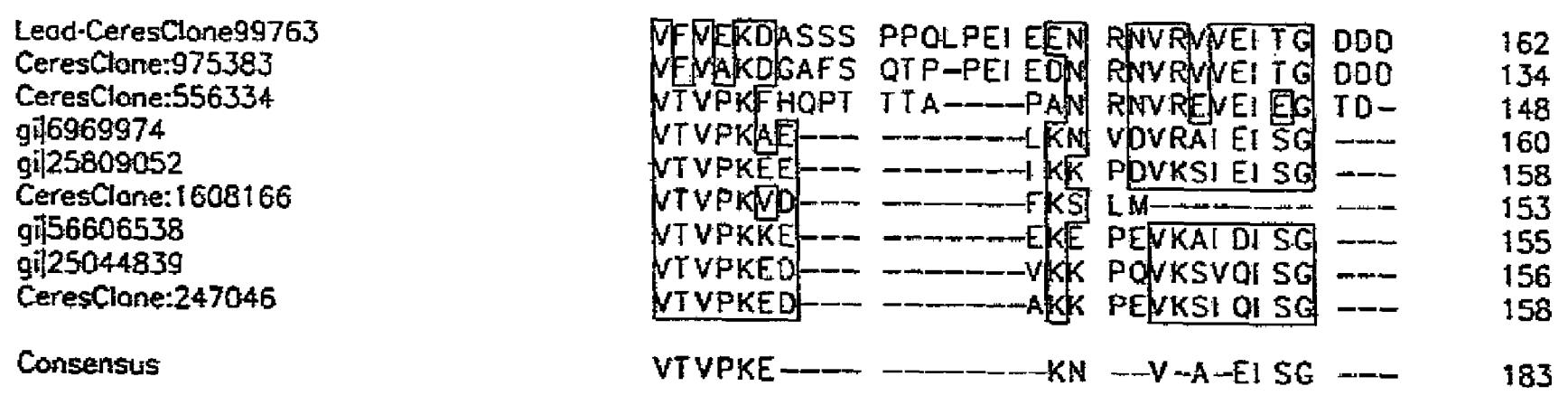

```
Lead-CeresClone99763   VFVEKDASSS PPQLPEI EEN RNVRVVEI TG DDD   162
CeresClone:975383      VFVAKDGAFS QTP-PEI EDN RNVRVVEI TG DDD   134
CeresClone:556334      VTVPKFHQPT TTA----PAN RNVREVEI EG TD-    148
gi|6969974             VTVPKAE--- -------LKN VDVRAI EI SG ---   160
gi|25809052            VTVPKEE--- -------IKK PDVKSI EI SG ---   158
CeresClone:1608166     VTVPKVD--- -------FKS LM-------- ---     153
gi|56606538            VTVPKKE--- -------EKE PEVKAI DI SG ---   155
gi|25044839            VTVPKED--- -------VKK PQVKSVQI SG ---    156
CeresClone:247046      VTVPKED--- -------AKK PEVKSI QI SG ---   158

Consensus              VTVPKE---- --------KN --V-A-EI SG ---    183
```

```
CeresClone:1041952        M--------- ---------- ------GLCD ERITSSE-CD LRCKSHYN-D  23
Lead-CeresClone95855      MEIVTSLVFI VNLLIIFTSV VNQARGDTCI DGLGYCNNCD ERCKAKHGPS  50
gi|46396244               MERITSLVFF ASFLIIFVSG VNQTRADSCD ESLGLCEFCD ERCQAKHGPS  50

Consensus                 ME--TSLVF- ---LIIF-S- VNQ-R-D-CD E-LG-CE-CD ERCKAKHGPS  50

CeresClone:1041952        GEGHCD---N MNICNCIHHC VSPQPNKDTE PIRKCTSGLG LCSIDHCYDD  70
Lead-CeresClone95855      SESSCDRSVG VPLCKCYYEC ESP-PSPPAQ P-KKCDGGAG ICS-QRCQGQ  97
gi|46396244               CISKCDGEVG MLSCTCTYEC -GP-PLPPKG --NVCSGGTG MCS-GKCPYK  95

Consensus                 -ES-CD--VG M--C-C-YEC -SP-P-PP-- P--KC-GG-G -CS----C---  100

CeresClone:1041952        CCNSKCAKQF KEGIGHCEIV GSMGTILCTC DYVC  104
Lead-CeresClone95855      CCDMNCAQKY IGGHGFCNTL GIFS---FCQC EYPC  129
gi|46396244               CCDTSCAQKY NGGRGFCNSF GNYN---FCQC EYPC  127

Consensus                 CCD--CAQKY -GG-GFCN-- G-----FCQC EYPC  134
```

```
CeresClone:769994        MGVGGTLEYL SGLLGGGGGH GHGHGYGNRR RRKQMQTVEL KVSMDCEGCE   50
CeresClone:493668        M--------- ---------- ---------- ---------- ----DCEGCE    7
CeresClone:656297        M--------- ---------- ---------- -----QTVEI KVKMDCDGCE   16
Lead-CeresClone39127     MGALDSLSEY IS-------- DYFRVTRKRR KRKVMQTVN  KVKMDCDGCE   42
CeresClone:1608079       M--------- ---------- ---------- -----ETVEI KVKMDCDGCE   16

Consensus                M--------- ---------- ---------- -----QTVEI KVKMDCDGCE   50

CeresClone:769994        RKVKNALSSM KGVRSVN NR KQQKVXVAGY VEPSKVLRKA QSTGKKAEIW  100
CeresClone:493668        RRVKSAVKSM RVMTSVAVNA KQSKCTVTGN VEPAKVLERV KATGKNAEMW   57
CeresClone:656297        RRVRNSVSNM SGVKQVEVNR KQSRVTVTGY VDRNKVLKKV QSTGKRAEFW   66
Lead-CeresClone39127     RRVKNAVSSM KGVKSVEVNR K HKVTVSGY VEPKKVLKRI ERTGKKAEIW   92
CeresClone:1608079       RRVKNAASSL KGVKSVDVNR KQNRVTVKGY VEPKKVLKKV QNTGKKAEMW   66

Consensus                RRVKNAVSSM KGVKSV-VNR KQ-KVTV-GY VEP-KVLKKV QSTGKKAE-W  100

CeresClone:769994        PYVPYSQVSQ PYVAGTYDKR APAGYVRSQE PGYGNVSGQV SRQDDQLTDM  150
CeresClone:493668        PYVPYALITY PYVGGAYDKK APAGFVRSAP QAMAD--PGA P--ELKYMNM  103
CeresClone:656297        PYIQYNLVAY PYVAQAYDKK APSGYVKNTE QALPN--PNA P--DEKLTSL  112
Lead-CeresClone39127     PYVPYNMVAY PYAVGTYDKK APAGYVRKSE QSQLQLLPGA P--ENHYISL  140
CeresClone:1608079       PYVPVSIFSY PYAPQAYDKK APAGYVKNVP QAFHA--PNS P--TERYDDL  112

Consensus                PYVPY-LV-Y PYV-GAYDKK APAGYVR--E QA--N--P-A P----KY--M  150

CeresClone:769994        FNDDNANSCA VM            162
CeresClone:493668        FNDDNVDACT VM            115
CeresClone:656297        FSDDNPNACS IM            124
Lead-CeresClone39127     FSDENPNACT VM            152
CeresClone:1608079       FSDENPNACS VM            124

Consensus                FNDDNPNAC- VM            162
```

```
Lead-CeresClone38843   MGVI NHHFL AFIFGILGNV ISFLVFLAPV PTFYRIYKRK STESFQSLPY  50
CeresClone:263281      -----MEHPW ASVFGILGNI ISFLVFLAPV PTFLRVYRKK STEWFSSVPY  45
CeresClone:918913      -----MAHPW ASAFGILGNI ISFLVFLAPI PTFLRVYRKK STEGFSAVPY  45
CeresClone:239640      ---MSLQHPW AFAFGLLGNV ISFMTFLAPI PTFYRIYKSK STEGFQSVPY  47
CeresClone:798115      ---------- ---------- ---MTYLAPL PTFYRIYRSK STQGFQSVPY  27
CeresClone:219950      MAGLSLLHPM AFAFGLLGNI ISFMTYLAPL PTFYRIYKNK STEGFQSVPY  50

Consensus              -------HPW AFAFGILGNI ISF--FLAP- PTFYRIY--K STEGFQSVPY  50

Lead-CeresClone38843   QVSLFSCMLW LYYALIKKDA FLLITINSFG CVVETLYIAM FFAYAIREKR 100
CeresClone:263281      VVALFSCTLW ILYALVKTNS SPLLTINAFG CVVEAAYILL YLVYAPRGAR  95
CeresClone:918913      VVALFSCMLW IFYALVKTNS SPLLTINAFG CVVEGFYILL YVVYAPRHAR  95
CeresClone:239640      VVALFSAMLW IFYALIKSNE TFLITINAAG CVIETIYVVM YFVYAPKKAK  97
CeresClone:798115      VVALFSAMLW IYYALLKSDE CLLITINSAG CVIETIYIII YLTYAPKQAK  77
CeresClone:219950      VVALFSAMLW IYYALLKSNE LLLITINSAG CVIETLYIAM YLLYAPKKAK 100

Consensus              VVALFS-MLW IYYAL-KSN- SLLITIN--G CV-ET-YILM YLVYAP-KA- 100

Lead-CeresClone38843   ISAMKLFIAM NVAFFSLILM VTHFVVKTPP LQVSVLGWIC VALSVSVFAA 150
CeresClone:263281      LRALASFLLL DVAAFSLVAV VTVVLVAEPH -RVRVLGSVC LAFSMAVFVA 144
CeresClone:918913      HRALAFFLLL DVAAFALIVA VTVFLVPQPS -RVKVLGSVC LAFSMAVFVA 144
CeresClone:239640      LFTAKIMVLL NGGVFGVILL LTLLLFKGSK -RVVLLGWIC VGFSVSVFVA 146
CeresClone:798115      LFTAKILLLL NVGVFGLILL LTLLLSEGEK -RVVMLGWVC VGFSVSVFIA 126
CeresClone:219950      LFTAKILLLL NVGVFGLILL LTLLLSAGQR -RVVVLGWVC VAFSVSVFVA 149

Consensus              LF--KI-LLL NV-VF-LILL -TLLLVKGPK -RVVVLGWVC VAFSVSVFVA 150

Lead-CeresClone38843   PLMIVARVIK IKSVEYMPFT LSFFLTISAV MWFAYGLFLN DICIAIPNVV 200
CeresClone:263281      PLSVIFVVIR TKSAEFMPFT LSFFLTLSAV AWFLYGLFFK DPYVFLPNVG 194
CeresClone:918913      PLSVIFVVIK TKSAEYMPFS LSFFLTLSAV AWFFYGLFFK DLYVFLPNVG 194
CeresClone:239640      PLSIMRRVIQ TKSVEYMPFS LSLSLTLSAV VWFLYGLLIK DKYVALPNIL 196
CeresClone:798115      PLSVIRLVVR TRSVEFMPFS LSLSLTVSAV VWFLYGLLIK DKYVALPNIL 176
CeresClone:219950      PLSIIRQVVR TRSVEFMPFS LSLSLTVSAV VWFLYGLLIK DKYVALPNVI 199

Consensus              PLS-IR-VIR TKSVE-MPFS LS--LTISAV VWFLYGL-IK DKYVALPNVV 200
```

```
Lead-CeresClone38843   GFVLGLLQMV LYLVYRNSNE K----PEKLN SSEEQLKS-- --IVVMSPLG   242
CeresClone:263281      GFFFGCI QMV LYCCYRKRKP ASVVLPITTA AAAVAQQLEA EMELPLAAHQ   244
CeresClone:918913      GFFFGVAQMI LYFCYRKPDT SALVLPTGIH DVSTEPAAQQ EVELPEGTH-   243
CeresClone:239640      GFTFGVVQMV LYVLYMNKTP VAAT-AEGKD AGKLSSAADE HVLVNIAKL-   244
CeresClone:798115      GFAFGVI QMG LYALYRNAMP SPA--PKQVD DADAIKVPEH --VIHIAKL-   221
CeresClone:219950      GFSFGVVQMG LYALYRNATP RVPA-KDVAD DASKDKAPGE HVVVTIAKLT   248

Consensus              GF-FGV-QMV LY-LYRNA-P SA----PE-VD -A---KAAEE -VVV-IAKL-  250

Lead-CeresClone38843   VSEVHPVVTE SVDPLSEAVH HEDLSKVTKV EEPSIENGKC YVEAT----R   288
CeresClone:263281      HQLAVAVLPT CAAPVLAELQ KLEEAMGS-- ------PRKG GVKAI-----   281
CeresClone:918913      --PAVAMLTV STLPMLAELQ KMEQEISSPT ------PRKG YIKAF-----   280
CeresClone:239640      -SPALPERSS GVHPVTQMAG VPVRSCAAEA TAPAMLPNRD VVDVFVSRHS   293
CeresClone:798115      -CPAAAIELN THNPMERGMP PPMEDNGLAC ASD---MTKG GIDMVEKATR   267
CeresClone:219950      AATTAPAAAV AEDLVKVHDG HPEEAAKGAA KPAENGAGRS DAEDV-----   293

Consensus              -SPAV-VL-- S--PV---L- -PEE---S-- ------P-KG -V-AI-----   300

Lead-CeresClone38843   PETV--   292
CeresClone:263281      ------   281
CeresClone:918913      ------   280
CeresClone:239640      PAVHVA   299
CeresClone:798115      VEQV--   271
CeresClone:219950      ------   293

Consensus              ------   306
```

```
CeresClone:512972        MLPRSRTLPS RIHQGIIEER HNVRHYLQVE VRPNNTQTET EAMNIQSNYS  50
CeresClone:264196        ---------- ---------- -------MVG AMRGGAMELE DRLATLPRFR  23
CeresClone:479285        ---------- ---------- ---------- --------MHI ETPETFADGS 13
Lead-CeresClone38785     ---------- ---------- ----MKSFNT EERNHSTAES GDAYTVSDPT  26
CeresClone:1078352       ---------- ---------- ---------- ---------- -----MSDPT  5

Consensus                ---------- ---------- ---------- ---------- E---T-SD--  50

CeresClone:512972        KCFDDDGRLK RTGTFWMATA HIITAVIGSG VLSLAWAVAQ LGWVAGPIVM  100
CeresClone:264196        GDHDDDGKER RTGTVWIATA HIITAVIGSG VLSLAWAMAQ LGWVAGPLTL  73
CeresClone:479285        KNFDDDGRAK RTGTWITASA HIITAVIGSG VLSLAWAIAX MGWVAGPAXL  63
Lead-CeresClone38785     KNVDEDGREK RTGTWLTASA HIITAVIGSG VLSLAWAIAQ LGWIAGTSTL  76
CeresClone:1078352       KNVDDDGREK RTGTWLTASA HIITAVIGSG VLSLAWAIAQ LGWIAGTLIL  55

Consensus                KN-DDDGREK RTGTWLTASA HIITAVIGSG VLSLAWAIAQ LGWVAGPLVL  100

CeresClone:512972        FLFAVVNLYT SNLLTQCYRT GDSVTGHRNY TYMEAVNSIL GGKKVKLCGL  150
CeresClone:264196        VLFAAITFYT CGLLADCYRV GDPVTGKRNY TYTEAVKSNL GGWYVWFCGF  123
CeresClone:479285        FVFSLITYFT STLLADCYRS PDPVHGKRNY TYSEVVKANL GGRKFQLCGL  113
Lead-CeresClone38785     LIFSFITYFT STMLADCYRA PDPVTGKRNY TYMDVVRSYL GGRKVQLCGV  126
CeresClone:1078352       LIFSFITYFT STMLADCYRA PDPLTGKRNY TYMDVVRSYL GGRKVQLCGV  105

Consensus                --FS-ITYFT STLLADCYR- PDPVTGKRNY TYMEVV-S-L GGRKVQLCG-  150

CeresClone:512972        IQYINLFGVA IGYTIAASVS MMAIKRSNCY HSSHGKDPCH MSSNGYMITF  200
CeresClone:264196        CQYVNMFGTG IGYTITASIS AAAINKSNCF HWHGHDADCS QNTSAYIIGF  173
CeresClone:479285        AQYINLVGVT IGYTITASLS MGAVKKSNCL HKHGHQDECK VKDNAFMIAF  163
Lead-CeresClone38785     AQYGNLIGVT VGYTITASIS LVAVGKSNCF HDKGHTADCT ISNYPYMAVF  176
CeresClone:1078352       AQYGNLIGIT VGYTITASIS LVAIGKANCY HNKGHHADCT ISNYPYMAAF  155

Consensus                AQYVNLIGVT IGYTITASIS -VAI-KSNC- H--GH-ADCT VSNN-YMI-F  200
```

```
CeresClone:512972         GIAEVIFSQI PDFDQVWWLS IVAAIMSFTY SSVGLSLGVA KVAENKSFKG  250
CeresClone:264196         GVVQVIFSQL HNFHKLWWLS IIAAIMSFSY SAIAVGLSLA QIVMGPTGKT  223
CeresClone:479285         ACIQILLSQI PNFHKLSWLS IVAAVMSFAY SSIGLGLSIA KIIGGGHVRT  213
Lead-CeresClone38785      GIIQVILSQI PNFHKLSFLS IMAAVMSFTY ATIGIGLAIA TVAGGKVGKT  226
CeresClone:1078352        GIIQILLSQI PNFHKLSFLS LMAAVMSFAY ASIGIGLAIA TVAGGKVGKT  205

Consensus                 GIIQVILSQI PNFHKLSWLS I-AAVMSF-Y SSIG-GL-IA KVAGGK-GKT  250

CeresClone:512972         SLMGISIGTV TQAGIVTSIQ KIWRSLQALG AMAFAYSFSI ILIEIQDTIK  300
CeresClone:264196         TMTGTLVGV- ----DVDAAQ KVWMTFQALG NVAFAYSYAI ILIEIQDTLR  268
CeresClone:479285         TLTGV----- ----EVSGTE KVWKMFQAIG DIAFAYAFSN VLIEIQDTLK  254
Lead-CeresClone38785      SMTGTAVGV- ----DVTAAQ KIWRSFQAVG DIAFAYAYAT VLIEIQDTLR  271
CeresClone:1078352        NMTGTVVGV- ----DVTAAQ KIWRSFQAVG DIAFAYAYAT VLIEIQDTLR  250

Consensus                 -MTGT-VGV- ----DVTAAQ KIWRSFQA-G DIAFAYAYA- VLIEIQDTLR  300

CeresClone:512972         SPPAEHKTMR KATILSIAMT TVFYLLCGCM GYAAFGDNAP GNLLTGFGFY  350
CeresClone:264196         SPPAENKTMR RATMMGISTT TGFYMLCGCL GYAAFGNAAS GNLLTGFGFY  318
CeresClone:479285         SSPPENKVMK RASLIGIMTT TLFYVLCGCL GYAAFGNDAP SNFLTGFGFY  304
Lead-CeresClone38785      SSPAENKAMK RASLVGVSTT TFFYILCGCI GYAAFGNNAP GDFLTDFGFF  321
CeresClone:1078352        SSPAENKAMK RASFVGVSTT TFFYILCGCL GYAAFGNKAP GDFLTNFGFY  300

Consensus                 SSPAENK-MK RASLIGISTT T-FYILCGCL GYAAFGNNAP GNFLTGFGFY  350

CeresClone:512972         NPYWLLDLAN LAIVIHLVGA YQVFSQPLFA FVEKWSARKW PKSNFVTAEY  400
CeresClone:264196         EPFWLVDFAN ACIVVHLVGG FQVFCQPLFA AVECAVAARY PGS---TREY  365
CeresClone:479285         EPFWLIDFAN VCIAVHLVGA YQVFVQPIFG FVEKWSKENW TESQFINGEH  354
Lead-CeresClone38785      EPFWLIDFAN ACIAVHLIGA YQVFAQPIFQ FVEKKCNRNY PDNKFITSEY  371
CeresClone:1078352        EPFWLIDFAN ACIAFHLIGA YQVFAQPIFQ FVEKKCNRNW PDNKFITSEY  350

Consensus                 EPFWLIDFAN ACIAVHLVGA YQVFAQPIF- FVEK---RNW P-NKFITSEY  400
```

```
CeresClone:512972        DIPIPCFGVY QLNFFRLVWR TLFVLLTTLI AMLMPFFNDV VGILGAFGFW 450
CeresClone:264196        -------GAA GLNVFRLVWR TAFVAVITLL AILMPFFNSI LGILGSIAFW 408
CeresClone:479285        TLNIPLCGSY NVNFFRVVWR TAYVIITAVV AMLLPFFNDF LALIGALSFW 404
Lead-CeresClone38785     SVNVPFLGKF NISLFRLVWR TAYVVITTVV AMIFPFFNAI LGLIGAASFW 421
CeresClone:1078352       SVNIPFLGKF SINLFRLVWR TAYVVITTLV AMIFPFFNAI LGLIGAASFW 400

Consensus                SINIP--G-- N-NLFRLVWR TAYVVITTLV AMLMPFFNAI LGLIGA-SFW 450

CeresClone:512972        PLTVYFPIDM YISQKKIGRW TSRWLGLQLL SASCLIISLL AAVGSMAGVV 500
CeresClone:264196        PLTVFFPVEM YIRQRQVRRF STKWIALQSL SFVCFLVTAA SCAASVQGVV 458
CeresClone:479285        PLTVYFPIEM YIKKSNMQRF SFTMTWLKIL SWVCLIISII SLVGSIQGLS 454
Lead-CeresClone38785     PLTVYFPVEM HIAQTKIKKY SARWIALKIM CYVCLIVSLL AAARSIAGLI 471
CeresClone:1078352       PLTVYFPVEM HIAQTKVKKY SSRWIGLKML CWVCLIVSLL AAAGSIAGLI 450

Consensus                PLTVYFPVEM YIAQTK-KR- SSRWI-LK-L SWVCLIVSLL AAAGSIAGL- 500

CeresClone:512972        LDLKTYKPFK TSY- 513
CeresClone:264196        DSLKTYVPFK TRS- 471
CeresClone:479285        VSIKKYKPFQ AEQ- 467
Lead-CeresClone38785     SSVKTYKPFR TMHE 485
CeresClone:1078352       SSVKTYKPFR TIHE 464

Consensus                -S-KTYKPF- T-H- 514
```

```
Lead-CeresClone38757   MGNISSSGGE GRRRR---RR NHTAAPPPPP PPPSSSLPPP PLPTEIQANP  47
gi|31430853            MGNMCSSGGH RRRNNGHGRH HHHGQPTAPP PPPQQQ---- --QQEVAPNR  44
CeresClone:570295      MGNAGSSGR- ---------- -----PNLPP PRPHL----- ----------  19
gi|34914816            MGNIASSGG- ---------- -----ASPRP PPPHLE---- ----------  20

Consensus              MGNI-SSGG- -RR-----R- -H---P-PPP PPPHL----- ----E---N-  50

Lead-CeresClone38757   IVFAAVTPYP NPNPNP-VYQ YPASY--YHH PPPGAMPLP- --PYDHHLQ-  90
gi|31430853            YVFAAASPYP PQYPNPNLPQ YYPQYGNFYP PPPPSMPGPL PAPYDHHHRG  94
CeresClone:570295      ---------- HGVPPP---- YYHQY----P PWRPGAAAP- ----------  40
gi|34914816            -------AYR HGVPPP---- YYHSY----P RPPPGAAAP- ----------  44

Consensus              -VFAA--PYP HGVP-P---Q YYH-Y----P PPPP---AP- --PYDHH--- 100

Lead-CeresClone38757   ---------H HPPHPYHNHS -MAPVAMARY P----YAGHM MAQP------ 120
gi|31430853            GGPAQPPPPP PPPQPFHAAG EFPPAMLQQH PHYHGMGGNF SYGPPTQPPA 144
CeresClone:570295      ---------- -PPVPF---- ---------- ---------- ----------  45
gi|34914816            ---------- -PPVPV---- ---------- ---------- ----------  49

Consensus              ---------- -PPVP-H--- ---P------ P-----G--- ---P------ 150

Lead-CeresClone38757   --TPYVEHQK AVTIRNDVNL KKESLRLEP- -DPDNPGRFL VSFTFDATVS 166
gi|31430853            PAPPYVEHQK AVTIRNDVNL KKETLRVEP- -DDECPGRFL IIFTFDATVA 192
CeresClone:570295      --PTHVERHR AVAVSAGVNV KGHTLRLER- --DDDGGGHL LAFSFDADAP  90
gi|34914816            --PAHVERHR AVAVSVGVNV KGDTLRLVPD DDDDDGRSLL LAFSFDADGP  97

Consensus              --PP-VE--- AV---N-VN- K-ETLRLEP- -DDDD-GRFL IAF-FDA-V- 200

Lead-CeresClone38757   GRISVLFFAK ESEDCKLTAT KEDILPPITL DFEXGLGQKF KQSSGSGIDF 216
gi|31430853            GSMTVYFFAK EELNCNLTAT KEDLLKPVTV TFKEGLGQKF RQPSGTGIDF 242
CeresClone:570295      GSITVYFFAQ EADDSVLKGT KENLLKPVTV IFKEGHGQEF RQPSGTGIKL 140
gi|34914816            GSITVCFFAQ E-DKCALKTA KENLLQPVTV PFKEGRGQEF KQPSGSGIDV 146

Consensus              GSITVYFFA- E-DDC-L-AT KE-LLKPVTV TFKEGLGQ-F -QPSG-GID- 250
```

```
Lead-CeresClone38757   SVFEDVELFK AAADTEIYPL AVKAEAAPSG GE--NEEEER SGSKNAQITQ   264
gi|31430853            SLFEDAELFK EG-EMDVYPL AVKAETTFSI GQFSEGEEQK SQTPNSQITQ   291
CeresClone:570295      SMFEESELTK VG-EDHVFPL ALKVEVGVPS NQELGREHDA EDSK-SLAKF   188
gi|34914816            SRFEESELTN VG-EGGVFPV AFKVQMDVSG NQESEGAHET EQSK-YLVKY   194

Consensus              S-FE-SEL-K VG-E--V-PL AVK-E--VSG -QESEGE-E- -QSKNS-I--   300

Lead-CeresClone38757   AVYE-KDKGE IKIRVVKQIL WVNGTRYELQ EIYGIG--NT VEGDDDSADD   311
gi|31430853            AVFERKENGD YHVRVVKQIL WVNGTRYELQ EIYGIG--NS VEGDTEG---   336
CeresClone:570295      AVFVKKDSAE YGINIVQQIL WVNGTRYVLQ EIYGIGNRNT ADRNVNE---   235
gi|34914816            AIFVKKDNAE YGVHVVQQIL WVNGIRYVLQ EIYGIG--NT ADKNAHE---   239

Consensus              AVF-KKDN-E YG--VV-QIL WVNGTRY-LQ EIYGIG--NT -------E---   350

Lead-CeresClone38757   ANDPGKECVI CLSEPRDTTV LPCRHMCMCS GCAKVLRFQT NRCPICRQPV   361
gi|31430853            -NDPGKECVI CLSEPRDTTV LPCRHMCMCS ECAKVLRYQT NRCPICRQPV   385
CeresClone:570295      -DDSGKECVV CLTEPRDTTV LPCRHMCLCR ECAQTLRFQT NKCPMCRQPV   284
gi|34914816            -DDSGKECVV CLSEPRDTAV LPCRHMCLCR ECAQVLKYQT NKCPICRQPV   288

Consensus              --D-GKECV- CLSEPRDTTV LPCRHMC-C- ECA-VLR-QT N-CPICRQPV   400

Lead-CeresClone38757   ERLLEIKVHG NNGSGNNTGQ GETVEQE--- ---------- --   388
gi|31430853            ERLLEIKV-- NNKGEECQQQ QIPQPPPPPS TAPPHQQQES QA   425
CeresClone:570295      ESLLEIKV-- DSIPRHQGGD Q--------- ---------- --   303
gi|34914816            EGLREIEV-- DNKPIPQQGS QQLTAPQ--- ---------- --   313

Consensus              ERLLEIKV-- -NKP--QQGQ Q----P---- ---------- --   442
```

```
gi|50904897               MAQPSSKK--  TPSVYLYIPN  IIGYFRIIIN  FIAFAVCYSN  RVLFAILYFF   48
gi|13661020               MAQPSSKK--  TPSVYLYIPN  IIGYFRIIIN  FIAFAVCYSN  RVLFAILYFF   48
CeresClone:306792         ----------  MPSVYLYIPN  IIGYFRIIIN  FIAFAVCYSN  KALFAVLYFF   40
CeresClone:321760         ----------  MPSVYLYIPN  IIGYFRIIIN  FIAFAVCYSN  KALFAVLYFF   40
CeresClone:284101         ----------  MPSVYLYIPN  IIGYFRIIIN  FIAFAVCYSN  KALFAILYFI   40
gi|34577127               ----------  MPSVYLYIPN  IIGYFRIIIN  FIAFAVCYSN  KALFAILYFI   40
CeresClone:581207         MAKKPGPRSS  KLSVYLYIPN  IIGYIRVLLN  CFAFSQCLSN  KILFSILYFL   50
CeresClone:27810          MAKQ----RPA TLSVYLYIPN  IVGYMRVLLN  CIAFSVCFSN  KTLFSLLYFF   47
gi|21555401               MAKQ----RPA TLSVYLYIPN  IVGYMRVLLN  CIAFSVCFSN  KTLFSLLYFF   47
gi|27311653               MAKQ----RPA TLSVYLYIPN  IVGYMRVLLN  CIAFSVCFSN  KTLFSLLYFF   47
Lead-CeresClone34210      MAKKERPRPE  KLSVYLYIPN  IVGYMRVLLN  CVAFAVCFSN  KPLFSVLYFF   50
gi|21745398               MAKKERPRPE  KLSVYLYIPN  IVGYMRVLLN  CVAFAVCFSN  KTLFSLLYFF   50

Consensus                 MAK----R--  --SVYLYIPN  IIGY-R---N  -IAFAVCYSN  K-LF-ILYFF   50

gi|50904897               SFFCDGLDGW  FARKFNQAST  FGAVLDMVTD  RVSTACLLAL  LSQFYRPGLV   98
gi|13661020               SFFCDGLDGW  FARKFNQAST  FGAVLDMVTD  RVSTACLLAL  LSQFYRPGLV   98
CeresClone:306792         SFVLDGVDGW  FARKFNQAST  FGAVLDMVTD  RVSTACLLAL  LSQFYRPGLV   90
CeresClone:321760         SFVLDGVDGW  FARKFNQAST  FGAVLDMVTD  RVSTACLLAL  LSQFYRPGLV   90
CeresClone:284101         SFVLDGVDGW  FARKFNQAST  FGAVLDMVTD  RVSTACLLAL  LSQFYRPGLV   90
gi|34577127               SFVLDGVDGW  FARKFNQAST  FGAVLDMVTD  RVSTACLLAL  LSQFYRPGLA   90
CeresClone:581207         SFVCDAVDGW  CARKFNQVST  FGAVLDMVTD  RISTACLLVV  LSQLYKPGLS  100
CeresClone:27810          SFCCDAVDGW  CARKFNQVST  FGAVLDMVTD  RVSTACLLVI  LSQIYRPSLV   97
gi|21555401               SFCCDAVDGW  CARKFNQVST  FGAVLDMVTD  RVSTACLLVI  LSQIYRPSLV   97
gi|27311653               SFCCDAVDGW  CARKFNQVST  FGAVLDMVTD  RVSTACLLVI  LSQIYRPSLV   97
Lead-CeresClone34210      SFCCDAVDGW  VARRFNQVST  FGAVLDMVTD  RVSTACLLVI  LSQIYRPSLV  100
gi|21745398               SFCCDAVDGW  CARRFNQVST  FGAVLDMVTD  RVSTACLLVV  LSQVYRPSLV  100

Consensus                 SF-CD-VDGW  FARKFNQ-ST  FGAVLDMVTD  RVSTACLL-L  LSQ-YRPGLV  100
```

```
gi|50904897           FLMLLGLDIT SHWFQMYSSF LSGKTSHKDV KDTGNWLLKL YYGHRPFMAF 148
gi|13661020           FLMLLGLDIT SHWFQMYSSF LSGKTSHKDV KDTGNWLLKL YYGHRPFMAF 148
CeresClone:306792     FLILLGLDIT SHWFQMYSSF LSGKTSHKDV KHTGNWLLKL YYGYRPFMAF 140
CeresClone:321760     FLILLGLDIT SHWFQMYSSF LSGKTSHKDV KHTGNWLLKL YYGYRPFMAF 140
CeresClone:284101     FLILLGLDIT SHWFQMYSSF LSGKTSHKDV KHTGNWLLKL YYGYRPFMAF 140
gi|34577127           FLILLGLDIT SHWFQMYSSF LSGKTSHKDV KHTGNWLLKL YYGYRPFMAF 140
CeresClone:581207     FLSLLALDIA SHWLQMYSTF LTGKTSHKDV KDSSSWLFRA YYGNRMFMAY 150
CeresClone:27810      FLSLLALDIA SHWLQMYSTF LSGKTSHKDV KDSTSWLFRL YYGNRMFMGY 147
gi|21555401           FLSLLALDIA SHWLQMYSTF LSGKTSHKDV KDSTSWLFRL YYGNRMFMGY 147
gi|27311653           FLSLLALDIA SHWLQMYSTF LSGKTSHKDV KDSTSWLFRL YYGNRMFMGY 147
Lead-CeresClone34210  FLSLLALDIA SHWLQMYSTF LAGKSSHKDV KDSTSWLFRL YYGNRIFMCY 150
gi|21745398           FLSLLALDIA SHWLQMYSTF LAGKSSHKDV KDSTSWLFRL YYGNRIFMCY 150

Consensus             FL-LL-LDI- SHW-QMYS-F LSGKTSHKDV KD---WL--L YYGNR-FMA- 150

gi|50904897           CCVASEVLYI VLFLFADEKS TSLLNVCGNL LKQSPLTVFV FISTLVGWAL 198
gi|13661020           CCVASEVLYI VLFLFADEKS TSLLNVCGNL LKQSPLTVFF FISTLVGWAL 198
CeresClone:306792     CCVSCEVLYI ILFLFADEKS TSLLSACKGL LNQSPIIILV FISTLVGWAV 190
CeresClone:321760     CCVSCEVLYI ILFLFADEKS TSLLSACKGL LNQSPIIILV FISTLVGWAV 190
CeresClone:284101     CCVSCEVLYI FLFLFADEES TSLLSVCKGI LNQSPVVILV FVSTLVGWAV 190
gi|34577127           CCVSCEVLYI FLFLFADEES TSLLSVCKGI LNQSPVVILV FVSTLVGWAV 190
CeresClone:581207     CCVSCEVLYL ILFYLAENQT EKLVDVISSN LQKISFLSLL MGTSLFGWAV 200
CeresClone:27810      CCVSCEVLYI ILLLIATNQT ENLMNVVVKS LMQISPLSLL LALSIFGWSI 197
gi|21555401           CCVSCEVLYI ILLLIATNQT ENLMNVVVKS LMQISPLSLL LALSIFGWSI 197
gi|27311653           SCVSCEVLYI ILLLIATNQT ENLMNVVVKS LMQISPLSLL LALSIFGWSI 197
Lead-CeresClone34210  CCVSCEVLYI ILLLIAKNQS ENLLNVVVAT LTQISPLSFL LALTLFGWSM 200
gi|21745398           CCVSCEVLYI ILLLIAKNQT ENLLNVVVST LTQISPLSLL LALTIFGWSM 200

Consensus             CCVSCEVLYI ILFL-AD-QS -NLLNV---- L-Q---L-LL -VSTL-GWAV 200
```

| | | | | | |
|---|---|---|---|---|---|
| gi\|50904897 | KQVI NVI QMK | SAADACVVFD | LKRGK--- | 223 |
| gi\|13661020 | KQVI NVI QMK | SAADACVVFD | LKRGK--- | 223 |
| CeresClone:306792 | KQVT NVI QMK | TAADACVVYD | LKRSKRKA | 218 |
| CeresClone:321760 | KQVT NVI QMK | TAADACVVYD | LKRSKRKA | 218 |
| CeresClone:284101 | KQAT NVI QMK | TAADACVVYD | LKRSK--- | 215 |
| gi\|34577127 | KQAT NVI QMK | TAADACVVYD | LKRSK--- | 215 |
| CeresClone:581207 | KQI I NVI QMK | TAADACVLYD | I EKEHKN- | 227 |
| CeresClone:27810 | KQI I NVI QMK | TAADVCVLYD | I EKQHKKP | 225 |
| gi\|21555401 | KQI I NVI QMK | TAADVCVLYD | I EKQHKKP | 225 |
| gi\|27311653 | KQI I NVI QMK | TAADVCVLYD | I EKQHKKP | 225 |
| Lead-CeresClone34210 | KQTI NVI QMK | TAADVCVLYD | LEKQQKP- | 227 |
| gi\|21745398 | KQTVNI I QMK | TAADVCVLYD | I EKQQKP- | 227 |
| Consensus | KQ-I NVI QMK | TAADACV-YD | L--QKK-- | 228 |

```
gi|51964500             MAGGEDEGWR RSGIEVSALQ FDYDG-QPPL FARFNLRIAP GSRCLLIGAN  49
CeresClone:603261       MAAENEDSC- --GIRVTGMQ FSYDVQQPPL FLDFNLNVSP GSRCLLVGAN  47
gi|18379174             MAEKDATASG DDAIRVSGMQ FAYEV-EDPI FFDFNLDLPA GSRCLLVGAN  49
Lead-CeresClone33802    MAEKNASAV- DGAIRVSGMQ FSYDV-QDPI FFDFNLDLPA GSRCLLVGAN  48
CeresClone:979847       -------MARS DGAIRVSGMQ FSYDV-QDPI FFDFSLDLPA GSRCLLVGAN  43

Consensus               MA-K---A-- D-AIRVSGMQ FSYDV-QDPI FFDFNLDLPA GSRCLLVGAN  50

gi|51964500             GSGKTTLLKI LAGKHMVGGR DVVRVLNGSA FHDTQLVCNG DLSYLGGSWS  99
CeresClone:603261       GSGKTTLLKI LAGKHMVGGR DVVRVLSGSA FHDTQLVCSG DLAYLGGSWS  97
gi|18379174             GSGKTTLLKI LAGKHMVGGK NVVQVLSRSA FHDTQLVCSG DLSYLGGSWS  99
Lead-CeresClone33802    GSGKTTLLKI LAGKHMVGGK NVVQVLDRSA FHDTELVCSG DLSYLGGSWS  98
CeresClone:979847       GSGKTTLLKI LAGKHMVGGK NIVQVLNRSA FHDTDLVCSG DLSYLGGSWS  93

Consensus               GSGKTTLLKI LAGKHMVGGK NVVQVL-RSA FHDTQLVCSG DLSYLGGSWS  100

gi|51964500             RAIGSAGDVP LQGDFSAEHM IFGVDGVDPV RREKLVDLLD IDLQWRMHKV  149
CeresClone:603261       KNVGSAGEIP LQGDFSAEHM IFGVEGADPE RRDKLIELLD IDLQWRMHKV  147
gi|18379174             KTVGSAGEVP LQGDFSAEHM IFGVEGIDPV RREKLIDLLD INLQWRMHKV  149
Lead-CeresClone33802    KTAGSAGDIP LQGDFSAEHM IFGVEGIDPF RREKLIDLLD INLQWRMHKV  148
CeresClone:979847       KTAGSAGEIP LQGDFSAEHM IFGVEGIDPV RREKLIDLLD INLKWRMHKX  143

Consensus               KTVGSAGEIP LQGDFSAEHM IFGVEGVDPV RREKLIDLLD INLQWRMHKV  150

gi|51964500             SDGQRRRVQI CMGLLHPYKV LLLDEITVDL DVVTRMDLLD FFKEECEQRE  199
CeresClone:603261       SDGQRRRVQI CLGLLHPYKV LLLDEVTVDL DVVTRMDLLD FFKEECEQRE  197
gi|18379174             SDGQKRRVQI CMGLLHPFKV LLLDEVTVDL DVVARMDLLE FFKEECDQRG  199
Lead-CeresClone33802    SDGQRRRVQI CMGLLHPFKV LLLDEVTVDL DVVARMDLLE FFKEECEQRG  198
CeresClone:979847       SDGQRRRVQI CMGLLQPFKV LLLDEVTVDL DVVARMDLLE FFKEECEQRG  193

Consensus               SDGQRRRVQI CMGLLHPFKV LLLDEVTVDL DVVARMDLLE FFKEECEQRG  200
```

| | | | | | | |
|---|---|---|---|---|---|---|
| gi\|51964500 | ATI VYATHI F | DGLESWATDI | AYI QEGELRK | SAKYSDVEEL | KSAKNLLSVV | 249 |
| CeresClone:603261 | AI VYATHI F | DGLETWATHL | AYI QDGELRR | AEKI SNVKEL | KSSTNLLSVV | 247 |
| gi\|18379174 | ATI VYATHI F | DGLETWATHL | AYI QDGELNR | LSKMTDI EEL | KTSPNLLSVV | 249 |
| Lead-CeresClone33802 | ATI VYATHI F | DGLETWASHL | AYI NGGELKL | SAKLDEI KDL | KTSPNLLSVV | 248 |
| CeresClone:979847 | ATI VYATHI F | DGLETWASHL | AYI HGGELKX | SAKLKEI KDL | ETSPNLLSVV | 243 |
| Consensus | ATI VYATHI F | DGLETWATHL | AYI QDGEL-R | SAKLS-I KEL | KTSPNLLSVV | 250 |

| | | | | | | |
|---|---|---|---|---|---|---|
| gi\|51964500 | ESWLRSETKL | PKKEHPRPET | QPRRSSPFDA | SPFRSSRHMA | YYR | 292 |
| CeresClone:603261 | EAWLRAETKL | EKKN------ | -PVQKTSVAS | SPFFSSRHMA | YYR | 283 |
| gi\|18379174 | ESWLRSEIKL | VKKK--KKPV | APWKPSPFDN | SPFRSSRHMA | YYR | 290 |
| Lead-CeresClone33802 | EAWLRSETKV | EKKT------ | ---KKKPVVT | SPFMSSRQMA | YYR | 282 |
| CeresClone:979847 | ENWLRSETKV | EKKT------ | ---KKKPVAT | SPFMSSRQMA | YYR | 277 |
| Consensus | E-WLRSETKL | EKK------- | -P-KKSPV-- | SPF-SSRHMA | YYR | 293 |

```
Lead-CeresClone27197   MANRYDPNPF AEEEEVNPFA NARGVPPASN SRLSPLPPEP VGF--DYGRT   48
CeresClone:980747      MAGRYDRNPF DEGDEVNPFA NPGSVPAASS SRLSPLPPEP AGF--GFGRT   48
CeresClone:1075340     MAGRYDRNPF DEGDEVNPFA NPGSVPAASS SRLSPLPPEP AGF--GFGRT   48
gi|15220305            MGGRYDRNTF DEQDEVNPFA NPGSVPAASN SRLSPLPPEP AGF--GYGRT   48
CeresClone:580349      MAGRYDSNPF DE-EEVNPFY NPGSVPAATN SRLSPLKPEP VDYNYGFGAT   49
CeresClone:219387      MAGKHGRNGF DD-DNVNPFA G-GSVPPATN SRLSPLSHEP ADFYN-----   43
CeresClone:325927      MAGKHGRNGF DD-DNVNPFA G-GSVPPATN SRLSPLSHEP ADFYN-----   43
CeresClone:699286      MAGRYDRNPF DE-DDVNPFA G-GGVPPASN SRMPPLPHEP AGFYNDRAAT   48
gi|50902072            MAGRYDRNPF DE-DDVNPFA G-GSVPPASN SRMPPLPHEP -GFYNDRGAT   47

Consensus              MAGRYDRNPF DE-DEVNPFA N-GSVPPASN SRLSPLPPEP AGF---YG-T   50

Lead-CeresClone27197   VDIPLDR--A GTQDLKKKEK ELQAKEAELK RREQDLKRKE DAAARAGIVI   96
CeresClone:980747      VDVPLDRPGS GAQDLKKKEK ELQAKEAELK RREQDLKRKE DAAARAGIVI   98
CeresClone:1075340     VDVPLDRPGS GAQDLKKKEK ELQAKEAELK RREQDLKRKE DAAARAGIVI   98
gi|15220305            VDIPLDRPGS GAQDLKKKEK ELQAKEADLR RREQDLKRKQ DAAARAGIVI   98
CeresClone:580349      VDIPLDS--- -STDLKKKEK ELQAKETELR KREQEVRRRE EAASRAGIVL   95
CeresClone:219387      VDIPLDS--- -SKDLKKKEK ELQAMEAELN KRERELKRKE EAASRAGVVI   89
CeresClone:325927      VDIPLDS--- -SKDLKKKEK ELQAMEAELN KRERELKRKE EAASRAGVVI   89
CeresClone:699286      VDIPLGS--- -SKDLKQKEK ELQSKEAELN KRERELKRRE EAAARAGIVI   94
gi|50902072            VDIPLDS--- -TKDMKKKEK ELQAKEAELN KRESELRRRE EAASRAGIVI   93

Consensus              VDIPLDS--- -S-DLKKKEK ELQAKEAELK KREQDLKRKE DAAARAGIVI   100

Lead-CeresClone27197   EVKNWPPFFP LIHHDIANEI PVHLQRLQYV TFATYLGLVL CLFWNIIAVT   146
CeresClone:980747      EVKNWPPLFP LIHHDIANEI PIRLQRLQYI AFSTYLGLVL ALFWNVIAVT   148
CeresClone:1075340     EVKNWPPLFP LIHHDIANEI PIRLQRLQYI AFSTYLGLVL ALFWNVIAVT   148
gi|15220305            EAKNWPIFFP LIHHDIANEI LVRLQRLQYI AFATYLGLVL ALFWNIIAVT   148
CeresClone:580349      EEKNWPPFFP IIHHDIANEI PIHLQKLQYV AFTTLLGLVL CLFWNVIAVT   145
CeresClone:219387      EEKNWPPFFP LIHHDISNEI PIHLQRMQYL AFSSFLGLIA CLFWNVIATT   139
CeresClone:325927      EEKNWPPFFP LIHHDISNEI PIHLQRMQYL AFSSFLGLIA CLFWNVIATT   139
CeresClone:699286      ETKNWPPFMP IIHHDISNEI PIHLQRMQYL AFCSLLGLTL CLFWNIIATT   144
gi|50902072            EEKNWPPFFP IIHHDISNEI PIHLQRMQYL AFSSLLGLAA CLFWNIIATT   143

Consensus              E-KNWPPFFP LIHHDIANEI PIHLQRMQYI AFSTYLGLVL CLFWNVIAVT   150
```

| | | | | | | |
|---|---|---|---|---|---|---|
| Lead-CeresClone27197 | TAWI KGEGVT | I WLLALI YFI | AGVPGGYVLW | YRPLYRAFRT | DSALSFGWFF | 196 |
| CeresClone:980747 | TAWI KGEGVT | I WLLALI YFI | SGVPGGYVLW | YRPLYRAFRN | DSALSFGWFF | 198 |
| CeresClone:1075340 | TAWI KGEGVT | I WLLALI YFI | SGVPGGYVLW | YRPLYRAFRN | DSALSFGWFF | 198 |
| gi\|15220305 | TAWI KGEGVT | I WLLAVI YFI | SGVPGGYVLW | YRPLYRAFRS | DSAFNFGWFF | 198 |
| CeresClone:580349 | AAWI KGEGVK | I WFLAI I YFI | AGVPGAYVLW | YRPLYRAFRN | ESALKFGWFF | 195 |
| CeresClone:219387 | TAWI KGEGVM | I WLLAI I YFI | SGAPGAYVLW | YRPLYNAMRT | ESALKFGWFF | 189 |
| CeresClone:325927 | TAWI KGEGVM | I WLLAI I YFI | SGAPGAYVLW | YRPLYNAMRT | ESALKFGWFF | 189 |
| CeresClone:699286 | AAWI KGAGVV | I WLLAI I YFI | SGVPGAYVLW | YRPLYNAMRT | ESALKFGWFF | 194 |
| gi\|50902072 | AAWI KGAGVM | I WLLAI I YFI | SGVPGAYVLW | YRPLYNAMRT | ESALKFGWFF | 193 |
| Consensus | TAWI KGEGV- | I WLLAI I YFI | SGVPGAYVLW | YRPLYRAFRT | DSALKFGWFF | 200 |

| | | | | | | |
|---|---|---|---|---|---|---|
| Lead-CeresClone27197 | LFYMLHI AFC | VFAAVAPPVV | FKGKSLAGI L | PAI DVLSGQA | I VGI FYFI GF | 246 |
| CeresClone:980747 | LFYMLHI AFC | VFAAVAPPVV | FKGKSLAGI L | PALDMLSSQA | LVGI FYFI GF | 248 |
| CeresClone:1075340 | LFYMLHI AFC | VFAAVAPPVV | FKGKSLAGI L | PALDMLSSQA | LVGI FYFI GF | 248 |
| gi\|15220305 | LFYMLHI LFC | LFAAVAPPI V | FKGKSLAGI L | PAI DVLSAQA | LVGI FYFI GF | 248 |
| CeresClone:580349 | MFYLLHI GFC | I LAAVAPPI V | FKGKSLFGI L | AAI DVLGDHA | LI GI FYFI GF | 245 |
| CeresClone:219387 | LFYMI HI I FC | VWAAVAPPFP | FKGKSLAGI L | PAI DVI SKNA | I VGI FYFVGF | 239 |
| CeresClone:325927 | LFYMI HI I FC | VWAAVAPPFP | FKGKSLAGI L | PAI DVI SKNA | I VGI FYFVGF | 239 |
| CeresClone:699286 | LLYLI HI I FC | I WSAVSPPFP | FKGKSI AGFL | PAI DVI GSNV | I VGI FYFVGF | 244 |
| gi\|50902072 | LFYLI HI LFC | I WSAVAPPFP | FKGKSLAGI L | PAI DVI GNNA | I VGI FYFI GF | 243 |
| Consensus | LFYMLHI I FC | V-AAVAPPVV | FKGKSLAGI L | PAI DVLSSNA | I VGI FYFI GF | 250 |

| | | | | | | |
|---|---|---|---|---|---|---|
| Lead-CeresClone27197 | AFFCLESVVS | I WVI QQVYMY | FRGSGKQDQM | RREAARGALR | AAV | 289 |
| CeresClone:980747 | AFFCLESVVS | I WVI QQVYMY | FRGSGKADEM | KRDAARGAMR | AAV | 291 |
| CeresClone:1075340 | AFFCLESVVS | I WVI QQVYMY | FRGSGKADEM | KRDAARGAMR | AAV | 291 |
| gi\|15220305 | GLFCLESVVS | I WVI QQVYMY | FRGSGKADDM | RRDAARGAMR | AAI | 291 |
| CeresClone:580349 | GLFCVETLI S | I WVI QQVYMY | FRGSGKAAEM | KREAARGALR | AAI | 288 |
| CeresClone:219387 | GLFCLESLLS | I GVI QQVYMY | FRGSGKAAEM | KREAARSALS | SAF | 282 |
| CeresClone:325927 | GLFCLESLLS | I GVI QQVYMY | FRGSGKAAEM | KREAARSALS | SAF | 282 |
| CeresClone:699286 | GLFCLEALLS | I VVI QQVYMY | FRGSGKAAQM | RQEAARGAMR | SAF | 287 |
| gi\|50902072 | GLFCLESLLS | VVVI QQVYMY | FRGSGKAAEM | KREAARGAMR | SAF | 286 |
| Consensus | GLFCLESL-S | I WVI QQVYMY | FRGSGKAAEM | KREAARGAMR | AAV | 293 |

| | | | | | | |
|---|---|---|---|---|---|---|
| CeresClone:1429265 | SNCDAGNQQW | GRTSTCLSYG | XRXSXMXXXL | FXXLXXXXI X | QXPSI VXLVX | 50 |
| Lead-CeresClone23771 | ---------M | GAYKYVSELW | RKKQSDVMRF | LQRVRCWEYR | QQPSI VRLVR | 41 |
| CeresClone:1050058 | ---------- | ---------- | -------MRF | LQRVRCWEYR | QQPSI VRLTR | 23 |
| CeresClone:1064683 | ---------M | GAYKFVSELW | RRKQSDVMRF | VQRVRCWEYR | QQPAI VRI TR | 41 |
| CeresClone:291474 | ---------M | GAYKYVSELW | RRKQSDVMRF | VQRVRCWEYR | QQPSI VRLTR | 41 |
| CeresClone:221519 | ---------M | GAYKXVSELW | RRKQSDVMRF | VQRVRCWEYR | QQPSI VRLTR | 41 |
| CeresClone:297035 | ---------- | ---------- | -------MRF | VQRVRCWEYR | QQPAI VRLTR | 23 |
| CeresClone:312541 | ---------M | GAYKYVSELW | RRKQSDVMRF | VQRVRCWEYR | QQPAI VRLTR | 41 |
| CeresClone:1544938 | ---------M | GAYKYVSELW | RRKQSDVMRF | VQRVRCWEYR | QQPAI VRLTR | 41 |
| CeresClone:210309 | ---------M | GAYKYVSELW | RRKQSDVMRF | VQRMRCWEYR | QQPAI VRLTR | 41 |
| Consensus | ---------M | GAYKYVSELW | RRKQSDVMRF | VQRVRCWEYR | QQP-I VRLTR | 50 |

| | | | | | | |
|---|---|---|---|---|---|---|
| CeresClone:1429265 | PXXPDKARRL | GYKAKQGFVV | YRVRVRRGGR | KXXVPXGI VY | GKPTNQGVTQ | 100 |
| Lead-CeresClone23771 | PTRPDKARRL | GYKAKQGFVV | YRVRVRRGGR | KRPVPKGI VY | GKPTNQGVTQ | 91 |
| CeresClone:1050058 | STRPDKARRL | GFKAKQGYVI | YRVRVRRGGR | KRPVPKGI VY | GKPTNQGVTQ | 73 |
| CeresClone:1064683 | PTRPDRARRL | GFKAKQGYVF | YRVRVKRGGR | KRPVPKGI VY | GKPKHQGI TQ | 91 |
| CeresClone:291474 | PTRPDKARRL | GYKAKQGYVV | YRVRVKRGGR | KRPVPKGI VY | GKPKHQGI TQ | 91 |
| CeresClone:221519 | PTRPDKARRL | GYKAKQGYVV | YRVRVKRGGR | KRPVPKGI VY | GKPKHQGI TQ | 91 |
| CeresClone:297035 | PTRPDKARRL | GYKAKQGYVV | YRVRVKRGGR | KRPVPKGI VY | GKPKHQGI TQ | 73 |
| CeresClone:312541 | PTRPDKARRL | GFKAKQGYVV | YRVRVRRGGR | KRPVPKGI VY | GKPKHQGI TQ | 91 |
| CeresClone:1544938 | PTRPDKARRL | GFKAKQGYVV | YRVRVRRGGR | KRPVPKGI VY | GKPKHQGI TQ | 91 |
| CeresClone:210309 | PTRPDKARRL | GYKAKQGYVV | YRVRVRRGGR | KRPVPKGI VY | GKPKHQGI TQ | 91 |
| Consensus | PTRPDKARRL | GYKAKQGYVV | YRVRVRRGGR | KRPVPKGI VY | GKPKHQGI TQ | 100 |

| | | | | | | |
|---|---|---|---|---|---|---|
| CeresClone:1429265 | LKFQRSKRSV | AEERAGRKLS | XXRVVNSYWL | NEDSTYKYYE | I I LVDPAHNA | 150 |
| Lead-CeresClone23771 | LKFQRSKRSV | AEERAGRKLG | GLRVVNSYWL | NEDSTYKYYE | I I LVDPAHNA | 141 |
| CeresClone:1050058 | LKFQRSKRSV | AEERAGRKLG | GLRVLNSYWV | NEDSTYKYFE | VI LVDVAHSA | 123 |
| CeresClone:1064683 | LKFQRNKRSV | AEERAGRKLG | GLRVLNSYWV | NEDSTYKYFE | I I LVDVAHKA | 141 |
| CeresClone:291474 | LKFQRNKRSV | AEERAGRKLG | GLRVLNSYWV | NEDSTYKYFE | I I LVDVAHKA | 141 |
| CeresClone:221519 | LKFQRNKRSV | AEERAGRKLG | GLRVLNSYWV | NEDSTYKYFE | I I LVDVAHKA | 141 |
| CeresClone:297035 | LKFQRNKRSV | AEERAGRKLG | GLRVLNSYWV | NEDSTYKYFE | I I LVDVAHTA | 123 |
| CeresClone:312541 | LKFQRNKRSV | AEERAGRKLG | GLRVLNSYWV | NEDSTYKYFE | I I LVDVAHTA | 141 |
| CeresClone:1544938 | LKFQRNKRSV | AEERAGRKLG | GLRVLNSYWV | NEDSTYKYFE | I I LVDVAHTA | 141 |
| CeresClone:210309 | LKFQRNKRSV | AEERAGRKLG | GLRVLNSYWV | NEDSTYKYFE | I I LVDVAHTF | 141 |
| Consensus | LKFQRNKRSV | AEERAGRKLG | GLRVLNSYWV | NEDSTYKYFE | I I LVDVAH-A | 150 |

| | | | | | | |
|---|---|---|---|---|---|---|
| CeresClone:1429265 | I RNDPRI NWI | CNPVHKHREL | RGLTSEGKKN | RGLRGKGHNN | HKNRPSRRAT | 200 |
| Lead-CeresClone23771 | VRNDPRI NWI | CNPVHKHREL | RGLTSEGKKN | RGLRGKGHNN | HKNRPSRRAT | 191 |
| CeresClone:1050058 | VRNDPRI NWL | CNPVHKHREL | RGLTSAGKSN | RGLRGRGHLY | HKNRPSRRAT | 173 |
| CeresClone:1064683 | I KTDPRI NWL | CNPVHKHREL | RGLTSAGKKF | RGLRGKGHTH | HKNRPSRRAT | 191 |
| CeresClone:291474 | I KTDPRI NWL | CNPVHKHREL | RGLTSAGKKY | RGLRGKGHTH | HKNRPSRRAT | 191 |
| CeresClone:221519 | I KTDPRI NWL | CNPVHKHREL | RGLTSAGKKY | RGLRGKGHTH | HKNRPSRRAT | 191 |
| CeresClone:297035 | I RKDPRI NWL | CNPVHKHREL | RGLTSAGKKF | RGLRGKGHTH | HKNRPSRRAT | 173 |
| CeresClone:312541 | I RNDPRI NWL | CNPVHKHREL | RGLTSAGKKF | RGLRGKGHTH | HKNRPSRRAT | 191 |
| CeresClone:1544938 | I RNDPRI NWL | CNPVHKHREL | RGLTSAGKKF | RGLRGKGHTH | HKNRPSRRAT | 191 |
| CeresClone:210309 | I RNDPRI NWL | CNPVHKHREL | RGLTSAGKKF | RGLRGKGHTH | HKNRPSRRAT | 191 |
| Consensus | I RNDPRI NWL | CNPVHKHREL | RGLTSAGKKF | RGLRGKGHTH | HKNRPSRRAT | 200 |

| | | | |
|---|---|---|---|
| CeresClone:1429265 | WKKNNSLSLR | RYR | 213 |
| Lead-CeresClone23771 | WKKNNSLSLR | RYR | 204 |
| CeresClone:1050058 | WKRNNTLSLR | RYR | 186 |
| CeresClone:1064683 | WKRNQTLSLR | RYR | 204 |
| CeresClone:291474 | WKRNQTLSLR | RYR | 204 |
| CeresClone:221519 | WKRNQTLSLR | RYR | 204 |
| CeresClone:297035 | WKRNQTLSLR | RYR | 186 |
| CeresClone:312541 | WKRNQTLSLR | RYR | 204 |
| CeresClone:1544938 | WKRNQTLSLR | RYR | 204 |
| CeresClone:210309 | WKRNQTLSLR | RYR | 204 |
| Consensus | WKRNQTLSLR | RYR | 213 |

```
Lead-CeresClone22007   MKVLLGLLLL LSLTNSSSA- -YCLCKDGIG DTELQTSIDY ACGTLADCNP  49
CeresClone:700212      MEAPLLVAAL LLLSSTLVVS EFCVCRSEQP QAALQKTIDY ACGAGADCNS  50
gi|50939031            MEAVVVAALV LLMSSSLVAS -WCVCRSDQP QAALQKTIDY ACGAGADCNS  49

Consensus              MEA-L--ALL LLLSSSLVAS --CVCRS-QP QAALQKTIDY ACGAGADCNS  50

Lead-CeresClone22007   IHDKGICYQP DTIKSHCDWA VNSYFQNAAQ VPGSCNFSGT ATTNPNPPSN  99
CeresClone:700212      IHEQGPCYNP NNVVSHCSWA ANSYFQKKRA MGATCDFGGT ALVVSTDPS-  99
gi|50939031            IHEQGQCFNP NTVVAHCSWA ANSYFQRNRA MGATCDFTGT ATLTTSDP--  97

Consensus              IHEQG-CYNP NTVVSHCSWA ANSYFQ--RA MGATCDF-GT AT----DPS-  100

Lead-CeresClone22007   LANGCLYPSS PSSTRSPPST TPPTGTTPTN GTTPFPGTPF PGTPFPGT-P  148
CeresClone:700212      -SSCCSYPSS ASAAGT--ST TPTGTGTCGG GTT---GG-T PGTFTPGAGT  142
gi|50939031            -VSGCSFPAS A-GAGT--ST TPT-----MG GTT---GTMT PGTFTPGTGM  135

Consensus              --SGCSYPSS AS-AGT--ST TPT---T--G GTT---GT-T PGTFTPGTG-  150

Lead-CeresClone22007   PVFGPTGVFN PSNPGSGASS LGT------- ---------S SVFTLCFSLL  182
CeresClone:700212      STGGMGGTGT GTDTTTGFGG LGPTGTSNMD TAAAGLHPRS GAPAFLAVLL  192
gi|50939031            GTTTGTGMGT GTTTGTGLGG LGPTGTSSMD TAAAGLHLRA GLAFFCTVLL  185

Consensus              -T-G-TG-GT GT-TGTG-GG LGPTGTS-MD TAAAGLH-RS G--TFC-VLL  200

Lead-CeresClone22007   AFLWGSDVRF GFSHV  197
CeresClone:700212      SFL------- AFA--  198
gi|50939031            SFV------- AFA--  191

Consensus              SFL------- AFA--  215
```

```
CeresClone:284925          ---------- ---------- ---MQAGACP DRGAVVAARR RRRRAVV---  24
CeresClone:961315          ---------- MVDLGKHHHH MQLI TFPTTV DCARELRHRR TLRSLIE---  37
CeresClone:786659          ---------- ---------- --MAFSSACP SFHSLDFVSP PKKPVTG---  25
CeresClone:276062          ---------M KSSEAEDDDE TTMAFSSACT SFHSDGFVSP PLKPAPS---  38
Lead-CeresClone566317      MKTLVMDTTS STPQDSSSSK RHFHWTNKVG NEDPQLAISE TMSKIIEEED  50
gi|62320932                ---------- MAKDFASKRH NSFHWTRKVG SDENDDVSSH KPLPHHN---  37

Consensus                  ---------- ---------- --M--TSAC- S--S-L--S- -M-P-V----  50

CeresClone:284925          -----GLIELA ADAAHRV--- VLLRRGRVVA PPPHRHALRL ---PRRPRVA  64
CeresClone:961315          -----CLLPYC CTYQQPSPS- CQNDTVSVSS SSSSSSSSDH SSSSSSSSSS  82
CeresClone:786659          -----TAAPAQ EKQ------- -QQRRKVRTA VARLRSALSA AVSGRRRQV-  62
CeresClone:276062          -----DHIQQV AAAAAG---- QRRRMKVRTA VSRLRSALAN AVAGRFRQV-  79
Lead-CeresClone566317      TNTKEKEQEE DDKAVPLPGP ATKRKIQAVA ISRLRSVLTV FSKNHRSNLP 100
gi|62320932                ----NTKPSS SSSSSSSNVI THKKKLQSFA VSRLRSVIAI LSRARPGNQN  83

Consensus                  ------I --- A-AA------ -QKR--Q-TA VSRLRSAL-- ASS-RR--V- 100

CeresClone:284925          VAAAERAVPA HAGGRAG--- ---APDA-RA APRARRPRGR AHRAGGREAR 107
CeresClone:961315          SRSNSLI SGT FFGHRRGRVS FCLQDTAVGS PPLLLLELAV PTAKLAKEMD 132
CeresClone:786659          -GLGARLTGT LYGHRRGHVH LAFQTDP-RA CPALLLELAA PTGALVREM- 109
CeresClone:276062          -GMGARLTGT LYGHRRGHVH LAFQVDP-RA CPALLLELAA PTAALVREM- 126
Lead-CeresClone566317      FGLGSRVVGT LFGYRRGHVH FAFQRDP-TS QPAFLIELAT PISGLVREM- 148
gi|62320932                SGLGSRVVGT LFGSRRGHVH FSIQKDP-NS PPAFLIELAT PISGLVKEM- 131

Consensus                  -GLGSR--GT LFGHRRGHVH FAFQ-DP-R- -PALLLELA- PT-ALVREM- 150

CeresClone:284925          RAGHRRRQRG HRHHRPR--- -------RVG AG-------- -----GAHVDH 135
CeresClone:961315          QAGVLRI ALE CDRXXSSNSG P--------- ---------- -----XSXFDV 159
CeresClone:786659          ASGLVRI ALE CERAKAATGG -------GDG GG-------- -----RKLVEE 140
CeresClone:276062          ASGLVRI ALE CDRARARGSP AAALPSPSPG AC-------- -----KRLVEE 164
Lead-CeresClone566317      ASGLVRI ALE CDKDKDSEEK KTT----KKN KT-------- -----LRLLQE 182
gi|62320932                ASGLVRI ALE CDKGKEEEEG EEKNGTLRHG GGDKTKTTTT AAVSRRLVEE 181

Consensus                  ASGLVRI ALE CDR-KSS--G -------R-G -G-------- -----RRLVEE 200
```

```
CeresClone:284925       VLQR-----Q EGGYAVRRDP TEEDI AVLET LWAVXMGGGV LPGRS---DM  177
CeresClone:961315       PXWSMYCNGR KMGXAVRRKV TENXAVXLRM MQXVSVGAGV VPVDK-----  204
CeresClone:786659       TVWRAYVNGK SCGYAVRREC GAADWRVLRA LEPVSMGAGV I PAAS----C  186
CeresClone:276062       TVWRAYCNGK SCGYAVRREC GAADWRVLRA LEPVSMGAGV I PAAS----C  210
Lead-CeresClone566317   SVWRTYCNGK KCGFATRREC GAKDWDI LKA VEPI SMGAGV LPNSD-----  227
gi|62320932             PMWRTYCNGK KCGFATRREC GEKEKKVLKA LEMVSMGAGV LPETEEI GGG  231

Consensus               TVWR-YCNGK KCGYAVRREC G-KDWRVLRA LEPVSMGAGV LP--------  250

CeresClone:284925       DGPDGEMAYM RGSFEHTVGS RDSESLYMVG PPG------- GDCPELAI FF  220
CeresClone:961315       ---XEXTLYL RARFERVXGS SDSESFHMMN PGG------- SYGQELSI FL  244
CeresClone:786659       GGGEGDVMYM RARFERVVGS RDSEAFYMMN PDSSSSGSGI NGGPELSVYL  236
CeresClone:276062       GGGEGDVMYM RARFERVVGS RDSEAFYMMN PDGSGGGAHG HGGPELSVYL  260
Lead-CeresClone566317   -GSDGEVMYM RARFERI VGS RDSEAFYMMN PDS------- NGAPELSI YL  269
gi|62320932             GGGGGDI MYM RAKFERI VGS RDSEAFYMMN PDS------- NGAPELSI YL  274

Consensus               GGG-GDVMYM RARFERVVGS RDSEAFYMMN PD-------- NGGPELSI YL  300

CeresClone:284925       VRL        223
CeresClone:961315       LRS        247
CeresClone:786659       LRV        239
CeresClone:276062       LRV        263
Lead-CeresClone566317   LRV        272
gi|62320932             LRI        277

Consensus               LRV        303
```

```
Lead-CeresClone267657   ---MAQQHSF LLLC---FFL SISYLLSSAQ TEATSIERLV PRDLYNKIFI   44
CeresClone:719679       MTSSVPLVST LLLCSIALLY SASFGAEAWT SPYIPVSSLI SKSLYDTFFL   50

Consensus               MTS------S- LLLCSIA--- S-S------- ---------L- ---LY---F-   50

Lead-CeresClone267657   HKDNTACPAN GFYTYESFVQ ATRRFPRFGS VGSPVTQRLE VAAFLAQISH   94
CeresClone:719679       HKDDTACPAK DFYPYDAFIR ASKSFPAFGT TGCLATRKRE IAAFLAQISH   100

Consensus               HKD-TACPA- -FY-Y--F-- A---FP-FG- -G---T---E -AAFLAQISH   100

Lead-CeresClone267657   ETTGGWATAP DGPYAWGLCF KEEVSPQSTY CDSSNTQWPC FPNKTYQGRG   144
CeresClone:719679       ETTGGWATAP DGPFAWGLCF KEEISPQSNY CDSTNTQWPC FPGKSYKGRG   150

Consensus               ETTGGWATAP DGP-AWGLCF KEE-SPQS-Y CDS-NTQWPC FP-K-Y-GRG   150

Lead-CeresClone267657   PIQLSWNYNY GPAGRALGFD GLRNPETVSN NSVIAFQTAL WFWMTPQSPK   194
CeresClone:719679       PIQLSWNYNY GPAGKALGFD GLRNPEIVAN NSVIAFKTAM WFWMTEQKPK   200

Consensus               PIQLSWNYNY GPAG-ALGFD GLRNPE-V-N NSVIAF-TA- WFWMT-Q-PK   200

Lead-CeresClone267657   PSCHDVMIGK YRPTAADLAA NRTGGFGLTT NIINGGLECG IPGDGRVNDR   244
CeresClone:719679       PSCHNVMVGI YVPTEDDIAA NRTAGYGLVT NIINGGLECG IPGDARVNDR   250

Consensus               PSCH-VM-G- Y-PT--D-AA NRT-G-GL-T NIINGGLECG IPGD-RVNDR   250

Lead-CeresClone267657   IGFFQRYTGL FKVATGPNLD CENQRPYA   272
CeresClone:719679       IGFFERYTKL FNVDTGPNLD CAYQKPF-   277

Consensus               IGFF-RYT-L F-V-TGPNLD C--Q-P-A   278
```

```
Lead-CeresClone15343  MKMQAVLVIL VFSGLLSVKI ALAAQHVIGG SQG-WEQSVD FDSWSSDQSF   49
CeresClone:276252     -MVAAAAVLL ALAAVATEVA AAGTTYTVGA PDGLWDMQTD YAQWVKSKTF   49
CeresClone:773730     ---------- ----MAILST ASAAIYNVGE PGGAWDLSTN YGTWASSRNF   36
CeresClone:729952     -MAAARTILL AMAAMAILST TSAAIYNVGE PGGAWDLSTN YGTWASSRNF   49

Consensus             -M-AA--VLL A-AAMA-LST ASAAIYNVGE PGGAWDMST- YGTWASSRNF   50

Lead-CeresClone15343  KVGDQIVFKY S-GLHSVVEL GSETAYKSCD LGTSVNSLSS GNDVVKLSKI   98
CeresClone:276252     RPGDTITFTY SPELHDVVEV -TRAGYDACS SANNISAFRT GNDAVPLTAV   98
CeresClone:773730     KADDQIVFKY SPQAHDVLEV -SKADYDSCS TASPITTLNS GNDVVTLTAS   85
CeresClone:729952     HPNDQIIFKY SPQAHDVLEV -SKADYDSCS AASTIATLNS GNDVVSLTAT   98

Consensus             KP-DQIVFKY SPQ-HDV-EV -SKADYDSCS -AS-I-TLNS GNDVV-LTAT  100

Lead-CeresClone15343  GTRYFVCGIV GHCEQGMKIK VNVV--DSKS GSSPSGSGSG SDSGSGSKSS  146
CeresClone:276252     GTRYFLCGLT GHCGNGMKIR VDVV--AAAA SPSAPGPAAA AAAPPTTSSP  146
CeresClone:773730     GTRYFICGFP GHCAGGMKVK IDVM--SGFS SPAPASGPSA SNAPPPTPAS  133
CeresClone:729952     GTRYFLCGYP GHCAGGMKVK IDVVPRSSSS SPAPSSGPSA SSAPPPAPVA  148

Consensus             GTRYFLCG-P GHCAGGMK-K -DVV--SS-S SP-PS-GPSA S-APPPTPSS  150

Lead-CeresClone15343  SGDGLRASIG YMFVVGSLVI GLIWAY  172
CeresClone:276252     CNVGVVA-AS LLLLLLHAVV SY----  167
CeresClone:773730     AATNVEA-XG FGLAVLLAVA GLMA--  156
CeresClone:729952     AATSMEA-TG FGLTILLAVA GLMA--  171

Consensus             AAT-VEA--G F-L-VLLAV- GLMA--  176
```

```
CeresClone:966755        MTTVKDEWVA AAMTDDQMVV ELLLRLKHAG TVAAEN---- -PETNLRWGI   45
Lead-CeresClone8133      --MTGGDWIH EAMGDDSLVA EALICLLHAE PSLFDTKSGG ASDLKLKWSV   48
CeresClone:584341        --MSDDHWIK VAMADDSLVV DLLLRLHRPP PPPP------ -PCLNLHWTV   41
CeresClone:466978        --MCDDHWVK VAMADDSLVV DLLLRLHRS- PPPP------ -PCLNLHWTV   40

Consensus                --M-DD-W-K VAMADDSLVV -LLLRLH-A- PPPP------ -P-LNL-WTV   50

CeresClone:966755        RQRRSRSSRF GGGVTLKKGV DSVRGSPKTP LSWSGG-SGS GGASASPSAE   94
Lead-CeresClone8133      RQRRTKAATL R-----KKGD HDTRASPTTP LSWSGATSFS GGGGGAAAAV   93
CeresClone:584341        RQRRSRSA-- ------HNKA ESTRASPTTP LSWSGATSAS GG------NL   77
CeresClone:466978        RQRRSRSA-- ------HNKA ESTRASPTTP LSWSGATSAS GG------NL   76

Consensus                RQRRSRSA-- ---------A ESTRASPTTP LSWSGATSAS GG-------L  100

CeresClone:966755        DTSRQASCST SAGSGSKAFP TNEITSCFP- KRLKNKKSTS ELKHEENLKL  143
Lead-CeresClone8133      DGFEESSGVV KLSEAVRSKI TQTSVTTSPF KRSRKKKTLA QLKEEESVLL  143
CeresClone:584341        DGYEEYSRPS KPTQTSRSKV ANPSETTTT- RKTRRKKTLA ELKAEEDLLL  126
CeresClone:466978        DGYEES---- KPSQTSRSKV ANPSETATT- RKTRRKKTLT ELKEEEDLLL  121

Consensus                DGYEESS--- KPSQTSRSKV -NPSETTT-- --TRRKKTLA ELKEEEDLLL  150

CeresClone:966755        KERLXLEKEI ASLRAIFDQQ NVMNQRLKRI KLDLNS---- ------GHVK  183
Lead-CeresClone8133      KERNGLRNEL ATMQDLLKQQ RARNESLKKL QAESQK---- ----------  179
CeresClone:584341        KERRNLKKEL AFLRLTVEKH RATNESIKRK KLDFESRQNS SAAATASEVS  176
CeresClone:466978        KERRNLEKEL ASLRLTIQKH RATNESIKRL KLDFESRQNS SAAATASEVS  171

Consensus                KERRNLEKEL ASLRLT---- RATNES-KRL KLDFESRQNS SAAATASEVS  200

CeresClone:966755        NETPVDLIRK SQGESKPC-- ---------- -----RMEGK TATSESLFFL  216
Lead-CeresClone8133      ---------- ---------- ---------- ---------- --NDDSSFLL  187
CeresClone:584341        GKAVNGSFQF VKAECHPSNS VSHDDSPVCA ANVSPKAQDN IGNQESTFVL  226
CeresClone:466978        GKAVNGPFQF VKSECHPSNS VTHDDSPVCA ANASPKAQDN IGNRESTFVL  221

Consensus                GKAVNG-FQF VK-ECHPSNS V-HDDSPVCA AN-SPKAQDN IGN-ESTFVL  250
```

```
CeresClone:966755         PDLNITPSED ---ELLY--G TS    233
Lead-CeresClone8133       PDLNIALDNN SSPESLY--G TS    207
CeresClone:584341         PDLNLPVDED ISANIMHYIE LS    248
CeresClone:466978         PDLNLPADED INANVMH--- --    238

Consensus                 PDLN-P-DED ISA-------G TS   272
```

```
CeresClone:375711        METLLSPSTL FTL-PLRGSS RRPSL----- ---AASVSSR PTVSCSSALK   41
gi|50878369              METLLSPSTL LS--PLRGSK KKPAS-PAAS ASSSSSSPAR SVVSCALRRQ   47
Lead-CeresClone3853      METLLSPRAL SP--PLNP-- -KPLSLHQTK PTSHSLSLSK PTTFSGPKHL   45
CeresClone:478120        MGTLFPPHSL SPLLNLKPSP SRLLLAPCPQ PKSNSLFCSK PIVSSLRKNQ   50

Consensus                METLLSPSTL S-L-PLR-S- --P---P--- P-S-S-S-S- P-VS---K-Q   50

CeresClone:375711        RPQAGAVA-- --ASSHGDGV GRNWMSFLHH GLAAAALSLA IGLTPA--PA   85
gi|50878369              QPPPQAVAAW RGDGGRGGGV G-SWATFLQH GLAAAALSLA ISMAPA--PA   94
Lead-CeresClone3853      STRFTKPE-- ---------- SRNWLIDAKQ GLAALALSLT LTFSPV---G   80
CeresClone:478120        TSSPKPSS-- ---------- GTSWLAHAQQ GLAALAISLA LNFSPVLFNG   88

Consensus                ---P-AVA-- ------G-GV GR-WL-F-Q- GLAA-ALSLA ---SP---P-  100

CeresClone:375711        PAVASEFDVL NDGAPVDSYV VDDAGVLSRV TKSDVKRLAR DLEARKNIRL  135
gi|50878369              PAVASEFDVL NGGPPEDTYV VDDAGVLSRV TKSDVKRLVR DLESRKNIRI  144
Lead-CeresClone3853      TALASEFNIL NDGPPKETYV VDDAGVLSRV TKSDLKKLLS DLEYRKKLRL  130
CeresClone:478120        NALASEFDVL NEGPPKDSYV FDDAGVLSRV TRSDLKQLLS DLESRKNFRI  138

Consensus                PA-ASEFDVL NDGPPKD-YV VDDAGVLSRV TKSD-KRLL- DLESRKNIR-  150

CeresClone:375711        NFITVRKLTS KADAFEYADQ VLEKWYPTIE EGNNKGIVVL VTSQKEGAVT  185
gi|50878369              NFITVRKLTS KADAFEYADQ VLEKWYPTVE EGNNKGIVVL VTSQKEGAIT  194
Lead-CeresClone3853      NFITVRKLTS KADAFEYADQ VLEKWYPSIE EGNNKGIVVL ITSQKEGAIT  180
CeresClone:478120        NFITVRKLTS KADAFEYADQ VLERWYPSVE EGNNKGIVVL VTSQKEGAVT  188

Consensus                NFITVRKLTS KADAFEYADQ VLEKWYP--E EGNNKGIVVL VTSQKEGA-T  200

CeresClone:375711        GGPAFIQAVG DQILDATVSE NLPVLATDEK YNEAILSTAK RLAAAIDGLP  235
gi|50878369              GGPAFVQAVG DEILDSTVSE NLPVLATDEK YNEAIYTTAK RLAAAIDGLP  244
Lead-CeresClone3853      GGPAFIEAVG ENILDATVSE NLPVLATDEK YNEAVYSSAK RLVAAIDGQP  230
CeresClone:478120        GGPAFVEAVG EKILDATVSE NLPVLATDEK YNEAIFSTAK RLAAAIDGLP  238

Consensus                GGPAF--AVG --ILDATVSE NLPVLATDEK YNEAIYSTAK RLAAAIDGLP  250
```

| | | | | | | |
|---|---|---|---|---|---|---|
| CeresClone:375711 | DTGGPSFKEN | KRESNFKTKE | ETEEKRGQFT | LVVGGLLVIA | VVVPMAQYYA | 285 |
| gi\|50878369 | DPGGPTFKDN | KRESNFKTKE | ETEEKRGQFT | LVVGGLLVIA | FVVPMAQYYA | 294 |
| Lead-CeresClone3853 | DPGGPTVKDS | KRESNFKTKE | ETDEKRGQFS | LVVGGLLVIA | FVVPMAQYFA | 280 |
| CeresClone:478120 | DPGGPTVKDN | KRESNFKTKE | ETEEKRGQFT | LVVGGLLVIA | FVVPMAQYYA | 288 |
| Consensus | DPGGPT-KDN | KRESNFKTKE | ETEEKRGQFT | LVVGGLLVIA | FVVPMAQYYA | 300 |

| | | |
|---|---|---|
| CeresClone:375711 | YVSKK | 290 |
| gi\|50878369 | YI SKK | 299 |
| Lead-CeresClone3853 | YVSRK | 285 |
| CeresClone:478120 | YVSKK | 293 |
| Consensus | YVSKK | 305 |

| | | | | | | |
|---|---|---|---|---|---|---|
| Lead-CeresClone28003 | MALELWQTLK | EAI HAYTGLS | PVVFFTALAL | AFAI YQVI SG | WFASPFDDVN | 50 |
| CeresClone:980499 | MALLLWQTLK | EAI HAYTGLS | PVVFFTALAL | AFSI YQVVSG | WFASPFDDVR | 50 |
| CeresClone:1381318 | MALLLWQTLK | EAI HAYTGLS | PVVFFTALAL | AFSI YQVVSG | WFASPFDDVR | 50 |
| Consensus | MALLLWQTLK | EAI HAYTGLS | PVVFFTALAL | AFSI YQVVSG | WFASPFDDVR | 50 |
| | | | | | | |
| Lead-CeresClone28003 | RHQRARSLAQ | EEEPPI PQPV | QVGEI TEEEL | KQYDGSD-PQ | KPLLMAI KHQ | 99 |
| CeresClone:980499 | RHQRARSSAA | EEAPPI PQPV | QVGEI TEEEL | KQYDGSD-PQ | KPLLMAI KHQ | 99 |
| CeresClone:1381318 | RHQRARSSAA | EEAPPI PQPV | QVGEI TEXEL | XQYDXLPI LK | SPXSMAI KHQ | 100 |
| Consensus | RHQRARSSAA | EEAPPI PQPV | QVGEI TEEEL | KQYDGSD-PQ | KPLLMAI KHQ | 100 |
| | | | | | | |
| Lead-CeresClone28003 | I YDVTQSRMF- | YGPGGPYALF | AGKDASRALA | KMSFEEKDLT | WDI SGLGPFE | 149 |
| CeresClone:980499 | I YDVTQSRMF | YGPGGPYALF | AGKDASRALA | KMSFEEKDLT | WDI SGLGPFE | 149 |
| CeresClone:1381318 | I YDVTQSRMF | YGPGGPYALF | AGKDASRALA | KMSFEEKDLT | WDI SGLGPFE | 150 |
| Consensus | I YDVTQSRMF | YGPGGPYALF | AGKDASRALA | KMSFEEKDLT | WDI SGLGPFE | 150 |
| | | | | | | |
| Lead-CeresClone28003 | LDALQDWEYK | FMSKYAKVGT | VKVAGSEPET | ASVSEPTENV | EQDAHVTTTP | 199 |
| CeresClone:980499 | LEALQDWEYK | FKSKYATVGT | VKVTVSEAET | ASVSEPAETD | DGDAHVI KQ- | 198 |
| CeresClone:1381318 | LEALQDWEYK | FKSKYATVGT | VKVTVSEAET | ASVSEPAETD | DGDAHVI KQ- | 199 |
| Consensus | LEALQDWEYK | FKSKYATVGT | VKVTVSEAET | ASVSEPAETD | DGDAHVI KQ- | 200 |
| | | | | | | |
| Lead-CeresClone28003 | EKTVVDKSDD | APAETVLKKE | E | 220 | | |
| CeresClone:980499 | EPTVVDKNLE | TPAESDVKNE | - | 218 | | |
| CeresClone:1381318 | EPTVVDKNLE | TPAESDVKNE | - | 219 | | |
| Consensus | EPTVVDKNLE | TPAESDVKNE | - | 221 | | |

| | | | | | | |
|---|---|---|---|---|---|---|
| CeresClone:646162 | MGSK-G--PS | WSDQWGSGGF | GSDHYEEEEK | MKMKKSGSSK | KM--ADAKAV | 45 |
| Lead-CeresClone225200 | MGSKPGEAPT | WADQWASGE- | GDGSLANGKA | AG-------K | RTVAGNVKAA | 42 |
| gi\|38093751 | MGSK-KDAQT | WADQWGSSG- | GDGSFKKGGG | GGGSSGNSEK | KTVAGNVKAA | 48 |
| Consensus | MGSK-G-APT | WADQWGSGG- | GDGS---G-- | -G------S-K | KTVAGNVKAA | 50 |

| | | | | | | |
|---|---|---|---|---|---|---|
| CeresClone:646162 | ASAGMDKAKT | AAVVGAQKVK | SGTSAGLKWV | KNQYQKR--T | SK | 85 |
| Lead-CeresClone225200 | ASEGLVKAKA | AALVGAHKLK | TGTSSGIKWV | REQYQKKRTS | SK | 84 |
| gi\|38093751 | ASEGLVKAKA | AALVGAHKVK | SGTSSGIKWV | KGQYQKR--A | GK | 88 |
| Consensus | ASEGLVKAKA | AALVGAHKVK | SGTSSGIKWV | K-QYQKR--- | SK | 92 |

```
Lead-CeresClone301326   MCLHHTTPCD ARSL-FCLSS PYFQDAI MLP QT-PRALGHHD CLTASQESPP   49
CeresClone:908026       --LHHSTPCD ARSASLSSSS PNFQEAI MLP GAPWALRHHH  HHLLLF-PPA   47

Consensus               MCLHH-TPCD ARS-S---SS P-FQ-AI MLP --P-AL-HH-  ------E-P-   50

Lead-CeresClone301326   PTSKRKRPEK L   60
CeresClone:908026       PTSKKERSGE L   58

Consensus               PTSK--R--- L   61
```

```
Lead-CeresClone681088   -----MDHQP PPC-----PA AASAT DNPRG G--------T RHPMYRGVRK   32
CeresClone:973892       -----MKLSP PPLTNNEQPA ADT AVKSCGG GGRETFSA-T RHPVYHGVRK   44
gi|18378818             MSPQRMKLSS PPVTNNEPTA TASAVKSCGG GGKETSSSTT RHPVYHGVRK   50
gi|25406719             -----MKLSS PPVTNNEPTA TASAVKSCGG GGKETSSSTT RHPVYHGVRK   45
CeresClone:25524        MSPQRMKLSP PPVTNNEPTA TASAVKSCGG GGKETSSSTT RHPVYHGVRK   50
gi|21554403             -----MKLSP PPVTNNEPTA TASAVKSCGG GGKETSSSTT RHPVYHGVRK   45

Consensus               -----MKLSP PPVTNNEPTA TASAVKSCGG GGKETSSSTT RHPVYHGVRK   50

Lead-CeresClone681088   RRWGKWVSEI REPRKKNRI W LGSFPVPEMA ARAYDVAAYC LKGRKAQLNF   82
CeresClone:973892       RRWGKWVSEI REPRKKSRI W LGSFPI PEMA AKAYDVAALC LKGRKAQLNF   94
gi|18378818             RRWGKWVSEI REPRKKSRI W LGSFPVPEMA AKAYDVAAFC LKGRKAQLNF  100
gi|25406719             RRWGKWVSEI REPRKKSRI W LGSFPVPEMA AKAYDVAAFC LKGRKAQLNF   95
CeresClone:25524        RRWGKWVSEI REPRKKSRI W LGSFPVPEMA AKAYDVAAFC LKGRKAQLNF  100
gi|21554403             RRWGKWVSEI REPRKKSRI W LGSFPVPEMA AKAYDVAAFC LKGRKAQLNF   95

Consensus               RRWGKWVSEI REPRKKSRI W LGSFPVPEMA AKAYDVAAFC LKGRKAQLNF  100

Lead-CeresClone681088   PDDVDSLPLP SSRTARDI QT AAAQAARMMK --ASGNDEKS GI ASDDGDSG  130
CeresClone:973892       PDEI DDLPRP STCTARDI QV AAAKAANAVK I I KTGEDDVA NI --GDG---  138
gi|18378818             PEEI EDLPRP STCTPRDI QV AAAKAANAVK I I KMGDDDVA GI --DDG---  145
gi|25406719             PEEI EDLPRP STCTPRDI QV AAAKAANAVK I I KMGDDDVA GI --DDG---  140
CeresClone:25524        PEEI EDLPRP STCTPRDI QV AAAKAANAVK I I KMGDDDVA GI --DDG---  145
gi|21554403             PEEI EDLPRP STCTPRDI QV AAAKAANAVK I I KMGDDDVA GI --DDG---  140

Consensus               PEEI EDLPRP STCTPRDI QV AAAKAANAVK I I KMGDDDVA GI --DDG---  150

Lead-CeresClone681088   CDDFWGEI EL PELMDGECYW G-----CPAGA SSWTSSGDLA EWPEEELSPQ  176
CeresClone:973892       -DDFWEGI EL PELMMTRCGW SPEPFVAGDD ATWLVDEDSY QY--------  179
gi|18378818             -DDFWEGI EL PELMMSGGGW SPEPFVAGDD ATWLVDGDLY QY--------  186
gi|25406719             -DDFWEGI EL PELMMSGGGW SPEPFVAGDD ATWLVDGDLY QY--------  181
CeresClone:25524        -DDFWEGI EL PELMMTGGGW SPEPFVAGDD ATWLVDGDLY QY--------  186
gi|21554403             -DDFWEGI EL PELMMTGGGW SPEPFVAGDD ATWLVDGDLY QY--------  181

Consensus               -DDFWEGI EL PELMMTGGGW SPEPFVAGDD ATWLVDGDLY QY--------  200
```

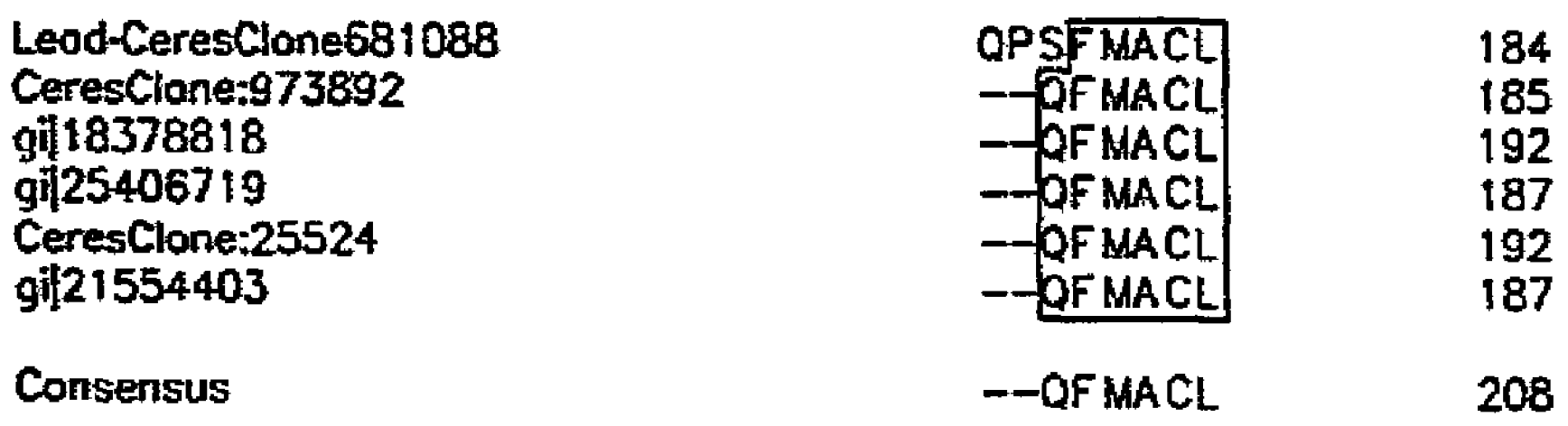

| | | |
|---|---|---|
| Leod-CeresClone681088 | QPSFMACL | 184 |
| CeresClone:973892 | --QFMACL | 185 |
| gi\|18378818 | --QFMACL | 192 |
| gi\|25406719 | --QFMACL | 187 |
| CeresClone:25524 | --QFMACL | 192 |
| gi\|21554403 | --QFMACL | 187 |
| | | |
| Consensus | --QFMACL | 208 |

```
CeresClone:298090        -MQGEY-RSS SEES------ AAAAAAAAMA PLAAAAAAAV KMEAEQAAMA  42
CeresClone:883658        MQQGEY-RSS SSSEGSAGSA AAAAAAAAMA PLAAAAAAVA --AKEEHNVT  47
gi|50929183              -MQGEYHRSS SEDSAASAAA AAAAAAAAMA PLAAAAAAVA --AKEEQAAA  47
CeresClone:1605060       -------NSS TTTIIIIIMG AQHHHNTDCS S--------- ----------  24
gi|56381907              --------ME TATEVATVVS TPAVTVAAVA T--------- ----------  23
gi|16323159              --------ME TATEVATVVS TPAVTVAAVA T--------- ----------  23
Lead-CeresClone681222    ---------- MEGEGRRREG GERETATAAA T--------- ----------  21
CeresClone:594823        ---------- MESEGRREGG ERETTAAT-- ---------- ----------  18

Consensus                --------SS --TE-A---- A-A-TAAAMA T--------- ----------  50

CeresClone:298090        SAAAPQLGSA HQHQHQQMQP RRQYRGVRMR KWGKWVAEIR EPHKRTRIWL  92
CeresClone:883658        VAVAPPMPMA MAMPLQQQQP RKQYRGVRMR KWGKWVAEIR EPHKRTRIWL  97
gi|50929183              AAV------- --LPLQQQQP RRQYRGVRMR KWGKWVAEIR EPHKRTRIWL  88
CeresClone:1605060       ---------- --SRKNQIHN NKPYRGIRMR KWGKWVAEIR EPNKRSRIWL  62
gi|56381907              ---------- --RK-----R DKPYKGIRMR KWGKWVAEIR EPNKRSRIWL  56
gi|16323159              ---------- --RK-----R DKPYKGIRMR KWGKWVAEIR EPNKRSRIWL  56
Lead-CeresClone681222    ---------- --RKVVEGAD QRRYKGIRMR KWGKWVAEIR EPNKRSRIWL  59
CeresClone:594823        ---------- --RKVEG--A ERRYKGIRMR KWGKWVAEIR EPNKRSRIWL  54

Consensus                ---------- --RK-QQ--- --QY-GIRMR KWGKWVAEIR EPNKRSRIWL  100

CeresClone:298090        GSYATAVAAA RAYDTAVFYL RGRSARLNFP DEIPSLA-PS EGEGEGDGGE  141
CeresClone:883658        GSYATPVAAA RAYDTAVFYL RGRSARLNFP DEISALALSS PEAAEAGGGE  147
gi|50929183              GSYATPVAAA RAYDTAVFYL RGRSARLNFP EEISSLA--- -SLSEGGGAS  134
CeresClone:1605060       GSYSSPVAAA RAYDTAVFYL RGPSARLNFP DLV------- --LDDRA---  100
gi|56381907              GSYSTPEAAA RAYDTAVFYL RGPSARLNFP ELLAGVT--- -VTGGGGGGV  102
gi|16323159              GSYSTPEAAA RAYDTAVFYL RSPSARLNFP ELLAGVT--- -VTGGGGGGV  102
Lead-CeresClone681222    GSYSTPVAAA RAYDTAVFYL RGPSARLNFP ELL------- --IGEGAAAL  100
CeresClone:594823        GSYSTPVAAA RAYDTAVFYL RGPSARLNFP ELL------- --VREGPAAL  95

Consensus                GSYSTPVAAA RAYDTAVFYL RGPSARLNFP ELI--L---- --VGEGGGG-  150
```

```
CeresClone:298090        PARDPADGGG TLSAASI RKK AI EVGSRVDA LQTGM---MV PPPHHREROR  188
CeresClone:883658        EPGD---GGG ALSAASI RKK AI EVGSRVDA LQTGMTTMVA APAHHREROR  194
gi|50929183              EPREP--DGG TLSAASI RKK AI EVGSRVDA LQTGM--MVA PTTHHREROK  180
CeresClone:1605060       -------DLC DLSAAYI RKK ATEVGAKVDA LQNQT----- ---------GG  130
gi|56381907              N------GGG DMSAAYI RRK AAEVGAQVDA LEAAG----- -----AGGNR  136
gi|16323159              N------GGG DMSAAYI RRK AAEVGAQVDA LEAAG----- -----AGGNR  136
Lead-CeresClone681222    T------GGC DMSAASI RKK ASEVGARVDA LQAT------ ----------  128
CeresClone:594823        V------AGC DMSAASI RKK ATEVGARVDA LQAT------ ----------  123

Consensus                -------GGG D-SAASI RKK A-EVGARVDA LQA------- ---------R  200

CeresClone:298090        HHHHHHHHLP QLRMHAAAAE AAAVAEHRQE VKQSPQRPAW SGRV-KNPDL  237
CeresClone:883658        LHHHHHHAEP H--------- -----GEELH RHVKQQRTAW NGRA-KNPDL  229
gi|50929183              HHHHHHHHHP HLQPHGE--- -----EQHHH HEQKHQRTAW SGRA-KNPDL  221
CeresClone:1605060       TRHHSP---- ---------- ---------- -------ESY SGRVCLNTDL  149
gi|56381907              HHHHHQHQRG N-HDYVDNHS DYRI NDDLME CSSKEGFKRC NGSL-ERVDL  184
gi|16323159              HHHHHQHQRG N-HDYVDNHS DYRI NDDLME CSSKEGFKRC NGSL-ERVDL  184
Lead-CeresClone681222    LHHHHHHVVP P--------- -----RQLLS ASCGGGSGDF AVRV---VDL  161
CeresClone:594823        LHHHYVP--- ---------- -----PRQLL SGGGGGSGDF PVRV---VDL  152

Consensus                HHHHHHH--P ---------- --------M- ---K-G--AW -GRV-KNVDL  250

CeresClone:298090        NRAPSPESSD AE----  249
CeresClone:883658        NQAPSPDTSD AEAE--  243
gi|50929183              NQAPSPENSD AE----  233
CeresClone:1605060       NEYPLPESSD GN----  161
gi|56381907              NKLPDPETSD DD----  196
gi|16323159              NKLPDPETSD DD----  196
Lead-CeresClone681222    NKMPEPESSD CEWNVN  177
CeresClone:594823        NKMPEPESSD CEWDVN  168

Consensus                NK-P-PESSD -E----  266
```

```
CeresClone:772062       -MEMPCEQPA VKLIG-WLSP YVHRAEVALR LKGVPYDLLH DD--MASKSD  46
CeresClone:381987       MATAGGGAGH LKLLGAWPSP FVNRVRMALH LKGLEYENVE ED--LTNKSD  48
CeresClone:1276499      --MAGGGDDE LKLLGAWASP FVLRVKLALS FKGLSYEDVE ED-LSGGKSE  47
CeresClone:373922       -MGRDGGDGE LKLLGLWASP FVARAKLALQ IKGLSYEYVE ED--LGNKSE  47
CeresClone:1017106      ----MAGDGE LKLLGVWTXP FVIRVRVVLN LKSLPYEYVE EN--LGSKSA  44
CeresClone:986507       ----MAGGND LKVLGVWTSP FVIRVRIVLN LKGLAYEYVE ED--LGNKSA  44
CeresClone:285432       ----MAAGGE LQLLSSWYSP YVIRAKVALG LKGLSYEFIE ED--LFSKSD  44
CeresClone:1061444      ------MEEE LTLVGYWSSP FALRARFALN LKGLPYAYVE EVGLFDGKSP  44
CeresClone:1592057      -----MSEAA VRVIGLWPSP FVIRVLIALK LKHVEYEFVE EV--VGSKSE  43
CeresClone:1558718      -----MSEAA VRVIGLWPSP FVIRVLIALK LKGVEFEFVE EV--VGRKSE  43
Leod-CeresClone11975    ----MGEKQE VKLLGVWYSP YAIRTKIALR LKSVDYDYVE ED-LFGSKSE  45
CeresClone:1103933      ----MSKSED LKLLGGWFSP FALRVQIALN LKGLEYEVVE ET--LNPKSD  44
gi|11096016             -----MASSD VKLIGAWASP FVMRPRIALN LKSVPYEFLQ ET--FGSKSE  43

Consensus               ---------E LKLLG-W-SP FVIRV-IALN LKGL-YEYVE ED--LGSKSE  50

CeresClone:772062       LLLAHNPVHK KVPVLXHXHR SIAESLVIVE YVDEAFP--A GPP-LLPSDP  93
CeresClone:381987       LLLASNPVHK LVPVLLHGDK PISESLVIVE YLDDAFPG-A GQA-VLPADP  96
CeresClone:1276499      LLLESNPVHK KVPVLLHNGK PVCESQIIVQ YIDEAFAG-T GPS-LLPADP  95
CeresClone:373922       LLLSSNPVHK TVPVLIHNGT PVCESTVIVQ YIDDAFAG-T GPS-LLPADP  95
CeresClone:1017106      LXLGSNPVHQ SVPVLLHGGR PVNESQVIVQ YIDEVWAG-A GPS-VLPADP  92
CeresClone:986507       LLLGSNPVHK SVPVLLHAGR AINESQVILQ YIDEVWAG-T GPA-VLPADP  92
CeresClone:285432       LLLELNPVHK KVPVLVHGGR PVCESLVIVQ YVDETWAACT GTP-LLPADA  93
CeresClone:1061444      LLLASNPVHK RVPVLIHNGK PVPESQLIVQ YVEEAFPA-S SPR-FLPPDP  92
CeresClone:1592057      LLLASNPVHK KIPVLLHHGK PLSESLIIVQ YIDEVWSS-G APAALLPADP  92
CeresClone:1558718      LLLRSNPVHK KIPVLLHHGK PISESLIVVQ YIDEVWSS-G APA-FLPVDA  91
Leod-CeresClone11975    LLLKSNPVHK KVPVLLHYNK PIVESLNIVE YIDETWNS-S APS-ILPSHP  93
CeresClone:1103933      LLLKSNPVHK KIPVFFHGDK VICESAIIVE YIDEAWT--N VPS-ILPQNA  91
gi|11096016             LLLKSNPVHK KIPVLLHADK PVSESNIIVE YIDDTWSS-S GPS-ILPSDP  91

Consensus               LLL-SNPVHK KVPVLLH-GK P-SES-VIVQ YIDE-W---- GPS--LPADP 100
```

| | | |
|---|---|---|
| CeresClone:772062 | LARANARFWA RFLDDKCWKA XWV--ALWAE PGXAQXAXAR EAKECLALLE | 141 |
| CeresClone:381987 | YERAVARFWA KYVDGK-LHG MMVK-ALMGA TEEERAIATA DALAAMDTLE | 144 |
| CeresClone:1276499 | HQRAVARFWG AYI DDK-LLA FWLQ-SARAK TQEEKAEALK QALAAAENLE | 143 |
| CeresClone:373922 | YQRALARFWA AYLEDK-I VT PWRR-FFMVK ADEEKAEAMR QTVAAMDALE | 143 |
| CeresClone:1017106 | YERATARFWA AYVDDK-VGS AWTGMLFSCK TEEERAEAVS RAVAALETLE | 141 |
| CeresClone:986507 | YERAVARFWG AYI DDK-VES AWLGMLFRCA NEEERAAAVA RAREALDALE | 141 |
| CeresClone:285432 | HDRATARFWA AYVDDK-FCK EMI K-LYRST TAEKAAEALG GVVPVVETLE | 141 |
| CeresClone:1061444 | HERAVARFWA SYVDGE-LLS AWLP-VYGGR TGEERAEAAG RVGAALETLE | 140 |
| CeresClone:1592057 | YARAVQRFWA QYVDDK-MHP AIR--VLKGT YDGDKEQAAG QLSAALQLLE | 139 |
| CeresClone:1558718 | HARAVQRFWA QYVDDK---L PWAI RLLKGT DDGGMEQAAG QLSAALQLLE | 138 |
| Lead-CeresClone11975 | YDRALARFWS DFVDNK-WFP ALRV-AAI AK SEDAKAKAME EVEEGLLQLE | 141 |
| CeresClone:1103933 | YDRANARFWF AYI DEK-WFT SLRS-VLVAE DDEAKKPHFE QAEEGLERLE | 139 |
| gi\|11096016 | YDRAMARFWA AYI DEK-WFV ALRG-FLKAG GEEEKKAVLA QLEEGNAFLE | 139 |
| Consensus | Y-RAVARFWA AYVDDK-L-S AW-------K -EEEKAEA-- Q--AALE-LE | 150 |

| | | |
|---|---|---|
| CeresClone:772062 | ---AQLPEG- ----KRXFGGD AI GLXDI AAS GLARWLGVFE EMAGVRLLXE | 184 |
| CeresClone:381987 | GAFAECSGG- ----KEFFAGD APGYLDVALG GFI GWLRAWD KVGGVKLLDA | 190 |
| CeresClone:1276499 | AAFTEISEG- ----KPFFGGD SVGYLDVTLG ALVAWVHAAE KLYGMRLFDA | 189 |
| CeresClone:373922 | GGLKECSSGG GGQSPFFGGD SVGYVDVLLG GMVSWVKASE PLSGAKI I DA | 193 |
| CeresClone:1017106 | GAFAECSKG- ----KAFFGGD AI GFVDVVLG GYLGWFGAI D KI I GRRLI DP | 187 |
| CeresClone:986507 | GAFRDCSRG- ----RPFFGGD DI GFVDAVLG GYLGWFGAVG RI I GSRLI DP | 187 |
| CeresClone:285432 | QAFRECSRG- ----KPFFGGD AVGLVDI ALG SFVVWI RVVD EAAGVKLLDE | 187 |
| CeresClone:1061444 | RAFGECSKG- ----KGFFGGD TVGLVDVVLG GFVGWLQTSE AMCGVRLLDA | 186 |
| CeresClone:1592057 | EAFAQLGQG- ----KRYFGGD SVGYLDI ALV SHVGWVKAVE KI AGVTLLDE | 185 |
| CeresClone:1558718 | EAFAQLSQG- ----KRYFGGD SVGYLDI ALV SHVGWVKAVE KI AGVTLLDK | 184 |
| Lead-CeresClone11975 | DAFVSI SKG- ----KPFFGGE VI GFMDI CFG SFVVLLKARE KFKAEKLLDE | 187 |
| CeresClone:1103933 | EVFNKYSEG- ----KAYFGGD SI GFI DI GFG SFLSWMRVI E EMSGRKLLDE | 185 |
| gi\|11096016 | KAFI DCSKG- ----KPFFNGD NI GYLDI ALG CFLAWLRVTE LAVSYKI LDE | 185 |
| Consensus | -AF-ECSKG- ----K-FFGGD S-GY-DI -LG --V-WL-A-E KI -GVKLLDE | 200 |

| | | | | | | | |
|---|---|---|---|---|---|---|---|
| CeresClone:772062 | EEHPALCRWA | RAYXADQTAQ | QCLP-DRDLV | LAV--LTPRR | DMFVSTAKAM | 231 |
| CeresClone:381987 | GRAPRLATWA | ERFAALDVAK | EVI P-DPDHI | AEF--AKVLQ | ARS-----AAA | 233 |
| CeresClone:1276499 | TRTPRLSAFV | ERFGALGAAK | AVLP-DVDGL | VEY--AKQRQ | ADA----AAA | 232 |
| CeresClone:373922 | ARTPLLAAWM | ERFCELDAAK | AVLQ-DVHEV | VEY--ARTVQ | ARVA---AAT | 237 |
| CeresClone:1017106 | ARTPLLARWE | EQFRAADAAK | GVVPDDADKM | LEF--FPPCS | LGS----PPK | 231 |
| CeresClone:986507 | ARTPLLAAWE | DRFRAADVAK | GVVPDDLDKM | LAF--LQTL- | -------RAM | 227 |
| CeresClone:285432 | AKFPALTAWA | ERFLAVDAVR | EVMP-DAGRL | LEH--YKGFL | AKRA---PPS | 231 |
| CeresClone:1061444 | AATPLLAAWA | ERFRALDGVK | EVMP-DAQRL | LEYNLMRRAR | LGLPLTQPPP | 235 |
| CeresClone:1592057 | AKVPNLVAWA | DRLCAHPAVV | DAI P-DADKF | VEF--SVTYG | SFS------- | 225 |
| CeresClone:1558718 | AKVPNLVAWA | DRLCAHPAVV | DAI P-DADKF | VEF--SVTYG | SFSK---PIN | 228 |
| Lead-CeresClone11975 | SKTPSLCKWA | DRFLSDETVK | NVAP-DI EKV | AEF--LQELF | VRA----QSA | 230 |
| CeresClone:1103933 | KKHPGLTQWA | ETFAADPAVK | GI LP-ETDKL | VEF--AKI LQ | LKWTA--AAA | 230 |
| gi\|11096016 | AKTPSLSKWA | ENFCNDPAVK | PVMP-ETAKL | AEF--AKKI - | -------FPK | 224 |
| Consensus | AKTP-L-AWA | ERF-A--AVK | -VLP-D-DKL | -EF--AK--Q | --------A- | 250 |

| | | |
|---|---|---|
| CeresClone:772062 | AAHK | 235 |
| CeresClone:381987 | ATSN | 237 |
| CeresClone:1276499 | ASDS | 236 |
| CeresClone:373922 | ASNQ | 241 |
| CeresClone:1017106 | RSEL | 235 |
| CeresClone:986507 | NYAK | 231 |
| CeresClone:285432 | PACY | 235 |
| CeresClone:1061444 | PQHQ | 239 |
| CeresClone:1592057 | ---- | 225 |
| CeresClone:1558718 | APAK | 232 |
| Lead-CeresClone11975 | ASRS | 234 |
| CeresClone:1103933 | AAAK | 234 |
| gi\|11096016 | PQA- | 227 |
| Consensus | AS-- | 254 |

| | | | | | | |
|---|---|---|---|---|---|---|
| CeresClone:1251169 | ---------- | ---------- | ---------- | ---------- | ------MDRG | 4 |
| CeresClone:32791 | ---------- | ---------- | ---------- | ---------- | ------MGRG | 4 |
| CeresClone:1010174 | ---------- | ---------- | ---------- | ---------- | ------MGRG | 4 |
| gi\|2130078 | ---------- | ---------- | ---------- | ---------- | ------MGRG | 4 |
| gi\|34903684 | ---------- | ---------- | ---------- | ---------- | ------MGRG | 4 |
| Lead-CeresClone228787 | ---------- | ----MLNMMT | DLSCGPSSKA | KGGQPAATTG | SGGDR-QGRG | 35 |
| CeresClone:266080 | ---------- | ----MLNMMT | DLSCGPSSKV | KEQVAAAPTG | SGDRQGQGRG | 36 |
| gi\|2529340 | ---------- | ----MLNMMT | DLSCGPSSKV | KEQVAAAPTG | SGDRQGQGRG | 36 |
| CeresClone:219824 | ---------- | ----MLNMMT | DLSCGPSSKV | KEQVAAAPTG | SGDRQGQGRG | 36 |
| gi\|29372746 | FPADREALPH | HHHPMLNMMT | DLSCGPSSKV | KEQVAAAPTG | SGDRQGQGRG | 50 |
| CeresClone:513630 | ---------- | ---------- | -MSVSPQRK- | ---------- | ------MGRG | 12 |
| CeresClone:1046745 | ---------- | ---------- | ---------- | ---------- | ------MGRG | 4 |
| Consensus | ---------- | ---------- | -LS--P--K- | ---------- | ------MGRG | 50 |

| | | | | | | |
|---|---|---|---|---|---|---|
| CeresClone:1251169 | KIEIKRIENA | NSRQVTFSKR | RAGLLKKAHE | LSVLCDSEVA | VIVFSKSGKL | 54 |
| CeresClone:32791 | KIEIKRIENS | TNRQVTFCKR | RNGLLKKAYE | LSVLCDAEVA | LIVFSTRGRL | 54 |
| CeresClone:1010174 | KIEIKRIENS | TNRQVTFCKR | RNGLLKKAYE | LSVLCDAEVA | LIVFSTRGRL | 54 |
| gi\|2130078 | KIEIKRIENT | TNRQVTFCKR | RNGLLKKAYE | LSVLCDAEVA | LIVFSSRGRL | 54 |
| gi\|34903684 | KIEIKRIENT | TNRQVTFCKR | RNGLLKKAYE | LSVLCDAEVA | LIVFSSRGRL | 54 |
| Lead-CeresClone228787 | KIEIKRIENT | TNRQVTFCKR | RNGLLKKAYE | LSVLCDAEVA | LVVFSSRGRL | 85 |
| CeresClone:266080 | KIEIKRIENT | TNRQVTFCKR | RNGLLKKAYE | LSVLCDAEVA | LVVFSSRGRL | 86 |
| gi\|2529340 | KIEIKRIENT | TNRQVTFCKR | RNGLLKKAYE | LSVLCDAEVA | LVVFSSRGRL | 86 |
| CeresClone:219824 | KIEIKRIENT | TNRQVTFCKR | RNGLLKKAYE | LSVLCDAEVA | LVVFSSRGRL | 86 |
| gi\|29372746 | KIEIKRIENT | TNRQVTFCKR | RNGLLKKAYE | LSVLCDAEVA | LVVFSSRGRL | 100 |
| CeresClone:513630 | KIEIKRIENT | TNRQVTFCKR | RNGLLKKAYE | LSVLCDAEVA | LIVFSSRGRL | 62 |
| CeresClone:1046745 | KIEIKRIENT | TNRQVTFCKR | RNGLLKKAYE | LSVLCDAEVA | LVVFSTRGRL | 54 |
| Consensus | KIEIKRIENT | TNRQVTFCKR | RNGLLKKAYE | LSVLCDAEVA | L-VFSSRGRL | 100 |

```
CeresClone:1251169       FEFSSTGMKR TVLRYE--NY QRSSDAPLIK YKPENQEEDC TEVDFLKNEI  102
CeresClone:32791         YEYANNNIRS TIERYKKACS DSTNTSTVQE INAAYYQQES AK---LRQQI  101
CeresClone:1010174       YEYANNNIRS TIERYKKACS DSTNTSTVQE INAAYYQQES AK---LRQQI  101
gi|2130078               YEYANNSVKS TVERYKKANS DTSNSGTVAE VNAQHYQQES SK---LRQQI  101
gi|34903684              YEYANNSVKS TVERYKKANS DTSNSGTVAE VNAQHYQQES SK---LRQQI  101
Lead-CeresClone228787    YEYANNSVKS TIERYKKANS DTSNSGTVAE VNAQHYQQES SK---LRQAI  132
CeresClone:266080        YEYANNSVKS TIERYKKANS DSSNSGTVAE VNAQYYQQES SK---LRQMI  133
gi|2529340               YEYANNSVKS TIERYKKANS DSSNSGTVAE VNAQYYQQES SK---LRQMI  133
CeresClone:219824        YEYANNSVKS TIERYKKANS DSSNSGTVAE VNAQYYQQES SK---LRQMI  133
gi|29372746              YEYANNSVKS TIERYKKANS DSSNSGTVAE VNAQYYQQES SK---LRQMI  147
CeresClone:513630        YEYANNSVKA TIERYKKASS DSSGAGSASE ANAQFYQQEA DK---LRQQI  109
CeresClone:1046745       YEYANNSVRA TIXRYKKANA AASNAESVSE ANTQFYQQES SX---LRRQI  101

Consensus                YEYANNSVKS TIERYKKANS DSSNSGTVAE VNAQYYQQES SK---LRQQI  150

CeresClone:1251169       SKLQEKH-LQ MQGKGLNALC LKELQHLEQQ LNVSLISVRE RKELLLTKQI  151
CeresClone:32791         QTIQNSN-RN LMGDSLSSLS VKELKQVENR LEKAISRIRS KKHELLLVEI  150
CeresClone:1010174       QTIQNSN-RN LMGDSLSSLS VKELKQVENR LEKAISRIRS KKHELLLVEI  150
gi|2130078               SSLQNANSRT IVGDSINTMS LRDLKQVENR LEKGIAKIRA RKNELLYAEV  151
gi|34903684              SSLQNANSRT IVGDSINTMS LRDLKQVENR LEKGIAKIRA RKNELLYAEV  151
Lead-CeresClone228787    DSLQNAN-RT IVGDSIHTMG LRELKQMEGK LEKAINKIRA RKNELLYAEV  181
CeresClone:266080        HSLQNANTRN IVGDSIHTMG LRDLKQMEGK LEKAIIKIRA RKNELLYAEV  183
gi|2529340               HSLQNANTRN IVGDSIHTMG LRDLKQMEGK LEKAIIKIRA RKNELLYAEV  183
CeresClone:219824        HSLQNANTRN IVGDSIHTMG LRDLKQMEGK LEKAISKIRA RKNELLYAEV  183
gi|29372746              HSLQNANTRN IVGDSIHTMG LRDLKQMEGK LEKAISKIRA RKNELLYAEV  197
CeresClone:513630        SNLQNNN-RQ MMGDSLGSLT AKDLKNLETK LEKGISRIRS KKNELLFAEI  158
CeresClone:1046745       RDIQNLN-RH ILGEALGSLS LKELKNLEGR LEKGLSRVRS RKHETLFADI  150

Consensus                -SLQNANTRN IVGDSI-TMS LRDLKQMEGK LEKAISKIRA RKNELLYAEV  200
```

| | | | | | | |
|---|---|---|---|---|---|---|
| CeresClone:1251169 | EESRLREQRA | ELENETLRRQ | VQE-LRNFLP | SINQNYV-PS | YITCFAIDPK | 199 |
| CeresClone:32791 | ENAQKREIEL | DNENIYLRTK | VAE-VERYQQ | HHHQM---VS | GSEINAIE-- | 194 |
| CeresClone:1010174 | ENAQKREIEL | DNENIYLRTK | VAE-VERYQQ | HHHQM---VS | GSEINAIE-- | 194 |
| gi\|2130078 | EYMQKREVEL | QNDNMYLRSK | VVE-NERGQQ | PLNMMGA-AS | TSEYDHMV-- | 197 |
| gi\|34903684 | EYMQKREVEL | QNDNMYLRSK | VVE-NERGQQ | PLNMMGA-AS | TSEYDHMV-- | 197 |
| Lead-CeresClone228787 | EYMQKREMDL | QTDNMYLRSK | IAENNETGQP | AMNMIGV-PS | TSEYDHMA-- | 228 |
| CeresClone:266080 | DYMQKREMDL | QTDNMYLRSK | IAESNETGQP | AMHMTMGAPP | TSEYDHMA-- | 231 |
| gi\|2529340 | DYMQKREMDL | QTDNMYLRSK | IAESNETGQP | AMHMTMGAPP | TSEYDHMA-- | 231 |
| CeresClone:219824 | DYMQKREMDL | QTDNMYLTSK | IAESNETGQP | AMHMMGVPPP | TSEYDHMA-- | 231 |
| gi\|29372746 | DYMQKREMDL | QTDNMYLTSK | IAESNETGQP | AMHMMGVPPP | TSEYDHMA-- | 245 |
| CeresClone:513630 | EYMQKREIDL | HNNNQLLRAK | IAE-SERNHH | NMAVL---PG | GSNYDSMQSS | 204 |
| CeresClone:1046745 | EFMQKREIEL | QNHNNFLRAK | IAE-NERAQQ | RQQDM---IP | GTECESTIPN | 196 |
| Consensus | EYMQKREMDL | QNDNMYLRSK | IAE-NERGQP | -MHMM---PS· | TSEYDHM--- | 250 |

| | | | | | | |
|---|---|---|---|---|---|---|
| CeresClone:1251169 | NSPV-NNSGL | DDTNYSLQKT | NSDTTLQLGL | PGEAQARRRS | EANRESPSSD | 248 |
| CeresClone:32791 | --AL-ASRNY | ---------- | -----FAHSI | ---------- | --MTAGSGSG | 214 |
| CeresClone:1010174 | --AL-ASRNY | ---------- | -----FAHSI | ---------- | --MTAGSGSG | 214 |
| gi\|2130078 | NNPY-DSRNF | ---------- | -----LQVNI | ---------- | --MQQ-PQ-- | 216 |
| gi\|34903684 | NNPY-DSRNF | ---------- | -----LQVNI | ---------- | --MQQ-PQ-- | 216 |
| Lead-CeresClone228787 | --PFVDSRNF | ---------- | -----LQVNM | ---------- | --QQQ-PQ-- | 246 |
| CeresClone:266080 | --PF-DSRNF | ---------- | -----LQVSM | ---------- | ------PQ-- | 245 |
| gi\|2529340 | --PF-DSRNF | ---------- | -----LQVSM | ---------- | ------PQ-- | 245 |
| CeresClone:219824 | --PF-DSRNF | ---------- | -----LQVSM | ---------- | ------PQ-- | 245 |
| gi\|29372746 | --PF-DSRNF | ---------- | -----LQVSM | ---------- | ------PQ-- | 259 |
| CeresClone:513630 | QQQF-DSRGY | ---------- | -----FQVTG | ---------- | --LQP-NN-- | 223 |
| CeresClone:1046745 | SQSY-D-RNF | ---------- | -----FPVNL | ---------- | --IDSNNN-- | 215 |
| Consensus | --PF-DSRNF | ---------- | -----LQVNM | ---------- | --M---PQ-- | 300 |

```
CeresClone:1251169        SVTTSTTKAT PQRINLV--- ---------- ----   265
CeresClone:32791          NGGSYSDP-D KKILHLG--- ---------- ----   230
CeresClone:1010174        NGGSYSDP-D KKILHLG--- ---------- ----   230
gi|2130078                ---HYAHQLQ PTTLQLGQQP AFN------- ----   236
gi|34903684               ---HYAHQLQ PTTLQLGSRP SISFGVDTVR THVR   247
Lead-CeresClone228787     ---HYSHQLQ PTTLQLG--- ---------- ----   260
CeresClone:266080         ---HYSHQLQ PTTLQLG--- ---------- ----   259
gi|2529340                ---HYSHQLQ PTTLQLG--- ---------- ----   259
CeresClone:219824         ---HYSHQLQ PTTLQLG--- ---------- ----   259
gi|29372746               ---HYSHQLQ PTTLQLG--- ---------- ----   273
CeresClone:513630         ---QYARQ-D QMSLQLV--- ---------- ----   236
CeresClone:1046745        ---QYSRQ-D QTALQLV--- ---------- ----   228

Consensus                 ---HYSHQLQ PTTLQLG--- ---------- ----   334
```

```
Lead-CeresClone537272  ---------- -----MI--- ---GFGG--- -------NS-- ---------CS   10
gi|57116572            ME--GSAGNM NMTSSFKGAN SYLGFGD--- ------NVNG ---------FCP   32
gi|18389212            ME---GGGGS SSNSCMI--- ---GFGE--- ------NTSS NNG-----FCP   28
gi|55276120            MEGGGGDGGS STTSCMM--- ---AFGD--- ------NSNG --------LCP   28
gi|54042995            ME--GGDGGS STTSCMM--- ---AFGD--- ------NSNG --------LCP   26
gi|7446291             MG--GGGSSG NTSSCLM--- ---GYGD--- ------DNNN NNSGNAALCP   33
gi|6016221             ME--GGSSGN TSTSCLM--- -MMGYGDHEN NNNNNGNGNG NGNGNVTICA   44
gi|4098240             ME--GGSSGN TSTSCLM--- -MMGYGDHEN NNNNNGNGNG NGNGNVTICA   44

Consensus              ME--GG-GGS S-TSCMM--- ---GFGD--- ------NSNG N------LCP   50

Lead-CeresClone537272  ELSEMDMTNM ET-------- ---------- -NRKFLSLPL SNNNNSGDNR   41
gi|57116572            MMMMMPANNP NG-------- ---------- DCSQPIFQPL PAANQQGINR   64
gi|18389212            MTMMMMPPPS MA-------- -------SSH PNGNTLFFPL PSTNNSHQGL   63
gi|55276120            MMMMTPLMSS SSSAHHQHPH HHHRANEGDS SISNTLFLPL PPTNNQGHNR   78
gi|54042995            MMMTPLMSSS SA-------H HHHRANEGDS SVSNTLFLPL PPTNNQGHNR   69
gi|7446291             PPMMMPPPPI NNN------N GESSNNIGGN NNNNILFLPF MANN------   71
gi|6016221             PPMMMMMPPP PP-------- SLTNNNNAET SNNNILFLPF MDNNN-----   81
gi|4098240             PPMMMMMPPP PP-------- SLTNNNNAET SSNNILFLPF MDNN------   80

Consensus              MMMMMMMP-- ---------- -----N---- SN-N--LFLPL P-NNN-G-NR  100

Lead-CeresClone537272  RVPV------ ---------- TSNSIAQEHH YSHHHN-PTD ICSVRDKIMA   74
gi|57116572            NSSSAAACGG SMMPEH---- QSNTSI---GY YFMEGDGDAG GGSVKSKIMA  108
gi|18389212            NHRT--SAST MLEDQH---- NNNTITSTGY YFMDGN---D NDSVKAKIMA  104
gi|55276120            IHSNASGSSS MIIDDHNRNH NNNTVTATGC YFMDNN-DGS SSSVKAKIMA  127
gi|54042995            IHSNASGSSS MIIDDHN--- HNNTVTATGC YFMDNN-DGS SSSVKAKIMA  115
gi|7446291             ---------- ---------- NNNPHE---- ---DAN-CSS SSSIKSKIMA   93
gi|6016221             ---------- ---------- NNNPQE---- ---DNN--SS SSSIKSKIMA  102
gi|4098240             ---------- ---------- NNNPQE---- ---DNN--SS SSSIKSKIML  101

Consensus              ---------- -I---H---- NNNT-T--G- YFMDNN--SS SSSVKSKIMA  150
```

| | | | | | | |
|---|---|---|---|---|---|---|
| Lead-CeresClone537272 | HPLFPRLLSS | YLNCLKVGAP | PEVVASLEES | YAKYESFNAS | SGRI GCGSI G | 124 |
| gi\|57116572 | HPHYPRLLAA | YVNCQKI GAP | PEVVAKLEEA | CASTLTI GGR | NE---RSCVG | 155 |
| gi\|18389212 | HPYYHKLLAA | YI NCQKI GAP | PEVAVKLEEA | CASAATMGRN | S----VSRI G | 150 |
| gi\|55276120 | HPHYHRLLAA | YANCQKVGAP | PEVVARLEEA | CASAASIAPA | N----TGCI G | 173 |
| gi\|54042995 | HPHYHRLLAA | YANCQKVGAP | PEVVARLEEA | CASAASMAPA | N----TGCI G | 161 |
| gi\|7446291 | HPHYPRLLSA | YVNCQKI GAP | PEVVARLEEV | CATSATI GRN | S----GGI I G | 139 |
| gi\|6016221 | HPHYHRLLTA | YLNCQKI GAP | PEVVARLEEI | CATSATMGRS | SSSSGGI I G | 152 |
| gi\|4098240 | NPHYHRLLTA | YLNCQKI GAP | PEVVARLEEI | CATSATMGRS | SSSSGGI I G | 151 |
| Consensus | HPHYHRLLAA | YLNCQKI GAP | PEVVARLEEA | CAS-ATMGRS | S----GG-I G | 200 |

| | | | | | | |
|---|---|---|---|---|---|---|
| Lead-CeresClone537272 | EDPALDQFME | AYCEMLLKYE | QELTKPFKEA | MLFFSRI ECQ | LKALAV---- | 170 |
| gi\|57116572 | EDPALDQFME | AYCEMLTKYE | QELSKPFKEA | MLFLSRI ECQ | FKALTL-SHS | 204 |
| gi\|18389212 | EDPALDQFME | AYCEMLSKYE | QELSKPFREA | MLFLSRI ECQ | FKALTL---S | 197 |
| gi\|55276120 | EDPALDQFME | AYCEMLTKYE | QELSKPLKEA | MLFLQRVECQ | FKALTL---S | 220 |
| gi\|54042995 | EDPALDQFME | AYCEMLTKYE | QELSKPLKEA | MLFLQRVECQ | FKALTV---S | 208 |
| gi\|7446291 | EDPALDQFME | AYCEMLTKYE | QELSKPFKEA | MVFLSRI ECQ | FKALTLTSSS | 189 |
| gi\|6016221 | EDPALDQFME | AYCEMLTKYE | QELSKPFKEA | MVFLSRI ECQ | FKALTLAPNS | 202 |
| gi\|4098240 | EDPALDQFME | AYCEMLTKYE | QELSKPFKEA | MVFLSRI ECQ | FKALTLAPNS | 201 |
| Consensus | EDPALDQFME | AYCEMLTKYE | QELSKPFKEA | MLFLSRI ECQ | FKALTL--NS | 250 |

| | | | | | | |
|---|---|---|---|---|---|---|
| Lead-CeresClone537272 | --SSDFGQS- | ---ETSSKNE | VDVHENNLDS | QAEDRELKVQ | LLRKYSGYLG | 214 |
| gi\|57116572 | SDSGACGEAV | LERNGSSEEE | FDVNNSFI DP | QAEDRELKGQ | LLRRYSGYLG | 254 |
| gi\|18389212 | SSDSACGEA- | MDRHGSSEEE | I DVDNSL DP | QAEDRELKGQ | LLRKYSGYLG | 246 |
| gi\|55276120 | SPI SGCGDG- | NDRNVSSEEE | VDVNNNFI DP | QAEDQELKGQ | LLRRYSGYLG | 269 |
| gi\|54042995 | SPI SGCGDG- | NDRNVSSEEE | VDVNNNFI DP | QAEDQELKGQ | LLRRYSGYLG | 257 |
| gi\|7446291 | ESVAALGEA- | I DRNGSSEEE | VDVNNGFI DP | QAEDQELKGQ | LLRKYSGYLG | 238 |
| gi\|6016221 | SHESALGEA- | MDRNGSSDEE | VDVNNSFI DP | QAEDRELKGQ | LLRKYSGYLG | 251 |
| gi\|4098240 | SHESALGEA- | MDRNGSSDEE | VDVNNSFI DP | QAEDRELKGQ | LLRKYSGYLG | 250 |
| Consensus | S--SACGEA- | MDRNGSSEEE | VDVNNNFI DP | QAEDRELKGQ | LLRKYSGYLG | 300 |

| | | | | | | |
|---|---|---|---|---|---|---|
| Lead-CeresClone537272 | SLKKEFLKKK | KNGKLPKEAR | QQLLDWWNRH | YKWPYPSESQ | KQALAESTGL | 264 |
| gi\|57116572 | NLKQEFMKKR | KKGKLPKEAR | QQLLDWWSRH | YKWPYPSESQ | KLALAESTGL | 304 |
| gi\|18389212 | SLKQEFMKKR | KKGKLPKEAR | QQLLDWWSRH | YKWPYPSESQ | KLALAEQTGL | 296 |
| gi\|55276120 | SLKQEFMKKR | KKGKLPKEAR | QQLLDWWSRH | YKWPYPSESQ | KLALAESTGL | 319 |
| gi\|54042995 | SLKQEFMKKR | KKGKLPKEAR | QQLLDWWSRH | YKWPYPSESQ | KLALAESTGL | 307 |
| gi\|7446291 | SLKQEFMKKR | KKGKLPKEAR | QQLLDWWTRH | YKWPYPSESQ | KLALAESTGL | 288 |
| gi\|6016221 | SLKQEFMKKR | KKGKLPKEAR | QQLVDWWLRH | IKWPYPSESQ | KLALAESTGL | 301 |
| gi\|4098240 | SLKQEFMKKR | KKGKLPKEAR | QQLVDWWLRH | IKWPYPSESQ | KLALAESTGL | 300 |
| Consensus | SLKQEFMKKR | KKGKLPKEAR | QQLLDWWSRH | YKWPYPSESQ | KLALAESTGL | 350 |

| | | | | | | |
|---|---|---|---|---|---|---|
| Lead-CeresClone537272 | DMKQI NNWFI | NQRKRHWKPS | EDMQFAVMDA | T---NYYMEN | VMCKPFPMDS | 311 |
| gi\|57116572 | DQKQI NNWFI | NQRKRHWKPS | EDMQFVVMDA | THP-HYYMDN | FMGIPFPMDI | 353 |
| gi\|18389212 | DQKQI NNWFI | NQRKRHWKPS | EDMQFVVMDA | AHPGHYYMDN | VLGNPFAMDI | 346 |
| gi\|55276120 | DQKQI NNWFI | NQRKRHWKPS | EDMQFVVMDA | GHP-HYYMDN | VLGNPFPMDI | 368 |
| gi\|54042995 | DQKQI NNWFI | NQRKRHWKPS | EDMQFVVMDA | GHP-HYYMDN | VLGNPFPMDI | 356 |
| gi\|7446291 | DQKQI NNWFI | NQRKRHWKPS | EDMQFVVMDA | AHP-HYYMDN | VLGNPFPMDI | 337 |
| gi\|6016221 | DQKQI NNWFI | NQRKRHWKPS | EDMQFVVMDA | AHP-HYYMDN | VLANHFPMDM | 350 |
| gi\|4098240 | DQKQI NNWFI | NQRKRHWKPS | EDMQFVVMDA | AHP-HYYMDN | VLANHFPMDM | 349 |
| Consensus | DQKQI NNWFI | NQRKRHWKPS | EDMQFVVMDA | AHP-HYYMDN | VLGNPFPMDI | 400 |

| | | |
|---|---|---|
| Lead-CeresClone537272 | MPMLL | 316 |
| gi\|57116572 | SPSFL | 358 |
| gi\|18389212 | LPTLL | 351 |
| gi\|55276120 | SPTLL | 373 |
| gi\|54042995 | SPTLL | 361 |
| gi\|7446291 | TPTLL | 342 |
| gi\|6016221 | TPSLL | 355 |
| gi\|4098240 | TPSLL | 354 |
| Consensus | -PTLL | 405 |

```
CeresClone:1603612        MP-------- ---------- ---------PG HSPCASCKLL RRRCAKDCIF   24
CeresClone:592749         MKGYEP---- ---------- ---------RS SSSCAACKFL KRRCLPNCIF   28
Lead-CeresClone156807     MASS------ ---------- ---------ST NSPCAACKFL RRKCQPECVF   26
CeresClone:281759         MASSVPAPSG SVITVASSSS SAAAAAVCGT GSPCAACKFL RRKCQPDCVF   50

Consensus                 MASS-P---- ---------- ---------T -SPCAACKFL RR-CQPDC-F   50

CeresClone:1603612        APYFPSNDPH KFAIVHKVFG ASNVSKMLQE LEVHQRGDAV SSLVYEANAR   74
CeresClone:592749         APYFRSDECK KFAKVHKVFG ASNVSKILVE VPEEDREDTV NSLAYEAEAR   78
Lead-CeresClone156807     APYFPPDQPQ KFANVHKVFG ASNVTKLLNE LHPSQREDAV NSLAYEADMR   76
CeresClone:281759         APYFPPDNPQ KFVHVHRVFG ASNVTKLLNE LHPFQREDAV NSLAYEADMR  100

Consensus                 APYFP-D-PQ KFA-VHKVFG ASNV-KLLNE LHP-QREDAV NSLAYEAD-R  100

CeresClone:1603612        MRDPVYGCVG AISYLQKEVS QLQKQLAMAQ AEILCIQMQQ EPLGPAPTLA  124
CeresClone:592749         LRDPVYGCIG AIALLQRKMV ELQHDLAIAK DRLARYTAAA TTATAFTTTS  128
Lead-CeresClone156807     LRDPVYGCVG VISLLQHQLR QLQIDLSCAK SELSKYQSLG ILAATHQSLG  126
CeresClone:281759         LRDPVYGCVG VISILQHNLR QLQQDLARAK YELSKYQAAA AASASTAPTG  150

Consensus                 LRDPVYGCVG -ISLLQ--LR QLQ-DLA-AK -ELSKYQAAA --AA-T-T--  150

CeresClone:1603612        ASVIN----- ---------- ---------- --SLVPXXPT RTSXVTDDVI  147
CeresClone:592749         DALIN----- ---------- ---------- -GHVSLPPF PDFFTCADNF  151
Lead-CeresClone156807     INLLA----- -----GAAD- --GTATAVRD HYHHHQFFPR EQMFGGLDVP  163
CeresClone:281759         PQAMAEFIGN AMPNGAHNFI NIGHSAALGS LGGSASVFGQ EQ-FGNAQML  199

Consensus                 --LI------ -----GA---- --G---A--- --GHVS-FP- EQ-FG-ADV-  200

CeresClone:1603612        FRGSSDD--- ---------- --VSYPCLHN TTNHHHHNDQ HFNFNF----  178
CeresClone:592749         NNDNF----- ---------- --CHTSSSQS SFTRHETVDD FIQIPYI---  181
Lead-CeresClone156807     AGNNYDGG-- --ILAI-GQI TQFQQPRAAA GDDGRRTVDP LEILGFWWCS  208
CeresClone:281759         S-RSYDGGEP IARLGLNGGG YEFGYSTAMG GSGAVSGLGT LGLSPFLKSG  248

Consensus                 ----YDGG-- ---L-I-G-- --F-Y--A-- ----H-TVD- L-I-PF----  250
```

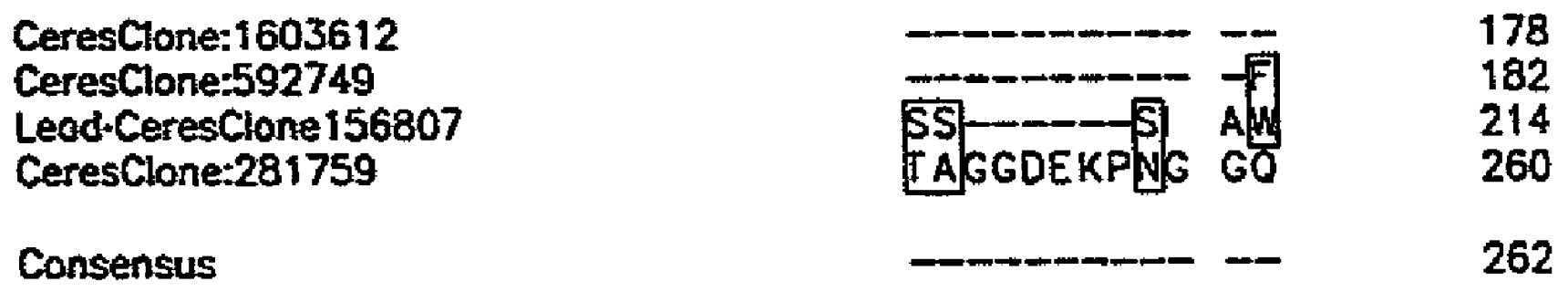

| | | |
|---|---|---|
| CeresClone:1603612 | ---------- -- | 178 |
| CeresClone:592749 | ---------- -F | 182 |
| Lead-CeresClone156807 | SS------SI AW | 214 |
| CeresClone:281759 | TAGGDEKPNG GQ | 260 |
| Consensus | ---------- -- | 262 |

```
CeresClone:654289      MLCRKSSKN- -DVGSGSVPV HLNVYDLTPI NGYAYWFGLG VYHSGVQVHG   48
CeresClone:626552      MLCRRSSKN- -GVGSGSVPV HLNVYDLTPI NGYAYWFGLG VYHSGVQVHD   48
CeresClone:963952      ----MVVVNG RKKKPGLVPV YLNVYDLTPI NGYAYWLGLG VYHSGVEVHG   46
gi|62319459            MLCRMVVVTG RKKKPGSVPV YLNVYDLTPI NGYAYWLGLG IYHSGVEVHG   50
Lead-CeresClone14105   MLCFKGSVK- RKKQSGSVPV YLNVYDLTPM NAYGYWLGLG VFHSGVEVHG   49
gi|20259079            MFCRNVSVR- RKKNSGTVPV YLNVYDLTPM NVYGYWLGIG IYHSGLEVHG   49

Consensus              MLCRKVSVN- RKKKSGSVPV YLNVYDLTPI NGYAYWLGLG VYHSGVEVHG   50

CeresClone:654289      VEFAFGAHEY SLTGIFEGEP KRCEGFAFRK TILIGKTDMR PGEVKAVMEE   98
CeresClone:626552      VEFAFGAHEY PSTGIFEGEP KRCEGFAFRK TILIGKTDMG PCEVRAVMEE   98
CeresClone:963952      VEYGFGAHEH STTGIFEVGP KQCPGFTFRK SILIGRTELD PQQVCAFLEK   96
gi|62319459            VEYGFGAHDH STTGIFEVEP KQCPGFTFRK SILIGRTDLD PENVRVFMEK  100
Lead-CeresClone14105   VEYAFGAHES SSTGIFEVEP KKCPGFTFRK SILVGKTDLV AKEVRVFMEK   99
gi|20259079            VEYGYGAHEK SSSGIFEVEP KKCPGFTFRK SILVGETEMK AKEVRSFMEK   99

Consensus              VEY-FGAHE- SSTGIFEVEP K-CPGFTFRK SILIGKTD-- PKEVRAFMEK  100

CeresClone:654289      LAAKYRGNAY NLITKNCNHF CNDACLRLTG NPIPSWVNRL ARIGFMCNCV  148
CeresClone:626552      LAAEYRGNAY NLITKNCNHF CNDACLRLTG NPIPSWVNRL ARIGFMCNCV  148
CeresClone:963952      LAEGYCGNTY HLITKNCNHF CNDVCVRLTR RSIPSWVNRL ARFGLFCNCV  146
gi|62319459            LAEEYSGNSY HLITKNCNHF CNDVCVQLTR RSIPSWVNRL ARFGLFCNCV  150
Lead-CeresClone14105   LAEEYQGNKY HLITRNCNHF CNEVCLKLAQ KSIPRWVNRL ARLGVLCNCV  149
gi|20259079            LSEEYQGNKY HLITRNCNHF CNHVSLKLTH KSIPSWVNRL ARLGFLCNCV  149

Consensus              LAEEY-GN-Y HLITKNCNHF CNDVCLRLTR -SIPSWVNRL AR-G--CNCV  150

CeresClone:654289      LPVTLNSTKV RHHK------ MEEKQCEGEK QALATKAKKL SASNSSSSSP  192
CeresClone:626552      LPVTLNSTKV RHHK------ LEDKQCEEEK QALASEPKKL NS--SNSSSP  190
CeresClone:963952      LPAELNETKV RQVRS----- KEEKIPEVKK --LRSRSSRF PP-SSSLSSS  188
gi|62319459            LPAELNETKV RQVRS----- KEEKIPEVEK KKLRSRSSRF PP-GPSLSSS  194
Lead-CeresClone14105   LPPRLNEAKV RRVG------ -KGELSESEK KKLRNR-SRS DPLLSSSPSS  191
gi|20259079            LPACLNETKV KRVGKDGKLL LEGENTKKKK RKKKIRRSRS GP-LSSSSSN  198

Consensus              LPA-LNETKV R-V------- -EEKI-E-EK -KLRSRSSR- -P--SSSSSS  200
```

```
CeresClone:654289        EGLRRGRSRN R---------- ---------- -RALPP---- -----SSPLI   213
CeresClone:626552        KGLRRGRSRT R---------- ---------- -RALPP---- -----SSPLI   211
CeresClone:963952        GSLNRNRRGE R---------- ----------R RQRLPP---- -----TPPVS   211
gi|62319459              GSLNRSRRGE R---------- ----------R RQCLPP---- -----SPTVS   217
Lead-CeresClone14105     STPDNHRSHI RAKSSGNHPS SSSSSSSGSK KNRRPK---- AQDQKSPSVS   237
gi|20259079              ARLDNTPTHN RSI STGNPPL SASPSC--PL RPRLPSVASG AEDQNPPSVS   246

Consensus                -SL-R-RS-- R---------- ----------R R-RLPP---- -----SP-VS   250

CeresClone:654289        IGSSSS   219
CeresClone:626552        IGSSSS   217
CeresClone:963952        A-----   212
gi|62319459              V-----   218
Lead-CeresClone14105     IKT---   240
gi|20259079              VKT---   249

Consensus                I-----   256
```

```
CeresClone:455104          MADD------ -GGSHE---- ---GSGXGGG VREQDRFLPI ANI SRI MKKA   36
gi|30409461                GRWSATRPGG GGG------- -------GGG VREQDRFLPI ANI SRI MKKA   37
CeresClone:1561235         MADAPASPGG GGGSHESGSP RGGGGGGGGS VREQDRFLPI ANI SRI MKKA   50
CeresClone:1559765         MAEAPASPGG GGGSHESGSP RGGG--GGGS VREQDRFLPI ANI SRI MKKA   48
Lead-CeresClone608818      MADGPASP-- GGGSHESG-- --EHSPRS-N VREQDRYLPI ANI SRI MKKA   43
gi|4371295                 MAESQAKSPG GGGSHESG-- -GDQSPRSLH VREQDRFLPI ANI SRI MKRG   47
gi|20147111                MAESQAKSPG GGGSHESG-- -GDQSPRSLH VREQDRFLPI ANI SRI MKRG   47

Consensus                  MA-S-A-P-G GGGSHESG-- -G--S--GG- VREQDRFLPI ANI SRI MKKA   50

CeresClone:455104          VPANGKI AKD AKETLQECVS EFI SFVTSEA SDKCQKEKRK TI NGDDLLWA   86
gi|30409461                I PANGKI AKD AKETVQECVS EFI SFI TSEA SDKCQREKRK TI NGDDLLWA   87
CeresClone:1561235         I PANGKI AKD AKETVQECVS EFI SFI TSEA SDKCQREKRK TI NGDDLLWA   100
CeresClone:1559765         I PANGKI AKD AKETVQECVS EFI SFI TSEA SDKCQREKRK TI NGDDLLWA   98
Lead-CeresClone608818      LPANGKI AKD AKETVQECVS EFI SFI TSEA SDKCQREKRK TI NGDDLLWA   93
gi|4371295                 LPANGKI AKD AKEIVQECVS EFI SFVTSEA SDKCQREKRK TI NGDDLLWA   97
gi|20147111                LPANGKI AKD AKEIVQECVS EFI SFVTSEA SDKCQREKRK TI NGDDLLWA   97

Consensus                  -PANGKI AKD AKETVQECVS EFI SFI TSEA SDKCQREKRK TI NGDDLLWA   100

CeresClone:455104          MATLGFEEYV EPLKI YLQKY KEMEGDSKLS TKAGEGSVKK DAI SPHGGTS   136
gi|30409461                MATLGFEDYI EPLKVYLQKY REMEGDSKLT AKAGDGSVKK DVLCSHCGSS   137
CeresClone:1561235         MATLGFEDYI EPLKVYLQKY REMEGDSKLT AKSSDGSI KK DALGHVGASS   150
CeresClone:1559765         MATLGFEDYI EPLKVYLQKY REMEGDSKLT AKSSDGSI KK DALGHVGASS   148
Lead-CeresClone608818      MATLGFEDYI DPLKI YLTRY REMEGDTKGS AKGGDSSSKK DVQPSPNA--   141
gi|4371295                 MATLGFEDYM EPLKVYLMRY R--EGDTKGS AKGGDPNAKK DGQSSQNGQF   145
gi|20147111                MATLGFEDYM EPLKVYLMRY REMEGDTKGS AKGGDPNAKK DGQSSQNGQF   147

Consensus                  MATLGFEDYI EPLKVYLQKY REMEGDSKLS AK-GDGS-KK D-L-S-GGSS   150

CeresClone:455104          SSSNQLVQHG VYNQGMGYM- QPQYH----- NGET--   164
gi|30409461                SSAQGMGQQA AYNQGMGYM- QPQYH----- NGDVSN   167
CeresClone:1561235         SAAQGMGQQG AYNQGMGYM- QPQYH----- NGDI KK   180
CeresClone:1559765         S----AAQGG AYNQGMGYM- QPQYH----- NGDI SN   174
Lead-CeresClone608818      -----QLAHQG SFSQGVSYFI SQGQHMMVPM QGPE--   171
gi|4371295                 S---QLAHQG PYGNSQVTFP LFSSHSSNTH HSLLI C   178
gi|20147111                S---QLAHQG PYGNS------ QAQQHMMVPM PGTD--   173

Consensus                  S---QLAQQG AYNQGMGYM- QPQYH----- NGDV--   186
```

```
CeresClone:467502        MGRGRVELKR IENKINRQVT FAKRRNGLLK KAYELSVLCD AEVALIIFSN   50
Lead-CeresClone5055      MGRGRVELKR IENKINRQVT FAKRRNGLLK KAYELSVLCD AEVALIIFSN   50
gi|1617211               MGRGRVELKR IENKINRQVT FAKRRNGLLK KAYELSVLCD AEVALIIFSN   50
gi|20385588              MGRGRVELKR IENKINRQVT FAKRRNGLLK KAYELSVLCD AEVALIIFSN   50
CeresClone:511680        MGRGRVELKR IENKINRQVT FAKRRNGLLK KAYELSVLCD AEVALIIFSN   50
CeresClone:226181        MGRGRVELKR IENKINRQVT FAKRRNGLLK KAYELSVLCD AEVALIIFSN   50
CeresClone:227805        MGRGRVELKR IENKINRQVT FAKRRNGLLK KAYELSVLCD AEVALIIFSN   50
CeresClone:246416        MGRGPVQLRR IENKINRQVT FSKRRNGLLK KAHEISVLCD AEVALIVFST   50
CeresClone:1314092       MGRGKVQLKR IENKINRQVT FSKRRSGLLK KAHEISVLCD AEVGLIIFST   50

Consensus                MGRGRVELKR IENKINRQVT FAKRRNGLLK KAYELSVLCD AEVALIIFSN   50

CeresClone:467502        RGKLYEFCSS SSMLKTLERY QKCSYGAVEV SKPAKEL--- EQSSYREYLK   97
Lead-CeresClone5055      RGKLYEFCSS SSMLRTLERY QKCNYGAPEP NVPSREALA- ELSSQQEYLK   99
gi|1617211               RGKLYEFCSS SSMIRTLERY QKCNYGPPEP NVPSREALAV ELSSQQEYLK  100
gi|20385588              RGKLYEFCSS SSMLKTLERY QKCNYGAPET NVSTREAL-- ELSSQQEYLK   98
CeresClone:511680        RGKLYEFCSS SSMLKTLERY QKCNYGAPEA NVSTREAL-- ELISQQEYLK   98
CeresClone:226181        RGKLYEFCSG QSITKTLERY EKNSYGGPDT AVQNKENEL- VQSSRNEYLK   99
CeresClone:227805        RGKLYEFSST QSMPKTLEKY QKCSFAGPET ALQNRENEQ- LKSSRNEYLK   99
CeresClone:246416        KGKLYEYSSH SSMEGILERY QRYSFEERAV LNPSIED--- QANWGDEYVR   97
CeresClone:1314092       KGKLYEFSTE SCMDKILERY ERYSYAEKVL VSSESEI--- QGNWCHEYRK   97

Consensus                RGKLYEFCSS SSMLKTLERY QKCNYG-PE- -V-SRE---- E-SSQQEYLK  100

CeresClone:467502        LKARFESLQR TQRNLLGEDL GPLNIKELEH LERQLDSSLK QVRSTKTQFM  147
Lead-CeresClone5055      LKERYDALQR TQRNLLGEDL GPLSTKELES LERQLDSSLK QIRALRTQFM  149
gi|1617211               LKERYDALQR TQRNLLGEDL GPLSTKELEL LERQLDSSLK QIRALRTQFM  150
gi|20385588              LKARYEALQL SQRNLLGEDL GPLSTKELES LERQLDVSLK QIRSTRTQYM  148
CeresClone:511680        LKARYEALQR SQRNLMGEDL GPLSSKELES LERQLDSSLK QIRSTRTQFM  148
CeresClone:226181        LKARVDNLQR TQRNLLGEDL GSLGVKELEQ LEKQLDSSLR HIRSTRTQHM  149
CeresClone:227805        LKARVDNLQR TQRNLLGEDL ESLGIKELEH LEKQLDSSLK HIRSTRTQHM  149
CeresClone:246416        LKSKLDALQK SQRQLLGEQL SSLTIKELQQ LEQQLDSSLK HIRSRKNQLM  147
CeresClone:1314092       LKAKVETIQK CQKHLMGEDL ESLNLKELQQ LEQQLESSLK HIRSRKNQLM  147

Consensus                LKARYDALQR TQRNLLGEDL GPLSIKELE- LERQLDSSLK QIRSTRTQ-M  150
```

```
CeresClone:467502      LDQLSDLQTK --MLVEANRS LTVKL---EE NSRNHYRQSW EAGDQSMPYG 193
Lead-CeresClone5055    LDQLNDLQSK ERMLTETNKT LRLRL---AD GYQ--MPLQL NPNQEEVD-H 193
gi|1617211             LDQLNDLQSK ERMLNETNKT LRLRL---AD GYQ--MPLQL NPNQEDHHVD 195
gi|20385588            LDQLTDLQRK EHMLNEANKT LKQRL---LE GTQ-VNQLQW NPNAQDV--G 192
CeresClone:511680      LDQLSDLQRK EHLLSEANRS LRQRQ---LE GYQ-INPLQL NPGVEEM--G 192
CeresClone:226181      LDQLTDLQRR EQMLCEANKC LRRKL----EE TSNQVHGQVW EHGANLL--G 194
CeresClone:227805      VDQLTELQKK EQMFCEANKC LRRRL----EE SNQVIWQHAW EQS------- 189
CeresClone:246416      FDSI SALQKK EKALTDQNGV LQKFMEAEKE KNKALMNAQL REQQN----- 192
CeresClone:1314092     HESI SELQKK ERSLQEENKV LQKEL-VEKQ KAQAAQQDQT QP-------- 188

Consensus              LDQLSDLQ-K ERML-EANKT LR-RL---EE --Q-----Q- -P--E----- 200

CeresClone:467502      GGGPENS--- HSHSHSQGFF ---QPLE--C NPTLHI GPDY RYNAVASDQI 235
Lead-CeresClone5055    YGRHHH---- QQQQHSQAFF ---QPLE--C EPI LQI GYQG QQDG-MGAGP 233
gi|1617211             YGRHDQQ--- QQQNSHHAFF ---QPLE--C EPI LQMGYQG QQDHGMEAGP 237
gi|20385588            YGRQ------ QAQPQGDGFF ---HPLE--C EPTLQI GYQP DPI TVAAAGP 231
CeresClone:511680      YGRH------ PAQTHGEALF ---QQME--C EPTLQI GYQP DPVSVVTAGP 231
CeresClone:226181      YERHSPQQQA PSHVGNGLFF ---HPLEAAA EPTLQI GFAP EHM------- 234
CeresClone:227805      -ERHXEVQ-- PQQLNGNNFF ---HPLDGAG EPTLQI GYPS EALTSSCM-- 231
CeresClone:246416      ---------- GASTSSPSLS ---PPI VPDS MPTLNI GPCQ HRGAAESESE 229
CeresClone:1314092     ---------- QTSSSSSSFM MRDAPPA--A ATSI HPAAAG ERAGDAAVQP 226

Consensus              YGRH------ --Q-----FF ----PLE--C EPTLQI GY-- E--------P 250

CeresClone:467502      TATTQPQQVS GFI PGWML-- ----     253
Lead-CeresClone5055    SV-------N NYMLGWLPYD TNSI     250
gi|1617211             SE-------N NYMLGWLPYD TNSI     254
gi|20385588            SV-------N NYMPGWLP-- ----     242
CeresClone:511680      SM-------S NYMAGWLP-- ----     242
CeresClone:226181      ---------N NFMPTWLP-- ----     243
CeresClone:227805      ---------T TFLPPWLP-- ----     240
CeresClone:246416      PSPAPAQANR GNLPPWMLRT VK--     251
CeresClone:1314092     QAPP-----R TGLPLWMVSH ING-     244

Consensus              S--------- NYMPGWLP-- ----     274
```

```
gi|33309864            MGRGRVQLRR IENKINRQVT FSKRRSGLLK KAHEISVLCD AEVALIIFST  50
gi|39843112            MGRGKVQLKR IENKINRQVT FSKRRSGLLK KAHEISVLCD AEVGLIIFST  50
gi|39843110            MGRGKVQLKR IENKINRQVT FSKRRSGLLK KAHEISVLCD AEVGLIIFST  50
gi|7592642             MGRGKVQLKR IENKINRQVT FSKRRSGLLK KANEISVLCD AEVALIIFST  50
gi|6606070             MGRGKVQLKR IENKINRQVT FSKRRSKLLK KANEISVLCD AEVALIIFST  50
CeresClone:1314092     MGRGKVQLKR IENKINRQVT FSKRRSGLLK KAHEISVLCD AEVGLIIFST  50
gi|4204232             MGRGKVQLKR IENKINRQVT FSKRRSGLLK KAHEISVLCD AEVGLIIFST  50
gi|24967140            MARGKVQMKR IENPVHRQVT FCKRRAGLLK KAKELSVLCD AEVGLEIFSA  50
gi|16549066            MARGKIQMKR IENSVHRQVT FCKRRAGLLK KARXXSVLCD VDIGLMIFST  50
Lead-CeresClone331626  MARGKVQLRR VENPVHRQVT FCKRRAGLLK KARELSVLCD ASVGIIVFSA  50
gi|50940449            MARGKVQLRR IENPVHRQVT FCKRRAGLLK KARELSILCE ADIGIIIFSA  50
gi|5230654             ---------- -ENSTNRQVT FCKRRAGLLK KARELSILCE ADIGIIIFSA  39
gi|21586457            MARGKVQLRR IENPVHRQVT FCKRRAGLLK KARELSILCE ADIGIIIFSA  50

Consensus              MGRGKVQLKR IENKINRQVT FSKRRSGLLK KAHEISVLCD AEVGLIIFST  50

gi|33309864            KGKLYEYATD SCMERILERY ERYTYAEKAL ISSGPELQGN WCHEFGKLKA  100
gi|39843112            KGKLYEYATD SCMDKILERY ERYSYAEKVL ISAESETQGN WCHEYRKLKA  100
gi|39843110            KGKLYEYATD SCMDKILERY ERYSYAEKVL ISAESETQGN WCHEYRKLKA  100
gi|7592642             KGKLYEYATD SCMDKILERY ERYSYAEKVL ISAESDTQGN WCHEYRKLKA  100
gi|6606070             KGKLYEYATD SCMDKILERY ERYSYAEKVL ISAESDTQGN WCHEYRKLKA  100
CeresClone:1314092     KGKLYEFSTE SCMDKILERY ERYSYAEKVL VSSESEIQGN WCHEYRKLKA  100
gi|4204232             KGKLYEFATD SCMDKILERY ERYSYAEKVL ISTESEIQGN WCHEYRKLKA  100
gi|24967140            HGKLYELATK GSMQGLIERY IKSTKGVEVA EEAKDTQPLD PKEEINMLKN  100
gi|16549066            HGKLYELATK GTMEGLIERY LGTSRGAQ-I EGGPAXXPPE SDQEVFMLKQ  99
Lead-CeresClone331626  HGKLYDLATT GTMEELIERY KAASAGEATT DGCGRHNRMD PKHETTVLQQ  100
gi|50940449            HGKLYDLATT GTMEELIERY KSASGEQA-- -NACGDQRMD PKQEAMVLKQ  97
gi|5230654             HGKLYDLATT GTMEELIERY KSASGEQA-- -NACGDQRMD PKQEAMVLKQ  86
gi|21586457            HGKLYDLATT GTMEELIERY KSASGEQA-- -NACGDQRMD PKQEAMVLKQ  97

Consensus              KGKLYEYAT- SCM-KILERY ERYSYAEKVL ISAES--QGN WCHEY-KLKA  100
```

```
gi|33309864             KVEALQKSQR HLMGEQL-EP LNLKELQQLE QQLESSLKHI RTRKCQLMFE   149
gi|39843112             KVETIQKCQK HLMGEDP-ES LNLKELQQLE QQLESSVKHI RSRKSQLMLE   149
gi|39843110             KVETIQKCQK HLMGEDL-ES LNLKELQQLE QQLESSVKHI RSRKSQLMLE   149
gi|7592642              KVETIQKCQK HLMGEDL-ES LNLKELQQLE QQLENSLKHI RSRKSQLMLE   149
gi|6606070              KVETIQKCQK HLMGEDL-ES LNLKELQQLE QQLENSLKHI RSRKSQLMLE   149
CeresClone:1314092      KVETIQKCQK HLMGEDL-ES LNLKELQQLE QQLESSLKHI RSRKNQLMHE   149
gi|4204232              KVETIQRCQK HLMGEDL-ES LNLKELQQLE QQLESSLKHI RSRKSQLMHE   149
gi|24967140             EIDVLQKGLS YMYGGGA-GT MTLDELHSLE KYLEIWMYHI RSAKMDIMFQ   149
gi|16549066             EIELLQKGLR NSIGGGM-GN MTMDELHALE RHLELWIYHI RSTKMRIMIQ   148
Lead-CeresClone331626   EINLLQKGLR YIYGNRANEH MNVDELNALE RYLEIWMYNI RSAKMQIMAQ   150
gi|50940449             EINLLQKGLR YIYGNRANEH MTVEELNALE RYLEIWMYNI RSAKMQIMIQ   147
gi|5230654              EINLLQKGLR YIYGNRANEH MTVEELNALE RYLEIWMYNI RSAKMQIMIQ   136
gi|21586457             EINLLQKGLR YIYGNRANEH MTVEELNALE RYLEIWMYNI RSAKMQIMIQ   147

Consensus               KVE-LQK-Q- HLMGE-L-E- MNLKELQQLE QQLESS-KHI RSRK-QLM-E   150

gi|33309864             SISELQKKEK SLQEQNKMLE KELMEKQKVK ALNQQAPWEQ QGPPQTSSSS   199
gi|39843112             SISELQKKEK SLQEENKVLQ KELVEKQQVH --KRLVQWDQ TQPQTSSSSS   197
gi|39843110             SISELQKKEK SLQEENKVLQ KELVEKQQVH --KRLVQWDQ TQPQTSSSSS   197
gi|7592642              SINELQRKEK SLQEENKVLQ KELVEKQKVQ --KQQLQWDQ TQPQTISSSS   197
gi|6606070              SINELQRKEK SLQEENKVLQ KELVEKQKVQ --KQQVQWDQ TQPQTISSSS   197
CeresClone:1314092      SISELQKKER SLQEENKVLQ KELVEKQKA- ---QAAQQDQ TQPQTSSSSS   195
gi|4204232              SISELQKKER SLQEENKILQ KELIEKQKAH --TQQAQLEQ TQPQTSSSSS   197
gi|24967140             EIQLLKNKGG ILEAANKYLQ DKIDEQYTVI ---------- ----------   179
gi|16549066             EIQSLKDNEG ILKSANEFLQ GKIEEQNVIF -----DM--- ----------   180
Lead-CeresClone331626   EIQALKSKEG MLKAANEILQ EKIVEQSSLL ----DVGMVV ADQQNGRFST   196
gi|50940449             EIQALKSKEG MLKAANEILQ EKIVEQNGLI ----DVGMMV ADQQNGHFST   193
gi|5230654              EIQALKSKEG MLKAANEILQ EKIVEQNGLI ----DVGMMV ADQQNGHFST   182
gi|21586457             EIQALKSKEG MLKAANEILQ EKIVEQNGLI ----DVGMMV ADQQNGHFST   193

Consensus               SISELQKKEK SLQEENK-LQ KELVEKQKV- ---Q-V--DQ --PQ--SSSS   200
```

```
gi|33309864              PTSFLIGDSL PTLNIGTYQC SGNEHGEE-- AAQPQ--VRI GNSLLPPWML   245
gi|39843112              --SFMMREAL PTTNISIYAA AAGERAED-A AGQPQ--IHI G---LPPWMV   239
gi|39843110              --SFMMREAL PTTNISIYAA AAGERAED-A AGQPQ--IHI G---LPPWMV   239
gi|7592642               --SFMMREAL PTTNISNYPA AAGERIEDVP AGQPQ-HVRI G---LPPWML   241
gi|6606070               --SFMMREAL PTTNISNYPA AAGERIEDVA AGQPQ-HERI G---LPPWML   241
CeresClone:1314092       --SFMMRDAP PAAATSIHPA AAGERAGD-A AVQPQAPPRT G---LPLWMV   239
gi|4204232               --SFMMGEAT PATNRSNPPA AASDRAED-A TGQP--PART V---LPPWMV   239
gi|24967140              --NM------ -TQNLTDFQC PLTVQNE--- ---------- ---------I   198
gi|16549066              --PPMIGGI- -PYPLTIPNE IFLEELNY-- ---------- ----------   204
Lead-CeresClone331626    --VPLVEEVI SSNPLTILSG YSSCRGSE-- ---------- ---------M   223
gi|50940449              --VPLLEEI- -TNPLTILSG YSTCRGSE-- ---------- ---------M   218
gi|5230654               --VPLLEEI- -TNPLTILSG YSTCRGSE-- ---------- ----NGLFLL   212
gi|21586457              --VPLLEEI- -TNPLTILSG YSTCRGSE-- ---------- ----NGLFLL   223

Consensus                --SFMM-EA- PT-NL-IYS- AA-ER-ED-- --QP------ -----LP-WML 250

gi|33309864              SHL-NG   250
gi|39843112              SHI-NG   244
gi|39843110              SHI-NG   244
gi|7592642               SHI-NG   246
gi|6606070               SHI-NG   246
CeresClone:1314092       SHI-NG   244
gi|4204232               SHLNNG   245
gi|24967140              FQF---   201
gi|16549066              ------   204
Lead-CeresClone331626    GYS-FC   228
gi|50940449              GYS-F-   222
gi|5230654               T-----   213
gi|21586457              T-----   224

Consensus                SHI-NG   256
```

```
CeresClone:298125       ---MAI VGG- -GGSWSI HGR ADVTSRYEVL GRAGSGSYAD VYRGRRRSDG   45
gi|54291188             ---MAI GGGG GGGSWSI HGR PDVTSRYEVL GRAGSGAYAD VYRGRRRSDG   47
Lead-CeresClone35742    MDKQP----- -ATSWSI HTR PEI I AKYEI F ERVGSGAYAD VYRARRLSDG   44
gi|6984233              MEQLPPSPPP HAKSWSI HTR PEI I AKYEI Q ERVGSGAYSD VYKARRLSDN   50

Consensus               M--M-I -GG- --GSWSI H-R P------YE-L -R-GSGAYAD VYR-RR-SDG   50

CeresClone:298125       AAVALKEVHD AVSARSEVEA LLAI PPSPNV VALI DHFPGG DCDDDVLVLE   95
gi|54291188             APVALKEVHD AVSARREADA LLAAAPSRHV VALLDHFPGG DHDDDVLVLE   97
Lead-CeresClone35742    LI VALKEI FD YQSAFREI DA LTI LNGSPNV VVMHEYFWRE E-ENAVLVLE   93
gi|6984233              LI VALKEI HD YQSAFREI EA LHI VQNCPNI VVLHEYFWRE D-EDAVLVLE   99

Consensus               -I VALKE-HD --SA-REV-A LL---PSPNV V-L---F--- D--D-VLVLE   100

CeresClone:298125       WLPLDLAAVV RDARRRAGGG EGGEGI PASQ LKRWMLQVLE GVAACHRAGV   145
gi|54291188             WLPLDLSAVV RAAA------A ARPSALPAAQ RKRWMLQVLE GVAACHSAGV   142
Lead-CeresClone35742    FLRSDLAAVI RDGKRKKK-V EGGDGFSVGE FKRWMI QI LT GVDACHRNLI   142
gi|6984233              FLRTDLASLI KEGK------K NGGI GVNAGE I KRWMMQI LS GLDACHRNMV   144

Consensus               -L--DLAAV- RD-KR----- EGG-G--A-- I KRWMLQ-L- GV-ACHR--V   150

CeresClone:298125       VHRDLKPENL LI SEDGVLKV ADFGQARI LQ QSA-----PTF QEMYPHEQSS   191
gi|54291188             VHRDLKPANL LI SEDGVLKV ADLGQARI LQ ETG------TY QGMHPYEQSS   187
Lead-CeresClone35742    VHRDLKPGNM LI SDDGVLKL ADFGQARI LM EHDI VASDEN QQAYKLEDKD   192
gi|6984233              VHRDLKPSNL LI SDDGVLKL ADFGQARI LM EPGFVATAFD ETMHPDEQNL   194

Consensus               VHRDLKP-NL LI S-DGVLK- ADFGQARI L- E-G-VA--T- Q-M-P-EQSS   200

CeresClone:298125       GMETWVPQQQ PAVLQGI EEE PTSYESDATA GQEPETLTAA DYLRELDQLR   241
gi|54291188             GVEPW-VSQQ RAVLHGVKEN HPSHDSETQT GQEPERLTAA DYLHEMDQLR   236
Lead-CeresClone35742    GE-----TSEP PEVI PDYENS PR-----QGSD GQEREAMSKD EYFRQVEELK   234
gi|6984233              AVNEQKVVTS PENI PQVNPV PI -----EVQS NQEQVI VKGY ESFREFGESK   240

Consensus               GVE-W-VSQQ P-V-PGVEE- P-S--SE--- GQE-E-LTAA -Y-RE-D-L-   250
```

```
CeresClone:298125       EKS-S--DVD KMS-FQDEHA SCLATCSTGD IEDDPYPASY SDDMEG--IG  285
gi|54291188             AKS-THGDVD KMS-LQDGNA SCLATCSTAD IDDDPFRASY SYDAEEGMLE  284
Lead-CeresClone35742    AKQVVRDDTD KDSNVHDGDI SCLATCTVSE MDDDLGRNSF SYDADE-AVD  283
gi|6984233              ----PYDYLD ETS-IRDGDT SCLATGTASD MGDDFMRSTY NYETDE-VDN  284

Consensus               AKS---DDVD KMS--QDGDA SCLATC-TSD -DDDP-RASY SYDA-E----  300

CeresClone:298125       EDSGAFTSCV GTRWFRAPEL LYGSTNYGLE IDLWSLGCIL AELMKLEALF  335
gi|54291188             EESGAFTSCV GTRWFRAPEL LYGSTNYGQE VDLWSLGCIL AELFNLEPIF  334
Lead-CeresClone35742    DTQGLMTSCV GTRWFRPPEL LYGSTMYGLE VDLWSLGCVF AELLSLEPLF  333
gi|6984233              ERYGSLTSCV GTRWFRAPEL LYGSTDYGLE IDLWSLGCIF AELLTLEPLF  334

Consensus               E-SGA-TSCV GTRWFRAPEL LYGSTNYGLE -DLWSLGCI- AELL-LEPLF  350

CeresClone:298125       PGISDIDQIS RIINVLGDIT EETFPGCSNL PDYNKISFNK VEKPTGLEAC  385
gi|54291188             PGTSDIDQIG RIISVLGNIT EETFPGCSNL PDYNKIFFNK VEKPIGLEAC  384
Lead-CeresClone35742    PGISDIDQIS RVINVLGNLN EEVWPGCVDL PDYKSISFAK VESPLGIEGC  383
gi|6984233              PGTSDIDQLS RIINVLGNLT EQVWPGCLKL PDYGTISFNK VENPTGIESY  384

Consensus               PG-SDIDQIS RIINVLGN-T EE--PGC-NL PDYN-ISFNK VE-P-G-EAC  400

CeresClone:298125       LPNRSPTEVS IIKQLICYDT AKRTSAVDLL NDRYFTEEPL PAPIEGLHVP  435
gi|54291188             LPDRSASEVS IIKRLLCYDP TKRASAADLL NDPYFAEEPL PVPIEGLQVP  434
Lead-CeresClone35742    LPNHSGDVIS LLKKLICYDP ASRATIMEML NDKYLSEEPL PVPVSELYVP  433
gi|6984233              LTNHSPEEIA LVKKLVCYDP AARATAMELL RDEYFSKEPF PVPKFELGGP  434

Consensus               LPN-SP-E-S -IKKLICYDP A-RA-AM-LL ND-YFSEEPL PVPIE-L-VP  450

CeresClone:298125       ASKDEDDDSS TEEWGNYRDG VSRVDFDEFG SMDATKTEKG FSIQFS  481
gi|54291188             ESKD-EDDDS TEEWANFRGG DSDSDFDEFG SMDVTKTDKG FSIRFS  479
Lead-CeresClone35742    PTMSGPDEDS PRKWNDYREM DSDSDFDGFG PMNVKPTSSG FTIEFP  479
gi|6984233              LLNSGQDEDF PGRYDDYFER DFDSDFDNFA PVKIRSTRTG FSKQFS  480

Consensus               -SK-G-D-DS -EEW--YREG DSDSDFDEFG -MDV-KT--G FSIQFS  496
```

```
Lead-CeresClone22382   MGFSDAGI YL SDPNNLCQTE LGFFHEPSLG FSDQSDPQNE FHI TPPI YQE   50
CeresClone:1094248     MGFSDAGI CH SDQNNLGQTE I GLLRVPSI G FSDRS----- VQVFRP----   41

Consensus              MGFSDAGI -- SD-NNL-QTE -G----PS-G FSD-SDPQNE -----PI YQE   50

Lead-CeresClone22382   LQDQDLEPKS QETNNCSRKE GATVKKEEEE EDDYCKTPTR SDQI LSAMPR   100
CeresClone:1094248     --DQDLETKV RELTNCS-PE GV----KNEE EEELCKTPTR LDQI LPNI PN   84

Consensus              LQDQDLE-K- -E--NCSR-E G-TVKK--EE E---CKTPTR -DQI L---P-   100

Lead-CeresClone22382   I CPPAPRKPK RVPSRSLKVR NSYRSKRMI I LNVSREI DCL FNPTSLCNKI   150
CeresClone:1094248     I CPPAPRKPK GI QSRSLKVR DSYKSRRMI I LNVSREI DCM FHSASLGNK-   133

Consensus              I CPPAPRKPK ---SRSLKVR -SY-S-RMI I LNVSREI DC- F---SL-NKI   150

Lead-CeresClone22382   KKARYI        156
CeresClone:1094248     ------        133

Consensus              KKARYI        156
```

```
CeresClone:234510         MMMMMMAGEH VLAALGTLLL ASLLILVLNH FLPLLLNPKA PRGSFGWPLL  50
CeresClone:390429         --MMMMAGEH VLAALATLLL ASLLILVLNH FLPLLLNPKA PRGSFGWPLL  48
Lead-CeresClone36334      ------MAFTA FLLLLSSIAA GFLLLLRRTR YRRMGL---- PPGSLGLPLI  41
CeresClone:574698         -MASLPALPT LLLSFAAIFF TVLLLFLRRR QLRL------ PPGSYGLPLI  43
CeresClone:690176         MASFLFTPVL FLLITSAVL- --LFLHRRSR CRRFRL---- PPGTLGLPFV  43

Consensus                 -----MMA--- VLLAL---L- --LLLLVR-R FLRL-L---- PPGSFGLPL-  50

CeresClone:234510         GETLRFLTPH ASNTLGGFLE DHCSRYGRVF KSHLFCTPTV VSCDQDLNHF  100
CeresClone:390429         GETLRFLTPH ASNTLGGFLE DHCSRYGRVF KSHLFCTPTV VSCDQDLNHF  98
Lead-CeresClone36334      GETFQLIGAY KTENPEPFID ERVARYGSVF MTHLFGEPTI FSADPEFNRF  91
CeresClone:574698         GETLQLISAY KSDNPEPFID ERVERYGSIF TTHVFGEATV FSADPEVNRF  93
CeresClone:690176         GETLQLISAY KSDNPEPFMD QRVKRYGPIF TTHVFGEPTV FSTDPEFNRF  93

Consensus                 GETLQLI-AY KS-NPEPF-D -RVSRYG-VF -THLFGEPTV FS-DPELNRF  100

CeresClone:234510         ILQNEERLFQ CSYPRPIHGI LGKSSMLVVL GEDHKRLRNL ALALVTSTKL  150
CeresClone:390429         ILQNEERLFQ CSYPRPIHGI LGKSSMLVVL GEDHKRLRNL ALALVTSTKL  148
Lead-CeresClone36334      VLQNEGKLFE CSYPASLCNL LGKHSLLLMK GSLHKRMHSL TMSFANSSII  141
CeresClone:574698         ILQNEGRLLD CSYPGSISNL LGKHSLLLMK GGLHKRMHSL TMSLANSSII  143
CeresClone:690176         ILLNEGKLFE CSYPGSISNL LGKHSLLLMK GSLHKRMHSL TMSFANSSII  143

Consensus                 ILQNEGRLF- CSYP-SI-NL LGKHSMLLMK G-LHKRMHNL TMSLANSSII  150

CeresClone:234510         KPSYLGDIEK IALHVVGAWR RHGSSGGVRV VAFCEEARKF AFSMVVKQVL  200
CeresClone:390429         KPSYLGDIEK IALHVVGAWR RH---GGVRV VAFCEEARKF AFSMVVKQVL  195
Lead-CeresClone36334      KDHLMLDIDR LVRFNLDSWS SR-------- VLLMEEAKKI TFELTVKQLM  183
CeresClone:574698         KDHLLHHIDR LVCLNLDAWS NR-------- VFLMDQAKKI TFELTVKQLM  185
CeresClone:690176         KDHLLVDIDR LIRLNLDSWS DR-------- VLLMEEAKKI TFELTVKQLM  185

Consensus                 KDHLL-DIDR LV--NLDAWS -R-------- V-LMEEAKKI TFELTVKQLM  200
```

```
CeresClone:234510        GLSPEEPVTA RILEDFLAFM KGLISFPLYI PGTPYAKAVR ARERISSTVK  250
CeresClone:390429        GLSPEEPVTA RILEDFLAFM KGLISFPLYI PGTPYAKAVR ARERISSTVK  245
Lead-CeresClone36334     SFDPGE-WSE SLRKEYLLVI EGFFSLPLPL FSTTYRKAIQ ARRKVAEALT  232
CeresClone:574698        SFDPDE-WTE NLRKEYVLVI EGFFTLPFPL FSTTYRRAIK ARTKVAEALT  234
CeresClone:690176        SFDPGE-WTE TLRKEYVLVI EGFFSVPLPL FSSTYRRAIK ARTKVAEALT  234

Consensus                SFDPEE-WTE -LRKEYLLVI EGFFSLPLPL FSTTYRKAI- AR-KVAEALT  250

CeresClone:234510        GIIKERRS-- AGSWNKQGDF LDVLLSSNE- LSDEEKVSFV LDSLLGGYET  297
CeresClone:390429        GIIKERRS-- AGSWNKQGDF LDVLLSSNE- LSDEEKVSFV LDSLLGGYET  292
Lead-CeresClone36334     VVVMKRREEE EEGAERKKDM LAALLAADDG FSDEEIVDFL VALLVAGYET  282
CeresClone:574698        LVVRQRRKEY DEDKEKKNDM LGALLASGDH FSDEEIVDFL LALLVAGYET  284
CeresClone:690176        LVVRDRRKE- SVIEEKKNDM LGALLASGYH FSDEEIVDFM LALLVAGYET  283

Consensus                LVV-ERRKE- A-S-EKK-DM L-ALLASN-- FSDEEIVDF- LALLVAGYET  300

CeresClone:234510        TSLLISMVVY FLGQSAQDLD LVKREHDSIR SNKG-KEECL TSEDYKKMEY  346
CeresClone:390429        TSLLISMVVY FLGQSAQDLD LVKREHDSIR SNKG-KEECL TSEDYKKMEY  341
Lead-CeresClone36334     TSTIMTLAVK FLTETPLALA QLKEEHEKIR AMKS-DSYSL EWSDYKSMPF  331
CeresClone:574698        TSTIMTLAIK FLTETPLALA QLKEEHDQIR ARSD-PGTPL EWTDYKSMAF  333
CeresClone:690176        TSTIMTLAIK FLTETPLALA QLKEEHDQIR AKKSCPEAPL EWTDYKSMAF  333

Consensus                TSTIMTMAVK FLTETPLALA QLKEEHDQIR A-K---E--L EWTDYKSM-F  350

CeresClone:234510        TQQVINEALR CGNIVKFVHR KALKDVKYKE YLIPSGWKVL PVFTAVHLNP  396
CeresClone:390429        TQQVINEALR CGNIVKFVHR KALKDVKYKE YLIPSGWKVL PVFTAVHLNP  391
Lead-CeresClone36334     TQCVVNETLR VANIIGGVFR RAMTDVEIKG YKIPKGWKVF SSFRAVHLDP  381
CeresClone:574698        TQCVVNETLR VANIIGGIFR RARTDIDIKG YTIPKGWKVF ASFRAVHLNP  383
CeresClone:690176        TQCVVNETLR VANIIGAIFR RAMTDINIKG YTIPKGWRVV ASFRAVHLNP  383

Consensus                TQCVVNETLR VANIIG-VFR RA-TDV-IKG Y-IPKGWKVL ASFRAVHLNP  400
```

```
CeresClone:234510        SLHGDAQQFQ PCRWEGTS-- -QGTSKRFTP FGGGPRLCPG SELAKVETAF   443
CeresClone:390429        SLHGDAQQFQ PCRWEGTS-- -QGTSKRFTP FGGGPRLCPG SELAKVETAF   438
Leod-CeresClone36334     NHFKDARTFN PWRWQSNS-V TTGPSNVFTP FGGGPRLCPG YELARVALSV   430
CeresClone:574698        EHYKDARSFN PWRWQSNSSE ATNPGNVYTP FGGGPRLCPG YKLARVVLSV   433
CeresClone:690176        DHFKDARTFN PWRWQSNS-E ASSPGNVYTP FGGGPRLCPG YELARVVLSV   432

Consensus                -H-KDARTFN PWRWQSNS-- -TGPSNVFTP FGGGPRLCPG YELARV-LSV   450

CeresClone:234510        FLHHLVLNYR WRIDGDDIPM AYPYVEFQRG LPIEIEPTSP ES------   485
CeresClone:390429        FLHHLVLNYR WRIDGDDIPM AYPYVEFQRG LPIEIEPTSP ES------   480
Leod-CeresClone36334     FLHRLVTGFS WVPAEQDKLV FFPTTRTQKR YPIFVKRRDF AT------   472
CeresClone:574698        FLHRIVTRFS WVPAEEDKLV FFPTTRTQKR YPIIVQRRD- --------   472
CeresClone:690176        FLHRIVTRYS WFPAEEDKLV FFPTTRTQKR YPIIVKRREE SKLSKSP    479

Consensus                FLHRLVT-YS W-PAE-DKLV FFPTTRTQKR YPI-V-RRD- -S------   497
```

| | | |
|---|---|---|
| CeresClone:325972 | MDAA------ ---------- ---------- -----ACSVLS RS-----YSAS | 16 |
| Lead-CeresClone157709 | MDDENLWKVV KKDSI FETTH F--SSKPVFT RSFSTKTSSS -SSKPVFTRS | 47 |
| gi\|42822063 | MDVEKLWNHT KKDSI FQTTH FSSSSKPFFT RSFSIKTSSS PSSKSHFTRS | 50 |
| CeresClone:594005 | MDEK--RKAS KKD------- ---------- -----TGSFSS PG--SLFSRS | 25 |
| CeresClone:975168 | MDDK--WKVS KKD------- ---------- -----ASSSSS SSSKSKFSRS | 27 |
| Consensus | MDD---WK-T KKD------- ---------- ----T-SSSS -SSKS-FSRS | 50 |
| CeresClone:325972 | VSSSRSTAAG TSTAAATGSS AAAPSSQQQQ QQQQAGAAAC --PAESSSSS | 64 |
| Lead-CeresClone157709 | FSTKP-TSYS SSEPI FRRSF SAKPTSSKSP FLSRSGSTKC --PVDTSSTS | 94 |
| gi\|42822063 | FSTKPSSSSS SSDLI FRRSF SAKPKTSKSL LLSRSCSTKS --SADLSSKS | 98 |
| CeresClone:594005 | TSTSN----- ---------- ---------S PLLRSLSQKS --SSSSSKCN | 49 |
| CeresClone:975168 | FSTSA----- ---------- ----SSTKAP VFI RSSSTKC SVPSSSSSI S | 58 |
| Consensus | FSTS--TS-- SS-------S- SA-PSSSKS- -L-RS-STKC --P-DSSS-S | 100 |
| CeresClone:325972 | SSSSSR---- -----LSKKCV EAVKEHRARF YI VRRCVSML VCWR-----DY | 102 |
| Lead-CeresClone157709 | KCSI SRSLSQ KGASVTRKCR NMAKEHKSRF YI MKRCVLML VCWHKHACDS | 144 |
| gi\|42822063 | -SSLSRI LSK KGASVTGKCF KVAKEHKSRF YI I KRCVLML VCWHKHS--- | 144 |
| CeresClone:594005 | NNNLPRSFSQ KNPSI GRKCT KLAKEQKARF YI MRRCVAML VCWHKHG-DS | 98 |
| CeresClone:975168 | RSSSKKEKCS SSSSI TQKYS SLAKEQKGRF YI MRRCVAML VCKHKH--DX | 106 |
| Consensus | -SSLSR--SQ K-AS-TRKC- KLAKEHK-RF YI MRRCVAML VCWHKH--D- | 150 |

```
CeresClone:305610        -----MYNPD GAA-GFGGGP QQPAALGPRI SFSSDFAV-- --E-PTPVQN   39
CeresClone:218076        MACI NMYNTD GTA-GFGGGP QPPAALGPRV SFSSDFAV-- --E-PPPVQN   44
CeresClone:827699        MACVNMYNPD GGAVAFGGG- -QP----GPRI SFSSDFSM-- --EPPPPVQN   41
gi|50913049              MACI NMYNPD GGA-AFGGG- -QPPALGPRI SFSSDFVV-- --EPPPPVQN   43
gi|50946783              -----MYNPE QQQ----PPLP HHQLMAPPRM SFSSDFAL-- --EPPPPPSG   38
gi|51536211              MACVNMYNPE HHH------H QSSSFMAPRI SFSSDFAL-- --EPPPPAQQ   40
CeresClone:758144        -----MYNPE HHQ-------- --SSFMAPRM SFSSDFAL-- --EPPPASAP   32
CeresClone:1061902       MACVDMYNPE HHH---QHQP APPSFMAPRM SFSSDFAV-- --EPPPPAAA   43
CeresClone:218046        -----MYNPE QHQ-------- AAPPFMAPRM SFSSDFAV-- --EPPPPAAA   34
CeresClone:562697        ---------- ---------- -----MSPRI SFSNDFVDL- --KQAMKQEQ   22
gi|28466849              MARLEMHNSM NG-------- ------AARI SFSNEFVEI R SEKSNAKSNN   36
Lead-CeresClone102248    MACLEMYNSN GG----GGTP ------MSPRI SFSNDFVEI - --RPETTKTT   38

Consensus                MACI -MYNP- ---------- --P--MAPRI SFSSDFAV-- --EPPPP---   50

CeresClone:305610        RAT SLRCQEE DL------NFE FS-VGSHPMM AADQLFSKGR I LPLKDNGGG   83
CeresClone:218076        RAMSLRCQEE DV------NFE FS-VGSHPMM AADQLFSKGR I LPLRDNCGC   88
CeresClone:827699        RAMGLRCQEE DQ------NFE FS-VGSHPMM AADQLFSKGR I LPFKVEGG-   84
gi|50913049              RAMNLRCQEE DI ------NFE FS-VGSHPMM AADQLFSKGR I LPLKDGGFS   87
gi|50946783              PGR---ASMG DA------DFE FSAVGSRPMI TADQLFSKGR I LPMREVSGG   80
gi|51536211              QPAV--RAPG DA------DFE FS-VGSHPMM AADQLISKGR LLPLREAPHG   82
CeresClone:758144        SAR-----GPG DA------DFE FS-VGSRPMM AADELFSKGR LLPLREAPHG   72
CeresClone:1061902       RGG-------G DA------DFE FS-VGSHPMM AADQLFSKGR LLPLREAPQQ   81
CeresClone:218046        RGGA--AGPG DA------DFE FS-VGSHPMM AADQLFSKGR LLPLREAPQQ   76
CeresClone:562697        RGSSRSDAPV SS------DFE FS-VANYSMM SADELFFKGR LMSTYNKDNC   66
gi|28466849              INSRSSFSMP SA------DFA FS-VTDYSMI PADEI FLKGK I LPFKETSH-   79
Lead-CeresClone102248    RSSPLSKQEG SSSSFSDNFE FS-VSNYTMM PADELFSKGK LLPFKETNQ-   86

Consensus                R--------G DA------DFE FS-VGSHPMM AADQLFSKGR -LPLRE----  100
```

```
CeresClone:305610          SVCF------ -------AAAR PPTTLRDELR G-------GGD DDDERAAFSA  115
CeresClone:218076          FAA------- --------AR PPTTLRDELC X---GGGVSS DDDERASAAG  120
CeresClone:827699          ---------- ---------R PPSTLRDELR G-------GAA DEERAS--TT  107
gi|50913049                S--------- --------GR PPTTLRDELR C---------- -DDR----AS  106
gi|50946783                GGG------- --------GG RAVTLRDELR G---HDGAAV ADGRHR--RA  110
gi|51536211                HGGA------ ------DAGG RPLTLRDELR T---------- -DSRHG--RV  108
CeresClone:758144          QSG------- ---------- RPTTLREELR T---------- -DDRHG--RA   93
CeresClone:1061902         AAG------- ---------G RPVTLRDELR A---------- -DERHG--RA  103
CeresClone:218046          AGG------- --------GA RPVTLKEEXR A---------- -DERHG--RV   99
CeresClone:562697          NNNNKNNHMM MMQQQRATTT TTTTXKEELL I------NDD DHDHDFSLRP  110
gi|28466849                ---------- ---------- VHRTLGEELL T---EEEGSM VDGNTFSLRP  106
Lead-CeresClone102248      ---------- ---------- VQRTLREELL VEEDEEEGPR DATNIFSLKP  116

Consensus                  ---------- ---------- -PTTLRDELR ---------- -DDR----R-  150

CeresClone:305610          AGTKG----- -SNSNRWKEM LGLRKALCVG VGGGGNGSPA KKASS-----  154
CeresClone:218076          SKGSG----- -----RWKEM LGLRKALCVG NGPPAKKASS GKQGVADDMA  160
CeresClone:827699          PKGSS----- -----RWREM LGLRKSLCVG GGVASNAAAA KKSDKVVAV-  146
gi|50913049                AKGSS----- -----RWKEM LGLRKPLCVG GVNGTAKKST ----------  136
gi|50946783                ARPAG---SG GGGGVRWKEM LGLKRP---G HRKHG----- ----------  139
gi|51536211                PRAPN----- ----IRWKEF LGLKKA---P KKAPTA---- ----------  132
CeresClone:758144          PRAPN----- ----IRWKEL LGFKKA---N KKAAAAAADA GASTSSAEAA  131
CeresClone:1061902         PRATN----- ----IRWKEL LGLKKA---P KKQQAAAA-- ----------  129
CeresClone:218046          PRAPN----- ----IRWKEL LGLKKA---P KKQ------- ----------  120
CeresClone:562697          PKPSS----- ----TRWKGL LGLRKT-HTG SKKPHKSTEG GSSDATRSA-  149
gi|28466849                ILLSS---SS FSTKGTWREL LGLKRT-HVR SKKTDKVNEE VL--------  144
Lead-CeresClone102248      P FSSSSSSS SSSKGRWKGL LGLKRA-HVG SKNNDERFVH HM--------  157

Consensus                  PR-SN----- -----RWKEM LGLKKA--VG -K-------- ----------  200
```

```
CeresClone:305610        SDKQGVVAAA APGPDDHMAA SNQQEQLS-- -   182
CeresClone:218076        ASNQGLCYDR ADGRDEIIIG GIAPQTSHA- -   189
CeresClone:827699        DADAKIATDM AAPKQEL--- ---------- -   163
gi|50913049              TVDTEMVTDV ADSKQEQ--- ---------- -   153
gi|50946783              AADEGGASTH DLDHMDL--G GGE------- -   160
gi|51536211              DAAAGATSSS ADTQMDL--G G-QGSTRD-- -   157
CeresClone:758144        AADAGASTSS AEAHTDL--G GHGGTRE--- -   156
CeresClone:1061902       AADAAAGAST DAHMVGH--- ---------- -   146
CeresClone:218046        AAADAAAGTS ADAHMDL--G GQQGSTRD-- -   146
CeresClone:562697        LVNDSPPTSI TSSQEVLNEG GSSCRDLEIG I   180
gi|28466849              SQDHKIISGN VAIRE----- CQVADTR--- -   166
Leod-CeresClone102248    INNNKQSQEA IGGREGS--S CREMKKSM-- -   183

Consensus                -AD-----SS A--REDL--G G--------- -   231
```

```
CeresClone:359934        ---------- ---------- ---------- ----MQI V-- CVRSASTGGG   14
CeresClone:294598        ---------- ---------- ---MQGGGGV DQPPMQMVLR VRHPSSLGGS   27
CeresClone:839270        ---------- ---------- ---------- ----MQMVLR VKHPSSLSSG   16
Lead-CeresClone24885     MTQSQTNDGA GAGAVTTVES VPPQPQSQPQ PQPQQQSNEM VLHTGSLSFS   50
CeresClone:693935        ---------- ---------M ATPKQSYEQQ QQQQQPNVQR VRNSGM NSN   31

Consensus                ---------- ---------- ---------- -Q--MQMV-R VRHSSSLS-S   50

CeresClone:359934        EEVGEWA--E QSSRSALSLF KEKEEEIERK KVEVRDKVFS MLGRVEEETK   62
CeresClone:294598        GADEDDG--E GSSRSALSVF KAKEEQIERR KMEVREKVFA HLGRVEEESK   75
CeresClone:839270        SEEASEG--E GSSRSALSVF KAKEEQIERK KMEVRDKVFA QLGRVEEESK   64
Lead-CeresClone24885     SHMSRED--E EMTRSALSAF RAKEDEIEKR RMEVRERIQA QLGRVEQETK   98
CeresClone:693935        QSPMRDDKEE EMSRSALAMF RAKEEEIERR KVEVRDKVHA YLGRVEEETK   81

Consensus                ---------E ESSRSALSVF KAKEEEIERR KMEVRDKVFA -LGRVEEETK  100

CeresClone:359934        RLAFIRQELE LMADPTRREV DAIRKRIDKV NRQLKPLGKT CLKKEKEYKM  112
CeresClone:294598        RLAFIRQELE GMADPTRKEV ESIRKRIDTV NRQLKPLSKS CVKKEKEYKE  125
CeresClone:839270        RLAFIRQELE GMADPTRKEV ESIQRRIDTV NRQLKPXSKX XVKKEKEXKE  114
Lead-CeresClone24885     RLSTIREELE SMADPMRKEV SVVRKKIDSV NKELKPLGST VQKKEREYKE  148
CeresClone:693935        RLAEIREELE GLTDPLRKEV AIVRKKIDSV NKELKPLGQT CQRKEREYKE  131

Consensus                RLAFIRQELE GMADPTRKEV EAIRKRID-V NRQLKPLGKT CVKKEKEYKE  150

CeresClone:359934        CLEAYNEKNN EKATLVNRLL E----LVSESE RLRMKKLEEL NKTIESLY  157
CeresClone:294598        VLEAYNEKSK EKALLVNRLI E----LVSESE RMRMKKLEEL NKTVDSLY  170
CeresClone:839270        IXEXYNEKSK EKAILVNRLI E----LVSESX RMRXKKLEEL NKXVDXLX  159
Lead-CeresClone24885     ALDTFNEKNR EKVQLITKLM EMEQLVGESE KLRMIKLEEL SKSIETV-  195
CeresClone:693935        ALDAFNEKNK EKAQLVTKLM E----LVTESE KLRMKKLEEL SKNVDTLH  176

Consensus                -LEAYNEKNK EKA-LVNRL- E----LVSESE RLRMKKLEEL NK-VD-LY  198
```

```
gi|50904897              --MAQPSSKK TPSVYLYIPN IIGYFRIIIN FIAFAVCYSN RVLFAILYFF  48
gi|13661020              --MAQPSSKK TPSVYLYIPN IIGYFRIIIN FIAFAVCYSN RVLFAILYFF  48
CeresClone:306792        ---------- ---------- ---------- ---------- ----------   0
CeresClone:321760        ---------- ---------- ---------- ---------- ----------   0
gi|34577127              ---------- MPSVYLYIPN IIGYFRIIIN FIAFAVCYSN KALFAILYFI  40
CeresClone:284101        ---------- ---------- ---------- ---------- ----------   0
CeresClone:259619        ---------- ---------- ---------- ---------- ----------   0
CeresClone:581207        MAKKPGPRSS KLSVYLYIPN IIGYIRVLLN CFAFSQCLSN KILFSILYFL  50
Lead-CeresClone27810     ---MAKQRPA TLSVYLYIPN IVGYMRVLLN CIAFSVCFSN KILFSLLYFF  47
gi|21745398              MAKKERPRPE KLSVYLYIPN IVGYMRVLLN CVAFAVCFSN KILFSLLYFF  50
gi|22655196              MAKKERPRPE KLSVYLYIPN IVGYMRVLLN CVAFAVCFSN KPLFSVLYFF  50
gi|21592927              MAKKERPRPE KLSVYLYIPN IVGYMRVLLN CVAFAVCFSN KPLFSVLYFF  50
CeresClone:34210         ---------- ---------- ----MRVLLN CVAFAVCFSN KPLFSVLYFF  26

Consensus                ---------- --SVYLYIPN I-GY-RVLLN --AFAVCFSN K-LFSILYFF  50

gi|50904897              SFFCDGLDGW FARKFNQAST FGAVLDMVTD RVSTACLLAL LSQFYRPGLV  98
gi|13661020              SFFCDGLDGW FARKFNQAST FGAVLDMVTD RVSTACLLAL LSQFYRPGLV  98
CeresClone:306792        ---------- ---------- ------MVTD RVSTACLLAL LSQFYRPGLV  24
CeresClone:321760        ---------- ---------- ------MVTD RVSTACLLAL LSQFYRPGLV  24
gi|34577127              SFVLDGVDGW FARKFNQAST FGAVLDMVTD RVSTACLLAL LSQFYRPGLA  90
CeresClone:284101        ---------- ---------- ------MVTD RVSTACLLAL LSQFYRPGLV  24
CeresClone:259619        ---------- ---------- ------MVTD RVSTACLLAL LSQFYRPGLV  24
CeresClone:581207        SFVCDAVDGW CARKFNQVST FGAVLDMVTD RISTACLLVV LSQLYKPGLS 100
Lead-CeresClone27810     SFCCDAVDGW CARKFNQVST FGAVLDMVTD RVSTACLLVI LSQIYRPSLV  97
gi|21745398              SFCCDAVDGW CARRFNQVST FGAVLDMVTD RVSTACLLVV LSQVYRPSLV 100
gi|22655196              SFCCDAVDGW VARRFNQVST FGAVLDMVTD RVSTACLLVI LSQIYRPSLV 100
gi|21592927              SFCCDAVDGW VARRFNQVST FGAVLDMVTD RVSTACLLVI LSQIYRPSLV 100
CeresClone:34210         SFCCDAVDGW VARRFNQVST FGAVLDMVTD RVSTACLLVI LSQIYRPSLV  76

Consensus                SF-CD-VDGW -ARKFNQ-ST FGAVLDMVTD RVSTACLLAL LSQFYRPGLV 100
```

| | | | | | | |
|---|---|---|---|---|---|---|
| gi\|50904897 | FLMLLGLDIT | SHWFQMYSSF | LSGKTSHKDV | KDTGNWLLKL | YYGHRPFMAF | 148 |
| gi\|13661020 | FLMLLGLDIT | SHWFQMYSSF | LSGKTSHKDV | KDTGNWLLKL | YYGHRPFMAF | 148 |
| CeresClone:306792 | FLILLGLDIT | SHWFQMYSSF | LSGKTSHKDV | KHTGNWLLKL | YYGYRPFMAF | 74 |
| CeresClone:321760 | FLILLGLDIT | SHWFQMYSSF | LSGKTSHKDV | KHTGNWLLKL | YYGYRPFMAF | 74 |
| gi\|34577127 | FLILLGLDIT | SHWFQMYSSF | LSGKTSHKDV | KHTGNWLLKL | YYGYRPFMAF | 140 |
| CeresClone:284101 | FLILLGLDIT | SHWFQMYSSF | LSGKTSHKDV | KHTGNWLLKL | YYGYRPFMAF | 74 |
| CeresClone:259619 | FLILLGLDIT | SHWFQMYSSF | LSGKTSHKDV | KHTGNWLLKL | YYGYRPFMAF | 74 |
| CeresClone:581207 | FLSLLALDIA | SHWLQMYSTF | LTGKTSHKDV | KDSSSWLFRA | YYGNRMFMAY | 150 |
| Lead-CeresClone27810 | FLSLLALDIA | SHWLQMYSTF | LSGKTSHKDV | KDSTSWLFRL | YYGNRMFMGY | 147 |
| gi\|21745398 | FLSLLALDIA | SHWLQMYSTF | LAGKSSHKDV | KDSTSWLFRL | YYGNRIFMCY | 150 |
| gi\|22655196 | FLSLLALDIA | SHWLQMYSTF | LAGKSSHKDV | KDSTSWLFRL | YYGNRIFMCY | 150 |
| gi\|21592927 | FLSLLALDIA | SHWLQMYSTF | LAGKSSHKDV | KDSTSWLFRL | YYGNRIFMCY | 150 |
| CeresClone:34210 | FLSLLALDIA | SHWLQMYSTF | LAGKSSHKDV | KDSTSWLFRL | YYGNRIFMCY | 126 |
| Consensus | FLILLGLDIT | SHWFQMYSTF | LSGKTSHKDV | KDTGNWLLKL | YYG-RPFMAY | 150 |

| | | | | | | |
|---|---|---|---|---|---|---|
| gi\|50904897 | CCVASEVLYI | VLFLFADEKS | TSLLNVCGNL | LKQSPLIVFV | FISTLVGWAL | 198 |
| gi\|13661020 | CCVASEVLYI | VLFLFADEKS | TSLLNVCGNL | LKQSPLIVFF | FISTLVGWAL | 198 |
| CeresClone:306792 | CCVSCEVLYI | ILFLFADEKS | TSLLSACKGL | LNQSPIIILV | FISTLVGWAV | 124 |
| CeresClone:321760 | CCVSCEVLYI | ILFLFADEKS | TSLLSACKGL | LNQSPIIILV | FISTLVGWAV | 124 |
| gi\|34577127 | CCVSCEVLYI | FLFLFADEES | TSLLSVCKGI | LNQSPVVILV | FVSTLVGWAV | 190 |
| CeresClone:284101 | CCVSCEVLYI | FLFLFADEES | TSLLSVCKGI | LNQSPVVILV | FVSTLVGWAV | 124 |
| CeresClone:259619 | CCVSCEVLYI | FLFLFADEES | TSLLSVCKGI | LNQSPVVILV | FVSTLVGWAV | 124 |
| CeresClone:581207 | CCVSCEVLYL | ILFYLAENQT | EKLVDVISSN | LQKISFLSLL | MGISLFGWAV | 200 |
| Lead-CeresClone27810 | CCVSCEVLYI | ILLLIATNQT | ENLMNVVVKS | LMQISPLSLL | LALSIFGWSI | 197 |
| gi\|21745398 | CCVSCEVLYI | ILLLIAKNQT | ENLLNVVVST | LTQISPLSLL | LALTIFGWSM | 200 |
| gi\|22655196 | CCVSCEVLYI | ILLLIAKNQS | ENLLNVVVAT | LTQISPLSFL | LALTLFGWSM | 200 |
| gi\|21592927 | CCVSCEVLYI | ILLLIAKNQS | ENLLNVVVAT | LTQISPLSFL | LALTLFGWSM | 200 |
| CeresClone:34210 | CCVSCEVLYI | ILLLIAKNQS | ENLLNVVVAT | LTQISPLSFL | LALTLFGWSM | 176 |
| Consensus | CCVSCEVLYI | ILFLFADEQS | TNLLNVC--L | L-QSPVLIL- | FVSTLVGWAV | 200 |

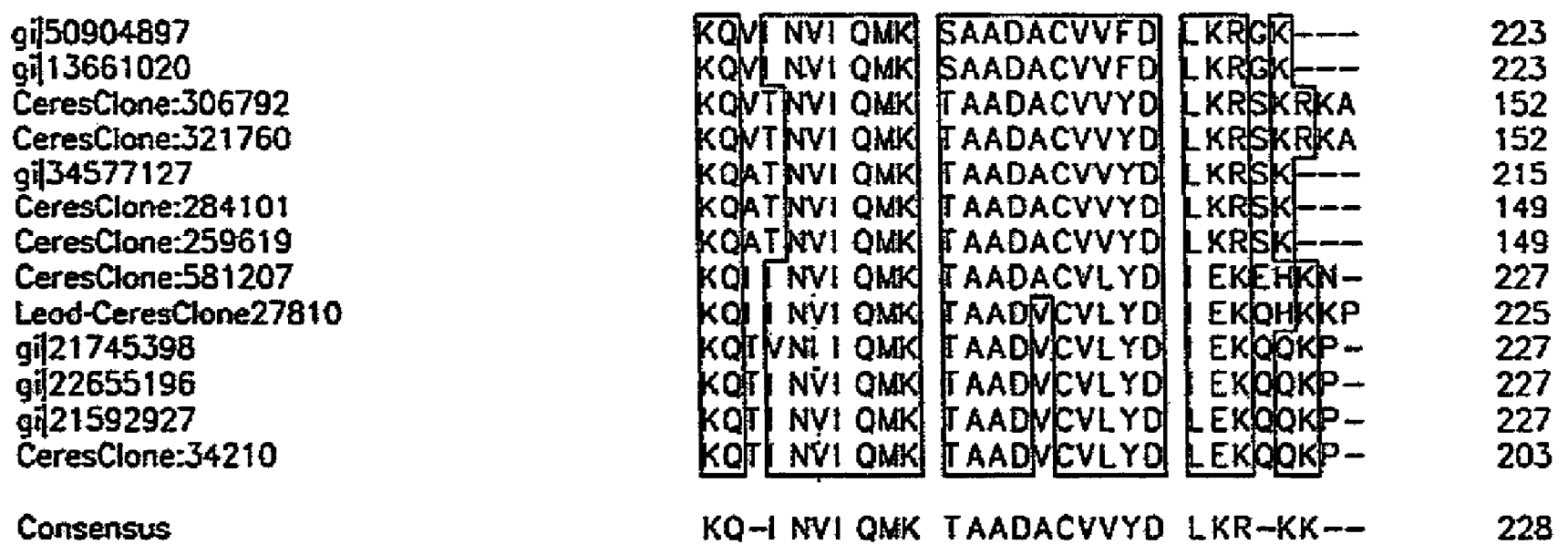

| | | |
|---|---|---|
| gi\|50904897 | KQVI NVI QMK SAADACVVFD LKRGK--- | 223 |
| gi\|13661020 | KQVI NVI QMK SAADACVVFD LKRGK--- | 223 |
| CeresClone:306792 | KQVT NVI QMK TAADACVVYD LKRSKRKA | 152 |
| CeresClone:321760 | KQVT NVI QMK TAADACVVYD LKRSKRKA | 152 |
| gi\|34577127 | KQAT NVI QMK TAADACVVYD LKRSK--- | 215 |
| CeresClone:284101 | KQAT NVI QMK TAADACVVYD LKRSK--- | 149 |
| CeresClone:259619 | KQAT NVI QMK TAADACVVYD LKRSK--- | 149 |
| CeresClone:581207 | KQI I NVI QMK TAADACVLYD IEKEHKN- | 227 |
| Leod-CeresClone27810 | KQI I NVI QMK TAADVCVLYD IEKQHKKP | 225 |
| gi\|21745398 | KQIV NI I QMK TAADVCVLYD IEKQQKP- | 227 |
| gi\|22655196 | KQTI NVI QMK TAADVCVLYD IEKQQKP- | 227 |
| gi\|21592927 | KQTI NVI QMK TAADVCVLYD LEKQQKP- | 227 |
| CeresClone:34210 | KQTI NVI QMK TAADVCVLYD LEKQQKP- | 203 |
| Consensus | KQ-I NVI QMK TAADACVVYD LKR-KK-- | 228 |

```
CeresClone:113577       --MSSSGAPS RKTLSKIATN RLQKELVEWQ MNPPTGFKHK VTDNLQRWII  48
CeresClone:40968        ---------- ---------- -------MEWQ TNPPSGFKHR VSDNLQRWII  24
CeresClone:1256091      ---------M RXXXRKIACN RLQKELTEWQ LNPPTGFRHK VTDNLQKWTI  41
CeresClone:618269       MTSSASSSPS RKVLSKIACL RLQKELGEWQ ASPPGGFTYK VSDNLQRWVI  50
CeresClone:677474       --MTSSSTPS RKALSKIACN RLQKELAEWQ VGPPAGFKYK VSDNLQRWVI  48
CeresClone:387067       --MTSSSSPS RKALSKIACN RLQKELAEWQ LSPPAGFKHK VSDNLQRWVI  48
CeresClone:280334       --MTSSSSPS RKALSKIACN RLQKELAEWQ LSPPAGFKHK VSDNLQRWVI  48
Lead-CeresClone40708    --MTSSSSPA RKALSKIACN RLQKELSEWQ VNPPTGFKHR VTDNLQKWVI  48
CeresClone:670593       --MTSSSAAA RKNLSKIACN RLQKELVEWQ VNPPTGFKHK VTDNLQRWVV  48
CeresClone:27375        --MSSSGAPS RKTLSKIATN RLQKELVEWQ MNPPTGFKHK VTDNLQRWII  48

Consensus               --MTSSSSPS RK-LSKIACN RLQKEL-EWQ -NPPTGFKHK V-DNLQRWVI  50

CeresClone:113577       EVIGAPGTLY ANDTYQLQVD FPEHYPMESP QVIFLHPAPL HPHIYSNGHI  98
CeresClone:40968        EVHGVPGTLY ANETYQLQVE FPEHYPMEAP QVIFQHPAPL HPHIYSNGHI  74
CeresClone:1256091      DVTGAPGTLY ANETYQLQVE FPVNYPMEAP QVIFVPPAPS HPHIYSNGHI  91
CeresClone:618269       EVSGAEGTLY AGETYRLQVD FPEQYPMEAP QVIFMHPAPM HPHIYSNGHI  100
CeresClone:677474       EVGGAEGTLY AGETYQLQVD FPEHYPMEAP QVIFLNPAPM HPHIYSNGHI  98
CeresClone:387067       EVTGAAGTLY AGETYKLQVD FPEHYPMEAP QVIFLHPAPM HPHIYSNGHI  98
CeresClone:280334       EVTGAAGTLY AGETYQLQVD FPEHYPMEAP QVIFLNPAPM HPHIYSNGHI  98
Lead-CeresClone40708    EVTGAPGTLY ANETYNLQVE FPQHYPMEAP QVIFVPPAPL HPHIYSNGHI  98
CeresClone:670593       EVTGAPGTLY ANETYQLQVD FPENYPMEAP QVIFLHPAPL HPHIYSNGHI  98
CeresClone:27375        EVIGAPGTLY ANDTYQLQVD FPEHYPMESP QVIFLHPAPL HPHIYSNGHI  98

Consensus               EVTGAPGTLY ANETYQLQVD FPEHYPMEAP QVIFLHPAPM HPHIYSNGHI  100

CeresClone:113577       CLDILYDSWS PAMTVSSICI SILSITAGSI -------RGK DLIGWRLTRC  141
CeresClone:40968        CLDVLYDSWS PAMRLSSICL SILSMLSSSS VKQKPKDNDH YLKNCKHGRS  124
CeresClone:1256091      XLDILYDSWS PAMTVSSVCI XILSMLSSSP AKERPADNDR YVKNCKNGRS  141
CeresClone:618269       CLDILYDSWS PAMTVSSVCI SILSMLSSSP AKERPSDNDR YVRNCRNGRS  150
CeresClone:677474       CLDILYDSWS PAMTVSSVCI SILSMLSSSP AKQRPADNDR YVRNCRNGRS  148
CeresClone:387067       CLDILYDSWS PAMTVSSICI SILSMLSSSP EKQRPADNDR YVKNCRNGRS  148
CeresClone:280334       CLDILYDSWS PAMTVSSVCI SILSMLSSSP AKQRPVDNDR YVRNCRNGRS  148
Lead-CeresClone40708    CLDILYDSWS PAMTVSSVCI SILSMLSSSP EKQRPTDNDR YVKNCKNGRS  148
CeresClone:670593       CLDILYDSWS PAMTVSSICI SILSMLSSST TKQRPEDNDR YVKNCRNGRS  148
CeresClone:27375        CLDILYDSWS PAMTVSSICI SILSMLSSST EKQRPTDNDR YVKNCKNGRS  148

Consensus               CLDILYDSWS PAMTVSS-CI SILSMLSSSP -KQRP-DNDR YVKNCRNGRS  150
```

| | | |
|---|---|---|
| CeresClone:113577 | SRI HRRWMKE ILF---TTRN R | 159 |
| CeresClone:40968 | PKETRWRFHD DKV-------- - | 137 |
| CeresClone:1256091 | PKG-------D EVVASMTTRL D | 156 |
| CeresClone:618269 | PKETRWWFHD DKV-------- - | 163 |
| CeresClone:677474 | PKETRWWFHD DKV-------- - | 161 |
| CeresClone:387067 | PKETRWWFHD DTV-------- - | 161 |
| CeresClone:280334 | PKETRWWFHD DTV-------- - | 161 |
| Leod-CeresClone40708 | PKETRWWFHD DKV-------- - | 161 |
| CeresClone:670593 | PKETRWWFHD DKV-------- - | 161 |
| CeresClone:27375 | PKETRWWFHD DKV-------- - | 161 |
| Consensus | PKETRWWFHD DKV-------- - | 171 |

```
CeresClone:333643        --MKLVVLGI PWDVDTEGLR EYMAKFGPLD DCVVMKERSS GRSRGFGYVT  48
gi|57899379              MATKLVVLGI PWDVDTEGLR EYMGKFGPLD DCVVMKERSS GRSRGFGYVT  50
Lead-CeresClone116117    MERKLVVLGI PWDIDSDGLK DYMSKFGDLE DCIVMKDRST GRSRGFGYVT  50
CeresClone:467735        ---------- ---------- --MSKFGFLE DCIVMKERST GRSRGFGYVT  28

Consensus                M--KLVVLGI PWDVDTEGLR EYMSKFG-L- DC-VMKERS- GRSRGFGYVT  50

CeresClone:333643        FASADDAKNV LDCEHVLGSR TLEVKVATPK EEMKSQGSKK ATRIFVARIP  98
gi|57899379              FSSADDAKNV LECEHVLGNR TLEVKIATPK EEMKSQGSKK ATRIFVARIP  100
Lead-CeresClone116117    FASAEDAKNA LKGEHFLGNR ILEVKVATPK EEMRFQPAKK VTRIFVARIP  99
CeresClone:467735        FASVDDAKEV LSSEHILGNR TLEVKVATPK EEMR-APVKK VTRIFVARIP  77

Consensus                FASADDAKNV L-CEHVLGNR TLEVKVATPK EEM-SQ-SKK -TRIFVARIP  100

CeresClone:333643        QSVDESMFRR HFEAFGEILD LYMPKEHGSK GHRGIGFITF QSAESVDNIM  148
gi|57899379              QSVDESMFRR HFEAYGEITD LYMPKEHGSK GHRGIGFITF QSAESVDSIM  150
Lead-CeresClone116117    SSVSESDFRS HFERYGEITD LYMPKDYNSK QHRRIGFITF SSADSVEDLM  149
CeresClone:467735        QSVTEATFRS HFEKYGEITD LYMPKDQGSK MHRGIGFITF ASADSVENLM  127

Consensus                QSV-ESMFR- HFE-YGEITD LYMPK-HGSK GHRGIGFITF -SA-SV-N-M  150

CeresClone:333643        QESHELDGTT VVVDRATPKD EDV------- ---RYPP--- -SR-PSQGGY  183
gi|57899379              QDSHELDGTT VVVDRATPKD EEV------- ---RYPP--- -SRGASQGGY  186
Lead-CeresClone116117    EDTHDLGGTT VAVDRATPKE DDHPPRPPPV ARMSRPPVAI AGGFGAPGGY  199
CeresClone:467735        SETHELGGSA VVVDRATPKD DDF----KPI GRMPLPP--- ----PTQGGY  166

Consensus                Q--HEL-GTT VVVDRATPKD -DV-----P- -RMRYPP--- -SR-PSQGGY  200

CeresClone:333643        GAYNAYISAA TRYAILGAPT LYDHPGSAYG RGY-YGPSQA VG-KKIFVGR  231
gi|57899379              GAYNAYISAA TRYAALGAPT LYDHPGSAYG RGGYYGSSQG MGNKKIFVGR  236
Lead-CeresClone116117    GAYDAYISAA TRYAALGAPT LYDNPAIFYG RGE--PTTRG IG-NKIFVGR  246
CeresClone:467735        GAYNAYISAA TRYAALGAPT LYDQPGPIYG RGD---PSRR TS-KKIFVGR  212

Consensus                GAYNAYISAA TRYAALGAPT LYDHPGSAYG RG--YG-S-G -G-KKIFVGR  250
```

```
CeresClone:333643          LPQEANTDDL RQYFGRFGRI VDAYIPKDPK RSGHRGFGFV TFADDGVAER   281
gi|57899379                LPQEANTEDL RHYFGKFGRI VDAYIPKDPK RSGHRGFGFV TFADEGVADR   286
Lead-CeresClone116117      LPQEASVDDL RDYFGRFGHI QDAYIPKDPK RSGHRGFGFV TFAENGVADR   296
CeresClone:467735          LPPEATSDDL RQYFGRFGRI LDVYVPRDPK RTGHRGFGFV TFAEDGVADR   262

Consensus                  LPQEANTDDL RQYFGRFGRI VDAYIPKDPK RSGHRGFGFV TFA-DGVADR   300

CeresClone:333643          VARRSHEILG HEVAIDTAAP LE--NDSAAG GYI-DPM--D LYGAY-GSMR   325
gi|57899379                VARRSHEILG HEVAIDTAAP LE--GDS-GG GYM-EPM--D LYGAY-GSMR   329
Lead-CeresClone116117      VARRSHEICG QEVAIDSATP LDEAGPSAGA SSMLSSSRPE YFGGYGGPMR   346
CeresClone:467735          VSRRSHEICG HQVAIDSATP VDDAGPS--G NFMMNSM--E SFGGYGGPVR   308

Consensus                  VARRSHEI-G HEVAID-A-P L--AG-SAGG -YM---M--- L-G-YGG-MR   350

CeresClone:333643          SFGRFCGGLD Y-NYGYGPS- SGSSRSRSDW RYRPY   358
gi|57899379                TYGRFCSGID Y-DYGYGHSG SSSSRSRADW RYRPY   363
Lead-CeresClone116117      AFGRMYGGMS LDDWGYGM-- PNARPSRPDR RYRPY   379
CeresClone:467735          SYGRMYGSLD FDDWGYGI-- --GRPSRADW RYRPY   339

Consensus                  S-GR--GGLD YDD-GYG-S- S-S--SRADW RYRPY   385
```

| | | | | | | |
|---|---|---|---|---|---|---|
| CeresClone:1557119 | ---------- | -MAATYQTGL | VAEPQLLNTE | IITRRATNCV | ADTNRKDKCV | 39 |
| CeresClone:452749 | ---------- | -MAATYQTGL | VAEPQLLNTE | IITRRATNSV | ADTNRKDKCV | 39 |
| CeresClone:1367041 | MDSPQSVVSP | FKIGESENEN | SNSVQSSGNQ | SNGINSNGKD | SKSCGRQDLM | 50 |
| CeresClone:677448 | ---------- | ---------- | ---------- | --MEAVSAPA | ASTNGGGELI | 18 |
| CeresClone:115393 | ---------- | ---------- | ---------- | ---------- | -MSSDSDSFI | 9 |
| CeresClone:113269 | ---------- | ---------- | ---------- | ---------- | ---------- | 0 |
| CeresClone:39481 | ---------- | ---------- | ---------- | ---------- | ---------- | 0 |
| CeresClone:763949 | MESQQKQ--- | ---------- | ---------- | --QMEAVSAP | AATNGGGELI | 25 |
| Lead-CeresClone538933 | MESPQSVVSP | FKRSVLGDAE | KYRSDVLSK- | --DIEVNGKE | GAVCNVEEFI | 47 |
| CeresClone:470921 | ---------- | ---------- | ---------- | ---------- | --MSNVEEFL | 8 |
| Consensus | ---------- | ---------- | ---------- | ---------- | A-TN---E-I | 50 |

| | | | | | | |
|---|---|---|---|---|---|---|
| CeresClone:1557119 | GYLDVFVHQA | RDIHNVCIYH | KQDVYAKLCL | TSSPDVSCST | KVINSAGRNP | 89 |
| CeresClone:452749 | GYLDVFVHQA | RDIHNVCIYH | KQDVYAKLCL | TSSPDVSCST | KVINSAGRNP | 89 |
| CeresClone:1367041 | GALEVYVHQA | RDIHNICIYH | KQDVYAKLCL | TSDPDKSVST | KIINGGGRNP | 100 |
| CeresClone:677448 | GYVDVHVRSA | RDIQNICIYH | KQDVYARLSL | PGEGAPAAST | QVINGGGRNP | 68 |
| CeresClone:115393 | GVLEVFVHQA | RDIHNICIYH | KQDVYAKLCL | TNDPENSLST | KIINGGGQNP | 59 |
| CeresClone:113269 | ---------- | ---------- | ---------- | ---------- | ---------- | 0 |
| CeresClone:39481 | ---------- | ---------- | ---------- | ---------- | ---------- | 0 |
| CeresClone:763949 | GYVDVHVRSA | RDIQNICIYH | KQDVYARLSL | PGEGAPAAST | QVINGGGRNP | 75 |
| Lead-CeresClone538933 | GVVDVYIHQA | RDIHNICIYH | KQDVYAKICL | TSNPENIVST | KTINGGGRNP | 97 |
| CeresClone:470921 | GVLDVYIHQA | RDIQNICIYH | KQDVYAKISL | TSNPETIMST | KTINGGGRNP | 58 |
| Consensus | G-LDV-VHQA | RDIHNICIYH | KQDVYAKLCL | TS-P--S-ST | KVINGGGRNP | 100 |

| | | | | | | |
|---|---|---|---|---|---|---|
| CeresClone:1557119 | VFEESLRLDV | QT--VDA--- | ---------- | ---------- | ---------- | 104 |
| CeresClone:452749 | VFEESLRLDV | QT--VDASLK | CEIWMLSRVR | NYLEDQLLGF | ALVPLMDIL- | 136 |
| CeresClone:1367041 | VFDDNVKLDV | RV--LDTSLK | CEIYMMSRVK | NYLEDQLLGF | TLVPMSELL- | 147 |
| CeresClone:677448 | VFDQSVRVGV | RAGDVDAALR | CEVWMLSRVK | NYLQDQLLGF | ALVPLPDVVA | 118 |
| CeresClone:115393 | VFDDTLQFDV | KN--LDCSLK | CEIFMMSRVK | NYLEDQLLGF | SLVPLSEVI- | 106 |
| CeresClone:113269 | ---------- | ---------- | ----MMSRVK | NYLEDQLLGF | TLVPMSELL- | 25 |
| CeresClone:39481 | ---------- | ---------- | ----MMSRVK | NYLEDQLLGF | SLVPLSEVI- | 25 |
| CeresClone:763949 | V--------- | ---------- | ---------- | ---------- | ---------- | 76 |
| Lead-CeresClone538933 | VFNENLSLSV | RI--VDSMVK | CEIWMLSRVK | NYLEDQLLGF | ALVPLSEVLV | 145 |
| CeresClone:470921 | VFNENLRIDV | RT--VDASLK | CEIWMLSRVK | NYLEDQLLGF | ALVPLSEVL- | 105 |
| Consensus | VFDE-LRLDV | R---VD-SLK | CEIWM-SRVK | NYLEDQLLGF | -LVPLSEVL- | 150 |

```
CeresClone:1557119        ---------- ---------- ------LSSA RYGC------ ----------  112
CeresClone:452749         IGNGKLVQEF SLTSTDLFHT PAGFVHLSLS YAGCSPDVVL ISSPNN---S  183
CeresClone:1367041        FKNGKLEKEF SLSSTDLYHS PAGFVQLSLS YYGSYPDVMA IPSMPSSVSI  197
CeresClone:677448         AEGGTLAREF PLSTNDLFHS PAGFLELELS YIGVVPDVIP VSPTPK----  164
CeresClone:115393         VRNGKLEKEF SLSSTDLYHS PAGFVELSLS YAGDSPDVMH IPAVPT----  152
CeresClone:113269         FKNGKLEKEF SLSSTDLYHS PAGFVQLSLS YYGSYPDVMA IPSMPSSVSI  75
CeresClone:39481          VRNGKLEKEF SLSSTDLYHS PAGFVELSLS YAGDSPDVMH IPAVPT----  71
CeresClone:763949         ---------- ---------- ---------- ---------- ----------  76
Lead-CeresClone538933     KKDGKLEKEF SLSSTDLFHS PAGYVQLSLA YTGASPDVMA ISSMPT----  191
CeresClone:470921         VQNGKLEKEF SLSSTDLFHS PSGFVQLSLS YTGASPDVMA ISAMPNKVAT  155

Consensus                 -KNGKLEKEF SLSSTDL-HS PAGFVQLSLS Y-G-SPDVM- I-SMP-----  200

CeresClone:1557119        ---------- ---------- ---------- ---------- ----------  112
CeresClone:452749         PSTVYDSGID HVVPS----- ---QLEKIVF PDLNVEKEDE IMVSKYLEMT  225
CeresClone:1367041        DETTKDPEGS ESVSG----- ---------- ---------- ----------  212
CeresClone:677448         -PALADPDEC ENAGGCAGAG AGKDYENMEF PDMNLVEENQ IMLSEYVGLP  213
CeresClone:115393         ------ADET ELAPI----- ---EFDESEF LDPKIVCENN QMVSKYFSTT  188
CeresClone:113269         DETTKDPEGS ESVPG----- ---ELDKIEF PDPNVANENE KMVSEYFGCS  117
CeresClone:39481          ------ADET ELAPI----- ---EFDESEF LDPKIVCENN QMVSKYFSTT  107
CeresClone:763949         ---------- ---------- ---------- ---------- ----------  76
Lead-CeresClone538933     --TEKDSESC ESLVR----- ---DLDKIEF PDPKIVNEDH LMVSEYFGIP  231
CeresClone:470921         DGTVQDSDTS ESLAR----- ---DLDKIEF PDPKIVNEDH LMVSEYFGLR  197

Consensus                 --T--DSD-S ESV------- -----DKIEF PDP-IV-EN- -MVSEYF-I-  250

CeresClone:1557119        ---------- ---------- ---------- ---------- ----------  112
CeresClone:452749         SD-------- ---------- ---------- ---------- ----------  227
CeresClone:1367041        ---------- ---------- ---------- ---------- ----------  212
CeresClone:677448         CTAMETQSSE SLLTSEDVDG AATESHDAGV RVVQSFSTDY STADSAGAFR  263
CeresClone:115393         CSDSDDFASS ETGFVE---- --VNSILS-- ---------- --AVVETAVD  218
CeresClone:113269         CSTIDSETSD SLVTSD---- --AENHVT-- ---------- --NSVTSILK  147
CeresClone:39481          CSDSDDFASS ETGFVE---- --VNSILS-- ---------- --AVVETAVD  137
CeresClone:763949         ---------- ---------- ---------- ---------- ----------  76
Lead-CeresClone538933     CE--ESQCSD SLTTTD---- --TENLSSEA GVQLVESFSA CSV-------  266
CeresClone:470921         CE--ETQCSD SLATSD---- --AENHSSEA GVQLVESFSA CSVESVQPTK  239

Consensus                 C-------S- ---------- -------S-- ---------- ----------  300
```

```
CeresClone:1557119         ---------- ---------- ---------- ---------- ----------  112
CeresClone:452749          ---------- ---------- ---------- ---------- ----------  227
CeresClone:1367041         ---------- ---------- ---------- ---------- ----------  212
CeresClone:677448          SETAASSVST TESPAAAVPA TPQSNPSEPS GNALSSAGQK EKASDAAEVD  313
CeresClone:115393          EAAPANTVST NGISSPSTAV SS-GSSGTHD VSKQSSEGNN SDSEQEAKKP  267
CeresClone:113269          QDSPESSNAT NGAASPHASA HS-------- ATETPNHEHL SVVNSKAS--  187
CeresClone:39481           EAAPANTVST NGISSPSTAV SS-GSSRTHD VSKQSSEGNN SDSEQEAKKP  186
CeresClone:763949          ---------- ---------- ---------- ---------- ----------  76
Lead-CeresClone538933      -----SSVST NGVSSPSVAA SS-DS----- ---SPNEET- -----KEKNVD 297
CeresClone:470921          VDSPPSSVST NGVSSPSVPA NSESSDAAAA ASKSPI QEQV SGTKEDKNVD  289

Consensus                  -----SSVST NG-SSPS--- SS--S----- -S---S---- -----E----  350

CeresClone:1557119         ---------- ---------- ---------- ---------- ----------  112
CeresClone:452749          ---------- ---------- ---------- ----SETPIK VENGVSLHSA  243
CeresClone:1367041         ---------- ---------- ---------- ---------- ----------  212
CeresClone:677448          SSPTVQESPA VNSPSTVSEN AVDKPPPAMS FNFAEEVQVN QKEIMDMYMK  363
CeresClone:115393          TDIIKSGDLD KTDEEAV--- -----VKPVLT VHIEPEQKVV QQDIVDMYTK 310
CeresClone:113269          SQESESEASG ETSEEKT--- -----VKSVLT VKVEPESKVV QQDIVDMYMK 230
CeresClone:39481           TDIIKSGDLD KTDEEAV--- -----VKPVLT VHIEPEQKVV QQDIVDMYTK 229
CeresClone:763949          ---------- ---------- ---------- ---------- ----------  76
Lead-CeresClone538933      VKDGETDS-- -------SF-- -----PKPLVT VNIEPEPNVV QQDEVDMYMK 333
CeresClone:470921          AKDGESDSSC GVPIDSF--- -----PKPVVS VNIEPEPKVV QQDIVDMYMK 332

Consensus                  ----ES---- ---------- ------KPVLT VNIEPE-KVV QQDIVDMY-K 400

CeresClone:1557119         ---------- ---------- ---------- ---------- ----------  112
CeresClone:452749          NDDDVPSKLE KIKF-IDSES ---------- ---------- ----------  262
CeresClone:1367041         ---------- ---------- ---------- ---------- ----------  212
CeresClone:677448          SMQQFTESLA KMKLPLDMDN GSDKSGSGPA AASPTDSSGT DSSAATKKPT  413
CeresClone:115393          SLQQFTESLA KMKLPLDIDS -PTQSE---- ---------- -NSSSSQQT-  343
CeresClone:113269          SMQQFTDSLA KMKLPLDIDS -PTKSE---- ---------- -NSSSDSQKL  264
CeresClone:39481           SLQQFTESLA KMKLPLDIDS -PTQSE---- ---------- -NSSSSQQT-  262
CeresClone:763949          ---------- ---------- ---------- ---------- ----------  76
Lead-CeresClone538933      SMQQFTESLA KMKLPVDFES GPTSSG---- ---------- -NSSSEHKL-  367
CeresClone:470921          SMQQFTESLA KMKLPMDLES EPTSSG---- ---------- -NSTTEQKL-  366

Consensus                  SMQQFTESLA KMKLPLDIDS -PT-S----- ---------- -NSSS-----  450
```

| | | | |
|---|---|---|---|
| CeresClone:1557119 | ---------- | --------- | 112 |
| CeresClone:452749 | ---------- | --------- | 262 |
| CeresClone:1367041 | ---------- | --------- | 212 |
| CeresClone:677448 | AGAAQEKSPK | VFYGSRAFF | 432 |
| CeresClone:115393 | ---PKSASSR | VFYGSRAFF | 359 |
| CeresClone:113269 | PTPKSNNGSR | VFYGSRPFF | 283 |
| CeresClone:39481 | ---PKSASSR | VFYGSRAFF | 278 |
| CeresClone:763949 | ---------- | --------F | 77 |
| Leod-CeresClone538933 | -QTPKSTNSR | VFYGSRAFF | 385 |
| CeresClone:470921 | -QPSKSNNSR | VFYGSRAFF | 384 |
| Consensus | ----KS-NSR | VFYGSRAFF | 469 |

```
CeresClone:609713      MSGQ----RR SSRTSKFTEI EINELVSRLQ VLLLQVNQ-R GNSRQSASKI   45
gi|22331645            MSSRKSRSRQ -TGASMI TDE QI NDLVLQLH RLLPELANNR RSGKVSASRV   49
CeresClone:951040      MSNRRS--RQ SSSAPRI SDD QI DLVTKLR QI LPEI GQRR RSDKVSASKV   48
CeresClone:733804      MSSRRSRSRQ -SGSSRI TDE QI SDLVSKLQ DLLPEARL-R GNDRVPSSRV   48
gi|28416803            MSSRRSSRSR QSGSSRI SDD QI SDLVSKLQ HLI PELRR-R RSDKVSASKV   49
CeresClone:18200       MSSRRSSRSR QSGSSRI SDD QI SDLVSKLQ HLI PELRR-R RSDKVSASKV   49
CeresClone:703180      MSSRRS--RQ QSASTRI SDD QI DLVSKLR QLVPEI RD-R RSDKVSASKV   47
CeresClone:560681      MSSRRS--RQ QSASTRI SDD QI DLVSKLR QLVPEI RD-R RSDKVSASKV   47
CeresClone:562428      MSSRRS--RQ QSASTRI SDD QI DLVSKLR QLVPEI RD-R RSDKVSASKV   47
CeresClone:560948      MSSRRS--RQ HSGSTRI SDD QI ELVSKLR QLVPEI RN-R RSDKVSASKV   47
CeresClone:653656      MSSRRSRSRQ TSSSRNI TDD QI NDLVSKLQ QLLPEI RD-R RSDKVSASKV   49
CeresClone:663844      MSSRRSRSRQ TSSSRNI TDD QI NDLVSKLQ QLLPEI RD-R RSDKVSASKV   49
Lead-CeresClone519     MSGRRSRSRQ SSGTSRI SED QI NDLI KLQ QLLPELRDSR RSDKVSAARV   50
CeresClone:1247092     MSGRRSRSRQ SSG---- SED QI NDLI KLQ QLLPELRNSR RSDKVSASRV   47

Consensus              MSSRRS--RQ -SGSSRI SDD QI NDLVSKLQ QLLPEI RD-R RSDKVSASKV   50

CeresClone:609713      LQETCCYI RK LQEEVEQLSE RLSELMDSVD I SDI DRRTLQ NLLQQY   91
gi|22331645            LQETCSYI RN LSKEVDDLSE RLSQLLESTD --SAQAALI R SLLMQ-   92
CeresClone:951040      LQETCNYI RN LNREVDNLSE RLAQLLESVD EDSPQAAVI R SLLM--   92
CeresClone:733804      LQETCTYI RS LHREVDDLSE RLSELLATSD MSSAQAATI R SLLM--   92
gi|28416803            LQETCNYI RN LHREVDDLSD RLSELLASTD DNSAEAAI I R SLLNY-   94
CeresClone:18200       LQETCNYI RN LHREVDDLSD RLSELLASTD DNSAETAI I R SLLNY-   94
CeresClone:703180      LQETCNYI RS LHREVDDLSE RLSQLLATI D ADSPEAAI I R SLI N--   91
CeresClone:560681      LQETCNYI RS LHREVDDLSE RLSQLLATI D ADSPEAAI I R SLI N--   91
CeresClone:562428      LQETCNYI RS LHREVDDLSE RLSQLLATI D ADSPEAAI I R SLI N--   91
CeresClone:560948      LQETCNYI RG LHREVSDLSE RLSQLLTTI D ADSAEAGLI R SLLNQ-   92
CeresClone:653656      LQETCNYI RS LHREVDDLSE RLSELLATTD --TAQAAI I R NLLMQ-   92
CeresClone:663844      LQETCNYI RS LHREVGDLSE RLSELLDTTD --TAQAAI I R NLLMQ-   92
Lead-CeresClone519     LQDTCNYI RN LHREVDDLSE RLSELLANSD --TAQAALI R SLLTQ-   93
CeresClone:1247092     LQETCNYI RN LHREVDDLSE RLSELLANTD --TAQAALI R SLLTQ-   90

Consensus              LQETCNYI R- LHREVDDLSE RLSELLATTD --SAQAAI I R SLL-Q-   96
```

```
Lead-CeresClone14033   MLRR--RLLS IISTSLINSS FHQTAKPRFI ISSPLLQCRP SPISTQIPTS   48
gi|50508079            MWRRASHLLR ATATATATAV SRRVPHPHPA PATAISTVLP APKLASSLSY   50
Consensus              M-RRAS-LL- ---T------ ------P--- ---------P -P--------   50

Lead-CeresClone14033   TSRALSFQGI RAY------- SLLSLNDLRD NV-PRKLKTR KGRGIGSGKG   90
gi|50508079            ATQAAAAAAV PAARAPRTVG SLLRLNDLRD NPGARKQKTR KGRGIGSGKG  100
Consensus              ---A------ -A-RAPRTVG SLL-LNDLRD N-G-RK-KTR KGRGIGSGKG  100

Lead-CeresClone14033   KTAGRGHKGQ KARGTMKFGF EGGQTPLRRR LPKRGFKNKF KLHFQPVGLG  140
gi|50508079            KTAGRGHKGQ KARGTARFGF EGGQTPLRRR LPRRGFKNRF SLTFQPCGLG  150
Consensus              KTAGRGHKGQ KARGT--FGF EGGQTPLRRR LP-RGFKN-F -L-FQP-GLG  150

Lead-CeresClone14033   KIAKLINAGK IDSHELITMK TLKDVGAIGK QIEDGVRLMG RGADDIKWPL  190
gi|50508079            KIAKLINAGK IDSSELITMK TLKDTGAIGK QIKDGIRLMG RGAEEIKWPI  200
Consensus              KIAKLINAGK IDS-ELITMK TLKD-GAIGK QI-DG-RLMG RGA--IKWP-  200

Lead-CeresClone14033   HFEVSRVTVR AKEVVEAAGG SVRRVYYNKL GLRALLKPEW FEKKGRLLPK  240
gi|50508079            HLEVSRTTAR AKAAVEAAGG TVRLVYYNNL GFRALLKPEW FAKKGRLLPK  250
Consensus              H-EVSR-T-R AK--VEAAGG -VR-VYYN-L G-RALLKPEW F-KKGRLLPK  250

Lead-CeresClone14033   AARPPPKQQD KVDSIGRLPA PKKPIPFFAA EETKVESPVE S-----   281
gi|50508079            AARPPPKQRD KVDSIGRLPA PTKPLP-FTP EELEFAAKRE AARVIA   295
Consensus              AARPPPKQ-D KVDSIGRLPA P-KP-PFF-- EE-------E -ARVIA   296
```

```
CeresClone:1573884      MATCVLLMLR EVSPWALASV VASVSLLMLV VWTLEWAMWT PWRLERALRV   50
Lead-CeresClone32574    ---------M EI SVASVTVS VAVVVVSWWV WRTLQWVWLK PKMLESYLRR   41
CeresClone:1012695      ---------M EI SVASVTIS VVLAVVSWWI WRTLQWVWFK PKMLEHYLRR   41
CeresClone:479101       -----MEAPW ATTSSSIVFM IVILALTSWA WRMLNWLWIR PKRLERLLRE   45
CeresClone:546712       ---------- ---------M LILILALIWV WKKFNSLWLT PKRLEKLLRE   31

Consensus               ---------- EVS-ASV--V VVLVV-SWWV WRTLQW-WLK PKRLER-LR-   50

CeresClone:1573884      QGLKGTRYRL FTGDLREIAR ANREARKKPL PLGSHDIAPR VQPMHHSTIK  100
Lead-CeresClone32574    QGLAGTPYTP LVGDLKRNFS MLAEARSKPI NL-TDDITPR IVPYPLQMLK   90
CeresClone:1012695      QGLAGTPYTP LVGDLKKNFS MLSEARSKPL KL-TDDISPR VVPYPLQMFK   90
CeresClone:479101       QGLQGNPYRI LVGDLKEIVK LQMEARSKPM NL-SHDIVPR VFAHLHQSVL   94
CeresClone:546712       QGLRGSPYRF KVGDFKETLK MQMQAMSKPM NLFSNDIGPR VSPYDHYIVN   81

Consensus               QGL-GTPYR- LVGDLKE--K M--EARSKP- NL-S-DI-PR V-PY-HQMIK  100

CeresClone:1573884      EYGKLSFTWF GPTPRVMIPD PELVKEVLSN KFGHFGKPRS NRIGRLLANG  150
Lead-CeresClone32574    THGRTFFTWF GPIPTITIMD PEQIKEVF-N KVYDFQKAHT FPLGRLIAAG  139
CeresClone:1012695      TYGRTYFTWF GPIPTITIMD PEQIKEVF-N KVYDFQKPHT FPLATIIAKG  139
CeresClone:479101       KHGKNSFIWF GPKPRVTLTD PELIKDVL-N KISDFRKPEA NPLAKLLATG  143
CeresClone:546712       KHGKNSFIWN GQTPRVTLTD PELIKDVF-N KIYDFGKPNM GPNIRSLIPG  130

Consensus               KHGK-SFTWF GP-PRVTI-D PELIKEVF-N K-YDFQKPH- -PL-RLLA-G  150

CeresClone:1573884      LVNHDGEKWA KHRRILNPAF HHEKIKGMMP VFSTCCLEMI TRWDNSMPSE  200
Lead-CeresClone32574    LVSYDGDKWT KHRRIINPAF HLEKIKNMVP AFHQSCSEIV GEWDKLVTDK  189
CeresClone:1012695      LANYDGDKWA KHRRIINPAF HIEKIKNMVP AFHQSCREVV GEWDQLVSDK  189
CeresClone:479101       LVNYDGEKWN KHRRLINPAF SLEKLKIMLP IFFKSCNDLI IKWEGMLSYD  193
CeresClone:546712       LAMHEGEKWS KHRKIINPAF NLEKLKNMLP LFIQCCDDLI SKWEEMLSSD  180

Consensus               LVNYDGEKW- KHRRIINPAF HLEKIKNM-P -F-QSC-ELI --WD----S-  200
```

```
CeresClone:1573884      G-SSEIDVWP EFQNLTGDVI SRTAFGSNYQ EGRRIFELQG ELAERLIQSV 249
Lead-CeresClone32574    QSSCEVDIWP WLVSMTADVI SRTAFGSSYK EGQRIFELQA ELAQLIIQAF 239
CeresClone:1012695      GSSCEVDVWP GLVSMTADVI SRTAFGSSYK EGQRIFELQA ELAQLIIQAF 239
CeresClone:479101       G-SCEMDVWP FLQNLASDVI ARTAFGSSFE EGKRIFQLQK ELAELTMKVI 242
CeresClone:546712       G-SSEIDVWP FVKNLTADVI SRTAFGSSYL EGRRIFQLLK EKIELFLK-- 227

Consensus               G-SCE-DVWP WLQNLTADVI SRTAFGSSYK EG-RIFELQ- ELAELIIQA- 250

CeresClone:1573884      QTIFIPGYWF LPTKNNRRMR AIDVEIRKIL REIIGKREKD TKNRETNNDD 299
Lead-CeresClone32574    RKAIIPGYRY LPTKGNRRMK AAAREIKFIL RGIVNKRLRA RDLGK----- 284
CeresClone:1012695      RKAFIPGYSY LPTKSNRRMK AAAREIQVIL RGIVNKRLRA REAGEAPSDD 289
CeresClone:479101       MKVYIPGWRF VPTATNRRMK EIDRYIKASL TDMIKKREKA PKTGEATRDD 292
CeresClone:546712       ----MRGQRL VP----KRMK EIDRDIKASL MDIINKRDKA LKAGEATKNN 269

Consensus               RK-FIPGYR- LPTK-NRRMK AIDREIK-IL RDIINKREKA -K-GEA--DD 300

CeresClone:1573884      LLGLLLESNT RQSN---GNA SLGLTTEDVI EECKLFYFAG METTSVLLTW 346
Lead-CeresClone32574    ---------- ---------- ---------- ---------- ---HQVTICW 291
CeresClone:1012695      LLGILLESNL RQTE---GN- --GMSTEDLM EECKLFYFAG QETTSVLLVW 333
CeresClone:479101       LLGILLESNH KEIQEHRNNE NVGMNLNDVI EECKLFYFAG QETTSVLLVW 342
CeresClone:546712       LLDILLESNH KEIEEHGNNK NVGMNIEEVI EECKLFYFAG QDTTSVLLVW 319

Consensus               LLGILLESN- ---E----N- NVGM--EDVI EECKLFYFAG QETTSVLLVW 350

CeresClone:1573884      TLIVLSMHPE WQERAREEVL SHFGRTTPDY DSLSRLKITI MILHEVLRLY 396
Lead-CeresClone32574    VYFL---NRI WDKQ------ ---------- ---------- ---------- 302
CeresClone:1012695      TMVLLSQHQD WQARAREEVK QVFGDKEPDA EGLNQLKVMT MILYEVLRLY 383
CeresClone:479101       TMVLLSRYPD WQSRAREEVL QVFGKQAPNF DGLSHLKIVT MILYEVLRLY 392
CeresClone:546712       TMILLSRYPD WQARAREEVS QVFGNQKPTF DGLNQLKIVT MILYEVLRLY 369

Consensus               TM-LLSR-PD WQARAREEV- QVFG-Q-PDF DGL-QLKVVT MILYEVLRLY 400
```

```
CeresClone:1573884     PPATFLTRRT YKEMELGGLK YPAGVDLLLP VIFLHHDPDI WGKDASEFNP  446
Lead-CeresClone32574   ---------- -KEME----- ---------- ---------- ----------  306
CeresClone:1012695     PPVTQLTRAI HKELKLGDLT LPGGVQISLP ILLVQHDIEL WGNDAAEFNP  433
CeresClone:479101      PPGIGLTRSV HRDMKLGNLT LPAGVQVSLP IIMVHHDREL WGDDAKEFNP  442
CeresClone:546712      PPGVGVPRKV IKDVKLGNLS FPAGVEIFIS TILVHHDSEL WGDDAKEFKP  419

Consensus              PP---LTR-V HKEMKLGNLT -PAGV-I-LP VILVHHD-EL WGDDA-EFNP  450

CeresClone:1573884     ERFANGISSA IRHQAAFFPF GGGPRICIGQ SFALLEAKMT LCTILQRFSF  496
Lead-CeresClone32574   ---------- ---------- ---------- ---------- ----------  306
CeresClone:1012695     DRFKDGLSKA TKSQVSFFPF AWGPRICIGQ NFALLEAKMA MALILRRFSF  483
CeresClone:479101      ERFSEGVSKA TNGRVSFFPF GWGPRICIGQ NFSLLEAKMA LSMILQHFSF  492
CeresClone:546712      ERFSEGVLKA TNGRFSFFPF GGGPRICIAQ NFALLEAKIA LSMILQCFSF  469

Consensus              ERFS-GISKA T----SFFPF G-GPRICIGQ NFALLEAKMA LSMILQ-FSF  500

CeresClone:1573884     ELSPSYTHAP YTVITLHPQH GAQIRLKKLS P--  527
Lead-CeresClone32574   ---------- ---------- ---------- ---  306
CeresClone:1012695     EISPSYMHAP YTVITIHPQF GAQLIMHKL- ---  512
CeresClone:479101      ELSPAYTHAP FTVITLQPQY GAHVILRKVE M--  523
CeresClone:546712      ELSPTYTHAP TMVMTIQPQY GAPVILHKVE KYE  502

Consensus              ELSPSYTHAP YTVIT--PQY GA-IIL-K-- ---  533
```

```
gi|53749401            MAAAAASPTS SSSLPPKPPN SAAMLVEQQP LSYHDVDAAS TPSSSVSSSS  50
gi|1935918             --MLLESDGE MSL------- ---------- ----ETTNSP ISSGTESC--  25
CeresClone:142380      --MLRESDGE MSL------- ---------- ----GTTNSP ISSGTESC--  25
CeresClone:1361030     MLDTAERDSE VSL------- ---------- ----ETVYSS TLGSSMSS--  27
Lead-CeresClone609573  METGGGRDSG MSS------- ---------- ----ETINSS TQRTSMSN--  27
gi|45271576            ---------- MSL------- ---------- ----ETVNSN TQRTSLSSAT  19

Consensus              M----ESDSE MSL------- ---------- ----ETVNSS T-S-SMSS--  50

gi|53749401            TASVGGRSST FSLDSAAFA- --TPT---SS PPRPHRAADV AWAPTRAA-A  93
gi|1935918             -----SSFSR LSFDAPPSTT AIIPEEESCL SLKPHRSSDF AYAEILRRRK  70
CeresClone:142380      -----SSFSR LSFDAPPST- --IPEEESFL SLKPHRSSDF AYAEIRRRKK  67
CeresClone:1361030     ESICSTSFSR LSFDLLPP-- --SPE---TL SIKPHRSSDF AYSAAFRR-K  69
Lead-CeresClone609573  ESVCSTSFSR LSFDLPPPSS --SPE---TL FVKPHRSSDF AYSAILRR-K  71
gi|45271576            ESICSTSFSR LSFELLPSS- --SPE---SL SIKPHRSSDF AYSAI--R-K  60

Consensus              ESICSTSFSR LSFD-PPS-- --SPE----L S-KPHRSSDF AY-AI-RR-K  100

gi|53749401            APLGPRDFTL VRRVGAGDIG TVYLCRLDGK ------RCAG SPSPCEY-AM  136
gi|1935918             HSLTFRDFRL MRRIGAGDIG TVYLCRLACD ---------Q EESRSSYFAM  111
CeresClone:142380      QGLTFRDFRL MRRIGAGDIG TVYLCRLACD ---------E EESRSSYFAM  108
CeresClone:1361030     AALTFRDFHL LRRIGAGDIG TVYLCRLHNS NQLKNQDEDE EDVSCLY-AM  118
Lead-CeresClone609573  SALTFRDFHL LRRIGAGDIG TVYLCRLRHD ----AGDEDD DEDPCFY-AM  116
gi|45271576            SGLTFRDFHL LRRIGSGDIG TVYLCRLRDS ----SVNYIN DEDSSFYYAM  106

Consensus              -ALTFRDFHL MRRIGAGDIG TVYLCRL--D ------D--E EES---YFAM  150

gi|53749401            KVVDRRALAK KGKLGRAAAE KRVLRRLDHP FLPTMFADFD AGQDYSCVVM  186
gi|1935918             KVVDNEALAM KKKMHRAEME KKILKMLDHP FLPSLYAEFE AS-HFSCIVM  160
CeresClone:142380      KVVDKEALAL KKKMHRAEME KTILKMLDHP FLPTLYAEFE AS-HFSCIVM  157
CeresClone:1361030     KVVDKDAVAL KKKSQRAEME KKILKMLDHP FLPTLYAEFE AS-HFSCIVM  167
Lead-CeresClone609573  KVVDKEAVAL KKKAQRAEME RKILKMVDHP FLPTLYAEFE AS-NFSCIVM  165
gi|45271576            KVVDKDAVAL KKKSHRAEME RKILKMLDHP FLPSLYAEFE AS-NFSCIVM  155

Consensus              KVVDKEA-AL KKK-HRAEME KKILKMLDHP FLPTLYAEFE AS-HFSCIVM  200
```

```
gi|53749401            EFCPGGDLHS LRHRVPGRRF PVASARFYAA EVLLALEYLH NMGIVYRDLK 236
gi|1935918             EYCSGGDLHS LRHRQPQHRF SLSSARFYAA EVLVALEYLH MLGIIYRDLK 210
CeresClone:142380      EYCSGGDLHS LRHRQPHRRF SLSSARFYAA EVLVALEYLH MLGIIYRDLK 207
CeresClone:1361030     EFCSGGDLHS LRFKHPHNRF PLSSARFYAA EVLVALEYLH MLGIIYRDLK 217
Lead-CeresClone609573  EYCSGGDLHS LQHNHPNNRF SLSSARFYAA EVLVALEYLH MLGIIYRDLK 215
gi|45271576            EFCSGGDLHS LRHRHPRNRF SLSSARFYAA EVLVALEYLH MLGIIYRDLK 205

Consensus              E-CSGGDLHS LRHRHPHNRF SLSSARFYAA EVLVALEYLH MLGIIYRDLK 250

gi|53749401            PENVLIRADG HIMLTDFDLS LESIASPALE DARN---GAD DDPATPTCLP 283
gi|1935918             PENILVRSDG HIMLSDFDLS LCSDSIAAVE SSSS------ -TPENYPHSS 253
CeresClone:142380      PENILVRSDG HIMLSDFDLS LCSDSIAAVE SSSS------ -SPENQQLRS 250
CeresClone:1361030     PENVLVRSDG HIMLSDFDLS LYSEAIPAVE SSPDSLPSSN ALPLPYAYTR 267
Lead-CeresClone609573  PENVLVRSDG HIMLSDFDLS LCSDAIPAVE -SPD---CSL DPAFAPALRY 261
gi|45271576            PENVLVRSDG HIMLSDFDLS LCSHAIPAVE LSPD------ DPPLDVSCTR 249

Consensus              PENVLVRSDG HIMLSDFDLS LCSDAIPAVE SSPD----S- D-P-N---T- 300

gi|53749401            EVQL-FRLRR WRRRAAPRRR PR-------F VAEPVDARSS SFVGTHEYVA 325
gi|1935918             PRRL-TRLAK LFNRVLRSKK VQTLEPNRLF VAEPVTARSG SFVGTHEYVA 302
CeresClone:142380      PRRF-TRLAR LFQRVLRSKK VQTLEPTRLF VAEPVTARSG SFVGTHEYVA 299
CeresClone:1361030     SHSFMSPFSC FSNR---SRE VRTIEPNRLF VAEPVSARSC SFVGTHEYVS 314
Lead-CeresClone609573  TRQYSTPFSC LSNRVFRSRK VQTLQPNRLF VAEPVGARSC SFVGTHEYVS 311
gi|45271576            PHSISSPFRC LSKRLFRSRK VQTFQSNRLF VAEPVEARSC SFVGTHEYVS 299

Consensus              PR---T---- LS-RV-RSRK VQTLEPNRLF VAEPVTARSC SFVGTHEYV- 350

gi|53749401            PEVARSGGHG AGVDWWAYGV FLYELLYGRT PFVGATNEAT LRNIVRRPLE 375
gi|1935918             PEVASGGSHG NAVDWWAFGV FLYEIIYGRT PFAAPTNDVI LRNIVKRPLS 352
CeresClone:142380      PEVASGGSHG NAVDWWAFGV FLYEMIYGKT PFVAPTNDVI LRNIVKRQLS 349
CeresClone:1361030     PKVASGRSHG NAVDWWSFGV FIYELIYGRT PYAGPSKEAT LRNIVKKPLA 364
Lead-CeresClone609573  PEVASGNSHG NAVDWWSFGI FIYEMVYGRT PFAGSSNEAT LRSIIKKPLA 361
gi|45271576            PEVASGNSHG NAVDWWSFGI FIYEMVYGRT PFAGPSNEAT LRNIIKKPLS 349

Consensus              PEVASGGSHG NAVDWW-FGV F-YEMIYGRT PFAGP-NEAT LRNIVK-PLS 400
```

```
gi|53749401              FPPDAAGGCS PHDAAARDLI ARLLDKDPRS RLCSRRGAAD VKSHAFFKGL  425
gi|1935918               FPTDSP--AT MFELHARSLI SGLLNKDPST RLGSRRGAAE VKVHPFFKGL  400
CeresClone:142380        FPTDSP--AT MFELHARNLI SGLLNKDPTK RLGSRRGAAE VKVHPFFKGL  397
CeresClone:1361030       FPTATP--TS NLELHARDLI SGLLNKDPAR RLGSKRGAAD VKKHPFFKGL  412
Lead-CeresClone609573    FPTSTP--SS TLEMHARDLI SGLLNKDPNR RLGSKRGSAD VKKHPFFAGL  409
gi|45271576              FPTATP--SS TLEMHARDLI SGLLNKDPNR RLGLKRGAAD VKMHPFFVGL  397

Consensus                FPT-TP---S -LELHARDLI SGLLNKDP-R RLGS-RGAAD VKVHPFFKGL  450

gi|53749401              NFALLRSSAP PVVPP----- PAVAAAQCSK AAD------- -VPQ-LFDLF  461
gi|1935918               NFALIRTMTP PEVPSD-VRR PKKSATFGGR SS-------- -KPA-AFDFF  439
CeresClone:142380        NFALIRTLTP PEIPSSVVKK PMKSATFSGR SSN------- -KPA-AFDYF  438
CeresClone:1361030       NLALIRMQTP PEVPG--SRR RTKTTSLYPV KGNGNNNHKQ QQTA-SFDFY  459
Lead-CeresClone609573    NLALIRTVTP PEVPS--LRR HKTTPFYYPA NVNNSR---- QQLT-AFDYF  452
gi|45271576              NLALIRMVTP PEVPG--LRR NKTIPFVSGK DSNGNRSSSK QHPASSFDYF  445

Consensus                N-ALIRTMTP PEVPS---RR PKKTA-F-G- SSN-N----- Q-PA-AFDYF  500

gi|53749401              461
gi|1935918               439
CeresClone:142380        438
CeresClone:1361030       460
Lead-CeresClone609573    452
gi|45271576              445

Consensus                501
```

```
CeresClone:1072510         MNSNSN---- -----VGGGFR SRLNHYLYSG DKKHVFVGLT LITAVFTIPW   42
CeresClone:636196          MNSNSNSN-- -----VGGGFR SRLNHYLYSG DKKHVFVGLT LITAVFTIPW   44
CeresClone:299189          M--------- ----------- ---EHYLYSG EKKHVVAGIA IFAAVFGVPW   28
CeresClone:870660          MGGEGASS-- -----SGGGFR ARIDHYLYSG EKKHVVAGIA IFAAIFGVPW   44
CeresClone:1053154         MGGEGASS-- -----SGGGFR ARIDHYLYSG EKKHVVAGIA IFAAIFGVPW   44
CeresClone:568747          MGGEGASS-- -----SGGGFR ARIDHYLYSG EKKHVVAGIA IFAAIFGVPW   44
CeresClone:30167           M--------- ----------- ---EHYVYSG EKKHVLVGIG IVTIFGVPW    28
CeresClone:154257          M--------- ----------- ---EHYVYSG EKKHVLVGIG IVTIFGVPW    28
CeresClone:1088403         MGNETKGNGA SSLGGGGGFR  AKMEHYVYSG EKKHVLAGIG IFTVIFGIPW   50
Lead-CeresClone266142      MGNESKSN-- ----LGGGGFR AKMEHYVYSG EKKHVLAGIG IISIFGIPW    45

Consensus                  MG-E--S--- -----GGGFR  ARLEHYLYSG EKKHV-AGI- I-TAIFGVPW   50

CeresClone:1072510         YFMSRGT-KH QSHQDYLEKA DKARSQRLSS SS--ASAK   77
CeresClone:636196          YFMSRGT-KH QSHQDYLEKA DKARSQRLSS SS--ASAK   79
CeresClone:299189          YFMTRGA-KH QSHQDYMEKA NKARSERLSS GQSSALKE   65
CeresClone:870660          YLMTRGA-KH DSHQDYVERA NKARSDRLSS GQPSSLKE   81
CeresClone:1053154         YLMTRGA-KH DSHQDYVERA NKARSDRLSS GQPSSLKE   81
CeresClone:568747          YFMTRGA-KH DSHQDYMERA NKARSDRLSS GQPSSLKE   81
CeresClone:30167           YLMTQGS-KH QSHQDYMDKA DKARKARLSS SS--SANK   63
CeresClone:154257          YLMTQGS-KH QSHQDYMDKA DKARKARLSS SS--SANK   63
CeresClone:1088403         YLMNRGSNNH RSHQDYMEKA DKARKARLSS SPSPSSDK   88
Lead-CeresClone266142      YLMNQGS-KH RSHQDYLEKA DKARKARLSS SS--SSDK   80

Consensus                  YLMTRG--KH QSHQDYMEKA DKARS-RLSS SS--SS-K   88
```

```
CeresClone:591984          MEAYYSGSYP ASTKP----- ISLLHTVRKV QAKPWKKAAV APPAPTPIRV  45
CeresClone:879739          MDHLLHHGHE M-RRPSVPGH EAALRAVQKP PAKPWRAGGG LTPAPTPPKV  49
Lead-CeresClone248859      MEATSQPCFS H--------- NSSLHSTRKQ PANPWKKPVT GLPQRMHPKV  41
CeresClone:1126651         MEATSQPCFS HNYRRSSENY NSSLHSTRKQ PAKPWKRPVT ASLQRMHPRV  50

Consensus                  MEATSQPCFS H--RPS---- NSSLHS-RKQ PAKPWKKPVT A-P-----P-V  50

CeresClone:591984          YKVDAINFRD LVQQLTGAPE FKPADQEQHQ LFPSVAPIAA TFVDTPQKPM  95
CeresClone:879739          YRVEPREFRD LVQRLTGAPA AAMARQHQHT HQLQRAP--- -------TQPV  90
Lead-CeresClone248859      YRVEPVNFKE LVQRLTGAED VE---QEVHQ VE-------- --------AKPV  74
CeresClone:1126651         YRVEPVNFKE LVQSLTGAPQ DH-ERDQVHQ VETKPLLKMQ HGLVEVRQPL  99

Consensus                  YRVEPVNF-- LVQRLTGAP- ---ARQE-HQ VE---AP--- ---------PV  100

CeresClone:591984          LSSKD-NIA- ---ASSTVSS ATNMYQGAKS EPLEMNLSSP SSL  133
CeresClone:879739          PVRPG----- ----GVEDAAA GGQMYAPWCS FPL-MGP--- ---  118
Lead-CeresClone248859      KISDDTTTAK DNPFAFDLSP SSSRF--WEA FPL-LSPANL SRW  114
CeresClone:1126651         KIFHE-TTTQ ENPVAFDLSP SSSRF--WEA FPL-LSPANL SRW  138

Consensus                  KIS-DTTTA- -NP-AFDLS- SSSR---WE- FPL--SPANL SRW  143
```

```
Lead-CeresClone121021  ---------- ---------- ---MENGGTI PGQEIGSGLQ KPVNPDGFVT   27
CeresClone:1121512     MAEIPKLDLS SSCFDNGEPL DSEQKSQKIF VSDHINAFQY ADEKADSFV-   49
CeresClone:1046846     ---------- ---------- ---MGTQRIL VSDHINAYQY SAEEADSFV-   26

Consensus              ---------- ---------- ---M--Q-I- VSDHINA-QY --E-ADSFV-   50

Lead-CeresClone121021  IDVESFSSVI HKDFSSSSPR ITLQRNVSRK GSPRSNNERK LHFDANGNDK   77
CeresClone:1121512     IDMDAFSSGH NKDATNANSR ITLQRSLSRK GSQRL-GDMK LNNNATLYDK   98
CeresClone:1046846     IDMDSFSSGI NKDSNNANSR ITLQRSLSRK GSQRG-GDRK VNGNVTLHDR   75

Consensus              IDMDSFSSGI NKD--NANSR ITLQRSLSRK GSQR--GDRK LN-NATL-DK  100

Lead-CeresClone121021  E----ISFPQ SPLRGSSTPE KAS--TVGPT EHAGTATTAA TAVSASPLHQ  121
CeresClone:1121512     DTVPAICSPK XTLVGPFTPE KPAGMAVGPM GHS------- --MNPHVH--  137
CeresClone:1046846     DTAPTTCSPK AALAGSCTAE KSAVVAVGST HHS------- --TNTQVHHQ  116

Consensus              DT-P-ICSPK --L-GS-TPE K-A--AVGPT -HS------- ---N--VHHQ  150

Lead-CeresClone121021  ITVTTAATAA GNMTFDQNRE RRFGFSRKSS FKRSHTSWML DPKKIVLFFA  171
CeresClone:1121512     ------NLTA DNIPTESKC- ---SITRRNS FRRP-SSWAI DPKRVLLFFA  176
CeresClone:1046846     ITITASNMCT TTTPTTESK- ---CITRRNS FKRS-SSWLL DPKRVLLFFA  161

Consensus              IT-T--N--A -N-PT----- ----ITRRNS FKRS-SSW-L DPKRVLLFFA  200

Lead-CeresClone121021  TLSSMGSILL ILFTLSISKS NPGDMPLD-- -   199
CeresClone:1121512     TLSSMGTMLL IYFTLTISKQ SAEEYGG--- -   203
CeresClone:1046846     TLSSMGTMLL IYFTLTLSKQ NADEYGGDWQ Q   192

Consensus              TLSSMGTMLL IYFTLTISKQ NA-EYGGD-- -   231
```

```
gi|22325451            MAKSFLMVML ASMVMFYMAC PIYSQK---- --NISEDIDI APT-------  37
gi|22325449            MAKSILMAIL VSILTFSMVC LICSQKIHHY SKEISEDVDI SPT-------  43
gi|15220221            MTKTLLMVTL VSIVMFYMAR PIFSQEIDPY SLEVLEDVAL SSSSKFNIYV  50
gi|7267642             MFDPTYIEHL YHNIP--SEC WLVAEN---- --EIHEDVAI SPT-------  35
gi|8953752             MAKSLLMVML VSIVMFYMAC PILSQ----- --EVHEDVMI SPT-------  36
gi|18413965            MAKSLLMVML VSIVMFYMAC PIFSQ----- --EIHEDVAI SPT-------  36
gi|18413969            MAKSLLMVML VSIVMFYMAC PIFSQ----- --EIHEDVAI SPT-------  36
gi|15220229            ---------- -------MAR PIFSQEIDPY SQEVPKDVAI SPSSKFDIYV  33
gi|25405889            MAKSLLMVML VSIVMFYMAR PICSQKINPH SQEMPEDVAI SPSSDFD-YV  49
Lead-CeresClone115966  MAKSLLIVML MSIVMFYMAR PIFSQKINPY LEVMPEDVTI SPSSDFD-YV  49
gi|10998140            MAKSLLIVML MSIVMFYMAR PIFSQKINPY LEVMPKDVTI SPSSNFD-YV  49

Consensus              MAKSLLMVML VSIVMFYMAC PIFSQKIN-Y --EI-EDVAI SPT-------  50

gi|22325451            ------SVEG ADLPTTEYEI ELAHRLHE-- -DYILACPKK PSSKCDDEIF  78
gi|22325449            ------SVEG ADSPTTEYEI KLAHRLHE-- -DYILACPKK PSSKCDDEIF  84
gi|15220221            EAPDEALFEE ADSPAIEYDK D---RY--KI PDFIAACAMK QSWICLNVVF  95
gi|7267642             ------PFEE ANSPAMEYDK KLP-HYSQKV FDFLETCAEK PSSICGGEIF  78
gi|8953752             ------PFEK AISPAMEYEM KLP-HYSQKQ YDFLEACVEK PSSICGGEIF  79
gi|18413965            ------PFEE ANSPAMEYDM KLP-HYSQKQ YDFLEACVEK PSSICGGEIF  79
gi|18413969            ------PFEE ANSPAMEYDM KLP-HYSQKV FDFLETCAEK PSSLCGGEIF  79
gi|15220229            EAPGEAPFEE ADSPAMEYDR ELAHHYSHKQ LDFLEACSEK PSSKCGNEVF  83
gi|25405889            EAPDEAPFEE ADSPAMEYDR ELAHHYSDKQ LKFLEACSEK PSSKCGNEVF  99
Lead-CeresClone115966  EAPYEAPFEE ADSPAMEYDM ELAHHYSDKQ FKFLEACSEK PSSKCGNEVF  99
gi|10998140            EAPDEAPFEE ADSPAMEYDM ELAHHYSDKQ LKFLEACSEK PSSKCGNEVF  99

Consensus              ------PFEE ADSPAMEYDM -LAHHYS-KQ -DFLEACAEK PSSKCGNEIF 100
```

| | | |
|---|---|---|
| gi\|22325451 | NNMMDGTIPV ISECCRDI LK TGKDCHLALV KI VFSTDGYK S-KASRAI PK | 127 |
| gi\|22325449 | QNMLDGTTPV TNECCLDI LK TGKDCHLALV KI I FSTDDYK N-I ASRAI PK | 133 |
| gi\|15220221 | ENMKDEMMPI INECCREI LK MGKDCHFRLV EGWSAMYVYG NSI ASKDI PY | 145 |
| gi\|7267642 | QNVLDAITLV TDKCCRDI LK I GKDCHLGLI KI FFSSYEYK N-I AS--I PR | 125 |
| gi\|8953752 | QNVLDETNLV TDKCCRNI LK I GKDCHLGLM KI LFSSYEYK N-I AS--I PR | 126 |
| gi\|18413965 | QNVLDAITLV TDKCCRDI LK I GKDCHLGLI KI FFSSYEYK N-I AS--I PR | 126 |
| gi\|18413969 | QNVLDAITLV TDKCCRDI LK I GKDCHLGLI KI FFSSYEYK N-I AS--I PR | 126 |
| gi\|15220229 | KNMLDETVPI TDECCRDI LK I GKDCHLGLV KLI FATYEYK N-KASKGI PK | 132 |
| gi\|25405889 | KNMLNETMPI TEECCRDI LK MGKDCHLGLV KLI FATYEYK N-I ASKGI PK | 148 |
| Lead-CeresClone115966 | KNMLNETMPI TEECCRDI LK MGKDCHLGLV KLI FATYEYK N-I ASKGI PK | 148 |
| gi\|10998140 | KNMLNETNLI TEECCRDI LK MGKDCHLGLV KLI FATYEYK N-I ASKGI PK | 148 |
| Consensus | QNMLDET-PV TDECCRDI LK MGKDCHLGLV KI I FSTYEYK N-I ASK-I PK | 150 |

| | | |
|---|---|---|
| gi\|22325451 | SKQTWNDCVR RVGMEI GAPV TFEA | 151 |
| gi\|22325449 | SKQTWNDCAR RVSKEI GAPI SFEQ | 157 |
| gi\|15220221 | SKQSWNECVR RVGSKFGAPV SFEQ | 169 |
| gi\|7267642 | SKQTWNDCFR RVGSKI GVPV SIE- | 148 |
| gi\|8953752 | SKQTWNDCLR RVGSKI GVPV SFE- | 149 |
| gi\|18413965 | NKQTWNDCLR RVGSKI GVPV SSE- | 149 |
| gi\|18413969 | SKQTWNDCFR RVGSKI GVPV SIE- | 149 |
| gi\|15220229 | SKQTWNECVF RVGSKI GAPV SFEQ | 156 |
| gi\|25405889 | SKQAWNECI R RVGSKI GAPV SFEQ | 172 |
| Lead-CeresClone115966 | SKQTWNECVR RVGSKI GAPV SFEQ | 172 |
| gi\|10998140 | SKQTWNECVH RVGSKI GAPV SFEQ | 172 |
| Consensus | SKQTWNDCVR RVGSKI GAPV SFEQ | 174 |

```
CeresClone:265075        MAAALLRRSP AARALLSPAL SSRLVASKPH SSSPAPPPPA KA----DSST  46
CeresClone:1000303       MAAALLRRSP AVRALLSPAL SSRLVASKPH SSSPAPPPPA KA----ASST  46
Lead-CeresClone36094     MAFGLI GRVV GTKP-SRLST AARLI PARWT SKGSEAQSKA STGGG-GASL  48
CeresClone:14357         MASGLI GRLV GTKP-SKLAT VARLI PVRWT STGAEAETKA SSGGGRGSNL  49

Consensus                MAA-L--R-- -T--L---A- S-RL--S--- SS-------A -AGGG-GSS-  50

CeresClone:265075        KTFSI YRWDP DSPSTKPHLK DYQVDLSDCG PMVLDALLKI KNEQDPSLTF  96
CeresClone:1000303       KTFSI YRWDP DSPSTKPHLK DYQVDLSDCG PMVLDALLKI KNEQDPSLTF  96
Lead-CeresClone36094     KTFQI YRWNP DNPG-KPELQ DYKI DLKDCG PMVLDALI KI KNEMDPSLTF  97
CeresClone:14357         KTFQI YRWNP DNPG-KPELQ NYQI DLKDCG PMVLDALI KI KNEMDPSLTF  98

Consensus                KTF-I YRW-P -D-P-TKP-L- DYQ-DL-DCG PMVLDAL-KI KNE-DPSLTF  100

CeresClone:265075        RRSCREGI CG SCAMNI DGDN GLACLTKI SG ASSASTVSPL PHMFVVKDLV  146
CeresClone:1000303       RRSCREGI CG SCAMNI DGDN GLACLTKI SA ASSASTVSPL PHMFVI KDLV  146
Lead-CeresClone36094     RRSCREGI CG SCAMNI DGCN GLACLTKI ES GSKETTI TPL PHMFVI KDLV  147
CeresClone:14357         RRSCREGI CG SCAMNI DGCN GLACLTKI QD EASETTI TPL PHMFVI KDLV  148

Consensus                RRSCREGI CG SCAMNI DG-N GLACLTKI -- ASS--T--PL PHMFVI KDLV  150

CeresClone:265075        VDMTNFYSQY KSVEPWLKRK DQPPQQGKEI PQTKADRAKL DGMYECI LCA  196
CeresClone:1000303       VDMTNFYNQY KSVEPWLKRK DPPPQLGKEV PQTKADRAKL DGMYECI LCA  196
Lead-CeresClone36094     VDMTNFYNQY KSI EPWLKRK NPASVPGKEI LQSKKDRAKL DGMYECI LCA  197
CeresClone:14357         VDMTNFYNQY KSI EPWLKRK TPASVPAKEI LQSKKDRAKL DGMYECI LCA  198

Consensus                VDMTNFYNQY KS-EPWLKRK DP---PGKEI -Q-K-DRAKL DGMYECI LCA  200

CeresClone:265075        CCSTSCPSYW WNPEEYLGPA ALLHANRWI Q DSRDQFTKER LDAI NDEFKL  246
CeresClone:1000303       CCSTSCPSYW WNPEEYLGPA ALLHANRWI Q DSRDQFTKER LDAI NDEFKL  246
Lead-CeresClone36094     CCSTSCPSYW WNPESYLGPA ALLHANRWI S DSRDEYTKER LEAI DDEFKL  247
CeresClone:14357         CCSTSCPSYW WNPESYLGPA ALLHANRWI S DSRDEYTKER LEAI DDEFKL  248

Consensus                CCSTSCPSYW WNPE-YLGPA ALLHANRWI - DSRD--TKER L-AI -DEFKL  250
```

| | | | | | | |
|---|---|---|---|---|---|---|
| CeresClone:265075 | YRCHTI KNCT | HACPKGLNPA | KQI DTI KKLQ | LGAPSA | 282 |
| CeresClone:1000303 | YRCHTI KNCT | HACPKGLNPA | KQI DTI KKLQ | LDA--- | 279 |
| Lead-CeresClone36094 | YRCHTI LNCA | RACPKGLNPG | KQI THI KQLQ | KSG--- | 280 |
| CeresClone:14357 | YRCHTI LNCA | RACPKGLNPG | KQI THI KQLQ | R----- | 279 |
| Consensus | YRCHTI -NC- | -ACPKGLNP- | KQI --I K-LQ | --A--- | 286 |

| | | | | | | | |
|---|---|---|---|---|---|---|---|
| gi\|38347600 | -------MADQ | SNNMI I E-EV | NKGLNPGTI V | LLVVATLLI L | FFVGNYALYM | 43 |
| CeresClone:289176 | --MAXQFADS | ANNVI I E-EV | NKGLNPGMVV | LLVVASFLLL | FFAGNYXLYV | 47 |
| CeresClone:563046 | MADDFEFADK | VPPSFDR-AG | SKGFNPALI V | LLLVGGLLLT | FLI GNYVLYT | 49 |
| CeresClone:737633 | MADDFEFSDK | VPPSFDR-VG | SKGFNPALI V | LLLVGGLLLI | FLVGNYVLYT | 49 |
| CeresClone:1608024 | MDYESDPSFD | KSQFVNKNVE | AFGFNPGLI V | LLVVGGLLI T | FLVGNYVLYM | 50 |
| Leod-CeresClone32612 | ---------M | AAEFDGK-I E | SKGLNPGLI V | LLVI GGLLLT | FLVGNFI LYT | 40 |
| CeresClone:1068098 | ----------M | ADEFSGK-I E | SKGLNPGLI V | LLVI GGLLVT | FLVGNFI LYT | 40 |
| gi\|498705 | ---------- | --MAVNE-VE | AKGLNPGLI V | LLVI GGLLLT | FLVGNFI LYT | 37 |
| Consensus | -----E-AD- | AN------VE | SKGLNPGLI V | LLVVGGLLLT | FLVGNY-LYT | 50 |

| | | | | | |
|---|---|---|---|---|---|
| gi\|38347600 | YAQKTLPPRK | KKPVSKKKLK | REKLKQGVSA | PGE | 76 |
| CeresClone:289176 | YAQKTLPPKK | KKPVSKKKLK | REKLKQGVSA | PGE | 80 |
| CeresClone:563046 | YAQKTLPPRK | KKPVSKKKMK | KERLKQGVSA | PGE | 82 |
| CeresClone:737633 | YAQKTLPPRK | KKPI SKKKMK | KERLKQGVSA | PGE | 82 |
| CeresClone:1608024 | YAQKTLPPRK | KKPVSKKKLK | REKLKQGVAV | PGE | 83 |
| Leod-CeresClone32612 | YAQKNLPPRK | KKPVSKKKMK | KEKMKQGVQV | PGE | 73 |
| CeresClone:1068098 | YAQKNLPPRK | KKPVSKKKMK | KEKLKQGVQV | PGE | 73 |
| gi\|498705 | YAQKNLPPKK | KKPI SKKKMK | RERLKQGVAP | PGE | 70 |
| Consensus | YAQKTLPPRK | KKPVSKKKMK | -EKLKQGVSA | PGE | 83 |

| | | | | | | |
|---|---|---|---|---|---|---|
| Lead-CeresClone29009 | MTDLQMEVEV | DTNSSLQES- | LPKPQVMYRC | KKCRRIVAIE | ENIVPHEPCK | 49 |
| CeresClone:300070 | MFEDDPGLSL | ESGSCQDSSK | VEQRKTAYRC | RKCRRVIAVE | GNVISHVPGE | 50 |
| Consensus | M--------- | ---S----SK | -------YRC | -KCRR--A-E | -N---H-PG- | 50 |
| Lead-CeresClone29009 | GEECFAWKKR | SG-----NSEQ | VQCSSIFVEP | MKWMQTIHDG | VVEEKLLCFG | 95 |
| CeresClone:300070 | GESCFDWNRR | KSGHPYNNKE | HGCSSLFVEP | LKWMTPVEDG | ALEGKLSCIH | 100 |
| Consensus | GE-CF-W--R | --GHPYN--- | --CSS-FVEP | -KWM-----DG | --E-KL-C-- | 100 |
| Lead-CeresClone29009 | CNGRLGYFNW | AGMQCSCGAW | VNPAFQLNKS | RIDECKSEPN | PNLNMET | 142 |
| CeresClone:300070 | CGARLGYFNW | SGIQCNCGSW | VTPAFQIVKS | KVDISTI--- | ------- | 137 |
| Consensus | C--RLGYFNW | -G-QC-CG-W | V-PAFQ--KS | --D----EPN | PNLNMET | 147 |

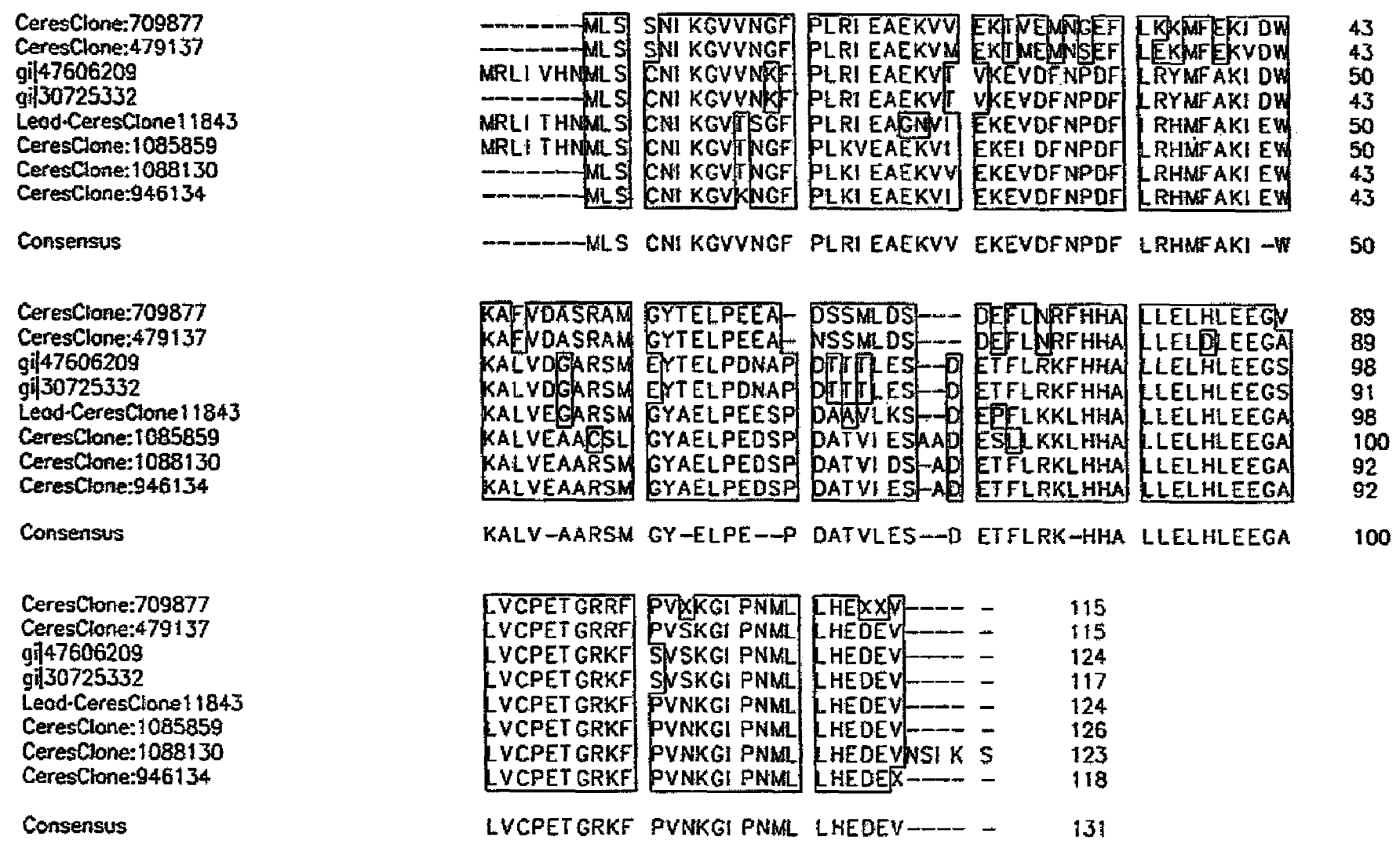

```
CeresClone:709877          -------MLS SNI KGVVNGF PLRI EAEKVV EKTVEMNGEF LKKMFEKI DW   43
CeresClone:479137          -------MLS SNI KGVVNGF PLRI EAEKVM EKTMEMNSEF LEKMFEKVDW   43
gi|47606209                MRLI VHNMLS CNI KGVVNKF PLRI EAEKVT VKEVDFNPDF LRYMFAKI DW   50
gi|30725332                -------MLS CNI KGVVNKF PLRI EAEKVT VKEVDFNPDF LRYMFAKI DW   43
Lead-CeresClone11843       MRLI THNMLS CNI KGVTSGF PLRI EAGNVI EKEVDFNPDF I RHMFAKI EW   50
CeresClone:1085859         MRLI THNMLS CNI KGVTNGF PLKVEAEKVI EKEI DFNPDF LRHMFAKI EW   50
CeresClone:1088130         -------MLS CNI KGVTNGF PLKI EAEKVV EKEVDFNPDF LRHMFAKI EW   43
CeresClone:946134          -------MLS CNI KGVKNGF PLKI EAEKVI EKEVDFNPDF LRHMFAKI EW   43

Consensus                  -------MLS CNI KGVVNGF PLRI EAEKVV EKEVDFNPDF LRHMFAKI -W   50

CeresClone:709877          KAFVDASRAM GYTELPEEA- DSSMLDS--- DEFLNRFHHA LLELHLEEGV   89
CeresClone:479137          KAFVDASRAM GYTELPEEA- NSSMLDS--- DEFLNRFHHA LLELDLEEGA   89
gi|47606209                KALVDGARSM EYTELPDNAP DTTTLES--D ETFLRKFHHA LLELHLEEGS   98
gi|30725332                KALVDGARSM EYTELPDNAP DTTTLES--D ETFLRKFHHA LLELHLEEGS   91
Lead-CeresClone11843       KALVEGARSM GYAELPEESP DAAVLKS--D EPFLKKLHHA LLELHLEEGA   98
CeresClone:1085859         KALVEAACSL GYAELPEDSP DATVI ESAAD ESLLKKLHHA LLELHLEEGA  100
CeresClone:1088130         KALVEAARSM GYAELPEDSP DATVI DS-AD ETFLRKLHHA LLELHLEEGA   92
CeresClone:946134          KALVEAARSM GYAELPEDSP DATVI ES-AD ETFLRKLHHA LLELHLEEGA   92

Consensus                  KALV-AARSM GY-ELPE--P DATVLES--D ETFLRK-HHA LLELHLEEGA  100

CeresClone:709877          LVCPETGRRF PVXKGI PNML LHEXXV---- -   115
CeresClone:479137          LVCPETGRRF PVSKGI PNML LHEDEV---- -   115
gi|47606209                LVCPETGRKF SVSKGI PNML LHEDEV---- -   124
gi|30725332                LVCPETGRKF SVSKGI PNML LHEDEV---- -   117
Lead-CeresClone11843       LVCPETGRKF PVNKGI PNML LHEDEV---- -   124
CeresClone:1085859         LVCPETGRKF PVNKGI PNML LHEDEV---- -   126
CeresClone:1088130         LVCPETGRKF PVNKGI PNML LHEDEVNSI K S   123
CeresClone:946134          LVCPETGRKF PVNKGI PNML LHEDEX---- -   118

Consensus                  LVCPETGRKF PVNKGI PNML LHEDEV---- -   131
```

```
gi|38602797          FSIKGNGIGN GNGHCNGYSN GHGHCINGYS NGISASVSSN GVSHLPYSNG   50
gi|50252842          ---------- ---------- MVGAVQEGIV REMN-----G GFEVM-----   20
gi|40788039          ---------- ---------- -MGSEALEFF SCANNNNNNN GFSYEP----   25
Lead-CeresClone3968  ---------- ---------- -MGEAVEVMF G--------N GF---P----   14
gi|18150168          ---------- ---------- -MGEAVEIMF G--------N GF---P----   14

Consensus            ---------- ---------- -MG--VE-MF ---N-----N GF---P----   50

gi|38602797          NTVHHSNSNG HIHTSPSFGD GRRRCFWYEE EIEDDLRWCF ALNRILHIGV  100
gi|50252842          ------SGYD RSSMAPKQQQ REEESKWYEE EIDDDLKLCY ALNSVLHRGA   64
gi|40788039          ------KKNI IMEETDNLSI NIHDGSWFEE EIDVDLKWSF ALNSVLHKGT   69
Lead-CeresClone3968  ------EIHK ATSPTQTLHS NQQDCHWYEE TIDDDLKWSF ALNSVLHQGT   58
gi|18150168          ------EIHK DTSPIQTLHS NQQDCHWYEE TIDDDLKWSF ALNSVLHQGT   58

Consensus            ------E--- -TS----L-- NQQDC-WYEE EIDDDLKWSF ALNSVLHQGT  100

gi|38602797          SEYQDIALID TRPFGKALVI DGKMQSTEVD EFIYHESLVH PALVYHSQPK  150
gi|50252842          SKYQEIALID TKHFGKALII DGKMQSTEVD EFIYHESLIH PPLLFHPNPK  114
gi|40788039          SEYQDIALLD TKHFGKILVI DGKMQSAEVD EFIYHECLIH PALLCHPNPK  119
Lead-CeresClone3968  SEYQDIALLD TKRFGKVLVI DGKMQSAERD EFIYHECLIH PALLFHPNPK  108
gi|18150168          SEYQDIALLD TKRFGKVLVI DGKMQSAERD EFIYHECLIH PALLFHPNPK  108

Consensus            SEYQDIALLD TK-FGKVLVI DGKMQSAEVD EFIYHECLIH PALLFHPNPK  150

gi|38602797          SAFIMGGGEG SIAREILRHK CVKKVVMCDI DKEVVDFCKK YLVVNREAFS  200
gi|50252842          TVFIMGGGEG SAAREVLRHN TVHRVVMCDI DQEVVDFCRT YLTVNMDAFA  164
gi|40788039          NVFIMGGGEG SAAREALRHK SMEKVVMCDI DKEVVDFCKK HLTANHEAFL  169
Lead-CeresClone3968  TVFIMGGGEG SAAREILKHT TIEKVVMCDI DQEVVDFCRR FLTVNSDAFC  158
gi|18150168          TVFIMGGGEG SAAREILKHT TIEKVVMCDI DQEVVDFCRR FLTVNSDAFC  158

Consensus            TVFIMGGGEG SAAREILRH- T-EKVVMCDI DQEVVDFCR- -LTVN-DAF-  200
```

```
gi|38602797            NSRLELVI ND  ARIELQSRQE  RFDVI I GDLA  DPVEGGPCYQ  LYTKSFYELV   250
gi|50252842            SDKLCLI I ND  ARAELEKSRE  KFDVI VGDLA  DPVEGGPCYQ  LYTKSFYQHI   214
gi|40788039            NKKLNLVI ND  AKAELEQRQE  KFDI I VGDLA  DPVEGGPCYQ  LYTKSFYQNI   219
Lead-CeresClone3968    NKKLELVI KD  AKAELEKREE  KFDI I VGDLA  DPVEGGPCYQ  LYTKSFYQNI   208
gi|18150168            NKKLELVI KD  AKAELEKREE  KFDI I VGDLA  DPVEGGPCYQ  LYTKSFYQNI   208

Consensus              NKKLELVI ND  AKAELEKR-E  KFDI I VGDLA  DPVEGGPCYQ  LYTKSFYQNI   250

gi|38602797            IKPKLNHQGI  FVTQAGPAGV  LTHIQVFSSI  YNTLRQVFKH  VMPYSAHVPS   300
gi|50252842            VKPKLNDRGV  FVTQAGPAGV  LTHKEVFSSI  YNTLRHVFKY  VKAYTAHVPS   264
gi|40788039            LKPKLNDTGI  FVTQAGPAGV  FTHKEVFSSI  YNTIKQVFKY  VLAYTAHVPS   269
Lead-CeresClone3968    LKPKLSPNGI  FVTQAGPAGI  FTHKEVFTSI  YNTMKQVFKY  VKAYTAHVPS   258
gi|18150168            LKPKLSPNGI  FVTQAGPAGI  FTHKEVFTSI  YNTMKQVFKY  VKAYTAHVPS   258

Consensus              LKPKLN--GI  FVTQAGPAGV  FTHKEVFSSI  YNT-KQVFKY  VKAYTAHVPS   300

gi|38602797            FADTWGWVMA  SDHPLTLEAG  EIDDRI KQRI  KGELQFLDGQ  TFLVAATLNK   350
gi|50252842            FADTWGWVMA  SDYPFSMNAQ  QI NERI KERI  DGELVYLSGE  SLI SSTILNK   314
gi|40788039            FADTWGWVMA  SDKPFCLDAG  KLDKKI AERI  EGELLYLNGA  SFFSSTILNK   319
Lead-CeresClone3968    FADTWGWVMA  SDHEFDVEVD  EMDRRI EERV  NGELMYLNAP  SFVSAATLNK   308
gi|18150168            FADTWGWVMA  SDHEFDVEVD  EMDRRI EERV  KGELMYLNAP  SFVSAATLNK   308

Consensus              FADTWGWVMA  SDHPF--EA-  E-D-RI -ERI  -GELMYLNG-  SFI SAATLNK   350

gi|38602797            SVRKSLSKET  HVYTEETARF  IHGHGKASYQ  -   380
gi|50252842            SVYQSLLNET  HVYTEDDARF  IYGHGRARCA  -   344
gi|40788039            TVAKTLKNES  HVYAEDDARF  IHGHGLGFRN  -   349
Lead-CeresClone3968    TI SLALEKET  EVYSEENARF  IHGHGVAYRH  I   339
gi|18150168            TI SLALEKET  EVYSEENARF  IHGHGVAYRH  I   339

Consensus              TVSK-LEKET  HVY-EE-ARF  IHGHGVAYRH  -   381
```

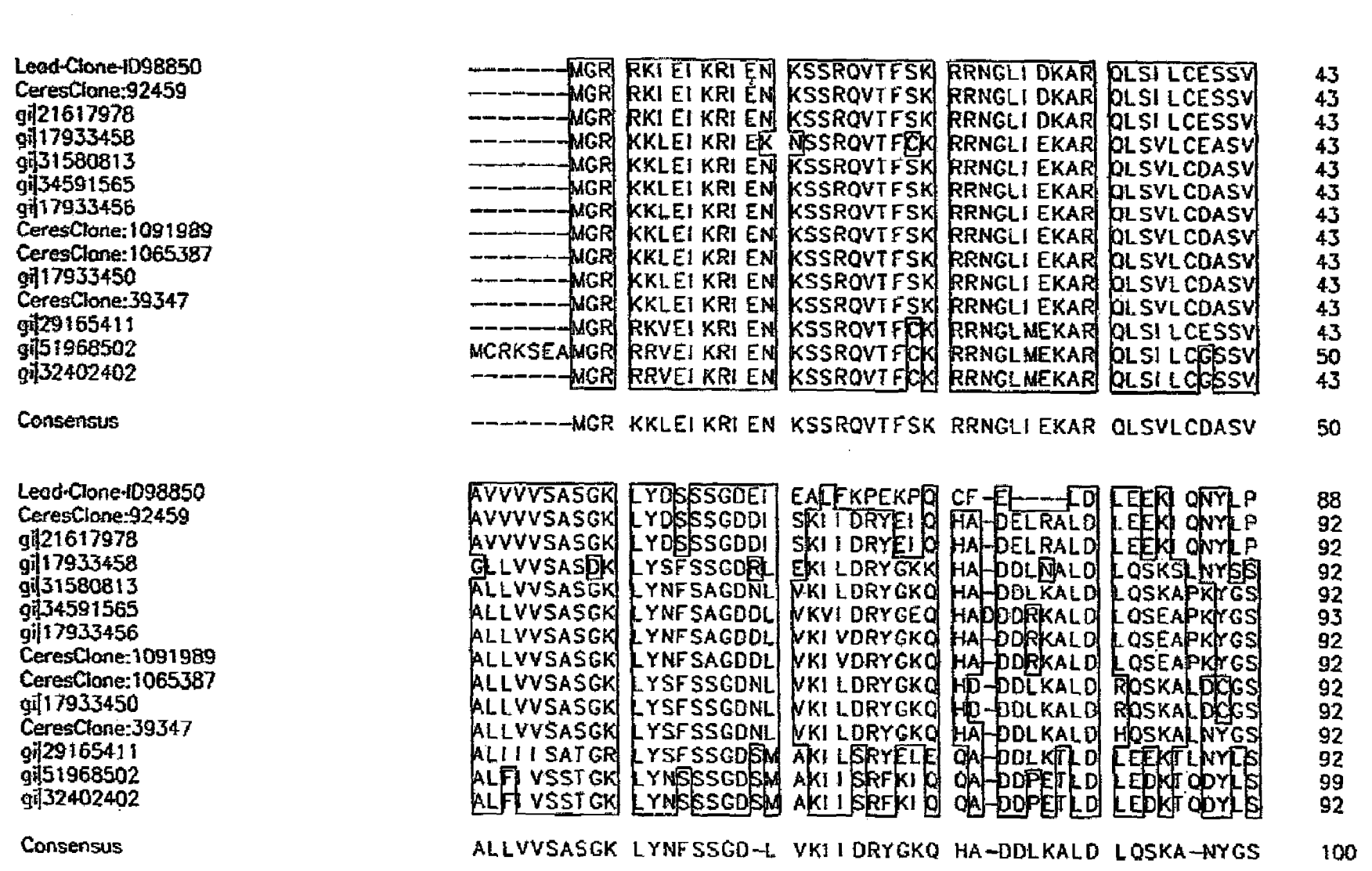

| | | | | | | |
|---|---|---|---|---|---|---|
| Lead-Clone-ID98850 | -------MGR | RKIEIKRIEN | KSSRQVTFSK | RRNGLIDKAR | QLSILCESSV | 43 |
| CeresClone:92459 | -------MGR | RKIEIKRIEN | KSSRQVTFSK | RRNGLIDKAR | QLSILCESSV | 43 |
| gi\|21617978 | -------MGR | RKIEIKRIEN | KSSRQVTFSK | RRNGLIDKAR | QLSILCESSV | 43 |
| gi\|17933458 | -------MGR | KKLEIKRIEK | NSSRQVTFCK | RRNGLIEKAR | QLSVLCEASV | 43 |
| gi\|31580813 | -------MGR | KKLEIKRIEN | KSSRQVTFSK | RRNGLIEKAR | QLSVLCDASV | 43 |
| gi\|34591565 | -------MGR | KKLEIKRIEN | KSSRQVTFSK | RRNGLIEKAR | QLSVLCDASV | 43 |
| gi\|17933456 | -------MGR | KKLEIKRIEN | KSSRQVTFSK | RRNGLIEKAR | QLSVLCDASV | 43 |
| CeresClone:1091989 | -------MGR | KKLEIKRIEN | KSSRQVTFSK | RRNGLIEKAR | QLSVLCDASV | 43 |
| CeresClone:1065387 | -------MGR | KKLEIKRIEN | KSSRQVTFSK | RRNGLIEKAR | QLSVLCDASV | 43 |
| gi\|17933450 | -------MGR | KKLEIKRIEN | KSSRQVTFSK | RRNGLIEKAR | QLSVLCDASV | 43 |
| CeresClone:39347 | -------MGR | KKLEIKRIEN | KSSRQVTFSK | RRNGLIEKAR | QLSVLCDASV | 43 |
| gi\|29165411 | -------MGR | RKVEIKRIEN | KSSRQVTFCK | RRNGLMEKAR | QLSILCESSV | 43 |
| gi\|51968502 | MCRKSEAMGR | RRVEIKRIEN | KSSRQVTFCK | RRNGLMEKAR | QLSILCGSSV | 50 |
| gi\|32402402 | -------MGR | RRVEIKRIEN | KSSRQVTFCK | RRNGLMEKAR | QLSILCGSSV | 43 |
| Consensus | -------MGR | KKLEIKRIEN | KSSRQVTFSK | RRNGLIEKAR | QLSVLCDASV | 50 |

| | | | | | | |
|---|---|---|---|---|---|---|
| Lead-Clone-ID98850 | AVVVVSASGK | LYDSSSGDEI | EALFKPEKPQ | CF-E----LD | LEEKIQNYLP | 88 |
| CeresClone:92459 | AVVVVSASGK | LYDSSSGDDI | SKIIDRYEIQ | HA-DELRALD | LEEKIQNYLP | 92 |
| gi\|21617978 | AVVVVSASGK | LYDSSSGDDI | SKIIDRYEIQ | HA-DELRALD | LEEKIQNYLP | 92 |
| gi\|17933458 | GLLVVSASDK | LYSFSSGDRL | EKILDRYGKK | HA-DDLNALD | LQSKSLNYSS | 92 |
| gi\|31580813 | ALLVVSASGK | LYNFSAGDNL | VKILDRYGKQ | HA-DDLKALD | LQSKAPKYGS | 92 |
| gi\|34591565 | ALLVVSASGK | LYNFSAGDDL | VKVIDRYGEQ | HADDDRKALD | LQSEAPKYGS | 93 |
| gi\|17933456 | ALLVVSASGK | LYNFSAGDDL | VKIVDRYGKQ | HA-DDRKALD | LQSEAPKYGS | 92 |
| CeresClone:1091989 | ALLVVSASGK | LYNFSAGDDL | VKIVDRYGKQ | HA-DDRKALD | LQSEAPKYGS | 92 |
| CeresClone:1065387 | ALLVVSASGK | LYSFSSGDNL | VKILDRYGKQ | HD-DDLKALD | RQSKALDCGS | 92 |
| gi\|17933450 | ALLVVSASGK | LYSFSSGDNL | VKILDRYGKQ | HD-DDLKALD | RQSKALDCGS | 92 |
| CeresClone:39347 | ALLVVSASGK | LYSFSSGDNL | VKILDRYGKQ | HA-DDLKALD | HQSKALNYGS | 92 |
| gi\|29165411 | ALIIISATGR | LYSFSSGDSM | AKILSRYELE | QA-DDLKTLD | LEEKTLNYLS | 92 |
| gi\|51968502 | ALFIVSSTGK | LYNSSSGDSM | AKIISRFKIQ | QA-DDPETLD | LEDKTQDYLS | 99 |
| gi\|32402402 | ALFIVSSTGK | LYNSSSGDSM | AKIISRFKIQ | QA-DDPETLD | LEDKTQDYLS | 92 |
| Consensus | ALLVVSASGK | LYNFSSGD-L | VKIIDRYGKQ | HA-DDLKALD | LQSKA-NYGS | 100 |

```
Lead-Clone-ID98850   HKELLETVQS KLEEPNVDNV SVDSLISLEE QLETALSVSR ARKAELMMEY  138
CeresClone:92459     HKELLETVQS KLEEPNVDNV SVDSLISLEE QLETALSVSR ARKAELMMEY  142
gi|21617978          HKELLETVQS KLEEPNVDNV SVDSLISLEE QLETALSVSR ARKAELMMEY  142
gi|17933458          HHELLELVES KLVES- DDV SVDSLVELEQ HLETALSVTR ARKAELMLKL  141
gi|31580813          HHELLELVES KLVESNSD-V SVDSLVQLED HLETALSVTR ARKTELMLKL  141
gi|34591565          HHELLELVES KLVESNSD-V SVDSLVQLEN HLETALSVTR ARKTELLLKL  142
gi|17933456          HHELLELVES KLVESNSD-V SVDSLVQLEN HLETALSVTR ARKTELLLKL  141
CeresClone:1091989   HHELLELVES KLVESNSD-V SVDSLVQLEN HLETALSVTR ARKTELLLKL  141
CeresClone:1065387   HHELLELVES KLEESNVDNV SVGSLVQLEE HLENALSVTR ARKTELMLKL  142
gi|17933450          HHELLELVES KLEESNVDNV SVGSLVQLEE HLENALSVTR ARKTELMLKL  142
CeresClone:39347     HYELLELVDS KLVGSNVKNV SI DALVQLEE HLETALSVTR AKKTELMLKL  142
gi|29165411          HKELLEI QC KI EEAKSDNV SI DCLKSLEE QLKTALSVTR ARKTELMMEL  142
gi|51968502          HKELLEI VQR KI EEAKGDNV SI ESLISMEE QLKSALSVIR ARKTELLMEL  149
gi|32402402          HKELLEI VQR KI EEAKGDNV SI ESLISMEE QLKSALSVIR ARKTELLMEL  142

Consensus            HHELLELVES KLEESNVDNV SVDSLVQLEE HLETALSVTR ARKTELMMKL  150

Lead-Clone-ID98850   IESLKEKEKL LREENQVLAS QM----GKNI LLATDDERG- MFP-GSSSGN  182
CeresClone:92459     IESLKEKEKL LREENQVLAS QM----GKNI LLATDDERG- MFP-GSSSGN  186
gi|21617978          IESLKEKEKL LREENQVLAS QM----GKNI LLATDDERG- MFP-GSSSGN  186
gi|17933458          VESLKEKENL LKEENQVLAS QI----EKKN LEGAEADNIE MSS-GQISDI  186
gi|31580813          VDSLKEKEKL LKEENQGLAS QM----EKNN LAGAEADKME MSP-GQISDI  186
gi|34591565          VDSLKEKEKL LKEENQGLAS QM----EKNN LAGAEADKME VSP-GQISDI  187
gi|17933456          VDSLKEKEKL LKEENQGLAS QM----EKNN LAGAEADKME VSP-GQISDI  186
CeresClone:1091989   VDSLKEKEKL LKEENQGLAS QM----EKNN LAGAEADKME VSP-GQISDI  186
CeresClone:1065387   VENLKEKEKL LEEENHVLAS QM----EKSN LVRAEADNMD VSP-GQISDI  187
gi|17933450          VENLKEKEKL LEEENHVLAS QM----EKSN LVRAEADNMD VSP-GQISDI  187
CeresClone:39347     VENLKEKEKM LKEENQVLAS QM----ENNH HVGAEAE-ME MSPAGQISD-  186
gi|29165411          VKTHQEKEKL LREENQSLIN QLIKMGKMKK SVEAEDARA- MSP-ESSSDN  190
gi|51968502          VKNLQDKEKL LKEKNKVLAS EV---GKLKK ILETGDERAV MSP-ENSSGH  195
gi|32402402          VKNLQDKEKL LKEKNKVLAS EV---GKLKK ILETGDERAV MSP-ENSSGH  188

Consensus            VESLKEKEKL LKEENQVLAS QM----EKNN LV-AEADRME MSP-GQISDI  200
```

| | | |
|---|---|---|
| Lead-Clone-ID98850 | KIPETLPLLN | 192 |
| CeresClone:92459 | KIPETLPLLN | 196 |
| gi\|21617978 | KIPETLPLLN | 196 |
| gi\|17933458 | NLPVTLPLLN | 196 |
| gi\|31580813 | NRPVTLRLLY | 196 |
| gi\|34591565 | NCPVTLPLLY | 197 |
| gi\|17933456 | NCPVTLPLLY | 196 |
| CeresClone:1091989 | NCPVTLPLLY | 196 |
| CeresClone:1065387 | NLPVTLPLLN | 197 |
| gi\|17933450 | NLPVTLPLLN | 197 |
| CeresClone:39347 | NLPVTLPLLN | 196 |
| gi\|29165411 | KPPETLLLLK | 200 |
| gi\|51968502 | SPPETLPLLK | 205 |
| gi\|32402402 | SPPETLPLLK | 198 |
| Consensus | NLPVTLPLLN | 210 |

NUCLEOTIDE SEQUENCES AND POLYPEPTIDES ENCODED THEREBY USEFUL FOR MODIFYING PLANT CHARACTERISTICS AND PHENOTYPES

CROSS REFERENCE TO RELATED APPLICATION

This non-provisional application claims priority under 35 U.S.C. § 119(e) on U.S. Provisional Application No(s). 60/583,621, filed Jun. 30, 2004; 60/584,829, filed Jun. 30, 2004; and 60/584,800 filed on Jun. 30, 2004, the entire contents of which are hereby incorporated by reference.

This application contains two (2) CDRs (copy 1 and copy 2) in place of the paper copy of the Sequence Listing, the entire contents of which are hereby incorporated by reference. The CDRs contain the following file:

| File Name | Date of Creation | File Size |
|---|---|---|
| 2005-06-30_2750-1602PUS2.ST25.txt | Jun. 30, 2005 | 5,986 KB |

FIELD OF THE INVENTION

The present invention relates to isolated polynucleotides, polypeptides encoded thereby, and the use of those products for making transgenic plants or organisms, such as transgenic plants.

BACKGROUND OF THE INVENTION

There are more than 300,000 species of plants. They show a wide diversity of forms, ranging from delicate liverworts, adapted for life in a damp habitat, to cacti, capable of surviving in the desert. The plant kingdom includes herbaceous plants, such as corn, whose life cycle is measured in months, to the giant redwood tree, which can live for thousands of years. This diversity reflects the adaptations of plants to survive in a wide range of habitats. This is seen most clearly in the flowering plants (phylum Angiospermophyta), which are the most numerous, with over 250,000 species. They are also the most widespread, being found from the tropics to the arctic.

The process of plant breeding involving man's intervention in natural breeding and selection is some 20,000 years old. It has produced remarkable advances in adapting existing species to serve new purposes. The world's economics was largely based on the successes of agriculture for most of these 20,000 years.

Plant breeding involves choosing parents, making crosses to allow recombination of gene (alleles) and searching for and selecting improved forms. Success depends on the genes/alleles available, the combinations required and the ability to create and find the correct combinations necessary to give the desired properties to the plant. Molecular genetics technologies are now capable of providing new genes, new alleles and the means of creating and selecting plants with the new, desired characteristics.

Plants specifically improved for agriculture, horticulture and other industries can be obtained using molecular technologies. As an example, great agronomic value can result from modulating the size of a plant as a whole or of any of its organs. The green revolution came about as a result of creating dwarf wheat plants, which produced a higher seed yield than taller plants because they could withstand higher levels and inputs of fertilizer and water.

Similarly, modulation of the size and stature of an entire plant, or a particular portion of a plant, allows production of plants better suited for a particular industry. For example, reductions in the height of specific ornamentals, crops and tree species can be beneficial by allowing easier harvesting. Alternatively, increasing height may be beneficial by providing more biomass. Other examples of commercially desirable traits include increasing the length of the floral stems of cut flowers, increasing or altering leaf size and shape, enhancing the size of seeds and/or fruits, enhancing yields by specifically stimulating hormone (e.g. Brassinolide) synthesis and stimulating early flowering or evoking late flowering by altering levels of gibberellic acid or other hormones in specific cells. Changes in organ size and biomass also result in changes in the mass of constituent molecules such as secondary products.

To summarize, molecular genetic technologies provide the ability to modulate and manipulate growth, development and biochemistry of the entire plant as well as at the cell, tissue and organ levels. Thus, plant morphology, development and biochemistry are altered to maximize or minimize the desired plant trait.

SUMMARY OF THE INVENTION

The present invention, therefore, relates to isolated polynucleotides, polypeptides encoded thereby, and the use of those products for making transgenic organisms, such as plants, bacteria, yeast, fungi and mammals, depending upon the desired characteristics.

In the field of agriculture and forestry efforts are constantly being made to produce plants with improved characteristics, such as increased overall yield or increased yield of biomass or chemical components, in particular in order to guarantee the supply of the constantly increasing world population with food and to guarantee the supply of reproducible raw materials. Conventionally, people try to obtain plants with an increased yield by breeding, but this is time-consuming and labor-intensive. Furthermore, appropriate breeding programs must be performed for each relevant plant species.

Recently, progress has been made by the genetic manipulation of plants. That is, by introducing into and expressing recombinant nucleic acid molecules in plants. Such approaches have the advantage of not usually being limited to one plant species, but being transferable to other plant species as well. EP-A 0 511 979, for example, discloses that the expression of a prokaryotic asparagine synthetase in plant cells inter alia leads to an increase in biomass production. Similarly, WO 96/21737 describes the production of plants with increased yield from the expression of deregulated or unregulated fructose-1,6-bisphosphatase due to an increased rate of the photosynthesis. Nevertheless, there still is a need for generally applicable processes that improve yield in plants interesting for agriculture or forestry purposes.

BRIEF DESCRIPTION OF THE FIGURES

FIG. 1 shows alignments of the polypeptide sequences of the invention with other sequences, showing conserved regions of identical or similar residues. The sequences shown are CeresClone:40252 (SEQ ID NO: 2); CeresClone:1094231 (SEQ ID NO: 3); CeresClone:967599 (SEQ ID NO: 4); CeresClone:32791 (SEQ ID NO: 6); gi|23194453 (SEQ ID NO: 7); gi|60100358 (SEQ ID NO: 8); gi|3646326 (SEQ ID NO: 9); CeresClone:1044034 (SEQ ID NO: 10);

gi|4103342 (SEQ ID NO: 11); gi|2997615 (SEQ ID NO: 12); gi|20385590 (SEQ ID NO: 13); gi|27763670 (SEQ ID NO: 14); gi|2981133 (SEQ ID NO: 15); gi|42794566 (SEQ ID NO: 16); gi|42794562 (SEQ ID NO: 17); gi|1568513 (SEQ ID NO: 18); gi|861081 (SEQ ID NO: 19); gi|1067169 (SEQ ID NO: 20); gi|24967137 (SEQ ID NO: 21); CeresClone: 39319 (SEQ ID NO: 23); CeresClone:1016818 (SEQ ID NO: 24); CeresClone:947724 (SEQ ID NO: 25); gi|6165638 (SEQ ID NO: 26); CeresClone:1088967 (SEQ ID NO: 27); CeresClone:27929 (SEQ ID NO: 28); gi|4585973 (SEQ ID NO: 29); CeresClone:1555168 (SEQ ID NO: 30); CeresClone: 774974 (SEQ ID NO: 31); CeresClone:705811 (SEQ ID NO: 32); CeresClone:516874 (SEQ ID NO: 33); CeresClone: 1097485 (SEQ ID NO: 34); CeresClone:1126017 (SEQ ID NO: 35); CeresClone:1084637 (SEQ ID NO: 36); CeresClone:41337 (SEQ ID NO: 38); CeresClone:37506 (SEQ ID NO: 39); CeresClone:293206 (SEQ ID NO: 40); CeresClone: 297432 (SEQ ID NO: 41); CeresClone:246807 (SEQ ID NO: 42); CeresClone:246886 (SEQ ID NO: 43); CeresClone: 994766 (SEQ ID NO: 44); CeresClone:554851 (SEQ ID NO: 45); CeresClone:314 (SEQ ID NO: 47); CeresClone:13483 (SEQ ID NO: 48); gi|21387015 (SEQ ID NO: 49); CeresClone:481859 (SEQ ID NO: 50); CeresClone:366717 (SEQ ID NO: 51); gi|50909577 (SEQ ID NO: 52); CeresClone: 696513 (SEQ ID NO: 53); CeresClone:332 (SEQ ID NO: 55); gi|55168209 (SEQ ID NO: 56); gi|25992100 (SEQ ID NO: 57); gi|38099059 (SEQ ID NO: 58); gi|45385108 (SEQ ID NO: 59); gi|58700406 (SEQ ID NO: 60); gi|25989383 (SEQ ID NO: 61); gi|42822041 (SEQ ID NO: 62); gi|52145406 (SEQ ID NO: 63); CeresClone:557009 (SEQ ID NO: 64); gi|27960757 (SEQ ID NO: 65); CeresClone:907 (SEQ ID NO: 67); gi|9757729 (SEQ ID NO: 68); g|50940339 (SEQ ID NO: 69); gi|52354409 (SEQ ID NO: 70); CeresClone:1241 (SEQ ID NO: 72); gi|5218072 (SEQ ID NO: 73); CeresClone:108339 (SEQ ID NO: 74); gi|21536682 (SEQ ID NO: 75); CeresClone:473347 (SEQ ID NO: 76); CeresClone: 224792 (SEQ ID NO: 77); CeresClone:704321 (SEQ ID NO: 78); CeresClone:1610 (SEQ ID NO: 80); CeresClone: 1001432 (SEQ ID NO: 81); gi|4056502 (SEQ ID NO: 82); CeresClone:8397 (SEQ ID NO: 83); gi|21617886 (SEQ ID NO: 84); gi|3043428 (SEQ ID NO: 85); CeresClone:533766 (SEQ ID NO: 86); CeresClone:792839 (SEQ ID NO: 87); CeresClone:471212 (SEQ ID NO: 88): CeresClone:1033671 (SEQ ID NO: 89); CeresClone:1281072 (SEQ ID NO: 90); CeresClone:287037 (SEQ ID NO: 91); CeresClone:741488 (SEQ ID NO: 92); gi|34893994 (SEQ ID NO: 93); gi|40748265 (SEQ ID NO: 94); CeresClone:2403 (SEQ ID NO: 96); CeresClone:1482731 (SEQ ID NO: 97); CeresClone:1005233 (SEQ ID NO: 98); CeresClone:1123804 (SEQ ID NO: 99); CeresClone:273687 (SEO ID NO: 100); Ceres-CeresClone:522921 (SEQ ID NO: 101); CeresClone: 1439969 (SEQ ID NO: 102); CeresClone:1036726 (SEQ ID NO: 103); CeresClone:513071 (SEQ ID NO: 104); CeresClone:1464066 (SEQ ID NO: 105); CeresClone:1453619 (SEQ ID NO: 106); CeresClone:2835 (SEQ ID NO: 108); CeresClone:1048082 (SEQ ID NO: 109); CeresClone: 1085655 (SEQ ID NO: 110); CeresClone:1087946 (SEQ ID NO: 111); CeresClone:642424 (SEQ ID NO: 112); CeresClone:1570772 (SEQ ID NO: 113); CeresClone:3000 (SEQ ID NO: 115); CeresClone:541719 (SEQ ID NO: 116); CeresClone:524559 (SEQ ID NO: 117); CeresClone:537272 (SEQ ID NO: 118); CeresClone:1250120 (SEQ ID NO: 119); CeresClone:276087 (SEQ ID NO: 120); CeresClone: 1060946 (SEQ ID NO: 121); CeresClone:303119 (SEQ ID NO: 122); CeresClone:3036 (SEQ ID NO: 124); gi|31432429 (SEQ ID NO: 125); CeresClone:278965 (SEQ ID NO: 126); gi|56785318 (SEQ ID NO: 127); CeresClone:3363 (SEQ ID NO: 129); CeresClone:1053095 (SEQ ID NO: 130); CeresClone:1059204 (SEQ ID NO: 131); CeresClone:1382087 (SEQ ID NO: 132); CeresClone:952003 (SEQ NO: 133); CeresClone:1032859 (SEQ ID NO: 134); CeresClone: 1123883 (SEQ ID NO: 135); CeresClone:1379029 (SEQ ID NO: 136); CeresClone:1101282 (SEQ ID NO: 137); CeresClone:1463543 (SEQ ID NO: 138), CeresClone:38506 (SEQ ID NO: 139); CeresClone:20822 (SEQ ID NO: 140); CeresClone:1438404 (SEQ ID NO: 141); CeresClone:652242 (SEQ ID NO: 142); CeresClone:632635 (SEQ ID NO: 143); CeresClone:570063 (SEQ ID NO: 144); CeresClone: 1453911 (SEQ ID NO: 145); CeresClone:302748 (SEQ ID NO: 146); CeresClone:3510 (SEQ ID NO: 148); CeresClone: 1070119 (SEQ ID NO: 149); CeresClone:553538 (SEQ ID NO: 150); CeresClone:857804 (SEQ ID NO: 151); CeresClone:644900 (SEQ ID NO: 152); CeresClone:300291 (SEQ ID NO: 153); CeresClone:421214 (SEQ ID NO: 154); CeresClone:678746 (SEQ ID NO: 155); CeresClone:753703 (SEQ ID NO: 156); CeresClone:927400 (SEQ ID NO: 157); CeresClone:1316352 (SEQ ID NO: 158); CeresClone:810742 (SEQ ID NO: 159); gi|81888 (SEQ ID NO: 160); CeresClone:3699 (SEQ ID NO: 162); gi|28972461 (SEQ ID NO: 163); CeresClone:1039319 (SEQ ID NO: 164); gi|28972463 (SEQ ID NO: 165); CeresClone:1354315 (SEQ ID NO: 166); gi|6523104 (SEQ ID NO: 167); gi|498914 (SEQ ID NO: 168); gi|642911 (SEQ ID NO: 169); gi|19875 (SEQ ID NO: 170); gi|19873 (SEQ ID NO: 171); CeresClone:297802 (SEQ ID NO: 172); CeresClone:523191 (SEQ ID NO: 173); CeresClone:3817 (SEQ ID NO: 175); CeresClone:3858 (SEQ ID NO: 177); gi|16191591 (SEQ ID NO: 178); CeresClone: 1115030 (SEQ ID NO: 179); CeresClone:1079413 (SEQ ID NO: 180); gi|31559433 (SEQ ID NO: 181); gi|33323059 (SEQ ID NO: 182); CeresClone:464464 (SEQ ID NO: 183); gi|32165478 (SEQ ID NO: 184); gi|32165470 (SEQ ID NO: 185); gi|32165466 (SEQ ID NO: 186); gi|32165476 (SEQ ID NO: 187); CeresClone:476943 (SEQ ID NO: 188); CeresClone:641520 (SEQ ID NO: 189); gi|256141 (SEQ ID NO: 190); CeresClone:5597 (SEQ ID NO: 192); CeresClone: 970267 (SEQ ID NO: 193); CeresClone:619936 (SEQ ID NO: 194); gi|50355738 (SEQ ID NO: 195); CeresClone: 504766 (SEQ ID NO: 196); CeresClone:618484 (SEQ ID NO: 197); CeresClone:1610116 (SEQ ID NO: 198); CeresClone:5605 (SEQ ID NO: 200); CeresClone:1040415 (SEQ ID NO: 201); CeresClone:970237 (SEQ ID NO: 202); CeresClone:599624 (SEQ ID NO: 203); gi|50943407 (SEQ ID NO: 204); gi|50943405 (SEQ ID NO: 205); CeresClone: 993322 (SEQ ID NO: 206); CeresClone:1466290 (SEQ ID NO: 207); CeresClone:229182 (SEQ ID NO: 208); CeresClone:1398876 (SEQ ID NO: 209); CeresClone:6685 (SEQ ID NO: 211); CeresClone:463486 (SEQ ID NO: 212); CeresClone:8161 (SEQ ID NO: 214); CeresClone:8265 (SEQ ID NO: 216); CeresClone:540561 (SEQ ID NO: 217); gi|50906111 (SEQ ID NO: 218); CeresClone:1560255 (SEQ ID NO: 219); gi|5679336 (SEQ ID NO: 220); CeresClone: 8490 (SEQ ID NO: 222); CeresClone:305463 (SEQ ID NO: 223); CeresClone:258437 (SEQ ID NO: 224); CeresClone: 219341 (SEQ ID NO: 225); CeresClone:929917 (SEQ ID NO: 226); CeresClone:923677 (SEQ ID NO: 227); CeresClone:8500 (SEQ ID NO: 229); CeresClone:9683 (SEQ ID NO: 231); gi|17104783 (SEQ ID NO: 232); CeresClone: 605144 (SEQ ID NO: 233); CeresClone:9897 (SEQ ID NO: 235); CeresClone:1083013 (SEQ ID NO: 236); gi|13430182 (SEQ ID NO: 237); CeresClone:568627 (SEQ ID NO: 238); CeresClone:1073644 (SEQ ID NO: 239); CeresClone: 1447299 (SEQ ID NO: 240); CeresClone:1605872 (SEQ ID NO: 241); CeresClone:12272 (SEQ ID NO: 243); CeresClone:541471 (SEQ ID NO: 244); CeresClone:528932 (SEQ ID NO: 245); CeresClone:855912 (SEQ ID NO: 246); CeresClone:563093 (SEQ ID NO: 247); CeresClone:246369 (SEQ ID NO: 248); CeresClone:12514 (SEQ ID NO: 250); CeresClone:12935 (SEQ ID NO: 252); CeresClone:1025550 (SEQ ID NO: 253); gi|21593750 (SEQ ID NO: 254); CeresClone:8827 (SEQ ID NO: 255); gi|21617917 (SEQ ID NO: 256); CeresClone:951883 (SEQ ID NO: 257); CeresClone:1126078 (SEQ ID NO: 258); CeresClone:1070103 (SEQ ID NO: 259); CeresClone:1461734 (SEQ ID NO: 260); CeresClone:1127491 (SEQ ID NO: 261); CeresClone:13092 (SEQ ID NO: 263); gi|25285637 (SEQ ID NO: 264); CeresClone:288261 (SEQ ID NO: 265); gi|27544804 (SEQ ID NO: 266); gi|11544696 (SEQ ID NO: 267); CeresClone:1059504 (SEQ ID NO: 268); CeresClone:639745 (SEQ ID NO: 269); CeresClone:13263 (SEQ ID NO: 271); CeresClone:227877 (SEQ ID NO: 272); CeresClone:228481 (SEQ ID NO: 273); CeresClone:13757 (SEQ ID NO: 275); CeresClone:14583 (SEQ ID NO: 277); CeresClone:1119033 (SEQ ID NO: 278); CeresClone:649770 (SEQ ID NO: 279); CeresClone:29087 (SEQ ID NO: 280); CeresClone:1100582 (SEQ ID NO: 281); CeresClone:1042725 (SEQ ID NO: 282); CeresClone:14909 (SEQ ID NO: 284); CeresClone:380874 (SEQ ID NO: 285); CeresClone:276776 (SEQ ID NO: 286); CeresClone:529239 (SEQ ID NO: 287); CeresClone:240510 (SEQ ID NO: 288); CeresClone:1535974 (SEQ ID NO: 289); CeresClone:738726 (SEQ ID NO: 290); CeresClone:1428788 (SEQ ID NO: 291); CeresClone:631823 (SEQ ID NO: 292); CeresClone:416460 (SEQ ID NO: 293); CeresClone:1561415 (SEQ ID NO: 294); CeresClone:16412 (SEQ ID NO: 296); gi|51971769 (SEQ ID NO: 297); gi|30687750 (SEQ ID NO: 298); CeresClone:1352771 (SEQ ID NO: 299); gi|27363302 (SEQ ID No: 300); gi|42566152 (SEQ ID NO: 301); gi|7269635 (SEQ ID NO: 302); gi|22328869 (SEQ ID NO: 303); CeresClone:16461 (SEQ ID NO: 305); gi|3687688 (SEQ ID NO: 306); CeresClone:1051749 (SEQ ID NO: 307); gi|50918565 (SEQ ID NO: 308); CeresClone:17409 (SEQ ID NO: 310); CeresClone:1073780 (SEQ ID NO: 311); CeresClone:240836 (SEQ ID NO: 312); CeresClone:281173 (SEQ ID NO: 313); CeresClone:225601 (SEQ ID NO: 314); CeresClone:779692 (SEQ ID NO: 315); CeresClone:17482 (SEQ ID NO: 317); gi|51457942 (SEQ ID NO: 318); CeresClone:658444 (SEQ ID NO: 319); CeresClone:1559567 (SEQ ID NO: 320); CeresClone:17632 (SEQ ID NO: 322); CeresClone:473410 (SEQ ID NO: 323); gi|5090911 (SEQ ID NO: 324); CeresClone:703717 (SEQ ID NO: 325); CeresClone:277297 (SEQ ID NO: 326); CeresClone:1459706 (SEQ ID NO: 327); CeresClone:18612 (SEQ ID NO: 329); CeresClone:1359803 (SEQ ID NO: 330); gi|12057164 (SEQ ID NO: 331); CeresClone:374674 (SEQ ID NO: 332); gi|50919691 (SEQ ID NO: 333); CeresClone925629 (SEQ ID NO: 334); CeresClone:18820 (SEQ ID NO: 336); CeresClone:277479 (SEQ ID NO: 337); CeresClone:978584 (SEQ ID NO: 338); CeresClone:673690 (SEQ ID NO: 339); CeresClone:1018883 (SEQ ID NO: 340); CeresClone:19188 (SEQ ID NO: 342); CeresClone:953088 (SEQ ID NO: 343); CeresClone:901252 (SEQ ID NO: 344); CeresClone:524628 (SEQ ID NO 345); gi|33325041 (SEQ ID NO: 346); gi|27476082 (SEQ ID NO: 347); gi|3411152 (SEQ ID NO: 348); CeresClone:284998 (SEQ ID NO: 349); CeresClone:226318 (SEQ ID NO: 350); CeresClone:20257 (SEQ ID NO: 352); CeresClone:1038259 (SEQ ID NO: 353); CeresClone:957946 (SEQ ID NO: 354); CeresClone:855445 (SEQ ID NO: 355); CeresClone:1447025 (SEQ ID NO: 356); CeresClone:291379 (SEQ ID NO: 357); CeresClone:327661 (SEQ ID NO: 358); CeresClone:1047513 (SEQ ID NO: 359); CeresClone:639625 (SEQ ID NO: 360); CeresClone:1317381 (SEQ ID NO: 361); CeresClone:21068 (SEQ ID NO: 363); gi|25992126 (SEQ ID NO: 364); gi|23452024 (SEQ ID NO: 365); gi|52547872 (SEQ ID NO: 366); CeresClone:22461 (SEQ ID NO: 368); CeresClone:601676 (SEQ ID NO: 369); CeresClone:23118 (SEQ ID NO: 371); CeresClone:23203 (SEQ ID NO: 373); CeresClone:961876 (SEQ ID NO: 374); gi|52076162 (SEQ ID NO: 375); CeresClone:582490 (SEQ ID NO: 376); CeresClone:226408 (SEQ ID NO: 377); CeresClone:1424939 (SEQ ID NO: 378); CeresClone:488797 (SEQ ID NO: 379); CeresClone:372782 (SEQ ID NO: 380); CeresClone:607279 (SEQ ID NO: 381); CeresClone:26907 (SEQ ID NO: 383); CeresClone:564029 (SEQ ID NO: 384); gi|51490665 (SEQ ID NO: 385); CeresClone:473087 (SEQ ID NO: 386); gi|51490663 (SEQ ID NO: 387); CeresClone:568942 (SEQ ID NO: 388); CeresClone:218083 (SEQ ID NO: 389); CeresClone:240010 (SEQ ID NO: 390); CeresClone:293151 (SEQ ID NO: 391); CeresClone:259439 (SEQ ID NO: 392); CeresClone:27460 (SEQ ID NO: 394); CeresClone:975540 (SEQ ID NO: 395); CeresClone:32348 (SEQ ID NO: 397); gi|12276037 (SEQ ID NO: 398); gi|586082 (SEQ ID NO: 399); CeresClone:755965 (SEQ ID NO: 400); CeresClone:241576 (SEQ ID NO: 401); gi|44889626 (SEQ ID NO: 402); gi|9965897 (SEQ ID NO: 403); gi|9965899 (SEQ ID NO: 404); gi|3915112 (SEQ ID NO: 405); gi|24571503 (SEQ ID NO: 406); CeresClone:32548 (SEQ ID NO: 408); gi|17819 (SEQ ID NO: 409); gi|18347 (SEQ ID NO: 410); gi|1346180 (SEQ ID NO: 411); CeresClone:7420 (SEQ ID NO: 412); gi|1346181 (SEQ ID NO: 413); gi|4567224 (SEQ ID NO: 414); CeresClone:13879 (SEQ ID NO: 415); gi|21553354 (SEQ ID NO: 416); CeresClone:32753 (SEQ ID NO: 418); CeresClone:21756 (SEQ ID NO: 419); CeresClone:1538293 (SEQ ID NO: 420); CeresClone:933957 (SEQ ID NO: 421); CeresClone:34167 (SEQ ID NO: 423); gi|18857720 (SEQ ID NO: 424); CeresClone:1014844 (SEQ ID NO: 425); CeresClone:527278 (SEQ ID NO: 426); CeresClone:514259 (SEQ ID NO: 427); gi|8919876 (SEQ ID NO: 428); gi|992598 (SEQ ID NO: 429); CeresClone:34385 (SEQ ID NO: 431); CeresClone:46378 (SEQ ID NO: 432); gi|50923675 (SEQ ID NO: 433); CeresClone:222358 (SEQ ID NO: 434); CeresClone:246601 (SEQ ID NO: 435); CeresClone:1213577 (SEQ ID NO: 436); CeresClone:34552 (SEQ ID NO: 438); CeresClone:35776 (SEQ ID NO: 440); gi|18377977 (SEQ ID NO: 441); CeresClone:1119202 (SEQ ID NO: 442); gi|757740 (SEQ ID NO: 443); gi|50947507 (SEQ ID NO: 444); gi|51965008 (SEQ ID NO: 445); gi|1155255 (SEQ ID NO: 446); gi|28628597 (SEQ ID NO: 447); gi|32400332 (SEQ ID NO: 448); CeresClone:36518 (SEQ ID NO: 450); CeresClone:37800 (SEQ ID NO: 451); CeresClone:564011 (SEQ ID NO: 452); CeresClone:225429 (SEQ ID NO: 453); CeresClone:450648 (SEQ ID NO: 454); CeresClone:326 (SEQ ID NO: 455); CeresClone:36891 (SEQ ID NO: 457); CeresClone:861902 (SEQ ID NO: 458); CeresClone:471579 (SEQ ID NO: 459); CeresClone:422618 (SEQ ID NO: 460); CeresClone:686137 (SEQ ID NO: 461); CeresClone:1315179 (SEQ ID NO: 462); CeresClone:725504 (SEQ ID NO: 463); CeresClone:705622 (SEQ ID NO: 464); CeresClone 726433 (SEQ ID NO: 465); CeresClone:256068 (SEQ ID NO: 466); CeresClone:264576 (SEQ ID NO: 467); CeresClone:1412402 (SEQ ID NO: 468); CeresClone:914491 (SEQ ID NO: 469); CeresClone:773962 (SEQ ID NO: 470); CeresClone:36904 (SEQ ID NO: 472); gi|27803873 (SEQ ID NO: 473); CeresClone:476815 (SEQ ID NO: 474); CeresClone:336060 (SEQ ID NO: 475); gi|50910635 (SEQ ID NO: 476); CeresClone:306053 (SEQ ID NO: 477); CeresClone:37288 (SEQ ID NO: 479); gi|52789958 (SEQ ID NO: 480); CeresClone:523628 (SEQ ID N0: 481); gi|38326712 (SEQ ID NO: 482); gi|34452081 (SEQ ID NO: 483); CeresClone:37298 (SEQ ID NO: 485);

CeresClone:33731 (SEQ ID NO: 486); gi|21592895 (SEQ ID NO: 487); gi|9294221 (SEQ ID NO: 488); gi|27765032 (SEQ ID NO: 489); gi|58979188 (SEQ ID NO: 490); gi|1946329 (SEQ ID NO: 491); CeresClone:523811 (SEQ ID NO: 492); CeresClone:296971 (SEQ ID NO: 493); CeresClone:238897 (SEQ ID NO: 494); CeresClone:37663 (SEQ ID NO: 496); CeresClone:476994 (SEQ ID NO: 497); CeresClone:38101 (SEQ ID NO: 499); CeresClone:338602 (SEQ ID NO: 500); CeresClone:331439 (SEQ ID NO: 501); CeresClone:294922 (SEQ ID NO: 502); CeresClone:116045 (SEQ ID NO: 503); CeresClone:292789 (SEQ ID NO: 504); CeresClone:996136 (SEQ ID NO: 505); CeresClone:1073372 (SEQ ID NO: 506); CeresClone:41421 (SEQ ID NO: 507); CeresClone:1549130 (SEQ ID NO: 508); CeresClone:34479 (SEQ ID NO: 509); CeresClone:223048 (SEQ ID NO: 510); CeresClone:38419 (SEQ ID NO: 512); CeresClone:1125315 (SEQ ID NO: 513); CeresClone:319835 (SEQ ID NO: 514); CeresClone:944775 (SEQ ID NO: 515); CeresClone:1078589 (SEQ ID NO: 516); CeresClone:1067464 (SEQ ID NO: 517); CeresClone:38470 (SEQ ID NO: 519); CeresClone:1087891 (SEQ ID NO: 520); CeresClone:946439 (SEQ ID NO: 521); CeresClone: 1610064 (SEQ ID NO: 522); gi|45593274 (SEQ ID NO: 523); gi|28973415 (SEQ ID NO: 524); CeresClone:1061228 (SEQ ID NO: 525); CeresClone:38690 (SEQ ID NO: 527); gi|34898868 (SEQ ID NO: 528); gi|11994389 (SEQ IID NO: 529); CeresClone:39286 (SEQ ID NO: 531); CeresClone: 967750 (SEQ ID NO: 532); CeresClone:675195 (SEQ ID NO: 533); CeresClone:460412 (SEQ ID NO: 534); gi|50908821 (SEQ ID NO: 535); CeresClone:40508 (SEQ ID NO: 537); CeresClone:1063112 (SEQ ID NO: 538); CeresClone:521881 (SEQ ID NO: 539); CeresClone:217396 (SEQ ID NO: 540); CeresClone:699913 (SEQ ID NO: 541); gi|57900400 (SEQ ID NO: 542); CeresClone:40729 (SEQ ID NO: 544); CeresClone:1604687 (SEQ ID NO: 545); CeresClone:627169 (SEQ ID NO: 546); gi|34914598 (SEQ ID NO: 547); CeresClone:1397168 (SEQ ID NO: 548); gi|50909895 (SEQ ID NO: 549); CeresClone:304724 (SEQ ID NO: 550); CeresClone:41306 (SEQ ID NO: 552); CeresClone:578942 (SEQ ID NO: 553); CeresClone:41439 (SEQ ID NO: 555); gi|7228329 (SEQ ID NO: 556); gi|2981169 (SEQ ID NO: 557); gi|55734108 (SEQ ID NO: 558); gi|439493 (SEQ ID NO: 559); gi|7488707 (SEQ ID NO: 560); gi|33771374 (SEQ ID NO: 561); CeresClone:701379 (SEQ ID NO: 562); gi|2058504 (SEQ ID NO: 563); CeresClone:638614 (SEQ ID NO: 564); gi|33331578 (SEQ ID NO: 565); gi|4666360 (SEQ ID NO: 566); gi|28849865 (SEQ ID NO: 567); gi|2058506 (SEQ ID NO: 568); CeresClone: 42141 (SEQ ID NO: 570); gi|51970844 (SEQ ID NO: 571); CeresClone:1197765 (SEQ ID NO: 572); gi|4559353 (SEQ ID NO: 573); gi|45476407 (SEQ ID NO: 574); CeresClone: 512325 (SEQ ID NO: 575); gi|50934355 (SEQ ID NO: 576); CeresClone:297520 (SEQ ID NO: 577); CeresClone:92459 (SEQ ID NO: 579); CeresClone:98850 (SEQ ID NO: 580); gi|11545547 (SEQ ID NO: 581); gi|2829920 (SEQ ID NO: 582); gi|51968502 (SEQ ID NO: 583); CeresClone:963001 (SEQ ID NO: 584); CeresClone:92670 (SEQ ID NO: 586); CeresClone:1067750 (SEQ ID NO: 587); CeresClone: 1259129 (SEQ ID NO: 588); CeresClone:981652 (SEQ ID NO: 589); CeresClone:937515 (SEQ ID NO: 590); CeresClone:260168 (SEQ ID NO: 591); CeresClone:599515 (SEQ ID NO: 592); CeresClone:685681 (SEQ ID NO: 593); CeresClone:1074266 (SEQ ID NO: 594); 34904072 (SEQ ID NO: 595); CeresClone:894996 (SEQ ID NO: 596); CeresClone: 1466424 (SEQ ID NO: 597); CeresClone:94231 (SEQ ID NO: 599); CeresClone:121353 (SEQ ID NO: 600); CeresClone:981738 (SEQ ID NO: 601); CeresClone:707989 (SEQ ID NO: 602); gi|416640 (SEQ ID NO: 603); CeresClone: 471171 (SEQ ID NO: 604); gi|114733 (SEQ ID NO: 605); CeresClone:612705 (SEQ ID NO: 606); gi|414175 (SEQ ID NO: 607); gi|4887018 (SEQ ID NO: 608); gi|4887016 (SEQ ID NO: 609); gi|225314161 (SEQ ID NO: 610); CeresClone: 95135 (SEQ ID NO: 612); gi|38260472 (SEQ ID NO: 613); CeresClone:31014 (SEQ ID NO: 614); gi|38260657 (SEQ ID NO: 615); gi|21592658 (SEQ ID NO: 616); gi|3826063 (SEQ ID NO: 617); gi|7576185 (SEQ ID NO: 618); gi|4884035 (SEQ ID NO: 619); gi|138196010 (SEQ ID NO: 620); CeresClone:958836 (SEQ ID NO: 621); CeresClone:463936 (SEQ ID NO: 622); CeresClone:97434 (SEQ ID NO: 624); CeresClone:953928 (SEQ ID NO: 625); CeresClone:524682 (SEQ ID NO: 626); CeresClone:949174 (SEQ ID NO: 627); CeresClone:1299820 (SEQ ID NO: 628); gi|42565379 (SEQ ID NO: 629); CeresClone:1098019 (SEQ ID NO: 630); CeresClone:691062 (SEQ ID NO: 631); gi|47026878 (SEQ ID NO: 632); CeresClone:1120463 (SEQ ID NO: 633); gi|24473796 (SEQ ID NO: 634); CeresClone:708265 (SEQ ID NO: 635); CeresClone:473895 (SEQ ID NO: 636); CeresClone:415601 (SEQ ID NO: 637); gi|551267 (SEQ ID NO: 638); CeresClone:1117460 (SEQ ID NO: 639); CeresClone: 97480 (SEQ ID NO: 641); CeresClone:1073419 (SEQ ID NO: 642); CeresClone:1064362 (SEQ ID NO: 643); CeresClone:1067161 (SEQ ID NO: 644); gi|50941651 (SEQ ID NO: 645); CeresClone:685838 (SEQ ID NO: 646); CeresClone:462970 (SEQ ID NO: 647); CeresClone:393073 (SEQ ID NO: 648); CeresClone:606064 (SEQ ID NO: 649); CeresClone:101883 (SEQ ID NO: 650); CeresClone:1031827 (SEQ ID NO: 651); CeresClone:1502051 (SEQ ID NO: 652); CeresClone:1054195 (SEQ ID NO: 653); CeresClone:97958 (SEQ ID NO: 655); CeresClone:101583 (SEQ ID NO: 656); CeresClone:1347792 (SEQ ID NO: 657); gi|23506107 (SEQ ID NO: 658); gi|12744973 (SEQ ID NO: 659); CeresClone: 12023 (SEQ ID NO: 660); gi|62320460 (SEQ ID NO: 661); gi|15218138 (SEQ ID NO: 662); gi|289713283 (SEQ ID NO: 663); gi|47232556 (SEQ ID NO: 664); CeresClone:632026 (SEQ ID NO: 665); CeresClone:974547 (SEQ ID NO: 666); gi|5031494 (SEQ ID NO: 667); gi|5031492 (SEQ ID NO: 668); CeresClone:561287 (SEQ ID NO: 669); gi|4808524 (SEQ ID NO: 670); gi|57157826 (SEQ ID NO: 671); CeresClone:98855 (SEQ ID NO: 673); CeresClone:977670 (SEQ ID NO: 674); CeresClone:1091493 (SEQ ID NO: 673); CeresClone:945779 (SEQ ID NO: 676); CeresClone: 1092319 (SEQ ID NO: 677); CeresClone:965777 (SEQ ID NO: 678); CeresClone:963616 (SEQ ID NO: 679); CeresClone:972545 (SEQ ID NO: 680); CeresClone:99657 (SEQ ID NO: 682); CeresClone:976676 (SEQ ID NO: 683); CeresClone:962705 (SEQ ID NO: 684); CeresClone:1081690 (SEQ ID NO: 685); CeresClone:1076675 (SEQ ID NO: 686); CeresClone:1082802 (SEQ ID NO: 687); CeresClone: 102921 (SEQ ID NO: 688); CeresClone:1061399 (SEQ ID NO: 689); CeresClone:1040255 (SEQ ID NO: 690); CeresClone:1040515 (SEQ ID NO: 691); CeresClone:1389554 (SEQ ID NO: 692); CeresClone:615044 (SEQ ID NO: 693); CeresClone:1053159 (SEQ ID NO: 694); CeresClone: 1266787 (SEQ ID NO: 695); CeresClone:1039442 (SEQ ID NO: 696); CeresClone:1425999 (SEQ ID NO: 697); CeresClone:473223 (SEQ ID NO: 698); CeresClone:100465 (SEQ ID NO: 700); gi|49333371 (SEQ ID NO: 701); gi|49333385 (SEQ ID NO: 702); CeresClone:107731 (SEQ ID NO: 704); CeresClone:661643 (SEQ ID NO: 705); CeresClone:471579 (SEQ ID NO: 706); CeresClone:364892 (SEQ ID NO: 707); CeresClone:726433 (SEQ ID NO: 708); CeresClone:705622 (SEQ ID NO: 709); CeresClone:306678 (SEQ ID NO: 710); CeresClone:861902 (SEQ ID NO: 711); CeresClone:725504 (SEQ ID NO: 712); CeresClone:1412402 (SEQ ID NO: 713); CeresClone:422618 (SEQ ID NO: 714); CeresClone:264576

(SEQ ID NO: 715); CeresClone:686137 (SEQ ID NO: 716); CeresClone:110454 (SEQ ID NO: 718); gi|50906397 (SEQ ID NO: 719); CeresClone:788183 (SEQ ID NO: 720); CeresClone:544756 (SEQ ID NO: 721); CeresClone:1536888 (SEQ ID NO: 722); CeresClone:116257 (SEQ ID NO: 724); gi|2506082 (SEQ ID NO: 725); CeresClone:604415 (SEQ ID NO: 726); gi|395216 (SEQ ID NO: 727); CeresClone:292667 (SEQ ID NO: 728); CeresClone:569711 (SEQ ID NO: 729); CeresClone:780669 (SEQ ID NO: 730); CeresClone:322131 (SEQ ID NO: 731); CeresClone:544846 (SEQ ID NO: 732); CeresClone:116843 (SEQ ID NO: 734); gi|4651204 (SEQ ID NO: 735); CeresClone:299434 (SEQ ID NO: 736); gi|50947067 (SEQ ID NO: 737); CeresClone:119256 (SEQ ID NO: 739); CeresClone:324710 (SEQ ID NO: 740); gi|50935081 (SEQ ID NO: 741); CeresClone:403558 (SEQ ID NO: 742); CeresClone:473726 (SEQ ID NO: 743); CeresClone:847500 (SEQ ID NO: 744); gi|50938543 (SEQ ID NO: 745); CeresClone:123905 (SEQ ID NO: 747); CeresClone:392659 (SEQ ID NO: 748); CeresClone:901326 (SEQ ID NO: 749); CeresClone:1446523 (SEQ ID NO: 750); CeresClone:461977 (SEQ ID NO: 751); gi|50913081 (SEQ ID NO: 752); CeresClone:141805 (SEQ ID NO: 754); gi|50921411 (SEQ ID NO: 755); CeresClone:616282 (SEQ ID NO: 756); CeresClone:524063 (SEQ ID NO: 757); CeresClone:482085(SEQ ID NO: 758); CeresClone:141890 (SEQ ID NO: 760); gi|34911538 (SEQ ID NO: 761); CeresClone:147358 (SEQ ID NO: 763); CeresClone:1064362 (SEQ ID NO: 764); CeresClone:1073419 (SEQ ID NO: 765); gi|50941651 (SEQ ID NO: 766); CeresClone:226155 (SEQ ID NO: 767); CeresClone:1452131 (SEQ ID NO: 768); CeresCloije:606064 (SEQ ID NO: 769); CeresClone:1502051 (SEQ ID NO: 770); CeresClone:1018838 (SEQ ID NO: 771); CeresClone:685838 (SEQ ID NO: 772); CeresClone:462970 (SEQ ID NO: 773); CeresClone:393073 (SEQ ID NO: 774); CeresClone:148943 (SEQ ID NO: 776); CeresClone:294522 (SEQ ID NO: 777); gi|37536088 (SEQ ID NO: 778); gi|34899608 (SEQ ID NO: 779); gi|50882170 (SEQ ID NO: 780); CeresClone:338088 (SEQ ID NO: 781); gi|24111265 (SEQ ID NO: 782); CeresClone:149402 (SEQ ID NO: 784); CeresClone:157547 (SEQ ID NO: 786); CeresClone:520302 (SEQ ID NO: 787); CeresClone:922101 (SEQ ID NO: 788); CeresClone:265717 (SEQ ID NO: 789); CeresClone:298205 (SEQ ID NO: 790); CeresClone:158333 (SFQ ID NO: 792); CeresClone:1118660 (SEQ ID NO: 793); gi|62319965 (SEQ ID NO: 794); CeresClone:225157 (SEQ ID NO: 796); CeresClone:227651 (SEQ ID NO: 798); CeresClone:628769 (SEQ ID NO: 799); CeresClonc:620287 (SEQ ID NO: 800); CeresClone:691483 (SEQ ID NO: 801); CeresClone:8700 (SEQ ID NO: 802); CeresClone:1387338 (SEQ ID NO: 803); CeresClone:761481 (SEQ ID NO: 804); CeresClone:615315 (SEQ ID NO: 805); CeresClone:1326610 (SEQ ID NO: 806); CeresClone:757080 (SEQ ID NO: 807); CeresClone:1417385 (SEQ ID NO: 808); CeresClone:1057479 (SEQ ID NO: 809); CeresClone:1443563 (SEQ ID NO: 810); CeresClone:1386515 (SEQ ID NO: 811); CeresClone:1068506 (SEQ ID NO: 812); CeresClone:1081109 (SEQ ID NO: 813); CeresClone:1070341 (SEQ ID NO: 814); CeresClone:235672 (SEQ ID NO: 816); CeresClone:235672 (SEQ ID NO: 817); gi|56784045 (SEQ ID NO: 818); CeresClone:241131 (SEQ ID NO: 820); CeresClone:674257 (SEQ ID NO: 821); CeresClone:621746 (SEQ ID NO: 822); CeresClone:1334990 (SEQ ID NO: 823); CeresClone:18857 (SEQ ID NO: 824); CeresClone:262460 (SEQ ID NO: 826); gi|26451911 (SEQ ID NO: 827); CeresClone:549651 (SEQ ID NO: 828); gi|2280528 (SEQ ID NO: 829); CeresClone:544897 (SEQ ID NO: 830); gi|1841475 (SEQ ID NO: 831); CeresClone:270555 (SEQ ID NO: 833); CeresClone:1087479 (SEQ ID NO: 834); CeresClone:481710 (SEQ ID NO: 836); gi|37147896 (SEQ ID NO: 837); gi|40647095 (SEQ ID NO: 838); gi|45826358 (SEQ ID NO: 839); CeresClone:1604576 (SEQ ID NO: 840); gi|41351817 (SEQ ID NO: 841); gi|12003384 (SEQ ID NO: 842); CeresClone:1014380 (SEQ ID INO: 843); gi|45826359 (SEQ ID NO: 844); gi|49658405 (SEQ ID NO: 845); CeresClone:482122 (SEQ ID NO: 847); gi|37147896 (SEQ ID NO: 848); gi|40647095 (SEQ ID NO: 849); gi|12003384 (SEQ ID NO: 850); CeresClone:1609048 (SEQ ID NO: 851); gi|38683266 (SEQ ID NO: 852); gi|55824656 (SEQ ID NO: 853); CeresClone:1014380 (SEQ ID NO: 854); CeresClone:481710 (SEQ ID NO: 855); gi|33304979 (SEQ ID NO: 856); gi|23495458 (SEQ ID NO: 857); CeresClone:620272 (SEQ ID NO: 858); gi|49658405 (SEQ ID NO: 859); CeresClone:336457 (SEQ ID NO: 861); CeresClone:744170 (SEQ ID NO: 862); CeresClone:7191 (SEQ ID NO: 863); CeresClone:954739 (SEQ ID NO: 864); CeresClone:16314 (SEQ ID NO: 865); CeresClone:971630 (SEQ ID NO: 866); CeresClone:40714 (SEQ ID NO: 867); CeresClone:18903 (SEQ ID NO: 868); CeresClone:703819 (SEQ ID NO: 869); CeresClone:1070258 (SEQ ID NO: 870); CeresClone:536796 (SEQ ID NO: 872); gi|29893536 (SEQ ID NO: 873); CeresClone:973892 (SEQ ID NO: 874); CeresClone:1609832 (SEQ ID NO: 875); CeresClone:1081780 (SEQ ID NO: 876); CeresClone:572121 (SEQ ID NO: 878); CeresClone:1169111 (SEQ ID NO: 879); CeresClone:641355 (SEQ ID NO: 881); gi|57012753 (SEQ ID NO: 882); gi|48479320 (SEQ ID NO: 883); gi|48479286 (SEQ ID NO: 884); gi|62632035 (SEQ ID NO: 885); gi|8843894 (SEQ ID NO: 886); gi|31432356 (SEQ ID NO: 887); gi|50948573 (SEQ ID NO: 888); gi|34221729 (SEQ ID NO: 889); gi|50921987 (SEQ ID NO: 890); gi|52076099 (SEQ ID NO: 891); CeresClone:657337 (SEQ ID NO: 893); CeresClone:660003 (SEQ ID NO: 895); gi|26450255 (SEQ ID NO: 896); CeresClone:763852(SEQ ID NO: 897); CeresClone:664365 (SEQ ID NO: 899); CeresClone:664365 (SEQ ID NO: 900); gi|23452024 (SEQ ID NO: 901); gi|50920293 (SEQ ID NO: 902); CeresClone:21068 (SEQ ID NO: 903); gi|21554205 (SEQ ID NO: 904); gi57012702 (SEQ ID NO: 905); CeresClone:679923 (SEQ ID NO: 907); CeresClone:708342 (SEQ ID NO: 909); gi|29893536 (SEQ ID NO: 910); gi|12083252 (SEQ ID NO: 911); CeresClone:1609832 (SEQ ID NO: 912); gi|50946411 (SEQ ID NO: 913); CeresClone:969750 (SEQ ID NO: 915); CeresClone:26867 (SEQ ID NO: 916); gi|21555003 (SEQ ID NO: 917); CeresClone:1469452 (SEQ ID NO: 918); CeresClone:1001432 (SEQ ID NO: 920); CeresClone:533766 (SEQ ID NO: 921); CeresClone:471212 (SEQ ID NO: 922); CeresClone:792839 (SEQ ID NO: 923); CeresClone:741488 (SEQ ID NO: 924); CeresClone:1033671 (SEQ ID NO: 925); gi|34893994 (SEQ ID NO: 926); CeresClone:287037 (SEQ ID NO: 927); CeresClone:1281072 (SEQ ID NO: 928); gi|40748265 (SEQ ID NO: 929); CeresClone:1002819 (SEQ ID NO: 931); CeresClone:113457 (SEQ ID NO: 932); CeresClone:1006934 (SEQ ID NO: 934); CeresClone:1007549 (SEQ ID NO: 936); gi|21689719 (SEQ ID NO: 937); gi|2465461 (SEQ ID NO: 938); gi|820119 (SEQ ID NO: 939); gi|71495 (SEQ ID NO: 940); gi|5732912(SEQ ID NO: 941); gi|18073562 (SEQ ID NO: 942); gi|46359518 (SEQ ID NO: 943); CeresClone:1609909 (SEQ ID NO: 944); gi|56606538 (SEQ ID NO: 945); CeresClone:1020202 (SEQ ID NO: 947); CeresClone:1043081 (SEQ ID NO: 949); CeresClone:556472 (SEQ ID NO: 950); gi|28950721 (SEQ ID NO: 951); CeresClone:17356 (SEQ ID NO: 952); gi|21553845 (SEQ ID NO: 953); CeresClone:224679 (SEQ ID NO: 954); gi|50906071 (SEQ ID NO: 955); CeresClone:302607 (SEQ ID NO: 956); CeresClone:1105554 (SEQ ID NO: 958); CeresClone:1120124 (SEQ ID NO: 960); CeresClone:1124135 (SEQ ID NO: 962); CeresClone:38416 (SEQ ID NO: 964); CeresClone:99298 (SEQ ID NO: 966); gi|15293287 (SEQ ID NO: 967); gi|2098711 (SEQ ID NO: 968); gi|57014097 (SEQ ID NO: 969); gi|8671350 (SEQ ID NO: 970); gi|29602797 (SEQ ID NO: 971); gi|54303968 (SEQ ID NO: 972); gi|6689892 (SEQ ID NO: 973); CeresClone:100245 (SEQ ID NO: 975); CeresClone:1099630 (SEQ ID NO: 976); CeresClone:95559 (SEQ ID NO: 977); CeresClone:260333 (SEQ ID NO: 978); CeresClone:591143 (SEQ ID NO: 979); CeresClone:623826 (SEQ ID NO: 980); CeresClone:1100861 (SEQ ID NO: 981); CeresClone: 288489 (SEQ ID NO: 982); CeresClone:240283 (SEQ ID NO: 983); CeresClone:31041 (SEQ ID NO: 984); CeresClone:39888 (SEQ ID NO: 985); CeresClone:237589 (SEQ ID NO: 986); CeresClone:515236 (SEQ ID NO: 987); CeresClone:679007 (SEQ ID NO: 988); CeresClone:101798 (SEQ ID NO: 990); CeresClone:43057 (SEQ ID NO: 991); CeresClone:1084610 (SEQ ID NO: 992); CeresClone:1256733 (SEQ ID NO: 993); CeresClone:1606591 (SEQ ID NO: 994); CeresClone:1610037 (SEQ ID NO: 995); CeresClone: 473005 (SEQ ID NO: 996); CeresClone:745591 (SEQ ID NO: 997); CeresClone:618028 (SEQ ID NO: 998); CeresClone:770864 (SEQ ID NO: 999); CercsClouie:1017382 (SEQ ID NO: 1000); CeresClone:775154 (SEQ ID NO: 1001); CeresClone:589684 (SEQ ID NO: 1002); CeresClone:325450 (SEQ ID NO: 1003); CeresClone:481690 (SEQ ID NO: 1004); CeresClone:38370 (SEQ ID NO: 1006); CeresClone:1091268 (SEQ ID NO: 1007); CeresClone: 1604873 (SEQ ID NO: 1008); CeresClone:615767 (SEQ ID NO: 1009); CeresClone:764645 (SEQ ID NO: 1010); CeresClone:241538 (SEQ ID NO: 1011); CeresClone:1496 (SEQ ID NO: 1013); CeresClone:1120170 (SEQ ID NO: 1014); CeresClone:1449840 (SEQ ID NO: 1015); CeresClone: 34004 (SEQ ID NO: 1016); gi|23505779 (SEQ ID NO: 1017); CeresClone:1060748 (SEQ ID NO: 1018); gi|438111 (SEQ ID NO: 1019); gi|438109 (SEQ ID NO: 1020); gi|34581769 (SEQ ID NO: 1021); CeresClone:1063698 (SEQ ID NO: 1022); CeresClone:1486090 (SEQ ID NO: 1023); CeresClone:1461422 (SEQ ID NO: 1024); gi|18252349 (SEQ ID NO: 1025); CeresClone:1233 (SEQ ID NO: 1026); gi|21537196 (SEQ ID NO: 1027); CeresClone: 544375 (SEQ ID NO: 1028); CeresClone:545629 (SEQ ID NO: 1029); CeresClone:850326 (SEQ ID NO: 1030); CeresClone:2561 (SEQ ID NO: 1032); CeresClone:1248535 (SEQ ID NO: 1033); CeresClone:22819 (SEQ ID NO: 1034); CeresClone:463579 (SEQ ID NO: 1035); CeresClone: 1608715 (SEQ ID NO: 1036); CeresClone:1440308 (SEQ ID NO: 1037); CeresClone:297892 (SEQ ID NO: 1038); CeresClone:479756 (SEQ ID NO: 1039); CeresClone:467309 (SEQ ID NO: 1040); CeresClone:1316364 (SEQ ID NO: 1041); CeresClone:3618 (SEQ ID NO: 1043); gi|50947055 (SEQ ID NO: 1044); CeresClone:520298 (SEQ ID NO: 1045); CeresClone:1171157 (SEQ ID NO: 1046); CeresClone:301153 (SEQ ID NO: 1047); CeresClone:7191 (SEQ ID NO: 1049); CeresClone:1388283 (SEQ ID NO: 1050); CeresClone:322573 (SEQ ID NO: 1051); CeresClone: 289956 (SEQ ID NO: 1052); CeresClone:972545 (SEQ ID NO: 1053); CeresClone:1091493 (SEQ ID NO: 1054); CeresClone:977670 (SEQ ID NO: 1055); CeresClone: 963616 (SEQ ID NO: 1056); CeresClone:8254 (SEQ ID NO: 1058); CeresClone:635423 (SEQ ID NO: 1059); CeresClone:219727 (SEQ ID NO: 1060); gi|50931507 (SEQ ID NO: 1064); CeresClone:8877 (SEQ ID NO: 1063); gi|2501578 (SEQ ID NO: 1064); CeresClone:707209 (SEQ ID NO: 1065); gi|46399271 (SEQ ID NO: 1066); gi|45477167 (SEQ ID NO: 1067); gi|17104657 (SEQ ID NO:

1068); CeresClone:575584 (SEQ ID NO: 1069); gi|50933621 (SEQ ID NO: 1070); gi|45477162 (SEQ ID NO: 1071); CeresClone:1278155 (SEQ ID NO: 1072); CeresClone:1371669 (SEQ ID NO: 1073); gi|31429734 (SEQ ID NO: 1074); CeresClone:8916 (SEQ ID NO: 1076); CeresClone:945362 (SEQ ID NO: 1077); CeresClone:10879 (SEQ ID NO: 1079); CeresClone:205653 (SEQ ID NO: 1080); CeresClone:36005 (SEQ ID NO: 1081); CeresClone: 1375012 (SEQ ID NO: 1082); CeresClone:519929 (SEQ ID NO: 1083); CeresClone:759040 (SEQ ID NO: 1084); gi|50934399 (SEQ ID NO: 1085); CeresClone:19116 (SEQ ID NO: 1087); gi|8809589 (SEQ ID NO: 1088); gi|29367365 (SEQ ID NO: 1089); CeresClone:325957 (SEQ ID NO: 1090); gi|984756 (SEQ ID NO: 1091); CeresClone:19319 (SEQ ID NO: 1093); CeresClone:1171110 (SEQ ID NO: 1094); CeresClone:1286956 (SEQ ID NO: 1095); CeresClone:290537 (SEQ ID NO: 1096); CeresClone:1283332 (SEQ ID NO: 1097); CeresClone:1277502 (SEQ ID NO: 1098); CeresClone:698804 (SEQ ID NO: 1099); CeresClone:19486 (SEQ ID NO: 1101); CeresClone:3549 (SEQ ID NO: 1102); CeresClone:472861 (SEQ ID NO: 1103); CeresClone:1446800 (SEQ ID NO: 1104); CeresClone: 239171 (SEQ ID NO: 1105); CeresClone:19510 (SEQ ID NO: 1107); CeresClone:473358 (SEQ ID NO: 1108); gi|1486472 (SEQ ID NO: 1109); gi|19913109 (SEQ ID NO: 1110); gi|19913105(SEQ ID NO: 1111); gi|19913107 (SEQ ID NO: 1112); gi|53749331 (SEQ ID NO: 1113); gi|10798640 (SEQ ID NO: 1114); CeresClone:234671 (SEQ ID NO: 1115); CeresClone:1396898 (SEQ ID NO: 1116); gi|37964368 (SEQ ID NO: 1117); gi|51860703 (SEQ ID NO: 1118); CeresClone:702388 (SEQ ID NO: 1119); CeresClone:1319106 (SEQ ID NO: 1120); gi|62701911 (SEQ ID NO: 1121); gi|6165162 (SEQ ID NO: 1122); gi|2130089 (SEQ ID NO: 1123); gi|2130090 (SEQ ID NO: 1124); CeresClone:23322 (SEQ ID NO: 1126); CeresClone:950968 (SEQ ID NO: 1127); CeresClone:513057 (SEQ ID NO: 1128); CeresClone:568719 (SEQ ID NO: 1129); gi|50907613 (SEQ ID NO: 1130); CeresClone:302545 (SEQ ID NO: 1131); CeresClone:242695 (SEQ ID NO: 1132); CeresClone: 399010 (SEQ ID NO: 1133); CeresClone:1605876 (SEQ ID NO 1134); gi|1808694 (SEQ ID NO: 1135); CeresClone: 25538 (SEQ ID NO: 1137); gi|50313439 (SEQ ID NO: 1138); CeresClone:947207 (SEQ ID NO: 1139); CeresClone:463846 (SEQ ID NO: 1140); CeresClone:788296 (SEQ ID NO: 1141); CeresClone:303545 (SEQ ID NO: 1142); gi|34903270 (SEQ ID NO: 1143); gi|56783703 (SEQ ID NO: 1144); CeresClone:25607 (SEQ ID NO: 1146); gi|44190488 (SEQ ID NO: 1147); gi|1070008 (SEQ ID NO: 1148); gi|1070006 (SEQ ID NO: 1149); gi|12006165 (SEQ ID NO: 1150); CeresClone:1243020 (SEQ ID NO: 1151); gi|1143319 (SEQ ID NO: 1152); CeresClone:625652 (SEQ ID NO: 1153); CeresClone:626132 (SEQ ID NO: 1154); CeresClone:25758 (SEQ ID NO: 1156); CeresClone:598129 (SEQ ID NO: 1157); CeresClone:1045071 (SEQ ID NO: 1158); gi|34914658 (SEQ ID NO: 1159); CeresClone: 246177 (SEQ ID NO: 1160); CeresClone:616734 (SEQ ID NO: 1161); CeresClone:25886 (SEQ ID NO: 1163); CeresClone:1068409 (SEQ ID NO: 1164); CeresClone:1374642 (SEQ ID NO: 1165); CeresClone:1048933 (SEQ ID NO: 1166); CeresClone:1065662 (SEQ ID NO: 1167); CeresClone:1350261 (SEQ ID NO: 1168); CeresClone:1356804 (SEQ ID NO: 1169); CeresClone:1125290 (SEQ ID NO: 1170); CeresClone:1030509 (SEQ ID NO: 1171); CeresClone:1128260 (SEQ ID NO: 1172); CeresClone:1377743 (SEQ ID NO: 1173); CeresClone:1066115 (SEQ ID NO: 1174); CeresClone:953102 (SEQ ID NO: 1175); CeresClone:971131 (SEQ ID NO: 1176); CeresClone:1609975

(SEQ ID NO: 1177); CeresClone:1274796 (SEQ ID NO: 1178); CeresClone:1016548 (SEQ ID NO: 1179); CeresClone:1610119 (SEQ ID NO: 1180); CeresClone:27464 (SEQ ID NO: 1182); gi|15027985 (SEQ ID NO: 1183); CeresClone:957229 (SEQ ID NO: 1184); CeresClone: 1120324 (SEQ ID NO: 1185); CeresClone:476765 (SEQ ID NO: 1186); CeresClone:1509889 (SEQ ID NO: 1187); CeresClone:1369486 (SEQ ID NO: 1188); gi|50916178 (SEQ ID NO: 1189); CeresClone:28602 (SEQ ID NO: 1191); CeresClone:969510 (SEQ ID NO: 1192); Ceres Clone: 1608016 (SEQ ID NO: 1193); CeresClone:1607887 (SEQ ID NO: 1194); CeresClone:227031 (SEQ ID NO: 1195); CeresClone:1069458 (SEQ ID NO: 1196); CeresClone:212187 (SEQ ID NO: 1197); CeresClone:317418 (SEQ ID NO: 1198); CeresClone:1321295 (SEQ ID NO: 1199); CeresClone:1555466 (SEQ ID NO: 1200); CeresClone:276371 (SEQ ID NO: 1201); CeresClone:840867 (SEQ ID NO: 1202); CeresClone:99654 1 (SEQ ID NO: 1203); CeresClone:35493 (SEQ ID NO: 1205); gi|18410026 (SEQ ID NO: 1206); gi|6822071 (SEQ ID NO: 1207); gi|21593243 (SEQ ID NO: 1208); CeresClone:37377 (SEQ ID NO: 1209); gi|16417950 (SEQ ID NO: 1210); CeresClone:464546 (SEQ ID NO: 1211); CeresClone:244285 (SEQ ID NO: 1212); CeresClone:696587 (SEQ ID NO: 1213); gi|50252009 (SEQ ID NO: 1214); CeresClone:224503 (SEQ ID NO: 1215); gi|54292590 (SEQ ID NO: 1216); CeresClone:37229 (SEQ ID NO: 1218); gi|46402460 (SEQ ID NO: 1219); CeresClone:1190836 (SEQ ID NO: 1220); CeresClone:565532 (SEQ ID NO: 1221); CeresClone:285684 (SEQ ID NO: 1222); CeresClone:513688 (SEQ ID NO: 1223); CeresClone:928014 (SEQ ID NO: 1224); CeresClone:279840 (SEQ ID NO: 1225); gi|56785038 (SEQ ID NO: 1226); CeresClone:37493 (SEQ ID NO: 1228); gi|509252439 (SEQ ID NO: 1229); gi|54290518 (SEQ ID NO: 1230); gi|50929461 (SEQ ID NO: 1231); gi|50929459 (SEQ ID NO: 1232); gi|50929453 (SEQ ID NO: 1233); gi|10177828 (SEQ ID NO: 1234); CeresClone:38105 (SEQ ID NO: 1236); CeresClone:703932 (SEQ ID NO: 1237); gi|23296480 (SEQ ID NO: 1238); CeresClone:474785 (SEQ ID NO: 1239); gi|30524691 (SEQ ID NO: 1240); gi|51535412 (SEQ ID NO: 1241); CeresClone:38214 (SEQ ID NO: 1243); gi|62530909 (SEQ ID NO: 1244); gi|56785066 (SEQ ID NO: 1245); CeresClone:1452029 (SEQ ID NO: 1246); CeresClone: 1114366 (SEQ ID NO: 1247); gi|53749460 (SEQ ID NO: 1248); gi|51702424 (SEQ ID NO: 1249); gi|52353038 (SEQ ID NO: 1250); CeresClone:533917 (SEQ ID NO: 1251); CeresClone:41320 (SEQ ID NO: 1253); CeresClone:399596 (SEQ ID NO: 1254); CeresClone:112937 (SEQ ID NO: 1255); CeresClone:30054 (SEQ ID NO: 1256); CeresClone: 621235 (SEQ ID NO: 1257); CeresClone:516928 (SEQ ID NO: 1258); CeresClone:1556600 (SEQ ID NO: 1259); CeresClone:287422 (SEQ ID NO: 1260); CeresClone: 1245439 (SEQ ID NO: 1261); CeresClone:42533 (SEQ ID NO: 1263); gi|8919876 (SEQ ID NO: 1264); CeresClone: 1044452 (SEQ ID NO: 1265); gi|1234900 (SEQ ID NO: 1266); CeresClone:514259 (SEQ ID NO: 1267); CeresClone:527278 (SEQ ID NO: 1268); gi|1149535 (SEQ ID NO: 1269); gi|18034437 (SEQ ID NO: 1270); CeresClone: 42925 (SEQ ID NO: 1272); CeresClone:13121 (SEQ ID NO: 1273); gi|10177184 (SEQ ID NO: 1274); CeresClone: 980268 (SEQ ID NO: 1275); CeresClone:761821 (SEQ ID NO: 1276); gi|50428638 (SEQ ID NO: 1277); CeresClone: 1464627 (SEQ ID NO: 1278); CeresClone:567431 (SEQ ID NO: 1279); CeresClone:94110 (SEQ ID NO: 1281); CeresClone:95453 (SEQ ID NO: 1283); CeresClone:1091493 (SEQ ID NO: 1284); CeresClone:977670 (SEQ ID NO: 1285); CeresClone:945779 (SEQ ID NO: 1286); CeresClone:965777 (SEQ ID NO: 1287); CeresClone:1092319 (SEQ ID NO: 1288); CeresClone:963616 (SEQ ID NO: 1289); CeresClone:942159 (SEQ ID NO: 1290); CeresClone:583672 (SEQ ID NO: 1291); CeresClone:258380 (SEQ ID NO: 1292); CeresClone:972545 (SEQ ID NO: 1293); CeresClone:1101112 (SEQ ID NO: 1294); CeresClone:96020 (SEQ ID NO: 1296); CeresClone:6579 (SEQ ID NO: 1297); CeresClone:593648 (SEQ ID NO: 1298); CeresClone:218466 (SEQ ID NO: 1299); gi|50907773 (SEQ ID NO: 1300); CeresClone:697349 (SEQ ID NO: 1301); CeresClone:97415 (SEQ ID NO: 1303); CeresClone:940194 (SEQ ID NO: 1304); CeresClone:637786 (SEQ ID NO: 1305); gi|15148884(SEQ ID NO: 1306); gi|472940 (SEQ ID NO: 1307); CeresClone:923131 (SEQ ID NO: 1308); CeresClone:355400 (SEQ ID NO: 1309); gi|50915316 (SEQ ID NO: 1310); CeresClone:98340 (SEQ ID NO: 1312); CeresClone:101255 (SEQ ID NO: 1314); gi|22531114 (SEQ ID NO: 1315); gi|60460512 (SEQ ID NO: 1316); CeresClone: 673872 (SEQ ID NO: 1317); gi|3490436 (SEQ ID NO: 1318); gi|56605376 (SEQ ID NO: 1319); gi|38260609 (SEQ ID NO: 1320); CeresClone:103581 (SEQ ID NO: 1322); gi|668794 (SEQ ID NO: 1323); CeresClone:978708 (SEQ ID NO: 1324); CeresClone:678544 (SEQ ID NO: 1325); CeresClone:324937 (SEQ ID NO: 1326); CeresClone:300623 (SEQ ID NO: 1327); CeresClone:1068780 (SEQ ID NO: 1328); gi|4996640 (SEQ ID NO: 1329); gi|50928017 (SEQ ID NO: 1330); gi|3341468 (SEQ ID NO: 1331); gi|1360078 (SEQ ID NO: 1332); gi|37051131 (SEQ ID NO: 1333); CeresClone:666382 (SEQ ID NO: 1334); CeresClone: 738478 (SEQ ID NO: 1335); CeresClone:109514 (SEQ ID NO: 1337); gi|17798996 (SEQ ID NO: 1338); CeresClone: 1608104 (SEQ ID NO: 1339); gi|2346974 (SEQ ID NO: 1340); gi|34908122(SEQ ID NO: 1341); gi|55734104 (SEQ ID NO: 1342); CeresClone:569852 (SEQ ID NO: 1343); gi|2346976 (SEQ ID NO: 1344); CeresClone:603406 (SEQ ID NO: 1345); CeresClone:115946 (SEQ ID NO: 1347); CeresClone:919325 (SEQ ID NO: 1348); gi|34896098 (SEQ ID NO: 1349); CeresClone:644693 (SEQ ID NO: 1350); CeresClone:115975 (SEQ ID NO: 1352); CeresClone: 463901 (SEQ ID NO: 1353); CeresClone:559449 (SEQ ID NO: 1354); CeresClone:477913 (SEQ ID NO: 1355); CeresClone:277275 (SEQ ID NO: 1356); CeresClone:1283429 (SEQ ID NO: 1357); CeresClone:239740 (SEQ ID NO: 1358); CeresClone:117369 (SEQ ID NO: 1360); CeresClone:968213 (SEQ ID NO: 1361); CeresClone:952177 (SEQ ID NO: 1362); CeresClone:716576 (SEQ ID NO: 1363); gi|50924582 (SEQ ID NO: 1364); CeresClone: 218224 (SEQ ID NO: 1365); CeresClone:1283561 (SEQ ID NO: 1366); CeresClone:639565 (SEQ ID NO: 1367); CeresClone:1273479 (SEQ ID NO: 1368); CeresClone:389544 (SEQ ID NO: 1369); CeresClone:118337 (SEQ ID NO: 1371); CeresClone:1389175 (SEQ ID NO: 1372); CeresClone:1069165 (SEQ ID NO: 1373); CeresClone:1326914 (SEQ ID NO: 1374); CeresClone:567871 (SEQ ID NO: 1375); CeresClone:743658 (SEQ ID NO: 1376); CeresClone:1488709 (SEQ ID NO: 1377); CeresClone:1075190 (SEQ ID NO: 1378); CeresClone:939972 (SEQ ID NO: 1379); CeresClone:388126 (SEQ ID NO: 1380); CeresClone:1289769 (SEQ ID NO: 1381); CeresClone:687467 (SEQ ID NO: 1382); CeresClone:150912 (SEQ ID NO: 1384); gi|17940314 (SEQ ID NO: 1385); CeresClone:36616 (SEQ ID NO: 1386); gi|50947311 (SEQ ID NO: 1387); CeresClone:328761 (SEQ ID NO: 1388); CeresClone: 152141 (SEQ ID NO: 1390); CeresClone:1107090 (SEQ ID NO: 1391); gi|17827 (SEQ ID NO: 1392); CeresClone:95686 (SEQ ID NO: 1393); CeresClone:34420 (SEQ ID NO: 1394); gi|15221631 (SEQ ID NO: 1395); gi|4512615 (SEQ ID NO:

1396); gi|53749178 (SEQ ID NO: 1397); gi|21592944 (SEQ ID NO: 1398); gi|18377879 (SEQ ID NO: 1399); CeresClone:325158 (SEQ ID NO: 1400); CeresClone:545212 (SEQ ID NO: 1401); CeresClone:279689 (SEQ ID NO: 1402); CeresClone:157730 (SEQ ID NO: 1404); CeresClone:537600 (SEQ ID NO: 1405); CeresClone:473923 (SEQ IID NO: 1406); CeresClone:704991 (SEQ ID NO: 1407); gi|50918691 (SEQ ID NO: 1408); CeresClone: 221477 (SEQ ID NO: 1410); CeresClone:225597 (SEQ ID NO: 1412); gi|50937881 (SEQ ID NO: 1413); CeresClone: 839318 (SEQ ID NO: 1414); CeresClone:264705 (SEQ ID NO: 1416); CeresClone:108581 (SEQ ID NO: 1417); CeresClone:28462 (SEQ ID NO: 1418); CeresClone:33570 (SEQ ID NO: 1419); CeresClone:979674 (SEQ ID NO: 1420); CeresClone:977919 (SEQ ID NO: 1421); CeresClone: 1068835 (SEQ ID NO: 1422); CeresClone:1118546 (SEQ ID NO: 1423); CeresClone:967899 (SEQ ID NO: 1424); CeresClone:953793 (SEQ ID NO: 1425); CeresClone:1063637 (SEQ ID NO: 1426); CeresClone:1104229 (SEQ ID NO: 1427); CeresClone:604258 (SEQ ID NO: 1428); CeresClone:682422 (SEQ ID NO: 1429); CeresClone:620922 (SEQ ID NO: 1430); CeresClone:712495 (SEQ ID NO: 1431); CeresClone:639432 (SEQ ID NO: 1432); CeresClone:1489971 (SEQ ID NO: 1433); CeresClone:464504 (SEQ ID NO: 1435); CeresClone:627596 (SEQ ID NO: 1437); gi|12325138 (SEQ ID NO: 1438); CeresClone: 1152303 (SEQ ID NO: 1439); gi|15222937 (SEQ ID NO: 1440); CeresClone:796158 (SEQ ID NO: 1441); gi|50916627 (SEQ ID NO: 1442); gi|50939101 (SEQ ID NO: 1443); gi|12739008 (SEQ ID NO: 1444); CeresClone: 779234 (SEQ ID NO: 1445); gi|20197777 (SEQ ID NO: 1446); gi|5921925 (SEQ ID NO: 1447); CeresClone:29661 (SEQ ID NO: 1448); CeresClone:689576 (SEQ ID NO: 1449); CeresClone:729085 (SEQ ID NO: 1451); CeresClone:901184 (SEQ ID NO: 1452); gi|46242609 (SEQ ID NO: 1453); CeresClone:324157 (SEQ ID NO: 1454); CeresClone:1565969 (SEQ ID NO: 1455); gi|45593100 (SEQ ID NO: 1456); gi|50938719 (SEQ ID NO: 1457); CeresClone: 1440579 (SEQ ID NO: 1458); CeresClone:527229 (SEQ ID NO: 1459); CeresClone:1351153 (SEQ ID NO: 1460); gi|7415614 (SEQ ID NO: 1461); gi|4006894 (SEQ ID NO: 1462); CeresClone:1011386 (SEQ ID NO: 1464); CeresClone:1462142 (SEQ ID NO: 1465); CeresClone:476264 (SEQ ID NO: 1466); CeresClone:6082 (SEQ ID NO: 1468); CeresClone:1068042 (SEQ ID NO: 1469); CeresClone: 602291 (SEQ ID NO: 1470); gi|50945605 (SEQ ID NO: 1471); CeresClone:347137 (SEQ ID NO: 1472); CeresClone:894286 (SEQ ID NO: 1473); CeresClone:13812 (SEQ ID NO: 1475); CeresClone:1080126 (SEQ ID NO: 1476); CeresClone:873616 (SEQ ID NO: 1477); CeresClone: 478304 (SEQ ID NO: 1478); CeresClone:32811 (SEQ ID NO: 1480); gi|50915438 (SEQ ID NO: 1481); gi|51979387 (SEQ ID NO: 1482); CeresClone:322953 (SEQ ID NO: 1483); CeresClone:1004568 (SEQ ID NO: 1484); CeresClone:224062 (SEQ ID NO: 1486); CeresClone:1490254 (SEQ ID NO: 1487); CeresClone:1074247 (SEQ ID NO: 1488); gi|30680080 (SEQ ID NO: 1489); CeresClone:20269 (SEQ ID NO: 1490); gi|50058911 (SEQ ID NO: 1491); CeresClone:1036315 (SEQ ID NO: 1492); CeresClone: 592780 (SEQ ID NO: 1493); CeresClone:254065 (SEQ ID NO: 1495); CeresClone:39922 (SEQ ID NO: 1496); gi|21593540 (SEQ ID NO: 1497); CeresClone:477450 (SEQ ID NO: 1498); gi|32489377 (SEQ ID NO: 1492); CeresClone:241340 (SEQ ID NO: 1500); CeresClone:700178 (SEQ ID NO: 1501); CeresClone:22339 (SEQ ID NO: 1503); gi|17223670 (SEQ ID NO: 1504); gi|52548150 (SEQ ID NO: 1505); gi|52548152 (SEQ ID NO: 1506); gi|52348134 (SEQ ID NO: 1507); gi|6970411 (SEQ ID NO: 1508); gi|5031217 (SEQ ID NO: 1509); gi|14279306 (SEQ ID NO: 1510); gi|62132641 (SEQ ID NO: 1511); CeresClone:1043518 (SEQ ID NO: 1512); CeresClone:1046745 (SEQ ID NO: 1513); gi|33308109 (SEQ ID NO: 1514); gi|16973296 (SEQ ID NO: 1515); CeresClone:99784 (SEQ ID NO: 1517); gi|9759075 (SEQ ID NO: 1518); gi|12323398 (SEQ ID NO: 1519); gi|27808586 (SEQ ID NO: 1520); gi|12323395 (SEQ ID NO: 1521); gi|47232556 (SEQ ID NO: 1522); gi|6760443 (SEQ ID NO: 1523); gi|18025321 (SEQ ID NO: 1524); CeresClone:283499 (SEQ ID NO: 1525); gi|4808524 (SEQ ID NO: 1526); gi|602588 (SEQ ID NO: 1527); CeresClone: 561287 (SEQ ID NO: 1528); CeresClone:751041 (SEQ ID NO: 1529); CeresClone:286311 (SEQ ID NO: 1530); CeresClone:570057 (SEQ ID NO: 1531); CeresClone:100319 (SEQ ID NO: 1533); CeresClone:625275 (SEQ ID NO: 1534); CeresClone:1246429 (SEQ ID NO: 1535); gi|37718893 (SEQ ID NO: 1536); CeresClone:937503 (SEQ ID NO: 1537); CeresClone:1549251 (SEQ ID NO: 1538); CeresClone:124720 (SEQ ID NO: 1540); CeresClone: 975672 (SEQ ID NO: 1541); CeresClone:1044385 (SEQ ID NO: 1542); gi|55419650 (SEQ ID NO: 1543); gi|56384582 (SEQ ID NO: 1544); gi|57012880 (SEQ ID NO: 1545); gi|50929507 (SEQ ID NO: 1546); CeresClone:273307 (SEQ ID NO: 1547); CeresClone:288251 (SEQ ID NO: 1549); CeresClone:94739 (SEQ ID NO: 1550); CeresClone:35872 (SEQ ID NO: 1551); CeresClone:22599 (SEQ ID NO: 1552); CeresClone:1053778 (SEQ ID NO: 1553); CeresClone: 855135 (SEQ ID NO: 1554); CeresClone:8014 (SEQ ID NO: 1556); gi|21594431 (SEQ ID NO: 1557); gi|7486482 (SEQ ID NO: 1558); gi|21700857 (SEQ ID NO: 1559); CeresClone:13186 (SEQ ID NO: 1561); CeresClone:16204 (SEQ ID NO: 1563); CeresClone:956177 (SEQ ID NO: 1564); CeresClone:721511 (SEQ ID NO: 1565); gi|18645 (SEQ ID NO: 1566); CeresClone:641329 (SEQ ID NO: 1567); CeresClone:782784 (SEQ ID NO: 1568); gi|1052956 (SEQ ID NO: 1569); gi|436424 (SEQ ID NO: 1570); gi|729737 (SEQ ID NO: 1571); CeresClone:1060767 (SEQ ID NO: 1572); CeresClone:101250 (SEQ ID NO: 1574); CeresClone: 295792 (SEQ ID NO: 1575); CeresClone:285704 (SEQ ID NO: 1576); CeresClone:557178 (SEQ ID NO: 1577); CeresClone:754768 (SEQ ID NO: 1578); CeresClone:283597 (SEQ ID NO: 1580); CeresClone:407007 (SEQ ID NO: 1581); CeresClone:225383 (SEQ ID NO: 1582); gi|13936312 (SEQ ID NO: 1583); CeresClone:40501 (SEQ ID NO: 1584); gi|21593605 (SEQ ID NO: 1585); CeresClone:292789 (SEQ ID NO: 1587); CeresClone:996136 (SEQ ID NO: 1588); gi|62732981 (SEQ ID NO: 1589); gi|9965319 (SEQ ID NO: 1590); gi|15076949 (SEQ ID NO: 1591); gi|52353611 (SEQ ID NO: 1592); CeresClone: 122726 (SEQ ID NO: 1593); gi|24496452 (SEQ ID NO: 1594); gi|20465865 (SEQ ID NO: 1595); gi|32186890 (SEQ ID NO: 1596); CeresClone:230603 (SEQ ID NO: 1597); gi|53759189 (SEQ ID NO: 1598); CeresClone:219282 (SEQ ID NO: 1599); CeresClone:331439 (SEQ ID NO: 1600); gi|50919951 (SEQ ID NO: 1601); CeresClone:338602 (SEQ ID NO: 1602); CeresClone:299306 (SEQ ID NO: 1603); CeresClone:1952 (SEQ ID NO: 1605); CeresClone:4289 (SEQ ID NO: 1607); gi|3927829 (SEQ ID NO: 1608); gi|30684022 (SEQ ID NO: 1609); CeresClone:7925 (SEQ ID NO: 1611); CeresClone:326385 (SEQ ID NO: 1612); CeresClone:10857 (SEQ ID NO: 1614); CeresClone:1334970 (SEQ ID NO: 1615); CeresClone:648816 (SEQ ID NO: 1616); CeresClone:617857 (SEQ ID NO: 1617); CeresClone:399368 (SEQ ID NO: 1618); CeresClone:19481 (SEQ ID NO: 1620); CeresClone:342958 (SEQ ID NO: 1621); CeresClone:632710 (SEQ ID NO: 1622); CeresClone:

443426 (SEQ ID NO: 1623); CeresClone:699425 (SEQ ID NO: 1624); CeresClone:1279273 (SEQ ID NO: 1625); CeresClone:28979 (SEQ ID NO: 1627); CeresClone: 1084062 (SEQ ID NO: 1628); CeresClone:302875 (SEQ ID NO: 1629); CeresClone:1347193 (SEQ ID NO: 1630); CeresClone:653284 (SEQ ID NO: 1631); CeresClone 1605870 (SEQ ID NO: 1632); CeresClone:1606960 (SEQ ID NO: 1633); CeresClone:1608365 (SEQ ID NO: 1634); CeresClone:1054986 (SEQ ID NO: 1635); CeresClone: 37969 (SEQ ID NO: 1637); CeresClone:113719 (SEQ ID NO: 1639); gi|22531225 (SEQ ID NO: 1640); CeresClone: 713993 (SEQ ID NO: 1641); gi|50939715 (SEQ ID NO: 1642); CeresClone:288729 (SEQ ID NO: 1643); CeresClone:297897 (SEQ ID NO: 1644); gi|31432214 (SEQ ID NO: 1645); gi|31432206 (SEQ ID NO: 1646); gi|50928869 (SEQ ID NO: 1647); CeresClone:859287 (SEQ ID NO: 1648); gi|31432164 (SEC ID NO: 1649); gi|50942543 (SEQ ID NO: 1650); CeresClone:147593 (SEQ ID NO: 1652); CeresClone:1090124(SEQ ID NO: 1653); gi|8778541 (SEQ ID NO: 1654); CeresClone:912191 (SEQ ID NO: 1655); CeresClone:297709 (SEQ ID NO: 1656); CeresClone: 937009 (SEQ ID NO: 1657); gi|34908220 (SEQ ID NO: 1658); CeresClone:1052536 (SEQ ID NO: 1659); CeresClone:630011 (SEQ ID NO: 1660); CeresClone:150798 (SEQ ID NO: 1662); CeresClone:814247 (SEQ ID NO: 1663); CeresClone:467982 (SEQ ID NO: 1664); CeresClone:541495 (SEQ ID NO: 1665); CeresClone:152076 (SEQ ID NO: 1667); gi|21436345 (SEQ ID NO: 1668); CeresClone:543435 (SEQ ID NO: 1669); gi|1282960 (SEQ ID NO: 1670); CeresClone:291623 (SEQ ID NO: 1671); gi|50904335 (SEQ ID NO: 1672); CeresClone:154031 (SEQ ID NO: 1674); CeresClone:636116 (SEQ ID NO: 1675); CeresClone:286081 (SEQ ID NO: 1676); CeresClone: 246416 (SEQ ID NO: 1678); gi|9367307 (SEQ ID NO: 1679); gi|62510920 (SEQ ID NO: 1680); gi|16175371 (SEQ ID NO: 1681); gi|7677036 (SEQ ID NO: 1682); gi|33309864 (SEQ ID NO: 1683); gi|6467974 (SEQ ID NO: 1684); gi|1483232 (SEQ ID NO: 1685); gi|33355661 (SEQ ID NO: 1686); gi|30020030 (SEQ ID NO: 1687); gi|32478105 (SEQ ID NO: 1688); gi|33391153 (SEQ ID NO: 1689); CeresClone:1314092 (SEQ ID NO: 1690); gi|39843110 (SEQ ID NO: 1691); CeresClone:557009 (SEQ ID NO: 1693); CeresClone:96 (SEQ ID NO: 1695); CeresClone:949 (SEQ ID NO: 1697); gi|40787165 (SEQ ID NO: 1698); gi|33943521 (SEQ ID NO: 1699); gi|22854966 (SEQ ID NO: 1700); gi|22854942 (SEQ ID NO: 1701); gi|22854970 (SEQ ID NO: 1702); gi|22854950 (SEQ ID NO: 1703); gi|22854918 (SEQ ID NO: 1704); gi|22854982 (SEQ ID NO: 1705); gi|22854908 (SEQ ID NO: 1706); gi|22854910 (SEQ ID NO: 1707); gi|22854934 (SEQ ID NO: 1708); gi|22854916 (SEQ ID NO: 1709); CeresClone:2036 (SEQ ID NO: 1711); CeresClone:463096 (SEQ ID NO: 1712); gi|42568400 (SEQ ID NO: 1713); gi|10177354(SEQ ID NO: 1714); gi|7489457 (SEQ ID NO: 1715); CeresClone:385771 (SEQ ID NO: 1716); CeresClone:729756 (SEQ ID NO: 1717); CeresClone:615259 (SEQ ID NO: 1718); CeresClone:18857 (SEQ ID NO: 1720); CeresClone:1334990 (SEQ ID NO: 1721); gi|20466045 (SEQ ID NO: 1722); CeresClone:938230 (SEQ ID NO: 1723); gi|52353703 (SEQ ID NO: 1724); gi|12711287 (SEQ ID NO: 1725); CeresClone:305252 (SEQ ID NO: 1726); CeresClone:473814 (SEQ ID NO: 1727); CeresClone:23518 (SEQ ID NO: 1729); CeresClone: 1070069 (SEQ ID NO: 1730); CeresClone:20681 (SEQ ID NO: 1731); gi|6951719 (SEQ ID NO: 1732); gi|5532505 (SEQ ID NO 1733); CeresClone:553599 (SEQ ID NO: 1734); CeresClone:1113804 (SEQ ID NO: 1735); CeresClone:479777 (SEQ ID NO: 1736); CeresClone:1066903 (SEQ ID NO: 1737); gi|4128206 (SEQ ID NO: 1738); gi|57471724 (SEQ ID NO: 1739); CeresClone:1283519 (SEQ ID NO: 1740); CeresClone:283165 (SEQ ID NO: 1741); gi|55167942 (SEQ ID NO: 1742); CeresClone: 259723 (SEQ ID NO: 1743); gi|22671664 (SEQ ID NO: 1744); CeresClone:156655 (SEQ ID NO: 1746); CeresClone:1342938 (SEQ ID NO: 1747); CeresClone:302736 (SEQ ID NO: 1748); gi|51451351 (SEQ ID NO: 1749); CeresClone:2273 (SEQ ID NO: 1751); CeresClone:963126 (SEQ ID NO: 1752); CeresClone:1118497 (SEQ ID NO: 1753); CeresClone:4043 (SEQ ID NO: 1755); CeresClone: 5198 (SEQ ID NO: 1757); CeresClone:954882 (SEQ ID NO: 1758); gi|34896996 (SEQ ID NO: 1759); CeresClone: 370168 (SEQ ID NO: 1760); CeresClone:1577130 (SEQ ID NO: 1761); CeresClone:562212 (SEQ ID NO: 1762); CeresClone:1046446 (SEQ ID NO: 1763); CeresClone:1520658 (SEQ ID NO: 1764); CeresClone:13767 (SEQ ID NO: 1766); gi|57900163 (SEQ ID NO: 1767); CeresClone:289382 (SEQ ID NO: 1768); CeresClone:1168763 (SEQ ID NO: 1769); CeresClone:243668 (SEQ ID NO: 1770); CeresClone: 579504 (SEQ ID NO: 1771); CeresClone:467253 (SEQ ID NO: 1772); CeresClone:29150 (SEQ ID NO: 1774); CeresClone:36801 (SEQ ID NO: 1775); CeresClone:470787 (SEQ ID NO: 1776); CeresClone:34480 (SEQ ID NO: 1778); gi|17028170 (SEQ ID NO: 1779); gi|15864561 (SEQ ID NO: 1780); CeresClone:1110310 (SEQ ID NO: 1781); gi|7657879 (SEQ ID NO: 1782); gi|6069464(SEQ ID NO: 1783); gi|56201842 (SEQ ID NO: 1784); CeresClone:38625 (SEQ ID NO: 1786); CeresClone:576522 (SEQ ID NO: 1787); gi|50932981 (SEQ ID NO: 1788); CeresClone: 381453 (SEQ ID NO: 1789); CeresClone:764831 (SEQ ID NO: 1790); CeresClone:39351 (SEQ ID NO: 1792); CeresClone:1016565 (SEQ ID NO: 1793); CeresClone:687466 (SEQ ID NO: 1794); CeresClone:343468 (SEQ ID NO: 1795); CeresClone:985017 (SEQ ID NO: 1796); CeresClone:213850 (SEQ ID NO: 1797); CeresClone:463478 (SEQ ID NO: 1798); CeresClone:1058593 (SEQ ID NO: 1799); CeresClone:153053 (SEQ ID NO: 1801); CeresClone:29150 (SEQ ID NO: 1802); CeresClone:1334525 (SEQ ID NO: 1803); CeresClone:470787 (SEQ ID NO: 1804); CeresClone:159318 (SEQ ID NO: 1806); CeresClone:872284 (SEQ ID NO: 1807); CeresClone:29150 (SEQ ID NO: 1808); CeresClone:1334525 (SEQ ID NO: 1809); CeresClone:470787 (SEQ ID NO: 1810); CeresClone: 241379 (SEQ ID NO: 1812); CeresClone:1032471 (SEQ ID NO: 1813); CeresClone:467335 (SEQ ID NO: 1814); CeresClone:1600660 (SEQ ID NO: 1815); CeresClone:620092 (SEQ ID NO: 1816); CeresClone:15190 (SEQ ID NO: 1817); CeresClone:1383206 (SEQ ID NO: 1818); CeresClone:9568 (SEQ ID NO: 1819); CeresClone:1062254 (SEQ ID NO: 1820); CeresClone:1208311 (SEQ ID NO: 1821); CeresClone:5220 (SEQ ID NO: 1823); CeresClone:476857 (SEQ ID NO: 1824); gi|55296987 (SEQ ID NO: 1825); CeresClone:11214 (SEQ ID NO: 1827); gi|21281125 (SEQ ID NO: 1828); gi|7141083 (SEQ ID NO: 1829); CeresClone: 36277 (SEQ ID NO: 1830); CeresClone:977208 (SEQ ID NO: 1831); gi|14422257 (SEQ ID NO: 1832); gi|14422255 (SEQ ID NO: 1833); CeresClone:1294554 (SEQ ID NO: 1834); CeresClone:1117994 (SEQ ID NO: 1835); CeresClone:697140 (SEQ ID NO: 1836); CeresClone:264627 (SEQ ID NO: 1837); CeresClone:272165 (SEQ ID NO: 1838); CeresClone:338740 (SEQ ID NO: 1839); CeresClone:472119 (SEQ ID NO: 1840); CeresClone:563522 (SEQ ID NO: 1842); CeresClone:1116523 (SEQ ID NO: 1843); CeresClone:973582 (SEQ ID NO: 1844); CeresClone:104017 (SEQ ID NO: 1845); gi|21536580 (SEQ ID NO: 1846); CeresClone:946814 (SEQ ID NO: 1847); Ceres- Clone:35419 (SEQ ID NO: 1848); gi|20466099 (SEQ ID NO: 1849); gi|21593032 (SEQ ID NO: 1850); CeresClone: 1276697 (SEQ ID NO: 1851); CeresClone:988038 (SEQ ID NO: 1852); CeresClone:631994 (SEQ ID NO: 1853); CeresClone:457248 (SEQ ID NO: 1854); CeresClone:370255 (SEQ ID NO: 1855); CeresClone:938645 (SEQ ID NO: 1856); CeresClone:685517 (SEQ ID NO: 1857); CeresClone:395326 (SEQ ID NO: 1858); gi|50924115 (SEQ ID NO: 1859); CeresClone:21563 (SEQ ID NO: 1861); CeresClone:103157 (SEQ ID NO: 1862); CeresClone:528914 (SEQ ID NO: 1863); gi|20465737 (SEQ ID NO: 1864); gi|62318522 (SEQ ID NO: 1865); gi|55296017 (SEQ ID NO: 1866); CeresClone:1589040 (SEQ ID NO: 1867); CeresClone:6397 (SEQ ID NO: 1869); gi|57012876 (SEQ ID NO: 1870); gi|3342211 (SEQ ID NO: 1871); CeresClone:14555 (SEQ ID NO: 1873); CeresClone:1339647 (SEQ ID NO: 1874); gi|34146804 (SEQ ID NO: 1875); gi|3980415 (SEQ ID NO: 1876); CeresClone:2618 (SEQ ID NO: 1877); gi|3980399 (SEQ ID NO: 1878); gi|21554716 (SEQ ID NO: 1879); CeresClone:480984 (SEQ ID NO: 1880); CeresClone:1371320 (SEQ ID NO: 1881); CeresClone:4067 (SEQ ID NO: 1883); CeresClone:1117707 (SEQ ID NO: 1884); CeresClone:873165 (SEQ ID NO: 1885); CeresClone:41682 (SEQ ID NO: 1886); CeresClone:1345188 (SEQ ID NO: 1887); gi|30679289 (SEQ ID NO: 1888); gi|21554019 (SEQ ID NO: 1889); CeresClone:1090313 (SEQ ID NO: 1890); CeresClone:971413 (SEQ ID NO: 1891); CeresClone: 966070 (SEQ ID NO: 1892); CeresClone:719050 (SEQ ID NO: 1893); CeresClone:708048 (SEQ ID NO: 1894); CeresClone:4734 (SEQ ID NO: 1896); CeresClone:951040 (SEQ ID NO: 1897); gi|9294226 (SEQ ID NO: 1898); CeresClone: 703180 (SEQ ID NO: 1899); CeresClone:560681 (SEQ ID NO: 1900); CeresClone:13391 (SEQ ID NO: 1902); CeresClone:28643 (SEQ ID NO: 1904); gi|18377454 (SEQ ID NO: 1905); CeresClone:27627 (SEQ ID NO: 1906); CeresClone:25350 (SEQ ID NO: 1907); gi|21554374 (SEQ ID NO: 1908); CeresClone:1123729 (SEQ ID NO: 1909); CeresClone:1372632 (SEQ ID NO: 1910); CeresClone: 1374198 (SEQ ID NO: 1911); CeresClone:1421186 (SEQ ID NO: 1912); CeresClone:1078224 (SEQ ID NO: 1913); CeresClone:1039916 (SEQ ID NO: 1914); CeresClone: 1051017 (SEQ ID NO: 1915); gi|445612 (SEQ ID NO: 1916); CeresClone:733804 (SEQ ID NO: 1918); CeresClone:653656 (SEQ ID NO: 1919); CeresClone:663844 (SEQ ID NO: 1920); gi|28416803 (SEQ ID NO: 1921); CeresClone:18200 (SEQ ID NO: 1922); CeresClone: 1247092 (SEQ ID NO: 1923); CeresClone:560681 (SEQ ID NO: 1924); CeresClone:562428 (SEQ ID NO: 1925); gi|31431968 (SEQ ID NO: 1926); CeresClone:486120 (SEQ ID NO: 1927); CeresClone:503296 (SEQ ID NO: 1928); CeresClone:9221 (SEQ ID NO: 1930); CeresClone:975562 (SEQ ID NO: 1931); CeresClone:706764 (SEQ ID NO: 1932); CeresClone:588880 (SEQ ID NO: 1933); gi|16566316 (SEQ ID NO: 1934); CeresClone:5455 (SEQ ID NO: 1935); gi|42374767 (SEQ ID NO: 1936); gi|28628203 (SEQ ID NO: 1937); gi|37695573 (SEQ ID NO: 1938); CeresClone:628637 (SEQ ID NO: 1939); CeresClone: 628130 (SEQ ID NO: 1940); gi|28628205 (SEQ ID NO: 1941); CeresClone:1061370 (SEQ ID NO: 1942); CeresClone:11929 (SEQ ID NO: 1944); CeresClone:7108 (SEQ ID NO: 1945); CeresClone:275791 (SEQ ID NO: 1946); CeresClone:33231 (SEQ ID NO: 1947); CeresClone: 1379318 (SEQ ID NO: 1948); CeresClone:39154 (SEQ ID NO: 1949); CeresClone:25220 (SEQ ID NO: 1950); CeresClone:546486 (SEQ ID NO: 1951); CeresClone:909689 (SEQ ID NO: 1952); CeresClone:868632 (SEQ ID NO: 1953); CeresClone:12071 (SEQ ID NO: 1955); CeresClone: 538817 (SEQ ID NO: 1956); gi|55419652 (SEQ ID NO: 1957); gi|30577630 (SEQ ID NO: 1958); gi|1183866 (SEQ ID NO: 1959); gi|62856979 (SEQ ID NO: 1960); CeresClone:13625 (SEQ ID NO: 1962); CeresClone:873093 (SEQ ID NO: 1963); CeresClone:608685 (SEQ ID NO: 1964); CeresClone:663726 (SEQ ID NO: 1965); CeresClone: 855086 (SEQ ID NO: 1966); CeresClone:647910 (SEQ ID NO: 1967); CeresClone:1524364 (SEQ ID NO: 1968); CeresClone:686525 (SEQ ID NO: 1969); CeresClone: 225086 (SEQ ID NO: 1970); CeresClone:16865 (SEQ ID NO: 1972); CeresClone:1605695 (SEQ ID NO: 1973); CeresClone:437144 (SEQ ID NO: 1974); CeresClone: 1380019 (SEQ ID NO: 1975); CeresClone:1031152 (SEQ ID NO: 1976); CeresClone:1431307 (SEQ ID NO: 1977); CeresClone:350577 (SEQ ID NO: 1978); CeresClone: 617835 (SEQ ID NO: 1979); CeresClone:1521928 (SEQ ID NO: 1980); CeresClone:1437721 (SEQ ID NO: 1981); CeresClone:702116 (SEQ ID NO: 1982); CeresClone: 1591070 (SEQ ID NO: 1983); CeresClone:256705 (SEQ ID NO: 1984); CeresClone:1357060 (SEQ ID NO: 1985); CeresClone:1531983 (SEQ ID NO: 1986); CeresClone: 376667 (SEQ ID NO: 1987); CeresClone:18246 (SEQ ID NO: 1989); CeresClone:1376280 (SEQ ID NO: 1990); CeresClone:340652 (SEQ ID NO: 1991); CeresClone: 695982 (SEQ ID NO: 1992); CeresClone:295402 (SEQ ID NO: 1993); CeresClone:31044 (SEQ ID NO: 1995); CeresClone:902699 (SEQ ID NO: 1996); CeresClone:709819 (SEQ ID NO: 1997); gi|37536842 (SEQ ID NO: 1998); gi|21908034 (SEQ ID NO: 1999); gi|25920951 (SEQ ID NO: 2000); CeresClone:38635 (SEQ ID NO: 2002); CeresClone: 1375513 (SEQ ID NO: 2003); CeresClone:96978 (SEQ ID NO: 2004); gi|30017229 (SEQ ID NO: 2005); CeresClone: 1242841 (SEQ ID NO: 2006); gi|12651665 (SEQ ID NO: 2007); CeresClone:39155 (SEQ ID NO: 2009); CeresClone: 676435 (SEQ ID NO: 2010); CeresClone:107988 (SEQ ID NO: 2012); CeresClone:948896 (SEQ ID NO: 2013); gi|50878365 (SEQ ID NO: 2014); CeresClone:685420 (SEQ ID NO: 2015); CeresClone:705978 (SEQ ID NO: 2016); CeresClone:109912 (SEQ ID NO: 2018); CeresClone: 966236 (SEQ ID NO: 2019); CeresClone:154718 (SEQ ID NO: 2018); gi|2832408 (SEQ ID NO: 2022); gi|50872446 (SEQ ID NO: 2023); CeresClone:226122 (SEQ ID NO: 2025); CeresClone:425913 (SEQ ID NO: 2026); CeresClone:888225 (SEQ ID NO: 2027); gi|40645413 (SEQ ID NO: 2028); gi|58891213 (SEQ ID NO: 2029); gi|58891235 (SEQ ID NO: 2030); gi|41745674 (SEQ ID NO: 2031); CeresClone:545652 (SEQ ID NO: 2032); gi|58891129 (SEQ ID NO: 2033); gi|58891059 (SEQ ID NO: 2034); gi|60649824 (SEQ ID NO: 2035); gi|58891028 (SEQ ID NO: 2036); CeresClone:9132 (SEQ ID NO: 2037); CeresClone: 953501 (SEQ ID NO: 2038); CeresClone:691319 (SEQ ID NO: 2040); CeresClone:1475648 (SEQ ID NO: 2041); gi|30725634 (SEQ ID NO: 2042); CeresClone:256148 (SEQ ID NO: 2044); CeresClone:641 (SEQ ID NO: 2046); CeresClone:620977 (SEQ ID NO: 2047); CeresClone:338717 (SEQ ID NO: 2048); CeresClone:697370 (SEQ ID NO: 2049); CeresClone:3819 (SEQ ID NO: 2051); CeresClone: 338602 (SEQ ID NO: 2052); CeresClone:299306 (SEQ ID NO: 2053); CeresClone:122726 (SEQ ID NO: 2054); CeresClone:292789 (SEQ ID NO: 2055); CeresClone:1073372 (SEQ ID NO: 2056); CeresClone:327971 (SEQ ID NO: 2057); CeresClone:227487 (SEQ ID NO: 2058); CeresClone:996136 (SEQ ID NO: 2059); CeresClone:116045 (SEQ ID NO: 2060); CeresClone:331439 (SEQ ID NO: 2061); CeresClone:230603 (SEQ ID NO: 2062); CeresClone:219282 (SEQ ID NO: 20652); CeresClone:25785 (SEQ ID NO: 2064); CeresClone:41421 (SEQ ID NO: 2065);

CeresClone:294922 (SEQ ID NO: 2066); CeresClone: 1549130 (SEQ ID NO: 2067); CeresClone:223048 (SEQ ID NO: 2068); CeresClone:3853 (SEQ ID NO: 2070); CeresClone:478120 (SEQ ID NO: 2071); CeresClone:375711 (SEQ ID NO: 2072); gi|50878369 (SEQ ID NO: 2073); CeresClone:8133 (SEQ ID NO: 2075); CeresClone:966755 (SEQ ID NO: 2076); CeresClone:584341 (SEQ ID NO: 2077); CeresClone:466978 (SEQ ID NO: 2078); CeresClone:15343 (SEQ ID NO: 2080); CeresClone:773730 (SEQ ID NO: 2081); CeresClone:729952 (SEQ ID NO: 2082); CeresClone:276252 (SEQ ID NO: 2083); CeresClone:22007 (SEQ ID NO: 2085); CeresClone:700212 (SEQ ID NO: 2086); gi|50939031 (SEQ ID NO: 2087); CeresClone:23771 (SEQ ID NO: 2089); CeresClone:1429265 (SEQ ID NO: 2090); CeresClone:1050058 (SEQ ID NO: 2091); CeresClone:312541 (SEQ ID NO: 2092); CeresClone:1544938 (SEQ ID NO: 2093); CeresClone:210309 (SEQ ID NO: 2094); CeresClone:291474 (SEQ ID NO: 2095); CeresClone:221519 (SEQ ID NO: 2096); CeresClone:297035 (SEQ ID NO: 2097); CeresClone:1064683 (SEQ ID NO: 2098); CeresClone:24644 (SEQ ID NO: 2100); CeresClone: 27197 (SEQ ID NO: 2102); CeresClone:980747 (SEQ ID NO: 2103); CeresClone:1075340 (SEQ ID NO: 2104); gi|15220305 (SEQ ID NO: 2105); CeresClone:580349 (SEQ ID NO: 2106); gi|50902072 (SEQ ID NO: 2107); CeresClone:219387 (SEQ ID NO: 2108); CeresClone:325927 (SEQ ID NO: 2109); CeresClone:699286 (SEQ ID NO: 2110); CeresClone:33802 (SEQ ID NO: 2112); CeresClone: 979847 (SEQ ID NO: 2113); gi|18379174 (SEQ ID NO: 2114); CeresClone:603261 (SEQ ID NO: 2115); gi|51964500 (SEQ ID NO: 2116); CeresClone:34210 (SEQ ID NO: 2118); gi|21745398 (SEQ ID NO: 2119); CeresClone:27810 (SEQ ID NO: 2120); gi|21555401 (SEQ ID NO: 2121); gi|27311653 (SEQ ID NO: 2122); CeresClone: 581207 (SEQ ID NO: 2123); CeresClone:306792 (SEQ ID NO: 2124); CeresClone:321760 (SEQ ID NO: 2125); CeresClone:284101 (SEQ ID ND: 2126); gi|34577127 (SEQ ID NO: 2127); gi|50904897 (SEQ ID NO: 2128); gi|13661020 (SEQ ID NO: 2129); CeresClone:38757 (SEQ ID NO: 2131); gi|31430853 (SEQ ID NO: 2131); CeresClone:570295 (SEQ ID NO: 2133); gi|34914816 (SEQ ID NO: 2134); CeresClone:38785 (SEQ ID NO: 2136); CeresClone:1078352 (SEQ ID NO: 2137); CeresClone:479285 (SEQ ID NO: 2138); CeresClone:264196 (SEQ ID NO: 2139); CeresClone:512972 (SEQ ID NO: 2140); CeresClone:38843 (SEQ ID NO: 2142); CeresClone:263281 (SEQ ID NO: 2143); CeresClone:918913 (SEQ ID NO: 2144); CeresClone: 239640 (SEQ ID NO: 2145); CeresClone:798115 (SEQ ID NO: 2146); CeresClone:219950 (SEQ ID NO: 2147); CeresClone:39127 (SEQ ID NO: 2149); CeresClone:656297 (SEQ ID NO: 2150); CeresClone:769994 (SEQ ID NO: 2151); CeresClone:493668 (SEQ ID NO: 2152); CeresClone: 1608079 (SEQ ID NO: 2153); CeresClone:95855 (SEQ ID NO: 2155); gi|46396244 (SEQ ID NO: 2156); CeresClone: 1041952 (SEQ ID NO: 2157); CeresClone:99763 (SEQ ID NO: 2159); CeresClone:975383 (SEQ ID NO: 2160); gi|6969974 (SEQ ID NO: 2161); CeresClone:556334 (SEQ ID NO: 2162); gi|25809052 (SEQ ID NO: 2163); CeresClone:247046 (SEQ ID NO: 2164); gi|25044839 (SEQ ID NO: 2165); CeresClone:1608166 (SEQ ID NO: 2166); gi|56606538 (SEQ ID NO: 2167); CeresClone:106135 (SEQ ID NO: 2169); CeresClone:267657 (SEQ ID NO: 2171); CeresClone:719679 (SEQ ID NO: 2172); CeresClone: 545208 (SEQ ID NO: 2174); CeresClone:6862916 (SEQ ID NO: 2175); CeresClone:336092 (SEQ ID NO: 2176 gi|57900676 (SEQ ID NO: 2177); CeresClone:546490 (SEQ ID NO: 2179); gi|56784222 (SEQ ID NO: 2180); CeresClone:566317 (SEQ ID NO: 2182); gi|62320932 (SEQ ID NO: 2183); CeresClone:961315 (SEQ ID NO: 2184); CeresClone:786659 (SEQ ID NO: 2185); CeresClone:276062 (SEQ ID NO: 2186); CeresClone:284925 (SEQ ID NO: 2187); CeresClone:28003 (SEQ ID NO: 2189); CeresClone: 980499 (SEQ ID NO: 2190); CeresClone:1381318 (SEQ ID NO: 2191); CeresClone:225200 (SEQ ID NO: 2193); gi|38093751 (SEQ ID NO: 2194); CeresClone:646162 (SEQ ID NO: 2195); CeresClone:19080 (SEQ ID NO: 2197 CeresClone:125409 (SEQ ID NO: 2199); CeresClone:301326 (SEQ ID NO: 2201); CeresClone:908026 (SEQ ID NO: 2202); CeresClone:681088 (SEQ ID NO: 2204); gi|18378818 (SEQ ID NO: 2205); gi|25406719 (SEQ ID NO: 2206); CeresClone:25524 (SEQ ID NO: 2207); gi|21554403 (SEQ ID NO: 2208); CeresClone:973892 (SEQ ID NO: 2209); CeresClone:681222 (SEQ ID NO: 2211); CeresClone:594823 (SEQ ID NO: 2212); gi|56381907 (SEQ ID NO: 2213); gi|16323159 (SEQ ID NO: 2214); CeresClone: 298090 (SEQ ID NO: 2215); CeresClone:883658 (SEQ ID NO: 2216); CeresClone:1605060 (SEQ ID NO: 2217); gi|50929183 (SEQ ID NO: 2218); CeresClone:11975 (SEQ ID NO: 2220); gi|11096016 (SEQ ID NO: 2221); CeresClone:1592057 (SEQ ID NO: 2222); CeresClone:285432 (SEQ ID NO: 2223); CeresClone:1103933 (SEQ ID NO: 2224); CeresClone:1017106 (SEQ ID NO: 2225); CeresClone:1558718 (SEQ ID NO: 2226); CeresClone:986507 (SEQ ID NO: 2227); CeresClone:1276499 (SEQ ID NO: 2228); CeresClone:772062 (SEQ ID NO: 2229); CeresClone:1061444 (SEQ ID NO: 2230); CeresClone:381987 (SEQ ID NO: 2231); CeresClone:373922 (SEQ ID NO: 2232); CeresClone:14105 (SEQ ID NO: 2234); gi|20259079 (SEQ ID NO: 2235); CeresClone:963952 (SEQ ID NO: 2236); gi|62319459 (SEQ ID NO: 2237); CeresClone: 654289 (SEQ ID NO: 2238); CeresClone:626552 (SEQ ID NO: 2239); CeresClone:156807 (SEQ ID NO: 2241); CeresClone:281759 (SEQ ID NO: 2242); CeresClone:1603612 (SEQ ID NO: 2243); CeresClone:592749 (SEQ ID NO: 2244); CeresClone:228787 (SEQ ID NO: 2246); CeresClone:219824 (SEQ ID NO: 2247); CeresClone:266080 (SEQ ID NO: 2248); gi|29372746 (SEQ ID NO: 2249); gi|2529340 (SEQ ID NO: 2250); gi|2130078 (SEQ ID NO: 2251); gi|34903684 (SEQ ID NO: 2252); CeresClone: 513630 (SEQ ID NO: 2253); CeresClone:32791 (SEQ ID NO: 2254); CeresClone:1010174 (SEQ ID NO: 2255); CeresClone:1046745 (SEQ ID NO: 2256); CeresClone: 1251169 (SEQ ID NO: 2257); CeresClone:537272 (SEQ ID NO: 2259); CeresClone:625922 (SEQ ID NO: 2260); gi|20977642 (SEQ ID NO: 2261); CeresClone:3000 (SEQ ID NO: 2262); gi|55276120 (SEQ ID NO: 2263); gi|7446291 (SEQ ID NO: 2264); gi|27413549 (SEQ ID NO: 2265); gi|54042995 (SEQ ID NO: 2266); gi|22074783 (SEQ ID NO: 2267); gi|6016221 (SEQ ID NO: 2268); CeresClone: 1250120 (SEQ ID NO 2269); gi|18389212 (SEQ ID NO: 2270); CeresClone:239250 (SEQ ID NO: 2271); gi|4098240 (SEQ ID NO: 2272); gi|57116572 (SEQ ID NO: 2273); gi|57116570 (SEQ ID NO: 2274); CeresClone:608818 (SEQ ID NO: 2276); gi|4371295 (SEQ ID NO: 2277); CeresClone: 1561235 (SEQ ID NO: 2278); gi|20147111 (SEQ ID NO: 2279); gi|30409461 (SEQ ID NO: 2280); CeresClone: 1559765 (SEQ ID NO: 2281); CeresClone:455104 (SEQ ID NO: 2282); CeresClone:5055 (SEO ID NO: 2284); gi|1617211 (SEQ ID NO: 2285); gi|20385588 (SEQ ID NO: 2286); CeresClone:511680 (SEQ ID NO: 2287); CeresClone:467502 (SEQ ID NO: 2288); CeresClone:226181 (SEQ ID NO: 2289); CeresClone:227805 (SEQ ID NO: 2290); CeresClone:246416 (SEQ ID NO: 2291); CeresClone:1314092 (SEQ ID NO: 2292); CeresClone:331626

(SEQ ID NO: 2294); CeresClone:50940449 (SEQ ID NO: 2295); gi|21586457 (SEQ ID NO: 2296); gi|5230654 (SEQ ID NO: 2297); gi|24967140 (SEQ ID NO: 2298); gi|16549066 (SEQ ID NO: 2299); CeresClone:1314092 (SEQ ID NO: 2300); gi|4204232 (SEQ ID NO: 2301); gi|3984311 (SEQ ID NO: 2302); gi|39843110 (SEQ ID NO: 2303); gi|33309864 (SEQ ID NO: 2304); gi|7592642 (SEQ ID NO: 2305); gi|6606070 (SEQ ID NO: 2306); CeresClone: 35742 (SEQ ID NO: 2308); gi|6984233 (SEQ ID NO: 2309); CeresClone:298125 (SEQ ID NO: 2310); gi|54291188 (SEQ ID NO: 2311); CeresClone:22382 (SEQ ID NO: 2313); CeresClone:1094248 (SEQ ID NO: 2314); CeresClone: 119790 (SEQ ID NO: 2316); CeresClone:1350005 (SEQ ID NO: 2317); gi|23308275 (SEQ ID NO: 2318); CeresClone: 1379507 (SEQ ID NO: 2319); gi|3955021 (SEQ ID NO: 2320); gi|40233087 (SEQ ID NO: 2321); CeresClone: 609489 (SEQ ID NO: 2322); CeresClone:561279 (SEQ ID NO: 2323); gi|34909272 (SEQ ID NO: 2324); gi|56201899 (SEQ ID NO: 2325); CeresClone:34976 (SEQ ID NO: 2327); CeresClone:36334 (SEQ ID NO: 2329); CeresClone:690176 (SEQ ID NO: 2330); CeresClone:574698 (SEQ ID NO: 2331); CeresClone:234510 (SEQ ID NO: 2332); CeresClone:390429 (SEQ ID NO: 2333); CeresClone:102248 (SEQ ID NO: 2335); gi|28466849 (SEQ ID NO: 2336); CeresClone:1061902 (SEQ ID NO: 2337); CeresClone: 827699 (SEQ ID NO: 2338); CeresClone:562697 (SEQ ID NO: 2339); CeresClone:218046 (SEQ ID NO: 2340); CeresClone:758144 (SEQ ID NO: 2341); gi|50913049 (SEQ ID NO: 2342); gi|51536211 (SEQ ID NO: 2343); CeresClone: 305610(SEQ ID NO: 2344); CeresClone:218076 (SEQ ID NO: 2345); gi|50946783 (SEQ ID NO: 2346); CeresClone: 157709 (SEQ ID NO: 2348); gi|42822063 (SEQ ID NO: 2349); CeresClone:24885 (SEQ ID NO: 2351); CeresClone: 693935 (SEQ ID NO: 2352); CeresClone:359934 (SEQ ID NO: 2353); CeresClone:294598 (SEQ ID NO: 2354); CeresClone:839270 (SEQ ID NO: 2355); CeresClone:27810 (SEQ ID NO: 2357); gi|21745398 (SEQ ID NO: 2358); gi|22655196 (SEQ ID NO: 2359); CeresClone:34210 (SEQ ID NO: 2360); gi|21592927 (SEQ ID NO: 2361); CeresClone:581207 (SEQ ID NO: 2362); gi|50904897 (SEQ ID NO: 2363); gi|13661020 (SEQ ID NO: 2364); gi|34577127 (SEQ ID NO: 2365); CeresClone:284101 (SEQ ID NO: 2366); CeresClone:259619 (SEQ ID NO: 2367); CeresClone:306792 (SEQ ID NO: 2368); CeresClone:321760 (SEQ ID NO: 2369); CeresClone:40708 (SEQ ID NO: 2371); CeresClone:670593 (SEQ ID NO: 2372); CeresClone: 387067 (SEQ ID NO: 2373); CeresClone:27375 (SEQ ID NO: 2374); CeresClone:280334 (SEQ ID NO: 2375); CeresClone:1256091 (SEQ ID NO: 2376); CeresClone:677474 (SEQ ID NO: 2377); CeresClone:618269 (SEQ ID NO: 2378); CeresClone:40968 (SEQ ID NO: 2379); CeresClone: 113577 (SEQ ID NO: 2380); CeresClone:116117 (SEQ ID NO: 2382); CeresClone:467735 (SEQ ID NO: 2383); CeresClone:333643(SEQ ID NO: 2384); gi|57899379 (SEQ ID NO: 2385); CeresClone:538933 (SEQ ID NO: 2387); CeresClone:470921 (SEQ ID NO: 2388); CeresClone:1367041 (SEQ ID NO: 2389); CeresClone:1557119 (SEQ ID NO: 2390); CeresClone:763949 (SEQ ID NO: 2391); CeresClone:113269 (SEQ ID NO: 2392); CeresClone:115393 (SEQ ID NO: 2393); CeresClone:452749 (SEQ ID NO: 2394); CeresClone:39481 (SEQ ID NO: 2395); CeresClone: 677448 (SEQ ID NO: 2396); CeresClone:519 (SEQ ID NO: 2398); CeresClone:1247092 (SEQ ID NO: 2399); gi|28416803 (SEQ ID NO: 2400); CeresClone:18200 (SEQ ID NO: 2401); CeresClone:653656 (SEQ ID NO: 2402); CeresClone:663844 (SEQ ID NO: 2403); CeresClone: 733804 (SEQ ID NO: 2404); CeresClone:703180 (SEQ ID NO: 2405); CeresClone:560681 (SEQ ID NO: 2406); CeresClone:562428 (SEQ ID NO: 2407); CeresClone:560948 (SEQ ID NO: 2408); CeresClone:951040 (SEQ ID NO: 2409); gi|22331645 (SEQ ID NO: 2410); CeresClone: 609713 (SEQ ID NO: 2411); CeresClone:4309 (SEQ ID NO: 2413); CeresClone:11843 (SEQ ID NO: 2415); CeresClone: 1088130 (SEQ ID NO: 2416); CeresClone:946134 (SEQ ID NO: 2417); CeresClone:1085859 (SEQ ID NO: 2418); gi|47606209 (SEQ ID NO: 2419); gi|30725332 (SEQ ID NO: 2420); CeresClone:709877 (SEQ ID NO: 2421); CeresClone:479137 (SEQ ID NO: 2422); CeresClone:14033 (SEQ ID NO: 2424); gi|50508079 (SEQ ID NO: 2425); CeresClone:28528 (SEQ ID NO: 2427); CeresClone:29009 (SEQ ID NO: 2429); CeresClone:300070 (SEQ ID NO: 2430); CeresClone:32574 (SEQ ID NO: 2432); CeresClone: 1012695 (SEQ ID NO: 2433); CeresClone:1573884 (SEQ ID NO: 2434); CeresClone:479101 (SEQ ID NO: 2435); CeresClone:546712 (SEQ ID NO: 2436); CeresClone:32612 (SEQ ID NO: 2438); CeresClone:1068098 (SEQ ID NO: 2439); gi|498705 (SEQ ID NO: 2440); CeresClone:563046 (SEQ ID NO: 2441); CeresClone:737633 (SEQ ID NO: 2442); CeresClone:1607819 (SEQ ID NO: 2443); CeresClone:1608024 (SEQ ID NO: 2444); gi|38347601 (SEQ ID NO: 2445); gi|38347600 (SEQ ID NO: 2446); gi|1173349 (SEQ ID NO: 2447); CeresClone:273675 (SEQ ID NO: 2448); CeresClone:289176 (SEQ ID NO: 2449); CeresClone:984214 (SEQ ID NO: 2450); CeresClone:1444070 (SEQ ID NO: 2451); CeresClone:219485 (SEQ ID NO: 2452); CeresClone:36094 (SEQ ID NO: 2454); CeresClone:14357 (SEQ ID NO: 2455); CeresClone:265075 (SEQ ID NO: 2456); CeresClone:1000303 (SEQ ID NO: 2457); CeresClone: 97031 (SEQ ID NO: 2459); CeresClone:115966 (SEQ ID NO: 2461); gi|10998140 (SEQ ID NO: 2462); gi|25405889 (SEQ ID NO: 2463); gi|15220229 (SEQ ID NO: 2464); gi|18413965 (SEQ ID NO: 2465); gi|18413969 (SEQ ID NO: 2466); gi|8953752 (SEQ ID NO: 2467); gi|7267642 (SEQ ID NO: 2468); gi|15220221 (SEQ ID NO: 2469); gi|22325451 (SEQ ID NO: 2470); gi|22325449 (SEQ ID NO: 2471); CeresClone:121021 (SEQ ID NO: 2473); CeresClone: 1121512 (SEQ ID NO: 2474); CeresClone:1046846 (SEQ ID NO: 2475); CeresClone:248859 (SEQ ID NO: 2477); CeresClone:1126651 (SEQ ID NO: 2478); CeresClone:591984 (SEQ ID NO: 2479); CeresClone:879739 (SEQ ID NO: 2480); CeresClone:266142 (SEQ ID NO: 2482); CeresClone:1088403 (SEQ ID NO: 2483); CeresClone:30167 (SEQ ID NO: 2484); CeresClone:154257 (SEQ ID NO: 2485); CeresClone:299189 (SEQ ID NO: 2486); CeresClone:1072510 (SEQ ID NO: 2487); CeresClone:870660 (SEQ ID NO: 2488); CeresClone:1053154 (SEQ ID NO: 2489); CeresClone:568747 (SEQ ID NO: 2490); CeresClone:636196 (SEQ ID NO: 2491); CeresClone:609573 (SEQ ID NO: 2493); gi|45271576 (SEQ ID NO: 2494); CeresClone:1361030 (SEQ ID NO: 2495); gi|1935918 (SEQ ID NO: 2496); CeresClone:142380 (SEQ ID NO: 2497); gi|53749401 (SEQ ID NO: 2498); CeresClone:4716 (SEQ ID NO: 2500); CeresClone:23664 (SEQ ID NO: 2502); CeresClone:3968 (SEQ ID NO: 2504); gi|18150168 (SEQ ID NO: 2505); gi|40788039 (SEQ ID NO: 2506); gi|50252842 (SEQ ID NO: 2507); gi|38602797 (SEQ ID NO: 2508); CeresClone:98850 (SEQ ID NO: 2510); CeresClone:92459 (SEQ ID NO: 2511); gi|21617978 (SEQ ID NO: 2512); gi|51968502 (SEQ ID NO: 2513); gi|32402402 (SEQ ID NO: 2514); gi|29165411 (SEQ ID NO: 2515); CeresClone: 1065387 (SEQ ID NO: 2516); gi|17933450 (SEQ ID NO: 2517); gi|31580813 (SEQ ID NO: 2518); gi|17933458 (SEQ ID NO: 2519); gi|34591565 (SEQ ID NO: 2520);

gi|17933456 (SEQ ID NO: 2521); CeresClone:1091989 (SEQ ID NO: 2522); CeresClone:39347 (SEQ ID NO: 2523).

DETAILED DESCRIPTION OF THE INVENTION

1. DEFINITIONS

The following terms are utilized throughout this application:

Chimeric: The term "chimeric" is used to describe genes, as defined supra, or contructs wherein at least two of the elements of the gene or construct, such as the promoter and the coding sequence and/or other regulatory sequences and/or filler sequences and/or complements thereof, are heterologous to each other.

Constitutive Promoter: Promoters referred to herein as "constitutive promoters" actively promote transcription under most, but not necessarily all, environmental conditions and states of development or cell differentiation. Examples of constitutive promoters include the cauliflower mosaic virus (CaMV) 35S transcript initiation region and the 1' or 2' promoter derived from T-DNA of *Agrobacterium tumefaciens*, and other transcription initiation regions from various plant genes, such as the maize ubiquitin-1 promoter, known to those of skill.

Domain: Domains are fingerprints or signatures that can be used to characterize protein families and/or parts of proteins. Such fingerprints or signatures can comprise conserved (1) primary sequence, (2) secondary structure, and/or (3) three-dimensional conformation. Generally, each domain has been associated with either a family of proteins or motifs. Typically, these families and/or motifs have been correlated with specific in-vitro and/or in-vivo activities. A domain can be any length, including the entirety of the sequence of a protein. Detailed descriptions of the domains, associated families and motifs, and correlated activities of the polypeptides of the instant invention are described below. Usually, the polypeptides with designated domain(s) can exhibit at least one activity that is exhibited by any polypeptide that comprises the same domain(s). Domains also define areas of non-coding sequences such as promoters and miRNAs.

Endogenous: The term "endogenous," within the context of the current invention refers to any polynucleotide, polypeptide or protein sequence which is a natural part of a cell or organisms regenerated from said cell.

Exogenous: "Exogenous," as referred to within, is any polynucleotide, polypeptide or protein sequence, whether chimeric or not, that is initially or subsequently introduced into the genome of an individual host cell or the organism regenerated from said host cell by any means other than by a sexual cross. Examples of means by which this can be accomplished are described below, and include Agrobacterium-mediated transformation (of dicots—e.g Salomon et al. *EMBO J.* 3:141 (1984); Herrera-Estrella et al. *EMBO J.* 2:987 (1983); of monocots, representative papers are those by Escudero et al., *Plant J.* 10:355 (1996), Ishida et al., *Nature Biotechnology* 14:745 (1996), May et al., *Bio/Technology* 13:486 (1995)), biolistic methods (Armaleo et al., *Current Genetics* 17:97 1990)), electroporation, in planta techniques, and the like. Such a plant containing the exogenous nucleic acid is referred to here as a $T_0$ for the primary transgenic plant and $T_1$ for the first generation. The term "exogenous" as used herein is also intended to encompass inserting a naturally found element into a non-naturally found location.

Gene: The term "gene," as used in the context of the current invention, encompasses all regulatory and coding sequence contiguously associated with a single hereditary unit with a genetic function. Genes can include non-coding sequences that modulate the genetic function that include, but are not limited to, those that specify polyadenylation, transcriptional regulation, DNA conformation, chromatin conformation, extent and position of base methylation and binding sites of proteins that control all of these. Genes comprised of "exons" (coding sequences), which may be interrupted by "introns" (non-coding sequences), encode proteins. A gene's genetic function may require only RNA expression or protein production, or may only require binding of proteins and/or nucleic acids without associated expression. In certain cases, genes adjacent to one another may share sequence in such a way that one gene will overlap the other. A gene can be found within the genome of an organism, artificial chromosome, plasmid, vector, etc., or as a separate isolated entity.

Heterologous sequences: "Heterologous sequences" are those that are not operatively linked or are not contiguous to each other in nature. For example, a promoter from corn is considered heterologous to an Arabidopsis coding region sequence. Also, a promoter from a gene encoding a growth factor from corn is considered heterologous to a sequence encoding the corn receptor for the growth factor. Regulatory element sequences, such as UTRs or 3' end termination sequences that do not originate in nature from the same gene as the coding sequence originates from, are considered heterologous to said coding sequence. Elements operatively linked in nature and contiguous to each other are not heterologous to each other. On the other hand, these same elements remain operatively linked but become heterologous if other filler sequence is placed between them. Thus, the promoter and coding sequences of a corn gene expressing an amino acid transporter are not heterologous to each other, but the promoter and coding sequence of a corn gene operatively linked in a novel manner are heterologous.

Homologous gene: In the current invention, "homologous gene" refers to a gene that shares sequence similarity with the gene of interest. This similarity may be in only a fragment of the sequence and often represents a functional domain such as, examples including without limitation a DNA binding domain, a domain with tyrosine kinase activity, or the like. The functional activities of homologous genes are not necessarily the same.

Misexpression: The term "misexpression" refers to an increase or a decrease in the transcription of a coding region into a complementary RNA sequence as compared to the parental wild-type. This term also encompasses expression of a gene or coding region for a different time period as compared to the wild-type and/or from a non-natural location within the plant genome.

Percentage of sequence identity: "Percentage of sequence identity," as used herein, is determined by comparing two optimally aligned sequences over a comparison window, where the fragment of the polynucleotide or amino acid sequence in the comparison window may comprise additions or deletions (e.g., gaps or overhangs) as compared to the reference sequence (which does not comprise additions or deletions) for optimal alignment of the two sequences. The percentage is calculated by determining the number of positions at which the identical nucleic acid base or amino acid residue occurs in both sequences to yield the number of matched positions, dividing the number of matched positions by the total number of positions in the window of comparison and multiplying the result by 100 to yield the percentage of sequence identity. Optimal alignment of sequences for comparison may be conducted by the local homology algorithm of Smith and Waterman *Add. APL. Math.* 2:482 (1981), by the homology alignment algorithm of Needleman and Wunsch *J. Mol. Biol.* 48:443 (1970), by the search for similarity method of Pearson and Lipman *Proc. Natl. Acad. Sci.* (*USA*) 85: 2444 (1988), by computerized implementations of these algorithms (GAP, BESTFIT, BLAST, PASTA, and TFASTA in the Wisconsin Genetics Software Package, Genetics Computer Group (GCG), 575 Science Dr., Madison, Wis.), or by inspection. Given that two sequences have been identified for comparison, GAP and BESTFIT are preferably employed to determine their optimal alignment. Typically, the default values of 5.00 for gap weight and 0.30 for gap weight length are used. The term "substantial sequence identity" between polynucleotide or polypeptide sequences refers to polynucleotide or polypeptide comprising a sequence that has at least 80% sequence identity, preferably at least 85%, more preferably at least 90% and most preferably at least 95%, even more preferably, at least 96%, 97%, 98% or 99% sequence identity compared to a reference sequence using the programs.

Regulatory Sequence: The term "regulatory sequence," as used in the current invention, refers to any nucleotide sequence that influences transcription or translation initiation and rate, and stability and/or mobility of the transcript or polypeptide product. Regulatory sequences include, but are not limited to, promoters, promoter control elements, protein binding sequences, 5' and 3' UTRs, transcriptional start site, termination sequence, polyadenylation sequence, introns, certain sequences within a coding sequence, etc.

Stringency: "Stringency" as used herein is a function of probe length, probe composition (G+C content), and salt concentration, organic solvent concentration, and temperature of hybridization or wash conditions. Stringency is typically compared by the parameter $T_m$, which is the temperature at which 50% of the complementary molecules in the hybridization are hybridized, in terms of a temperature differential from $T_m$. High stringency conditions are those providing a condition of $T_m$−5° C. to $T_m$−10° C. Medium or moderate stringency conditions are those providing $T_m$−20° C. to $T_m$−29° C. Low stringency conditions are those providing a condition of $T_m$−40° C. to $T_m$−48° C. The relationship of hybridization conditions to $T_m$ (in ° C.) is expressed in the mathematical equation $$T_m=81.5-16.6(\log_{10}[Na^+])+0.41(\%G+C)-(600/N) \quad (1)$$

where N is the length of the probe. This equation works well for probes 14 to 70 nucleotides in length that are identical to the target sequence. The equation below for $T_m$ of DNA-DNA hybrids is useful for probes in the range of 50 to greater than 500 nucleotides, and for conditions that include an organic solvent (formamide).

$$T_m=81.5+16.6\log\{[Na^+]/(1+0.7[Na^+])\}+0.41(\%G+C)-500/L\ 0.63(\%\ \text{formamide}) \quad (2)$$

where L is the length of the probe in the hybrid. (P. Tijessen, "Hybridization with Nucleic Acid Probes" in Laboratory Techniques in Biochemistry and Molecular Biology, P. C. vand der Vliet, ed., c. 1993 by Elsevier, Amsterdam.) The $T_m$ of equation (2) is affected by the nature of the hybrid; for DNA-RNA hybrids $T_m$ is 10-15° C. higher than calculated, for RNA-RNA hybrids $T_m$ is 20-25° C. higher. Because the $T_m$ decreases about 1° C. for each 1% decrease in homology when a long probe is used (Bonner et al., *J. Mol. Biol.* 81:123 (1973)), stringency conditions in polynucleotide hybridization reactions can be adjusted to favor hybridization of polynucleotides from identical genes or related family members.

Equation (2) is derived assuming equilibrium and therefore, hybridizations according to the present invention are most preferably performed under conditions of probe excess and for sufficient time to achieve equilibrium. The time required to reach equilibrium can be shortened by inclusion of a hybridization accelerator such as dextran sulfate or another high volume polymer in the hybridization buffer.

Stringency conditions can be selected during the hybridization reaction or after hybridization has occurred by altering the salt and temperature conditions of the wash solutions used. The formulas shown above are equally valid when used to compute the stringency of a wash solution. Preferred wash solution stringencies lie within the ranges stated above; high stringency is 5-8° C. below $T_m$, medium or moderate stringency is 26-29° C. below $T_m$ and low stringency is 45-48° C. below $T_m$.

Substantially free of: A composition containing A is "substantially free of" B when at least 85% by weight of the total A+B in the composition is A. Preferably, A comprises at least about 90% by weight of the total of A+B in the composition, more preferably at least about 95% or even 99% by weight. For example, a plant gene or DNA sequence can be considered substantially free of other plant genes or DNA sequences.

Translational start site: In the context of the current invention, a "translational start site" is usually an ATG in the cDNA transcript, more usually the first ATG. A single cDNA, however, may have multiple translational start sites.

Transcription start site: "Transcription start site" is used in the current invention to describe the point at which transcription is initiated. This point is typically located about 25 nucleotides downstream from a TFIID binding site, such as a TATA box. Transcription can initiate at one or more sites within the gene, and a single gene may have multiple transcriptional start sites, some of which may be specific for transcription in a particular cell-type or tissue.

Untranslated region (UTR):A "UTR" is any contiguous series of nucleotide bases that is transcribed, but is not translated. These untranslated regions may be associated with particular functions such as increasing mRNA message stability. Examples of UTRs include, but are not limited to polyadenylation signals, terminations sequences, sequences located between the transcriptional start site and the first exon (5' UTR) and sequences located between the last exon and the end of the mRNA (3' UTR).

Variant: The term "variant" is used herein to denote a polypeptide or protein or polynucleotide molecule that differs from others of its kind in some way. For example, polypeptide and protein variants can consist of changes in amino acid sequence and/or charge and/or post-translational modifications (such as glycosylation, etc).

2. IMPORTANT CHARACTERISTICS OF THE POLYNUCLEOTIDES OF THE INVENTION

The genes and polynucleotides of the present invention are of interest because when they are misexpressed (i.e. when expressed at a non-natural location or in an increased amount) they produce plants with important modified characteristics as discussed below. These traits can be used to exploit or maximize plant products or to minimize undesirable characteristics. For example, an increase in plant height is beneficial in species grown or harvested for their main stem or trunk, such as ornamental cut flowers, fiber crops (e.g. flax, kenaf, hesperaloe, hemp) and wood producing trees. Increase in inflorescence thickness is also desirable for some ornamentals, while increases in the number, shape and size of leaves can lead to increased production/harvest from leaf crops such as lettuce, spinach, cabbage and tobacco. Likewise, a decrease in plant height is beneficial in species that are particularly susceptible to lodging or uprooting due to wind stress.

The polynucleotides and polypeptides of the invention were isolated from *Arabidopsis thaliana*, corn, soybean, wheat, *Brassica* and others as noted in the Sequence Listing. The polynucleotides and polypeptides are useful to confer on transgenic plants the properties identified for each sequence in the relevant portion (miscellaneous feature section) of the Sequence Listing. The miscellaneous feature section of the sequence listing contains, for each sequence, a description of the domain or other characteristic from which the sequence has the function known in the art for other sequences. Some identified domains are indicated with "PEam Name," signifying that the pfam name and description can be found in the pfam database on the internet. Other domains are indicated by reference to a "GI Number" from the public sequence database maintained by GenBank under the NCBI, including the non-redundant (NR) database.

The sequences of the invention can be applied to substrates for use in array applications such as, but not limited to, assays of global gene expression, under varying conditions of development, and growth conditions. The arrays are also used in diagnostic or forensic methods The polynucleotides, or fragments thereof, can also be used as probes and primers. Probe length varies depending on the application. For use as primers, probes are 12-40 nucleotides, preferably 18-30 nucleotides long. For use in mapping, probes are preferably 50 to 500 nucleotides, preferably 100-250 nucleotides long. For Southern hybridizations, probes as long as several kilobases are used.

The probes and/or primers are produced by synthetic procedures such as the triester method of Matteucci et al. *J. Am. Chem. Soc.* 103:3185(1981) or according to Urdea et al. *Proc. Natl. Acad.* 80:7461 (1981) or using commercially available automated oligonucleotide synthesizers.

The polynucleotides of the invention can be utilized in a number of methods known to those skilled in the art as probes and/or primers to isolate and detect polynucleotides including, without limitation: Southems, Northerns, Branched DNA hybridization assays, polymerase chain reaction microarray assays and variations thereof. Specific methods given by way of examples, and discussed below include:

Hybridization
Methods of Mapping
Southern Blotting
Isolating cDNA from Related Organisms
Isolating and/or Identifying Homologous and Orthologous Genes.

Also, the nucleic acid molecules of the invention can be used in other methods, such as high density oligonucleotide hybridizing assays, described, for example, in U.S. Pat. Nos. 6,004,753 and 5,945,306.

The polynucleotides or fragments thereof of the present invention can be used as probes and/or primers for detection and/or isolation of related polynucleotide sequences through hybridization. Hybridization of one nucleic acid to another constitutes a physical property that defines the polynucleotide of the invention and the identified related sequences. Also, such hybridization imposes structural limitations on the pair. A good general discussion of the factors for determining hybridization conditions is provided by Sambrook et al. ("Molecular Cloning, a Laboratory Manual, 2nd ed., c. 1989 by Cold Spring Harbor Laboratory Press, Cold Spring Harbor, N.Y.; see esp., chapters 11 and 12). Additional considerations and details of the physical chemistry of hybridization are provided by G. H. Keller and M. M. Manak "DNA Probes", $2^{nd}$ Ed. pp. 1-25, c. 1993 by Stockton Press, New York, N.Y.

When using the polynucleotides to identify orthologous genes in other species, the practitioner will preferably adjust the amount of target DNA of each species so that, as nearly as is practical, the same number of genome equivalents are present for each species examined. This prevents faint signals from species having large genomes, and thus small numbers of genome equivalents per mass of DNA, from erroneously being interpreted as absence of the corresponding gene in the genome.

The probes and/or primers of the instant invention can also be used to detect or isolate nucleotides that are "identical" to the probes or primers. Two nucleic acid sequences or polypeptides are said to be "identical" if the sequence of nucleotides or amino acid residues, respectively, in the two sequences is the same when aligned for maximum correspondence as described below.

Isolated polynucleotides within the scope of the invention also include allelic variants of the specific sequences presented in the Sequence Listing. The probes and/or primers of the invention are also used to detect and/or isolate polynucleotides exhibiting at least 80% sequence identity with the sequences of the Sequence Listing or fragments thereof. Related polynucleotide sequences can also be identified according to the methods described in U.S. patent Publication 20040137466A1, dated Jul. 15, 2004 to Jofuku et al.

With respect to nucleotide sequences, degeneracy of the genetic code provides the possibility to substitute at least one nucleotide of the nucleotide sequence of a gene with a different nucleotide without changing the amino acid sequence of the polypeptide. Hence, the DNA of the present invention also has any base sequence that has been changed from a sequence in the Sequence Listing by substitution in accordance with degeneracy of genetic code. References describing codon usage include: Carels et al., *J. Mol. Evol.* 46: 45 (1998) and Fennoy et al., *Nucl. Acids Res.* 21(23): 5294 (1993).

The polynucleotides of the invention are also used to create various types of genetic and physical maps of the genome of corn, Arabidopsis, soybean, rice, wheat, or other plants. Some are absolutely associated with particular phenotypic traits, allowing construction of gross genetic maps. Creation of such maps is based on differences or variants, generally referred to as polymorphisms, between different parents used in crosses. Common methods of detecting polymorphisms that can be used are restriction fragment length polymorphisms(RFLPs, single nucleotide polymorphisms(SNPs) or simple sequence repeats (SSRs).

The use of RFLPs and of recombinant inbred lines for such genetic mapping is described for *Arabidopsis* by Alonso-Blanco et al. (*Methods in Molecular Biology*, vol.82, "*Arabidopsis Protocols*", pp. 137-146, J. M. Martinez-Zapater and J. Salinas, eds., c. 1998 by Humana Press, Totowa, N.J.) and for corn by Burr ("Mapping Genes with Recombinant Inbreds", pp. 249-254. In Freeling, M. and V. Walbot (Ed.), *The Maize Handbook*, c. 1994 by Springer-Verlag New York, Inc.: New York, N.Y., USA; Berlin Germany; Burr et al. *Genetics* (1998) 118: 519; Gardiner, J. et al., (1993) *Genetics*

134: 917). This procedure, however, is not limited to plants and is used for other organisms (such as yeast) or for individual cells.

The polynucleotides of the present invention are also used for simple sequence repeat (SSR) mapping. Rice SSR mapping is described by Morgante et al. (*The Plant Journal* (1993) 3: 165), Panaud et al. (*Genome* (1995) 38: 1170); Senior et al. (*Crop Science* (1996) 36: 1676), Taramino et al. (*Genome* (1996) 39: 277) and Ahn et al. (*Molecular and General Genetics* (1993) 241: 483-90). SSR mapping is achieved using various methods. In one instance, polymorphisms are identified when sequence specific probes contained within a polynucleotide flanking an SSR are made and used in polymerase chain reaction (PCR) assays with template DNA from two or more individuals of interest. Here, a change in the number of tandem repeats between the SSR-flanking sequences produces differently sized fragments (U.S. Pat. No. 5,766,847). Alternatively, polymorphisms are identified by using the PCR fragment produced from the SSR-flanking sequence specific primer reaction as a probe against Southern blots representing different individuals (U. H. Refseth et al., (1997) *Electrophoresis* 18: 1519).

The polynucleotides of the invention can further be used to identify certain genes or genetic traits using, for example, known AFLP technologies, such as in EP0534858 and U.S. Pat. No. 5,878,215.

The polynucleotides of the present invention are also used for single nucleotide polymorphism (SNP) mapping.

Genetic and physical maps of crop species have many uses. For example, these maps are used to devise positional cloning strategies for isolating novel genes from the mapped crop species. In addition, because the genomes of closely related species are largely syntenic (i.e. they display the same ordering of genes within the genome), these maps are used to isolate novel alleles from relatives of crop species by positional cloning strategies.

The various types of maps discussed above are used with the polynucleotides of the invention to identify Quantitative Trait Loci (QTLs). Many important crop traits, such as the solids content of tomatoes, are quantitative traits and result from the combined interactions of several genes. These genes reside at different loci in the genome, often times on different chromosomes, and generally exhibit multiple alleles at each locus. The polynucleotides of the invention are used to identify QTLs and isolate specific alleles as described by de Vicente and Tanksley (*Genetics* 134:585 (1993)). Once a desired allele combination is identified, crop improvement is accomplished either through biotechnological means or by directed conventional breeding programs (for review see Tanksley and McCouch, *Science* 277:1063 (1997)). In addition to isolating QTL alleles in present crop species, the polynucleotides of the invention are also used to isolate alleles from the corresponding QTL of wild relatives.

In another embodiment, the polynucleotides are used to help create physical maps of the genome of corn, Arabidopsis and related species. Where polynucleotides are ordered on a genetic map, as described above, they are used as probes to discover which clones in large libraries of plant DNA fragments in YACs, BACs, etc. contain the same polynucleotide or similar sequences, thereby facilitating the assignment of the large DNA fragments to chromosomal positions. Subsequently, the large BACs, YACs, etc. are ordered unambiguously by more detailed studies of their sequence composition (e.g. Marra et al. (1997) *Genomic Research* 7:1072-1084) and by using their end or other sequences to find the identical sequences in other cloned DNA fragments. The overlapping of DNA sequences in this way allows building large contigs of plant sequences to be built that, when sufficiently extended, provide a complete physical map of a chromosome. Sometimes the polynucleotides themselves provide the means of joining cloned sequences into a contig. All scientific and patent publications cited in this paragraph are hereby incorporated by reference.

U.S. Pat. Nos. 6,287,778 and 6,500,614, both hereby incorporated by reference, describe scanning multiple alleles of a plurality of loci using hybridization to arrays of oligonucleotides. These techniques are useful for each of the types of mapping discussed above.

Following the procedures described above and using a plurality of the polynucleotides of the present invention, any individual is genotyped. These individual genotypes are used for the identification of particular cultivars, varieties, lines, ecotypes and genetically modified plants or can serve as tools for subsequent genetic studies involving multiple phenotypic traits.

Identification and isolation of orthologous genes from closely related species and alleles within a species is particularly desirable because of their potential for crop improvement. Many important crop traits, result from the combined interactions of the products of several genes residing at different loci in the genome. Generally, alleles at each of these loci make quantitative differences to the trait. Once a more favorable allele combination is identified, crop improvement is accomplished either through biotechnological means or by directed conventional breeding programs (Tanksley et al. *Science* 277:1063(1997)).

FIG. 1 provides the results of ortholog analysis according to the invention. This analysis provides a means for identifying one or more sequences that are similar or orthologous or homologous to one or more polynucleotides as noted herein, or one or more target polypeptides encoded by the polynucleotides, or otherwise noted herein and may include linking or associating a given plant phenotype or gene function with a sequence. In the method, a sequence database is provided (locally or across an internet or intranet) and a query is made against the sequence database using the relevant sequences herein and associated plant phenotypes or gene functions.

In particular, the polypeptide sequences of the invention (the "query sequences") were used to query against the Applicant's own internal database of various plant sequences and against the entire NCBI GenBank database. This search resulted in an alignment for each query sequence with it's identified orthologous sequences, and that group of sequences provided the basis for identifying a respective consensus sequence. FIG. 1 sets forth the various alignments, wherein each query sequence is identified as a "Lead-Ceres Clone" followed by a numerical ID, the orthologs identified from the Applicant's internal database are identified as "Ceres Clone" followed by a numerical ID, and the orthologs identified from GenBank are identified as "gi" followed by a numerical ID. Each ortholog group, consisting of a query sequence (Lead-Ceres Clone), the identified orthologs, and the respective consensus sequence begins with a title that includes an identification of the relevant Lead-Ceres Clone.

The alignments of FIG. 1 also include an identification of the conserved domains or conserved regions, namely those domains or regions that are conserved across the group of orthologous sequences. One skilled in the art will recognize that each of the sequences in a particular ortholog group will be useful for the same purpose(s) as the Lead-Ceres Clone of that group, and that other useful orthologs can be designed or identified by taking into consideration the conserved regions or domains.

To aid in understanding the relationship of the various sequence identifiers used in this application, Table 1 provides a cross-reference for each polynucleotide sequence. In particular, Table 1 matches each polynucleotide sequence in the Sequence Listing ("SEQ ID NO:") with (1) a number referred to as,the "Ceres Clone ID" that is cited in the Sequence Listing as an internal identifier for the Applicant; (2) a similar identifier also utilized in the Sequence Listing and (3) the identifier utilized in the Homolog Table of FIG. 1 that references the sequence as a "Lead-Ceres Clone" and was used as the query sequence for identifying a homologous group of sequences. The SEQ ID NOS. in the Sequence Listing that are not in the Table 1 cross reference represent the polypeptide sequences that are coded by the next prior SEQ ID NO. or are part of the homolog group identified in FIG. 1. For example, SEQ ID NO: 1 is a polynucleotide sequence that encodes the polypeptide of SEQ ID NO:2 while SEQ ID NOS: 3-4 are the homologs of SEQ ID NO: 2 as shown in FIG. 1. Similarly, SEQ ID NO:5 is a polynucleotide sequence that encodes the polypeptide of SEQ ID NO:6 while SEQ ID NOS: 7-21 are the homologs of SEQ ID NO: 6 as shown in FIG. 1.

4. USE OF THE GENES TO MAKE TRANSGENIC PLANTS

To use the sequences of the present invention or a combination of them or parts and/or mutants and/or fusions and/or variants of them, recombinant DNA constructs are prepared which comprise the polynucleotide sequences of the invention inserted into a vector, and which are suitable for transformation of plant cells. The construct is made using standard recombinant DNA techniques (Sambrook et al. 1989) and is introduced to the species of interest by *Agrobacterium*-mediated transformation or by other means of transformation as referenced below.

The vector backbone is any of those typical in the art such as plasmids (such as Ti plasmids), viruses, artificial chromosomes, BACs, YACs and PACs and vectors of the sort described by (a) BAC: Shizuya et al., Proc. Natl. Acad. Sci. USA 89: 8794-8797 (1992); Hamilton et al., Proc. Natl. Acad. Sci. USA 93: 9975-9979 (1996);

(b) YAC: Burke et al., Science 236:806-812 (1987);

(c) PAC: Stemberg N. et al., Proc Natl Acad Sci U S A. January;87(l):103-7 (1990);

(d) Bacteria-Yeast Shuttle Vectors: Bradshaw et al., Nucl Acids Res 23: 4850-4856 (1995);

(e) Lambda Phage Vectors: Replacement Vector, e.g., Frischauf et al., J. Mol Biol 170:

827-842 (1983); or Insertion vector, e.g., Huynh et al., In: Glover N M (ed) DNA Cloning: A practical Approach, Vol.1 Oxford: IRL Press (1985); T-DNA gene fusion vectors :Walden et al., Mol Cell Biol 1: 175-194 (1990); and (g) Plasmid vectors: Sambrook et al., infra.

Typically, the construct comprises a vector containing a sequence of the present invention with any desired transcriptional and/or translational regulatory sequences, such as promoters, UTRs, and 3' end termination sequences. Vectors can also include origins of replication, scaffold attachment regions (SARs), markers, homologous sequences, introns, etc. The vector may also comprise a marker gene that confers a selectable phenotype on plant cells. The marker may encode biocide resistance, particularly antibiotic resistance, such as resistance to kanamycin, G418, bleomycin, hygromycin, or herbicide resistance, such as resistance to chlorosulfuron, glyphosate or phosphinotricin.

A plant promoter fragment is used that directs transcription of the gene in all tissues of a regenerated plant and/or is a constitutive promoter. Alternatively, the plant promoter directs transcription of a sequence of the invention in a specific tissue (tissue-specific promoter) or is otherwise under more precise environmental control (inducible promoter).

If proper polypeptide production is desired, a polyadenylation region at the 3'-end of the coding region is typically included. The polyadenylation region is derived from the natural gene, from a variety of other plant genes, or from T-DNA, synthesized in the laboratory.

Transformation

Techniques for transforming a wide variety of higher plant species are well known and described in the technical and scientific literature. See, e.g. Weising et al., *Ann. Rev. Genet.* 22:421 (1988); and Christou, Euphytica, v. 85, n.1-3:13-27, (1995).

The person skilled in the art knows processes for the transformation of monocotyledonous and dicotyledonous plants. A variety of techniques are available for introducing DNA into a plant host cell. These techniques comprise transformation of plant cells by DNA injection, DNA electroporation, use of bolistics methods, protoplast fusion and via T-DNA using *Agrobacterium tumefaciens* or *Agrobacterium rhizogenes*, as well as further possibilities, or other bacterial hosts for Ti plasmid vectors. See for example, Broothaerts et al., Gene Transfer to Plants by Diverse Species of Bacteria, *Nature*, Vol. 433, pp. 629-633, Feb. 10, 2005.

DNA constructs of the invention are introduced into the cell or the genome of the desired plant host by a variety of conventional techniques. For example, the DNA construct is introduced using techniques such as electroporation, microinjection and polyethylene glycol precipitation of plant cell protoplasts or protoplast fusion. Electroporation techniques are described in Fromm et al. *Proc. Natl Acad Sci. USA* 82:5824 (1985). Microinjection techniques are known in the art and well described in the scientific and patent literature. The plasmids do not have to fulfill specific requirements for use in DNA electroporation or DNA injection into plant cells. Simple plasmids such as pUC derivatives can be used.

The introduction of DNA constructs using polyethylene glycol precipitation is described in Paszkowski-et al. *EMBO J.* 3:2717 (1984). Introduction of foreign DNA using protoplast fusion is described by Willmitzer (Willmitzer, L., 1993 Transgenic plants. In: Biotechnology, A Multi-Volume Comprehensive Treatise (H. J. Rehm, G. Reed, A. Puhler, P. Stadler, eds.), Vol. 2, 627-659, VCH Weinheim-New York-Basel-Cambridge).

Alternatively, the DNA constructs of the invention are introduced directly into plant tissue using ballistic methods, such as DNA particle bombardment. Ballistic transformation techniques are described in Klein et al. *Nature* 327:773 (1987). Introduction of foreign DNA using ballistics is described by Willmitzer (Willmitzer, L., 1993 Transgenic plants. In: Biotechnology, A Multi-Volume Comprehensive Treatise (H. J. Rehm, G. Reed, A. Puhler, P. Stadler, eds.), Vol. 2, 627-659, VCH Weinheim-New York-Basel-Cambridge).

DNA constructs are also introduced with the help of *Agrobacteria*. The use of *Agrobacteria* for plant cell transformation is extensively examined and sufficiently disclosed in the specification of EP-A 120 516, and in Hoekema (In: The Binary Plant Vector System Offsetdrukkerij Kanters B.V., Alblasserdarn (1985), Chapter V), Fraley et al. (Crit. Rev. Plant. Sci. 4, 1-46) and DePicker et al. (EMBO J. 4 (1985), 277-287). Using this technique, the DNA constructs of the invention are combined with suitable T-DNA flanking regions and introduced into a conventional *Agrobacterium tumefaciens* host vector. The virulence functions of the *Agrobacterium tumefaciens* host direct the insertion of the construct and adjacent marker(s) into the plant cell DNA when the cell is infected by the bacteria (McCormac et al., 1997, *Mol. Biotechnol* 8:199; Hamilton, 1997, *Gene* 200:107; Salomon et al., 1984 *EMBO J.* 3:141; Herrera-Estrella et al., 1983 *EMBO J.* 2:987). *Agrobacterium tumefaciens*-mediated transformation techniques, including disarming and use of binary or co-integrate vectors, are well described in the scientific literature. See, for example Hamilton, C M., *Gene* 200:107 (1997); Müller et al. *Mol. Gen. Genet.* 207:171 (1987); Komari et al. *Plant J.* 10:165 (1996); Venkateswarlu et al. *Biotechnology* 9:1103 (1991) and Gleave, A P., *Plant Mol Biol.* 20:1203 (1992); Graves and Goldman, *Plant Mol. Biol.* 7:34 (1986) and Gould et al., *Plant Physiology* 95:426 (1991).

For plant cell T-DNA transfer of DNA, plant organs, e.g. infloresences, plant explants, plant cells that have been cultured in suspension or protoplasts are co-cultivated with *Agrobacterium tumefaciens* or *Agrobacterium rhizogenes* or other suitable T-DNA hosts. Whole plants are regenerated from the infected plant material or seeds generated from infected plant material using a suitable medium that contains antibiotics or biocides for the selection of transformed cells or by spraying the biocide on plants to select the transformed plants. Plants obtained in this way are then examined for the presence of the DNA introduced. The transformation of dicotyledonous plants via Ti-plasmid-vector systems and *Agrobacterium tumefaciens* is well established.

Monocotyledonous plants are also transformed by means of *Agrobacterium* based vectors (See Chan et al., Plant Mol. Biol. 22 (1993), 491-506; Hiei et al., Plant J. 6 (1994), 271-282; Deng et al., Science in China 33 (1990), 28-34; Wilmink et al., Plant Cell Reports 11 (1992), 76-80; May et al., Bio/Technology 13 (1995), 486-492; Conner and Domisse; Int. J. Plant Sci. 153 (1992), 550-555; Ritchie et al., Transgenic Res. 2 (1993), 252-265). Maize transformation in particular is described in the literature (see, for example, W095/06128, EP 0 513 849; EP 0 465 875; Frornm et al., Biotechnology 8 (1990), 833-844; Gordon-Kamm et al., Plant Cell 2 (1990), 603-618; Koziel et al., Biotechnology 11 (1993), 194-200). In EP 292 435 and in Shillito et al. (1989, Bio/Technology 7, 581) fertile plants are obtained from a mucus-free, soft (friable) maize callus. Prioli and Sondahl (1989, Bio/Technology 7, 589) also report regenerating fertile plants from maize protoplasts of the maize Cateto inbred line, Cat 100-1.

Other cereal species have also been successfully transformed, such as barley (Wan and Lemaux, see above; Ritala et al., see above) and wheat (Nehra et al., 1994, Plant J. 5, 285-297).

Alternatives to *Agrobacterium* transformation for plants are ballistics, protoplast fusion, electroporation of partially permeabilized cells and use of glass fibers (See Wan and Lemaux, Plant Physiol. 104 (1994), 37-48; Vasil et al., Bio/Technology 11 (1993), 1553-1558; Ritala et al., Plant Mol. Biol. 24 (1994), 317-325; Spencer et al., Theor. Appl. Genet. 79 (1990), 625-631)).

Introduced DNA is usually stable after integration into the plant genome and is transmitted to the progeny of the transformed cell or plant. Generally the transformed plant cell contains a selectable marker that makes the transformed cells resistant to a biocide or an antibiotic such as kanamycin, G 418, bleomycin, hygromycin, phosphinotricin or others. Therefore, the individually chosen marker should allow the selection of transformed cells from cells lacking the introduced DNA.

The transformed cells grow within the plant in the usual way (McCormick et al., 1986, Plant Cell Reports 5, 81-84) and the resulting plants are cultured normally. Transformed plant cells obtained by any of the above transformation techniques are cultured to regenerate a whole plant that possesses the transformed genotype and thus the desired phenotype. Such regeneration techniques rely on manipulation of certain phytohormones in a tissue culture growth medium, typically relying on a biocide and/or herbicide marker that has been introduced together with the desired nucleotide sequences.

Plant regeneration from cultured protoplasts is described in Evans et al., *Protoplasts Isolation and Culture* in "Handbook of Plant Cell Culture," pp. 124-176, MacMillan Publishing Company, New York, 1983; and Binding, *Regeneration of Plants, Plant Protoplasts*, pp.21-73, CRC Press, Boca Raton, 1988. Regeneration also occurs from plant callus, explants, organs, or parts thereof. Such regeneration techniques are described generally in Klee et al. *Ann. Rev. of Plant Phys.* 38:467 (1987). Regeneration of monocots (rice) is described by Hosoyama et al., (*Biosci Biotechnol Biochem.* 58:1500 (1994)) and by Ghosh et al. (*J. Biotechnol.* 32:1 (1994)). Useful and relevant procedures for transient expression are also described in U.S. Application No. 60/537,070 filed on Jan. 16, 2004 and PCT Application No. PCT/US2005/001153 filed on Jan. 14, 2005.

After transformation, seeds are obtained from the plants and used for testing stability and inheritance. Generally, two or more generations are cultivated to ensure that the phenotypic feature is stably maintained and transmitted.

One of skill will recognize that after the expression cassette is stably incorporated in transgenic plants and confirmed to be operable, it can be introduced into other plants by sexual crossing. Any of a number of standard breeding techniques can be used, depending upon the species to be crossed.

The nucleotide sequences according to the invention generally encode an appropriate protein from any organism, in particular from plants, fungi, bacteria or animals. The sequences preferably encode proteins from plants or fungi. Preferably, the plants are higher plants, in particular starch or oil storing useful plants, such as potato or cereals such as rice, maize, wheat, barley, rye, triticale, oat, millet, etc., as well as spinach, tobacco, sugar beet, soya, cotton etc.

In principle, the process according to the invention can be applied to any plant. Therefore, monocotyledonous as well as dicotyledonous plant species are particularly suitable. The process is preferably used with plants that are interesting for agriculture, horticulture and/or forestry. Examples are vegetable plants such as cucumber, melon, pumpkin, eggplant, zucchini, tomato, spinach, cabbage species, peas, beans, etc., as well as fruits such as pears, apples, etc.

Thus, the invention has use over a broad range of plants, preferably higher plants, pertaining to the classes of *Angiospermae* and *Gymnospermae*. Plants of the subclasses of the *Dicotylodenae* and the *Monocotyledonae* are particularly suitable. Dicotyledonous plants belong to the orders of the *Magniolales, Illiciales, Laurales, Piperales Aristochiales, Nymphaeales, Ranunculales, Papeverales, Sarraceniaceae, Trochodendrales, Hamamelidales, Eucomiales, Leitneriales, Myricales, Fagales, Casuarinales, Caryophyllales, Batales, Polygonales, Plumbaginales, Dilleniales, Theales, Malvales, Urticales, Lecythidales, Violales, Salicales, Capparales, Ericales, Diapensales, Ebenales, Primulales, Rosales, Fabales, Podostemales, Haloragales, Myrtales, Cornales, Proteales, Santales, Rafflesiales, Celastrales, Euphorbiales, Rhamnales, Sapindales, Juglandales, Geraniales, Polygalales, Umbellales, Gentianales, Polemoniales, Lamiales, Plantaginales, Scrophulariales, Campanulales,*

*Rubiales, Dipsacales*, and *Asterales*. Monocotyledonous plants belong to the orders of the *Alismatales, Hydrocharitales, Najadales, Triuridales, Commelinales, Eriocaulales, Restionales, Poales, Juncales, Cyperales, Typhales, Bromeliales, Zingiberales, Arecales, Cyclanthales, Pandanales, Arales, Lilliales*, and *Orchidales*. Plants belonging to the class of the *Gymnospermae* are *Pinales, Ginkgoales, Cycadales* and *Gnetales*.

The method of the invention is preferably used with plants that are interesting for agriculture, horticulture, biomass for bioconversion and/or forestry. Examples are tobacco, oilseed rape, sugar beet, potato, tomato, cucumber, pepper, bean, pea, citrus fruit, apple, pear, berries, plum, melon, eggplant, cotton, soybean, sunflower, rose, poinsettia, petunia, guayule, cabbage, spinach, alfalfa, artichoke, corn, wheat, rye, barley, grasses such as switch grass or turf grass, millet, hemp, banana, poplar, eucalyptus trees, conifers.

5. PHENOTYPE SCREENS AND RESULTS 5.1 Triparental Mating and Vacuum Infiltration Transformation of Plants The function/phenotype characteristics of the sequences of the invention were determined by means of screens with transgenic plants. Standard laboratory techniques are as described in Sambrook et al. (1989) unless otherwise stated. Single colonies of *Agrobacterium* C58C1Rif, *E. coli* helper strain HB101 and the *E. coli* strain containing the transformation construct to be mobilized into Agrobacterium are separately inoculated into appropriate growth media and stationary cultures produced. Cultures are mixed gently, plated on YEB (5g Gibco beef extract, 1 g Bacto yeast extract, 1 g Bacto peptone, 5g sucrose, pH 7.4) solid growth media and incubated overnight at 28° C. The bacteria from the triparental mating are collected in and serial dilutions made. An aliquot of the each dilution is then plated and incubated for 2 days at 28° C. on YEB plates supplemented with 100 μg/ml rifampicin and 100 μg/ml carbenicillin for calculation of the number of acceptor cells and on YEB plates supplemented with 100 μg/ml rifampicin, 100 μg/ml carbenicillin and 100 μg/ml spectinomycin for selection of transconjugant cells. The cointegrate structure of purified transconjugants is verified via Southern blot hybridization.

A transconjugant culture is prepared for vacuum infiltration by inoculating 1 ml of a stationary culture arising from a single colony into liquid YEB media and incubating at 28° C. for approximately 20 hours with shaking until the OD taken at 600 nm was 0.8-1.0. The culture is then pelleted and the bacteria resuspended in infiltration medium (0.5×MS salts, 5% w/v sucrose, 10 μg/l BAP, 200 μl/l Silwet L-77, pH 5.8) to a final $OD_{600}$ of 1.0. This prepared transconjugant culture is used within 20 minutes of preparation.

Wild-type plants for vacuum infiltration are grown in pots. Briefly, seeds of *Arabidopsis thaliana* (ecotype Wassilewskija) are sown in pots and left at 4° C. for two to four days to vernalize. They are then transferred to 22-25° C. and grown under long-day (16 hr light: 8 hr dark) conditions, sub-irrigated with water. After bolting, the primary inflorescence is removed and, after four to eight days, the pots containing the plants are inverted in the vacuum chamber to submerge all of the plants in the prepared transconjugant culture. Vacuum is drawn for two minutes before pots are removed, covered with plastic wrap and incubated in a cool room under darkness or very low light for one to two days. The plastic wrap is then removed; the plants returned to their previous growing conditions and subsequently produced (T1) seed collected.

5.2 Selection of T-DNA Insertion Lines

Seeds from the initial vacuum infiltrated plants are sown on flats of Metromix 350 soil. Flats are vernalized for four to five days at 4° C. before being transferred to 22-25° C. and grown under long-day (16 hr light: 8 hr dark) conditions, sub-irrigated with water. Approximately seven to ten days after germination, the (T1) seedlings are sprayed with 0.02% Finale herbicide (AgrEvo). After another five to seven days, herbicide treatment is repeated. Herbicide resistant TI plants are allowed to self-pollinate and T2 seed are collected from each individual. In the few cases where the T1 plant produced few seed, the T2 seed is planted in bulk, the T2 plants allowed to self-pollinate and T3 seed collected.

5.3 Phenotype Screening

Seeds from each T2 (or T3) line are planted in a 4-inch pot containing either Sunshine mix or Metromix 350 soil. Pots are vernalized for four to five days at 4° C. before being transferred to 22-25° C. and grown under long-day (16 hr light: 8 hr dark) conditions, sub-irrigated with water. A first phenotype screen is conducted by visually inspecting the seedlings five to seven days after germination and aberrant phenotypes noted. Plants are then sprayed with Finale herbicide within four days (i.e. about seven to nine days after germination). The second visual screen is conducted on surviving T2 (or T3) plants about sixteen to seventeen days after germination and the final screen was conducted after the plants have bolted and formed siliques. Here, the third and fourth green siliques are collected and aberrant phenotypes noted.

Alternatively, seed are surface sterilized and transferred to agar solidified medium containing Murashige and Skoog salts (1×), 1% sucrose (wt/v) pH 5.7 before autoclaving. Seed re cold treated for 48 hours and transferred to long days [16 hours light and 8 hours dark], 25° C. Plants are screened at 5 and 10 days.

The invention being thus described, it will be apparent to one of ordinary skill in the art that various modifications of the materials and methods for practicing the invention can be made. Such modifications are to be considered within the scope of the invention as defined by the following claims.

Each of the references from the patent and periodical literature cited herein is hereby expressly incorporated in its entirety by such citation.

TABLE 1

SEQUECE IDENTIFIER CROSS-REFERENCE

| SEQ ID NO | CERES CLONE ID | CERES ID IN SEQUENCE LISTING | HOMOLOG_TABLE_ID |
|---|---|---|---|
| SEQ ID NO: 1 | 40252 | Identifier: Ceres CLONE ID no. 40252 | Lead_CeresClone40252 |
| SEQ ID NO: 5 | 32791 | Identifier: Ceres CLONE ID no. 32791 | Lead_CeresClone32791 |
| SEQ ID NO: 22 | 39319 | Identifier: Ceres CLONE ID no. 39319 | Lead_CeresClone39319 |
| SEQ ID NO: 37 | 41337 | Identifier: Ceres CLONE ID no. 41337 | Lead_CeresClone41337 |
| SEQ ID NO: 46 | 314 | Identifier: Ceres CLONE ID no. 314 | Lead_CeresClone314 |
| SEQ ID NO: 54 | 332 | Identifier: Ceres CLONE ID no. 332 | Lead_CeresClone332 |
| SEQ ID NO: 66 | 907 | Identifier: Ceres CLONE ID no. 907 | Lead_CeresClone907 |

TABLE 1-continued

SEQUECE IDENTIFIER CROSS-REFERENCE

| SEQ ID NO | CERES CLONE ID | CERES ID IN SEQUENCE LISTING | HOMOLOG_TABLE_ID |
|---|---|---|---|
| SEQ ID NO: 71 | 1241 | Identifier: Ceres CLONE ID no. 1241 | Lead_CeresClone1241 |
| SEQ ID NO: 79 | 1610 | Identifier: Ceres CLONE ID no. 1610 | Lead_CeresClone1610 |
| SEQ ID NO: 95 | 2403 | Identifier: Ceres CLONE ID no. 2403 | Lead_CeresClone2403 |
| SEQ ID NO: 107 | 2835 | Identifier: Ceres CLONE ID no. 2835 | Lead_CeresClone2835 |
| SEQ ID NO: 114 | 3000 | Identifier: Ceres CLONE ID no. 3000 | Lead_CeresClone3000 |
| SEQ ID NO: 123 | 3036 | Identifier: Ceres CLONE ID no. 3036 | Lead_CeresClone3036 |
| SEQ ID NO: 128 | 3363 | Identifier: Ceres CLONE ID no. 3363 | Lead_CeresClone3363 |
| SEQ ID NO: 147 | 3510 | Identifier: Ceres CLONE ID no. 3510 | Lead_CeresClone3510 |
| SEQ ID NO: 161 | 3699 | Identifier: Ceres CLONE ID no. 3699 | Lead_CeresClone3699 |
| SEQ ID NO: 176 | 3858 | Identifier: Ceres CLONE ID no. 3858 | Lead_CeresClone3858 |
| SEQ ID NO: 191 | 5597 | Identifier: Ceres CLONE ID no. 5597 | Lead_CeresClone5597 |
| SEQ ID NO: 199 | 5605 | Identifier: Ceres CLONE ID no. 5605 | Lead_CeresClone5605 |
| SEQ ID NO: 210 | 6685 | Identifier: Ceres CLONE ID no. 6685 | Lead_CeresClone6685 |
| SEQ ID NO: 215 | 8265 | Identifier: Ceres CLONE ID no. 8265 | Lead_CeresClone8265 |
| SEQ ID NO: 221 | 8490 | Identifier: Ceres CLONE ID no. 8490 | Lead_CeresClone8490 |
| SEQ ID NO: 230 | 9683 | Identifier: Ceres CLONE ID no. 9683 | Lead_CeresClone9683 |
| SEQ ID NO: 234 | 9897 | Identifier: Ceres CLONE ID no. 9897 | Lead_CeresClone9897 |
| SEQ ID NO: 242 | 12272 | Identifier: Ceres CLONE ID no. 12272 | Lead_CeresClone12272 |
| SEQ ID NO: 251 | 12935 | Identifier: Ceres CLONE ID no. 12935 | Lead_CeresClone12935 |
| SEQ ID NO: 262 | 13092 | Identifier: Ceres CLONE ID no. 13092 | Lead_CeresClone13092 |
| SEQ ID NO: 270 | 13263 | Identifier: Ceres CLONE ID no. 13263 | Lead_CeresClone13263 |
| SEQ ID NO: 276 | 14583 | Identifier: Ceres CLONE ID no. 14583 | Lead_CeresClone14583 |
| SEQ ID NO: 283 | 14909 | Identifier: Ceres CLONE ID no. 14909 | Lead_CeresClone14909 |
| SEQ ID NO: 295 | 16412 | Identifier: Ceres CLONE ID no. 16412 | Lead_CeresClone16412 |

TABLE 1-continued

SEQUECE IDENTIFIER CROSS-REFERENCE

| SEQ ID NO | CERES CLONE ID | CERES ID IN SEQUENCE LISTING | HOMOLOG_TABLE_ID |
|---|---|---|---|
| SEQ ID NO: 304 | 16461 | Identifier: Ceres CLONE ID no. 16461 | Lead_CeresClone16461 |
| SEQ ID NO: 309 | 17409 | Identifier: Ceres CLONE ID no. 17409 | Lead_CeresClone17409 |
| SEQ ID NO: 316 | 17482 | Identifier: Ceres CLONE ID no. 17482 | Lead_CeresClone17482 |
| SEQ ID NO: 321 | 17632 | Identifier: Ceres CLONE ID no. 17632 | Lead_CeresClone17632 |
| SEQ ID NO: 328 | 18612 | Identifier: Ceres CLONE ID no. 18612 | Lead_CeresClone18612 |
| SEQ ID NO: 335 | 18820 | Identifier: Ceres CLONE ID no. 18820 | Lead_CeresClone18820 |
| SEQ ID NO: 341 | 19188 | Identifier: Ceres CLONE ID no. 19188 | Lead_CeresClone19188 |
| SEQ ID NO: 351 | 20257 | Identifier: Ceres CLONE ID no. 20257 | Lead_CeresClone20257 |
| SEQ ID NO: 362 | 21068 | Identifier: Ceres CLONE ID no. 21068 | Lead_CeresClone21068 |
| SEQ ID NO: 367 | 22461 | Identifier: Ceres CLONE ID no. 22461 | Lead_CeresClone22461 |
| SEQ ID NO: 372 | 23203 | Identifier: Ceres CLONE ID no. 23203 | Lead_CeresClone23203 |
| SEQ ID NO: 382 | 26907 | Identifier: Ceres CLONE ID no. 26907 | Lead_CeresClone26907 |
| SEQ ID NO: 393 | 27460 | Identifier: Ceres CLONE ID no. 27460 | Lead_CeresClone27460 |
| SEQ ID NO: 396 | 32348 | Identifier: Ceres CLONE ID no. 32348 | Lead_CeresClone32348 |
| SEQ ID NO: 407 | 32548 | Identifier: Ceres CLONE ID no. 32548 | Lead_CeresClone32548 |
| SEQ ID NO: 417 | 32753 | Identifier: Ceres CLONE ID no. 32753 | Lead_CeresClone32753 |
| SEQ ID NO: 422 | 34167 | Identifier: Ceres CLONE ID no. 34167 | Lead_CeresClone34167 |
| SEQ ID NO: 430 | 34385 | Identifier: Ceres CLONE ID no. 34385 | Lead_CeresClone34385 |
| SEQ ID NO: 449 | 36518 | Identifier: Ceres CLONE ID no. 36518 | Lead_CeresClone36518 |
| SEQ ID NO: 456 | 36891 | Identifier: Ceres CLONE ID no. 36891 | Lead_CeresClone36891 |
| SEQ ID NO: 471 | 36904 | Identifier: Ceres CLONE ID no. 36904 | Lead_CeresClone36904 |
| SEQ ID NO: 478 | 37288 | Identifier: Ceres CLONE ID no. 37288 | Lead_CeresClone37288 |
| SEQ ID NO: 484 | 37298 | Identifier: Ceres CLONE ID no. 37298 | Lead_CeresClone37298 |
| SEQ ID NO: 495 | 37663 | Identifier: Ceres CLONE ID no. 37663 | Lead_CeresClone37663 |

TABLE 1-continued

SEQUECE IDENTIFIER CROSS-REFERENCE

| SEQ ID NO | CERES CLONE ID | CERES ID IN SEQUENCE LISTING | HOMOLOG__TABLE__ID |
|---|---|---|---|
| SEQ ID NO: 498 | 38101 | Identifier: Ceres CLONE ID no. 38101 | Lead__CeresClone38101 |
| SEQ ID NO: 511 | 38419 | Identifier: Ceres CLONE ID no. 38419 | Lead__CeresClone38419 |
| SEQ ID NO: 518 | 38470 | Identifier: Ceres CLONE ID no. 38470 | Lead__CeresClone38470 |
| SEQ ID NO: 526 | 38690 | Identifier: Ceres CLONE ID no. 38690 | Lead__CeresClone38690 |
| SEQ ID NO: 530 | 39286 | Identifier: Ceres CLONE ID no. 39286 | Lead__CeresClone39286 |
| SEQ ID NO: 536 | 40508 | Identifier: Ceres CLONE ID no. 40508 | Lead__CeresClone40508 |
| SEQ ID NO: 543 | 40729 | Identifier: Ceres CLONE ID no. 40729 | Lead__CeresClone40729 |
| SEQ ID NO: 551 | 41306 | Identifier: Ceres CLONE ID no. 41306 | Lead__CeresClone41306 |
| SEQ ID NO: 554 | 41439 | Identifier: Ceres CLONE ID no. 41439 | Lead__CeresClone41439 |
| SEQ ID NO: 569 | 42141 | Identifier: Ceres CLONE ID no. 42141 | Lead__CeresClone42141 |
| SEQ ID NO: 578 | 92459 | Identifier: Ceres CLONE ID no. 92459 | Lead__CeresClone92459 |
| SEQ ID NO: 585 | 92670 | Identifier: Ceres CLONE ID no. 92670 | Lead__CeresClone92670 |
| SEQ ID NO: 598 | 94231 | Identifier: Ceres CLONE ID no. 94231 | Lead__CeresClone94231 |
| SEQ ID NO: 611 | 95135 | Identifier: Ceres CLONE ID no. 95135 | Lead__CeresClone95135 |
| SEQ ID NO: 623 | 97434 | Identifier: Ceres CLONE ID no. 97434 | Lead__CeresClone97434 |
| SEQ ID NO: 640 | 97480 | Identifier: Ceres CLONE ID no. 97480 | Lead__CeresClone97480 |
| SEQ ID NO: 654 | 97958 | Identifier: Ceres CLONE ID no. 97958 | Lead__CeresClone97958 |
| SEQ ID NO: 672 | 98855 | Identifier: Ceres CLONE ID no. 98855 | Lead__CeresClone98855 |
| SEQ ID NO: 681 | 99657 | Identifier: Ceres CLONE ID no. 99657 | Lead__CeresClone99657 |
| SEQ ID NO: 699 | 100465 | Identifier: Ceres CLONE ID no. 100465 | Lead__CeresClone100465 |
| SEQ ID NO: 703 | 107731 | Identifier: Ceres CLONE ID no. 107731 | Lead__CeresClone107731 |
| SEQ ID NO: 717 | 110454 | Identifier: Ceres CLONE ID no. 110454 | Lead__CeresClone110454 |
| SEQ ID NO: 733 | 116843 | Identifier: Ceres CLONE ID no. 116843 | Lead__CeresClone116843 |
| SEQ ID NO: 738 | 119256 | Identifier: Ceres CLONE ID no. 119256 | Lead__CeresClone119256 |

TABLE 1-continued

SEQUECE IDENTIFIER CROSS-REFERENCE

| SEQ ID NO | CERES CLONE ID | CERES ID IN SEQUENCE LISTING | HOMOLOG__TABLE__ID |
|---|---|---|---|
| SEQ ID NO: 746 | 123905 | Identifier: Ceres CLONE ID no. 123905 | Lead__CeresClone123905 |
| SEQ ID NO: 753 | 141805 | Identifier: Ceres CLONE ID no. 141805 | Lead__CeresClone141805 |
| SEQ ID NO: 759 | 141890 | Identifier: Ceres CLONE ID no. 141890 | Lead__CeresClone141890 |
| SEQ ID NO: 762 | 147358 | Identifier: Ceres CLONE ID no. 147358 | Lead__CeresClone147358 |
| SEQ ID NO: 775 | 148943 | Identifier: Ceres CLONE ID no. 148943 | Lead__CeresClone148943 |
| SEQ ID NO: 785 | 157547 | Identifier: Ceres CLONE ID no. 157547 | Lead__CeresClone157547 |
| SEQ ID NO: 791 | 158333 | Identifier: Ceres CLONE ID no. 158333 | Lead__CeresClone158333 |
| SEQ ID NO: 797 | 227651 | Identifier: Ceres CLONE ID no. 227651 | Lead__CeresClone227651 |
| SEQ ID NO: 815 | 235672 | Identifier: Ceres CLONE ID no. 235672 | Lead__CeresClone235672 |
| SEQ ID NO: 819 | 241131 | Identifier: Ceres CLONE ID no. 241131 | Lead__CeresClone241131 |
| SEQ ID NO: 825 | 262460 | Identifier: Ceres CLONE ID no. 262460 | Lead__CeresClone262460 |
| SEQ ID NO: 832 | 270555 | Identifier: Ceres CLONE ID no. 270555 | Lead__CeresClone270555 |
| SEQ ID NO: 835 | 481710 | Identifier: Ceres CLONE ID no. 481710 | Lead__CeresClone481710 |
| SEQ ID NO: 846 | 482122 | Identifier: Ceres CLONE ID no. 482122 | Lead__CeresClone482122 |
| SEQ ID NO: 860 | 536457 | Identifier: Ceres CLONE ID no. 536457 | Lead__CeresClone536457 |
| SEQ ID NO: 871 | 536796 | Identifier: Ceres CLONE ID no. 536796 | Lead__CeresClone536796 |
| SEQ ID NO: 877 | 572121 | Identifier: Ceres CLONE ID no. 572121 | Lead__CeresClone572121 |
| SEQ ID NO: 880 | 641355 | Identifier: Ceres CLONE ID no. 641355 | Lead__CeresClone641355 |
| SEQ ID NO: 894 | 660003 | Identifier: Ceres CLONE ID no. 660003 | Lead__CeresClone660003 |
| SEQ ID NO: 898 | 664365 | Identifier: Ceres CLONE ID no. 664365 | Lead__CeresClone664365 |
| SEQ ID NO: 908 | 708342 | Identifier: Ceres CLONE ID no. 708342 | Lead__CeresClone708342 |
| SEQ ID NO: 914 | 969750 | Identifier: Ceres CLONE ID no. 969750 | Lead__CeresClone969750 |
| SEQ ID NO: 919 | 1001432 | Identifier: Ceres CLONE ID no. 1001432 | Lead__CeresClone1001432 |
| SEQ ID NO: 930 | 1002819 | Identifier: Ceres CLONE ID no. 1002819 | Lead__CeresClone1002819 |

TABLE 1-continued

SEQUECE IDENTIFIER CROSS-REFERENCE

| SEQ ID NO | CERES CLONE ID | CERES ID IN SEQUENCE LISTING | HOMOLOG_TABLE_ID |
|---|---|---|---|
| SEQ ID NO: 935 | 1007549 | Identifier: Ceres CLONE ID no. 1007549 | Lead_CeresClone1007549 |
| SEQ ID NO: 948 | 1043081 | Identifier: Ceres CLONE ID no. 1043081 | Lead_CeresClone1043081 |
| SEQ ID NO: 965 | 99298 | Identifier: Ceres CLONE ID no. 99298 | Lead_CeresClone99298 |
| SEQ ID NO: 974 | 100245 | Identifier: Ceres CLONE ID no. 100245 | Lead_CeresClone100245 |
| SEQ ID NO: 989 | 101798 | Identifier: Ceres CLONE ID no. 101798 | Lead_CeresClone101798 |
| SEQ ID NO: 1005 | 38370 | Identifier: Ceres CLONE ID no. 38370 | Lead_CeresClone38370 |
| SEQ ID NO: 1012 | 1496 | Identifier: Ceres CLONE ID no. 1496 | Lead_CeresClone1496 |
| SEQ ID NO: 1031 | 2561 | Identifier: Ceres CLONE ID no. 2561 | Lead_CeresClone2561 |
| SEQ ID NO: 1042 | 3618 | Identifier: Ceres CLONE ID no. 3618 | Lead_CeresClone3618 |
| SEQ ID NO: 1048 | 7191 | Identifier: Ceres CLONE ID no. 7191 | Lead_CeresClone7191 |
| SEQ ID NO: 1057 | 8254 | Identifier: Ceres CLONE ID no. 8254 | Lead_CeresClone8254 |
| SEQ ID NO: 1062 | 8877 | Identifier: Ceres CLONE ID no. 8877 | Lead_CeresClone8877 |
| SEQ ID NO: 1075 | 8916 | Identifier: Ceres CLONE ID no. 8916 | Lead_CeresClone8916 |
| SEQ ID NO: 1078 | 10879 | Identifier: Ceres CLONE ID no. 10879 | Lead_CeresClone10879 |
| SEQ ID NO: 1086 | 19116 | Identifier: Ceres CLONE ID no. 19116 | Lead_CeresClone19116 |
| SEQ ID NO: 1092 | 19319 | Identifier: Ceres CLONE ID no. 19319 | Lead_CeresClone19319 |
| SEQ ID NO: 1100 | 19486 | Identifier: Ceres CLONE ID no. 19486 | Lead_CeresClone19486 |
| SEQ ID NO: 1106 | 19510 | Identifier: Ceres CLONE ID no. 19510 | Lead_CeresClone19510 |
| SEQ ID NO: 1125 | 23322 | Identifier: Ceres CLONE ID no. 23322 | Lead_CeresClone23322 |
| SEQ ID NO: 1136 | 25538 | Identifier: Ceres CLONE ID no. 25538 | Lead_CeresClone25538 |
| SEQ ID NO: 1145 | 25607 | Identifier: Ceres CLONE ID no. 25607 | Lead_CeresClone25607 |
| SEQ ID NO: 1155 | 25758 | Identifier: Ceres CLONE ID no. 25758 | Lead_CeresClone25758 |
| SEQ ID NO: 1162 | 25886 | Identifier: Ceres CLONE ID no. 25886 | Lead_CeresClone25886 |
| SEQ ID NO: 1181 | 27464 | Identifier: Ceres CLONE ID no. 27464 | Lead_CeresClone27464 |

TABLE 1-continued

SEQUECE IDENTIFIER CROSS-REFERENCE

| SEQ ID NO | CERES CLONE ID | CERES ID IN SEQUENCE LISTING | HOMOLOG_TABLE_ID |
|---|---|---|---|
| SEQ ID NO: 1190 | 28602 | Identifier: Ceres CLONE ID no. 28602 | Lead_CeresClone28602 |
| SEQ ID NO: 1204 | 35493 | Identifier: Ceres CLONE ID no. 35493 | Lead_CeresClone35493 |
| SEQ ID NO: 1217 | 37229 | Identifier: Ceres CLONE ID no. 37229 | Lead_CeresClone37229 |
| SEQ ID NO: 1227 | 37493 | Identifier: Ceres CLONE ID no. 37493 | Lead_CeresClone37493 |
| SEQ ID NO: 1235 | 38105 | Identifier: Ceres CLONE ID no. 38105 | Lead_CeresClone38105 |
| SEQ ID NO: 1242 | 38214 | Identifier: Ceres CLONE ID no. 38214 | Lead_CeresClone38214 |
| SEQ ID NO: 1252 | 41320 | Identifier: Ceres CLONE ID no. 41320 | Lead_CeresClone41320 |
| SEQ ID NO: 1262 | 42533 | Identifier: Ceres CLONE ID no. 42533 | Lead_CeresClone42533 |
| SEQ ID NO: 1271 | 42925 | Identifier: Ceres CLONE ID no. 42925 | Lead_CeresClone42925 |
| SEQ ID NO: 1282 | 95453 | Identifier: Ceres CLONE ID no. 95453 | Lead_CeresClone95453 |
| SEQ ID NO: 1295 | 96020 | Identifier: Ceres CLONE ID no. 96020 | Lead_CeresClone96020 |
| SEQ ID NO: 1302 | 97415 | Identifier: Ceres CLONE ID no. 97415 | Lead_CeresClone97415 |
| SEQ ID NO: 1313 | 101255 | Identifier: Ceres CLONE ID no. 101255 | Lead_CeresClone101255 |
| SEQ ID NO: 1321 | 103581 | Identifier: Ceres CLONE ID no. 103581 | Lead_CeresClone103581 |
| SEQ ID NO: 1336 | 109514 | Identifier: Ceres CLONE ID no. 109514 | Lead_CeresClone109514 |
| SEQ ID NO: 1346 | 115946 | Identifier: Ceres CLONE ID no. 115946 | Lead_CeresClone115946 |
| SEQ ID NO: 1351 | 115975 | Identifier: Ceres CLONE ID no. 115975 | Lead_CeresClone115975 |
| SEQ ID NO: 1359 | 117369 | Identifier: Ceres CLONE ID no. 117369 | Lead_CeresClone117369 |
| SEQ ID NO: 1370 | 118337 | Identifier: Ceres CLONE ID no. 118337 | Lead_CeresClone118337 |
| SEQ ID NO: 1383 | 150912 | Identifier: Ceres CLONE ID no. 150912 | Lead_CeresClone150912 |
| SEQ ID NO: 1389 | 152141 | Identifier: Ceres CLONE ID no. 152141 | Lead_CeresClone152141 |
| SEQ ID NO: 1403 | 157730 | Identifier: Ceres CLONE ID no. 157730 | Lead_CeresClone157730 |
| SEQ ID NO: 1411 | 225597 | Identifier: Ceres CLONE ID no. 225597 | Lead_CeresClone225597 |
| SEQ ID NO: 1415 | 264705 | Identifier: Ceres CLONE ID no. 264705 | Lead_CeresClone264705 |

TABLE 1-continued

SEQUECE IDENTIFIER CROSS-REFERENCE

| SEQ ID NO | CERES CLONE ID | CERES ID IN SEQUENCE LISTING | HOMOLOG_TABLE_ID |
|---|---|---|---|
| SEQ ID NO: 1436 | 627596 | Identifier: Ceres CLONE ID no. 627596 | Lead_CeresClone627596 |
| SEQ ID NO: 1450 | 729085 | Identifier: Ceres CLONE ID no. 729085 | Lead_CeresClone729085 |
| SEQ ID NO: 1463 | 1011386 | Identifier: Ceres CLONE ID no. 1011386 | Lead_CeresClone1011386 |
| SEQ ID NO: 1467 | 6082 | Identifier: Ceres CLONE ID no. 6082 | Lead_CeresClone6082 |
| SEQ ID NO: 1474 | 13812 | Identifier: Ceres CLONE ID no. 13812 | Lead_CeresClone13812 |
| SEQ ID NO: 1479 | 32811 | Identifier: Ceres CLONE ID no. 32811 | Lead_CeresClone32811 |
| SEQ ID NO: 1485 | 224062 | Identifier: Ceres CLONE ID no. 224062 | Lead_CeresClone224062 |
| SEQ ID NO: 1494 | 254065 | Identifier: Ceres CLONE ID no. 254065 | Lead_CeresClone254065 |
| SEQ ID NO: 1502 | 22339 | Identifier: Ceres CLONE ID no. 22339 | Lead_CeresClone22339 |
| SEQ ID NO: 1516 | 99784 | Identifier: Ceres CLONE ID no. 99784 | Lead_CeresClone99784 |
| SEQ ID NO: 1532 | 100319 | Identifier: Ceres CLONE ID no. 100319 | Lead_CeresClone100319 |
| SEQ ID NO: 1539 | 124720 | Identifier: Ceres CLONE ID no. 124720 | Lead_CeresClone124720 |
| SEQ ID NO: 1548 | 288251 | Identifier: Ceres CLONE ID no. 288251 | Lead_CeresClone288251 |
| SEQ ID NO: 1555 | 8014 | Identifier: Ceres CLONE ID no. 8014 | Lead_CeresClone8014 |
| SEQ ID NO: 1562 | 16204 | Identifier: Ceres CLONE ID no. 16204 | Lead_CeresClone16204 |
| SEQ ID NO: 1573 | 101250 | Identifier: Ceres CLONE ID no. 101250 | Lead_CeresClone101250 |
| SEQ ID NO: 1579 | 283597 | Identifier: Ceres CLONE ID no. 283597 | Lead_CeresClone283597 |
| SEQ ID NO: 1586 | 292789 | Identifier: Ceres CLONE ID no. 292789 | Lead_CeresClone292789 |
| SEQ ID NO: 1606 | 4289 | Identifier: Ceres CLONE ID no. 4289 | Lead_CeresClone4289 |
| SEQ ID NO: 1610 | 7925 | Identifier: Ceres CLONE ID no. 7925 | Lead_CeresClone7925 |
| SEQ ID NO: 1613 | 10857 | Identifier: Ceres CLONE ID no. 10857 | Lead_CeresClone10857 |
| SEQ ID NO: 1619 | 19481 | Identifier: Ceres CLONE ID no. 19481 | Lead_CeresClone19481 |
| SEQ ID NO: 1626 | 28979 | Identifier: Ceres CLONE ID no. 28979 | Lead_CeresClone28979 |
| SEQ ID NO: 1638 | 113719 | Identifier: Ceres CLONE ID no. 113719 | Lead_CeresClone113719 |

TABLE 1-continued

SEQUECE IDENTIFIER CROSS-REFERENCE

| SEQ ID NO | CERES CLONE ID | CERES ID IN SEQUENCE LISTING | HOMOLOG_TABLE_ID |
|---|---|---|---|
| SEQ ID NO: 1651 | 147593 | Identifier: Ceres CLONE ID no. 147593 | Lead_CeresClone147593 |
| SEQ ID NO: 1661 | 150798 | Identifier: Ceres CLONE ID no. 150798 | Lead_CeresClone150798 |
| SEQ ID NO: 1666 | 152076 | Identifier: Ceres CLONE ID no. 152076 | Lead_CeresClone152076 |
| SEQ ID NO: 1673 | 154031 | Identifier: Ceres CLONE ID no. 154031 | Lead_CeresClone154031 |
| SEQ ID NO: 1677 | 246416 | Identifier: Ceres CLONE ID no. 246416 | Lead_CeresClone246416 |
| SEQ ID NO: 1696 | 949 | Identifier: Ceres CLONE ID no. 949 | Lead_CeresClone949 |
| SEQ ID NO: 1710 | 2036 | Identifier: Ceres CLONE ID no. 2036 | Lead_CeresClone2036 |
| SEQ ID NO: 1719 | 18857 | Identifier: Ceres CLONE ID no. 18857 | Lead_CeresClone18857 |
| SEQ ID NO: 1728 | 23518 | Identifier: Ceres CLONE ID no. 23518 | Lead_CeresClone23518 |
| SEQ ID NO: 1745 | 156655 | Identifier: Ceres CLONE ID no. 156655 | Lead_CeresClone156655 |
| SEQ ID NO: 1750 | 2273 | Identifier: Ceres CLONE ID no. 2273 | Lead_CeresClone2273 |
| SEQ ID NO: 1756 | 5198 | Identifier: Ceres CLONE ID no. 5198 | Lead_CeresClone5198 |
| SEQ ID NO: 1765 | 13767 | Identifier: Ceres CLONE ID no. 13767 | Lead_CeresClone13767 |
| SEQ ID NO: 1773 | 29150 | Identifier: Ceres CLONE ID no. 29150 | Lead_CeresClone29150 |
| SEQ ID NO: 1777 | 34480 | Identifier: Ceres CLONE ID no. 34480 | Lead_CeresClone34480 |
| SEQ ID NO: 1785 | 38625 | Identifier: Ceres CLONE ID no. 38625 | Lead_CeresClone38625 |
| SEQ ID NO: 1791 | 39351 | Identifier: Ceres CLONE ID no. 39351 | Lead_CeresClone39351 |
| SEQ ID NO: 1800 | 153053 | Identifier: Ceres CLONE ID no. 153053 | Lead_CeresClone153053 |
| SEQ ID NO: 1805 | 159318 | Identifier: Ceres CLONE ID no. 159318 | Lead_CeresClone159318 |
| SEQ ID NO: 1811 | 241379 | Identifier: Ceres CLONE ID no. 241379 | Lead_CeresClone241379 |
| SEQ ID NO: 1822 | 5220 | Identifier: Ceres CLONE ID no. 5220 | Lead_CeresClone5220 |
| SEQ ID NO: 1826 | 11214 | Identifier: Ceres CLONE ID no. 11214 | Lead_CeresClone11214 |
| SEQ ID NO: 1841 | 563522 | Identifier: Ceres CLONE ID no. 563522 | Lead_CeresClone563522 |
| SEQ ID NO: 1860 | 21563 | Identifier: Ceres CLONE ID no. 21563 | Lead_CeresClone21563 |

TABLE 1-continued

SEQUECE IDENTIFIER CROSS-REFERENCE

| SEQ ID NO | CERES CLONE ID | CERES ID IN SEQUENCE LISTING | HOMOLOG_TABLE_ID |
|---|---|---|---|
| SEQ ID NO: 1868 | 6397 | Identifier: Ceres CLONE ID no. 6397 | Lead_CeresClone6397 |
| SEQ ID NO: 1872 | 14555 | Identifier: Ceres CLONE ID no. 14555 | Lead_CeresClone14555 |
| SEQ ID NO: 1882 | 4067 | Identifier: Ceres CLONE ID no. 4067 | Lead_CeresClone4067 |
| SEQ ID NO: 1895 | 4734 | Identifier: Ceres CLONE ID no. 4734 | Lead_CeresClone4734 |
| SEQ ID NO: 1903 | 28643 | Identifier: Ceres CLONE ID no. 28643 | Lead_CeresClone28643 |
| SEQ ID NO: 1917 | 733804 | Identifier: Ceres CLONE ID no. 733804 | Lead_CeresClone733804 |
| SEQ ID NO: 1929 | 9221 | Identifier: Ceres CLONE ID no. 9221 | Lead_CeresClone9221 |
| SEQ ID NO: 1943 | 11929 | Identifier: Ceres CLONE ID no. 11929 | Lead_CeresClone11929 |
| SEQ ID NO: 1954 | 12071 | Identifier: Ceres CLONE ID no. 12071 | Lead_CeresClone12071 |
| SEQ ID NO: 1961 | 13625 | Identifier: Ceres CLONE ID no. 13625 | Lead_CeresClone13625 |
| SEQ ID NO: 1971 | 16865 | Identifier: Ceres CLONE ID no. 16865 | Lead_CeresClone16865 |
| SEQ ID NO: 1988 | 18246 | Identifier: Ceres CLONE ID no. 18246 | Lead_CeresClone18246 |
| SEQ ID NO: 1994 | 31044 | Identifier: Ceres CLONE ID no. 31044 | Lead_CeresClone31044 |
| SEQ ID NO: 2001 | 38635 | Identifier: Ceres CLONE ID no. 38635 | Lead_CeresClone38635 |
| SEQ ID NO: 2008 | 39155 | Identifier: Ceres CLONE ID no. 39155 | Lead_CeresClone39155 |
| SEQ ID NO: 2011 | 107988 | Identifier: Ceres CLONE ID no. 107988 | Lead_CeresClone107988 |
| SEQ ID NO: 2017 | 109912 | Identifier: Ceres CLONE ID no. 109912 | Lead_CeresClone109912 |
| SEQ ID NO: 2020 | 154718 | Identifier: Ceres CLONE ID no. 154718 | Lead_CeresClone154718 |
| SEQ ID NO: 2024 | 226122 | Identifier: Ceres CLONE ID no. 226122 | Lead_CeresClone226122 |
| SEQ ID NO: 2039 | 691319 | Identifier: Ceres CLONE ID no. 691319 | Lead_CeresClone691319 |
| SEQ ID NO: 2045 | 641 | Identifier: Ceres CLONE ID no. 641 | Lead_CeresClone641 |
| SEQ ID NO: 2050 | 3819 | Identifier: Ceres CLONE ID no. 3819 | Lead_CeresClone3819 |
| SEQ ID NO: 2069 | 3853 | Identifier: Ceres CLONE ID no. 3853 | Lead_CeresClone3853 |
| SEQ ID NO: 2074 | 8133 | Identifier: Ceres CLONE ID no. 8133 | Lead_CeresClone8133 |

TABLE 1-continued

SEQUECE IDENTIFIER CROSS-REFERENCE

| SEQ ID NO | CERES CLONE ID | CERES ID IN SEQUENCE LISTING | HOMOLOG_TABLE_ID |
|---|---|---|---|
| SEQ ID NO: 2079 | 15343 | Identifier: Ceres CLONE ID no. 15343 | Lead_CeresClone15343 |
| SEQ ID NO: 2084 | 22007 | Identifier: Ceres CLONE ID no. 22007 | Lead_CeresClone22007 |
| SEQ ID NO: 2088 | 23771 | Identifier: Ceres CLONE ID no. 23771 | Lead_CeresClone23771 |
| SEQ ID NO: 2101 | 27197 | Identifier: Ceres CLONE ID no. 27197 | Lead_CeresClone27197 |
| SEQ ID NO: 2111 | 33802 | Identifier: Ceres CLONE ID no. 33802 | Lead_CeresClone33802 |
| SEQ ID NO: 2117 | 34210 | Identifier: Ceres CLONE ID no. 34210 | Lead_CeresClone34210 |
| SEQ ID NO: 2130 | 38757 | Identifier: Ceres CLONE ID no. 38757 | Lead_CeresClone38757 |
| SEQ ID NO: 2135 | 38785 | Identifier: Ceres CLONE ID no. 38785 | Lead_CeresClone38785 |
| SEQ ID NO: 2141 | 38843 | Identifier: Ceres CLONE ID no. 38843 | Lead_CeresClone38843 |
| SEQ ID NO: 2148 | 39127 | Identifier: Ceres CLONE ID no. 39127 | Lead_CeresClone39127 |
| SEQ ID NO: 2154 | 95855 | Identifier: Ceres CLONE ID no. 95855 | Lead_CeresClone95855 |
| SEQ ID NO: 2158 | 99763 | Identifier: Ceres CLONE ID no. 99763 | Lead_CeresClone99763 |
| SEQ ID NO: 2170 | 267657 | Identifier: Ceres CLONE ID no. 267657 | Lead_CeresClone267657 |
| SEQ ID NO: 2173 | 545208 | Identifier: Ceres CLONE ID no. 545208 | Lead_CeresClone545208 |
| SEQ ID NO: 2178 | 546490 | Identifier: Ceres CLONE ID no. 546490 | Lead_CeresClone546490 |
| SEQ ID NO: 2181 | 566317 | Identifier: Ceres CLONE ID no. 566317 | Lead_CeresClone566317 |
| SEQ ID NO: 2188 | 28003 | Identifier: Ceres CLONE ID no. 28003 | Lead_CeresClone28003 |
| SEQ ID NO: 2192 | 225200 | Identifier: Ceres CLONE ID no. 225200 | Lead_CeresClone225200 |
| SEQ ID NO: 2200 | 301326 | Identifier: Ceres CLONE ID no. 301326 | Lead_CeresClone301326 |
| SEQ ID NO: 2203 | 681088 | Identifier: Ceres CLONE ID no. 681088 | Lead_CeresClone681088 |
| SEQ ID NO: 2210 | 681222 | Identifier: Ceres CLONE ID no. 681222 | Lead_CeresClone681222 |
| SEQ ID NO: 2219 | 11975 | Identifier: Ceres CLONE ID no. 11975 | Lead_CeresClone11975 |
| SEQ ID NO: 2233 | 14105 | Identifier: Ceres CLONE ID no. 14105 | Lead_CeresClone14105 |
| SEQ ID NO: 2240 | 156807 | Identifier: Ceres CLONE ID no. 156807 | Lead_CeresClone156807 |

TABLE 1-continued

SEQUECE IDENTIFIER CROSS-REFERENCE

| SEQ ID NO | CERES CLONE ID | CERES ID IN SEQUENCE LISTING | HOMOLOG_TABLE_ID |
|---|---|---|---|
| SEQ ID NO: 2245 | 228787 | Identifier: Ceres CLONE ID no. 228787 | Lead_CeresClone228787 |
| SEQ ID NO: 2258 | 537272 | Identifier: Ceres CLONE ID no. 537272 | Lead_CeresClone537272 |
| SEQ ID NO: 2275 | 608818 | Identifier: Ceres CLONE ID no. 608818 | Lead_CeresClone608818 |
| SEQ ID NO: 2283 | 5055 | Identifier: Ceres CLONE ID no. 5055 | Lead_CeresClone5055 |
| SEQ ID NO: 2293 | 331626 | Identifier: Ceres CLONE ID no. 331626 | Lead_CeresClone331626 |
| SEQ ID NO: 2307 | 35742 | Identifier: Ceres CLONE ID no. 35742 | Lead_CeresClone35742 |
| SEQ ID NO: 2312 | 22382 | Identifier: Ceres CLONE ID no. 22382 | Lead_CeresClone22382 |
| SEQ ID NO: 2328 | 36334 | Identifier: Ceres CLONE ID no. 36334 | Lead_CeresClone36334 |
| SEQ ID NO: 2334 | 102248 | Identifier: Ceres CLONE ID no. 102248 | Lead_CeresClone102248 |
| SEQ ID NO: 2347 | 157709 | Identifier: Ceres CLONE ID no. 157709 | Lead_CeresClone157709 |
| SEQ ID NO: 2350 | 24885 | Identifier: Ceres CLONE ID no. 24885 | Lead_CeresClone24885 |
| SEQ ID NO: 2356 | 27810 | Identifier: Ceres CLONE ID no. 27810 | Lead_CeresClone27810 |
| SEQ ID NO: 2370 | 40708 | Identifier: Ceres CLONE ID no. 40708 | Lead_CeresClone40708 |
| SEQ ID NO: 2381 | 16117 | Identifier: Ceres CLONE ID no. 116117 | Lead_CeresClone116117 |
| SEQ ID NO: 2386 | 538933 | Identifier: Ceres CLONE ID no. 538933 | Lead_CeresClone538933 |
| SEQ ID NO: 2397 | 519 | Identifier: Ceres CLONE ID no. 519 | Lead_CeresClone519 |
| SEQ ID NO: 2414 | 11843 | Identifier: Ceres CLONE ID no. 11843 | Lead_CeresClone11843 |
| SEQ ID NO: 2423 | 14033 | Identifier: Ceres CLONE ID no. 14033 | Lead_CeresClone14033 |
| SEQ ID NO: 2428 | 29009 | Identifier: Ceres CLONE ID no. 29009 | Lead_CeresClone29009 |
| SEQ ID NO: 2431 | 32574 | Identifier: Ceres CLONE ID no. 32574 | Lead_CeresClone32574 |
| SEQ ID NO: 2437 | 32612 | Identifier: Ceres CLONE ID no. 32612 | Lead_CeresClone32612 |
| SEQ ID NO: 2453 | 36094 | Identifier: Ceres CLONE ID no. 36094 | Lead_CeresClone36094 |
| SEQ ID NO: 2460 | 115966 | Identifier: Ceres CLONE ID no. 115966 | Lead_CeresClone115966 |
| SEQ ID NO: 2472 | 121021 | Identifier: Ceres CLONE ID no. 121021 | Lead_CeresClone121021 |
| SEQ ID NO: 2476 | 248859 | Identifier: Ceres CLONE ID no. 248859 | Lead_CeresClone248859 |
| SEQ ID NO: 2481 | 266142 | Identifier: Ceres CLONE ID no. 266142 | Lead_CeresClone266142 |
| SEQ ID NO: 2492 | 609573 | Identifier: Ceres CLONE ID no. 609573 | Lead_CeresClone609573 |
| SEQ ID NO: 2503 | 3968 | Identifier: Ceres CLONE ID no. 3968 | Lead_CeresClone3968 |
| SEQ ID NO: 2509 | 98850 | Identifier: Ceres CLONE ID no. 98850 | Lead_CeresClone98850 |

SEQUENCE LISTING (2523 sequences)

SEQ ID NO: 1 - DNA, 538 bp, Arabidopsis thaliana
  misc_feature (1)..(538): Ceres CLONE ID no. 40252
  misc_feature (1)..(538): Also known as  Ceres CDNA ID no. 23446918
aaccattcaaattgattgagtttgttatacaaaaaaaaaaaagaagaagaagccagaagtctgagagttttataagtaacgaaaatgaaatcgaccgtcatgatgattttcctcattatctacctcctcctcgtcgtgccttgcttcgctaaaggatcggagcaaacggattcagaggtgtacgagatcgattacaggggaccagagactcataactctagacctccaccggaaactatgcacggcaagccaccgtacatccaccacaatacctccgccgctgggctcggtgctcatgtaggaggaaagaactagagagagagcgagaccttttccaaggagaagactcagaagttgaagaggaagattacgagagttgtgatatatatatgagtaattattaatgatgttgatacacatttatactttaattatttatcatatgaagatgatcatcgatgtgtgatcagtacagttagtgtgaataacacactactctcctgatgtcatgtccggtcttttatttatttcatttttc

SEQ ID NO: 2 - protein, 76 aa, Arabidopsis thaliana
  misc_feature: Utility: Useful for accelerating crop development and harvest
  misc_feature: Utility: Useful for delaying flowering time
  misc_feature: Utility: Useful for increasing chlorophyll and photosynthetic capacity
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with increased biomass and foliage
  misc_feature: Utility: Useful for making smaller plants
  misc_feature: Utility: Useful for making taller plants
  misc_feature: Utility: Useful for modifying plant structure, ie increased branching
MKSTVMMIFLIIYLLLVVPCFAKGSEQTDSEVYEIDYRGPETHNSRPPPETMHGKPPYIHHNTSAAGLGAHVGGKN

SEQ ID NO: 3 - protein, 67 aa, Brassica napus
  misc_feature (1)..(67): Ceres CLONE ID no. 1094231
  misc_feature: Utility: Useful for accelerating crop development and harvest
  misc_feature: Utility: Useful for delaying flowering time
  misc_feature: Utility: Useful for increasing chlorophyll and photosynthetic capacity
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with increased biomass and foliage
  misc_feature: Utility: Useful for making smaller plants
  misc_feature: Utility: Useful for making taller plants
  misc_feature: Utility: Useful for modifying plant structure, ie increased branching
MYLLFVVPCFVAIASENTDSEVYEIDYRGPETHNSRPSPETSHGKPPFIHHKTSAAGSASAYVGGQN

SEQ ID NO: 4 - protein, 75 aa, Brassica napus
  misc_feature (1)..(75): Ceres CLONE ID no. 967599
  misc_feature: Utility: Useful for accelerating crop development and harvest
  misc_feature: Utility: Useful for delaying flowering time
  misc_feature: Utility: Useful for increasing chlorophyll and photosynthetic capacity
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with increased biomass and foliage
  misc_feature: Utility: Useful for making smaller plants
  misc_feature: Utility: Useful for making taller plants
  misc_feature: Utility: Useful for modifying plant structure, ie increased branching
MKSIVVILLTYLLLVAPCFAIGSENTNSDVYEIDYRGPETHNSRPPPETLHGKRPFIHHKTSAAGSAGAHVGGQN

SEQ ID NO: 5 - DNA, 1057 bp, Arabidopsis thaliana
  misc_feature (1)..(1057): Ceres CLONE ID no. 32791
  misc_feature (1)..(1057): Also known as  Ceres CDNA ID no. 23556617
gtttttgggattctcaaaaaactcaaaataaactttcctcattttttttttctttcttttgttttgttttctttataaaggagaaagaaagagaaagagagtttccgaaagctgaattgagttgggtgaagcaaattctcaggatgggaagaggaaagatagaaataaagaggatagagaactcaacaaatcgacaagtgacgttttgcaaaagaagaaatggacttctgaagaaagcctatgagctttcggtcctttgcgatgcagaagttgcgctcattgttttctccactcgtggccgtctctatgaatacgccaataacaacataagatcaaccattgagaggtacaagaaagcttgttctgatagcaccaacactagcactgtccaagaaatcaatgccgcgtactatcaacaagaatctgctaagctgagacaacagatccaaacgattcaaaactccaacaggaatctgatgggagactctttgagttccttaagtgtcaaggaactaaaacaagttgagaatcgccttgagaaagctatctctaggatcaggtccaagaagcatgagttgcttctagttgaaatcgaaaacgcgcagaaaagggagattgagcttgacaatgagaacatctatctaagaactaaggtagcagaagtggagaggtatcaacaacaccatcatcaaatggttagtggttcagagattaacgcaattgaagctttagcctcacgcaattactttgctcatagcattatgactgctggttctggatctggtaatggaggttcttactctgatcccgacaagaaaattcttcatctcggataatctcgtctgcgaaaaaccgagctgcaataactctctgcatgcatctggggattctttgctcagatttatctctacataaaatatgttttggtgcaaaataattcaaagtacaatgaaggtattggtccttcaagactcattgcaatttgtgttgtgtaatgattaagacatactctagtttttattgcttcgtatcatagtatctattctatggtatctcc

SEQ ID NO: 6 - protein, 230 aa, Arabidopsis thaliana
  misc_feature (9)..(59): Pfam Name: SRF-TF; Pfam Description: SRF-type transcription factor (DNA- binding and dimerisation domain)
  misc_feature (74)..(173): Pfam Name: K-box; Pfam Description: K-box region
  misc_feature: Utility: Useful for accelerating flowering time
  misc_feature: Utility: Useful for delaying flowering time
  misc_feature: Utility: Useful for increasing seed/fruit yield or modifying fruit content
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with altered leaf shape eg curled leaves
  misc_feature: Utility: Useful for making plants with increased biomass and foliage
  misc_feature: Utility: Useful for making smaller plants
  misc_feature: Utility: Useful for making stronger plants
MGRGKIEIKRIENSTNRQVTFCKRRNGLLKKAYELSVLCDAEVALIVFSTRGRLYEYANNNIRSTIERYKKACSDSTNTSTVQEINAAYYQQESAKLRQQIQTIQNSNRNLMGDSLSSLSVKELKQVENRLEKAISRIRSKKHELLLVEIENAQKREIELDNENIYLRTKVAEVERYQQHHHQMVSGSEINAIEALASRNYFAHSIMTAGSGSGNGGSYSDPDKKILHLG

SEQ ID NO: 7 - protein, 223 aa, Arabidopsis thaliana
  misc_feature (1)..(223): Public GI no. 23194453
  misc_feature: Utility: Useful for accelerating flowering time
  misc_feature: Utility: Useful for delaying flowering time
  misc_feature: Utility: Useful for increasing seed/fruit yield or modifying fruit content
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with altered leaf shape eg curled leaves
  misc_feature: Utility: Useful for making plants with increased biomass and foliage
  misc_feature: Utility: Useful for making smaller plants
  misc_feature: Utility: Useful for making stronger plants
MGRGKIEIKRIENTTNRQVTFCKRRNGLLKKAYELSVLCDAEVALIVFSSRGRLYEYSNNNIRSTIDRYKKACSDTSNTNTVTEINAQYYQQESAKLRQQIQMLQNSNRHLMGDSLSSLTVKELKQVENRLERGITRIRSKKHEMLLAEIEFLQKREIELENESVCLRTKIAEIERLQQANMVTGPELNAIQALASRNFFSPNVIEHPSAYSHPSDKKILHLG

SEQ ID NO: 8 - protein, 223 aa, Arabidopsis thaliana
  misc_feature (1)..(223): Public GI no. 60100358
  misc_feature: Utility: Useful for accelerating flowering time
  misc_feature: Utility: Useful for delaying flowering time
  misc_feature: Utility: Useful for increasing seed/fruit yield or modifying fruit content
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with altered leaf shape eg curled leaves
  misc_feature: Utility: Useful for making plants with increased biomass and foliage
  misc_feature: Utility: Useful for making smaller plants
  misc_feature: Utility: Useful for making stronger plants
MGRGKIEIKRIENTTNRQVTFCKRRNGLLKKAYELSVLCDAEVALIVFSSRGRLYEYSNNNIRSTIERYKKACSDHSSTSTTTEINAQYYQQESAKLRQQIQMLQNSNRHLMGDALSTLTVKELKQLENRLERGITRIRSKKHEMLLAEIEYFQKREIELENENLCLRTKITDVERIQQVNMVSGQELNAIQALASRNFFNPPMIEDGTSYPQQPDKKILHLG

SEQ ID NO: 9 - protein, 207 aa, Arabidopsis thaliana
  misc_feature (1)..(207): Public GI no. 3646326
  misc_feature: Utility: Useful for accelerating flowering time
  misc_feature: Utility: Useful for delaying flowering time
  misc_feature: Utility: Useful for increasing seed/fruit yield or modifying fruit content
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with altered leaf shape eg curled leaves
  misc_feature: Utility: Useful for making plants with increased biomass and foliage
  misc_feature: Utility: Useful for making smaller plants
  misc_feature: Utility: Useful for making stronger plants
MGRGKIEIKRIENTTNRQVTFCKRRNGLLKKAYELSILCDAEVALIVFSTRGRLYEYSNNNSIRNTIERYKKACSDSTGSSSVTEINAQNSNRHLMGDALSTLTVKELKQVENRLERGITRIRSKKHELLLAEIEYFQKKEIELENENVYFRTKVSEVERLQQANMVSGSEMNAIQALASRHFFSQNMIEGGEATFPQQDKKNLHLG

SEQ ID NO: 10 - protein, 222 aa, Glycine max
  misc_feature (1)..(222): Ceres CLONE ID no. 1044034
  misc_feature: Utility: Useful for accelerating flowering time
  misc_feature: Utility: Useful for delaying flowering time
  misc_feature: Utility: Useful for increasing seed/fruit yield or modifying fruit content
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with altered leaf shape eg curled leaves
  misc_feature: Utility: Useful for making plants with increased biomass and foliage
  misc_feature: Utility: Useful for making smaller plants
  misc_feature: Utility: Useful for making stronger plants
MGRGKIEIKRIENTTNRQVTFCKRRNGLLKKAYELSVLCDAEVALIVFSSRGRLYEYSNNNIRSTIERYKKACSDHSSASTTTEINAQYYQQESAKLRQQIQMLQNSNRHLMGDALSTLTVKELKQLENRLERGITRIRSKKHEMLLAEIEYFQKREIELENENLCLRTKITDVERIQQVNMVSGPELNAIQALASRNFFNPNMLEGGTVYPHSDKKILHLG

SEQ ID NO: 11 - protein, 225 aa, Glycine max
  misc_feature (1)..(225): Public GI no. 4103342
  misc_feature: Utility: Useful for accelerating flowering time
  misc_feature: Utility: Useful for delaying flowering time
  misc_feature: Utility: Useful for increasing seed/fruit yield or modifying fruit content
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with altered leaf shape eg curled leaves
  misc_feature: Utility: Useful for making plants with increased biomass and foliage
  misc_feature: Utility: Useful for making smaller plants
  misc_feature: Utility: Useful for making stronger plants
MGRGKIEIKRIENTTNRQVTFCKRRNGLLKKAYELSVLCDAEVALIVFSSRGRLYEYSNNSIKTTIERYKKACSDSSATSSVTELNTQYYQQESAKLRQQIQMLQNSNRHLMGDSLSALTVKELKQLENRLERGITRIRSKKHEMLLAEIEYLQKREIELENENVCIRTKIAEVERVQQANMVSGQELNAIQALANSRNFFSPNIMEPAGPVSYSHQDKKMLHLG

SEQ ID NO: 12 - protein, 229 aa, Glycine max
  misc_feature (1)..(229): Public GI no. 2997615
  misc_feature: Utility: Useful for accelerating flowering time
  misc_feature: Utility: Useful for delaying flowering time
  misc_feature: Utility: Useful for increasing seed/fruit yield or modifying fruit content
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with altered leaf shape eg curled leaves
  misc_feature: Utility: Useful for making plants with increased biomass and foliage
  misc_feature: Utility: Useful for making smaller plants
  misc_feature: Utility: Useful for making stronger plants
MGRGKIEIKRIENTTNRQVTFCKRRNGLLKKAYELSVLCDAEVALIVFSSRGRLYEYSNNSIKTTIERYKKACSDSSATSSVTELNTQYYQQESAKLRQQIQMLQNSNSNLVRHLMGDSLSALTVKELKQLENRLERGITRIRSKKHEMLLAEIEYLQKREIELENENVCIRTKIAEVERVQQANMVSGQELNAIQALANSRNFFSPNIMEPAGPVSYSHQDKKMLHLG

SEQ ID NO: 13 - protein, 223 aa, Glycine max
  misc_feature (1)..(223): Public GI no. 20385590
  misc_feature: Utility: Useful for accelerating flowering time
  misc_feature: Utility: Useful for delaying flowering time
  misc_feature: Utility: Useful for increasing seed/fruit yield or modifying fruit content
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with altered leaf shape eg curled leaves
  misc_feature: Utility: Useful for making plants with increased biomass and foliage
  misc_feature: Utility: Useful for making smaller plants
  misc_feature: Utility: Useful for making stronger plants
MGRGKIEIKRIENTTNRQVTFCKRRNGLLKKAYELSVLCDAEVALIVFSSRGRVYEYSNNNIKSTIDRYKKASSDSTNGGFTMEINAQYYQQESAKLRQQIQMLQNSNRHLMGDSLASLTVKELKQLENRLERGITRIRSKKHELLLAEIEYLQKREIELENESVYLRTKIAEVERLQQANMVSTHEFNAIQALVSRNFFQPNMIEGGSTGYPLHDKKVLHLG

SEQ ID NO: 14 - protein, 227 aa, Glycine max
  misc_feature (1)..(227): Public GI no. 27763670
  misc_feature: Utility: Useful for accelerating flowering time
  misc_feature: Utility: Useful for delaying flowering time
  misc_feature: Utility: Useful for increasing seed/fruit yield or modifying fruit content
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with altered leaf shape eg curled leaves
  misc_feature: Utility: Useful for making plants with increased biomass and foliage
  misc_feature: Utility: Useful for making smaller plants
  misc_feature: Utility: Useful for making stronger plants
MGRGKIEIKRIENTTNRQVTFCKRRNGLLKKAYELSVLCDAEVALIVFSSRGRLYEYSNNSIKTTIGRYKKACSDSSATSSVTELNTQYYQQESAKLRQQIQMLQNSNSNLVRHLMGDSLSALTVKELKQLENRLERGITRIRSKKHEMLLAEIEYLQKREIELENENVCIRTKIAEVERLQQANMVSGQELNAIQALASRNFFTPNMMEGGAVTFSHQDKKMLHLG

SEQ ID NO: 15 - protein, 238 aa, Glycine max
  misc_feature (1)..(238): Public GI no. 2981133
  misc_feature: Utility: Useful for accelerating flowering time
  misc_feature: Utility: Useful for delaying flowering time
  misc_feature: Utility: Useful for increasing seed/fruit yield or modifying fruit content
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with altered leaf shape eg curled leaves
  misc_feature: Utility: Useful for making plants with increased biomass and foliage
  misc_feature: Utility: Useful for making smaller plants
  misc_feature: Utility: Useful for making stronger plants
MAYQNEPQESSPLRKLGRGKVEIKRIENTTNRQVTFCKRRNGLLKKAYELSVLCDAEVALIVFSSRGRLYEYSNNSVKSTIERYKKACADSSNNGSVSEANAQFYQQEAAKLRSQIGNLQNSNRNMLGESLSALSVKELKSLEIKLEKGIGRIRSKKNELLFAEIEYMQKREIDLHNNNQLLRAKIAENERKRQHMNLMPGGVNFEIMQSQPFDSRNYSQVNGLPPANHYPHEDQLFS

SEQ ID NO: 16 - protein, 226 aa, Glycine max
  misc_feature (1)..(226): Public GI no. 42794566
  misc_feature: Utility: Useful for accelerating flowering time
  misc_feature: Utility: Useful for delaying flowering time
  misc_feature: Utility: Useful for increasing seed/fruit yield or modifying fruit content
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with altered leaf shape eg curled leaves
  misc_feature: Utility: Useful for making plants with increased biomass and foliage
  misc_feature: Utility: Useful for making smaller plants
  misc_feature: Utility: Useful for making stronger plants
MGRGKIEIKRIENTTNRQVTFCKRRNGLLKKAYELSVLCEAEVALIVFSSRGRLYEYANNSVRTTIDRYKKASDSSNPASVSETNSQYYQQEATKLRQQIGILQNANRHLMGESLSSMSVKELKQLETRLEKGISRIRSKKNELLFAEIEYMQKREVELQNDNIFLRGKIVENERAQQNMNMLPGGGGYEVMSQHPPYDSRNYLPVNLLEHNQHFSHQEPTALQLG

SEQ ID NO: 17 - protein, 212 aa, Glycine max
  misc_feature (1)..(212): Public GI no. 42794562
  misc_feature: Utility: Useful for accelerating flowering time
  misc_feature: Utility: Useful for delaying flowering time
  misc_feature: Utility: Useful for increasing seed/fruit yield or modifying fruit content
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with altered leaf shape eg curled leaves
  misc_feature: Utility: Useful for making plants with increased biomass and foliage
  misc_feature: Utility: Useful for making smaller plants
  misc_feature: Utility: Useful for making stronger plants
IENTTNRQVTFCKRRNGLLKKAYELSVLCDAEVALIVFSTRGRLYEYANNSIKSTIERYKKASADSSSTTSIAEANTQYYQQEASKLRQQIHILQNSNRHLMGDALSSLSIKELKQLENRLERGITRIRSKKHELLFAEIEYMQKREADLQNDNMYLRAKIAENENAQQANMLPGPEFDTLPTFDSRNYFQANILEAAPQYSHQDQTALHLG

SEQ ID NO: 18 - protein, 228 aa, Glycine max
  misc_feature (1)..(228): Public GI no. 1568513
  misc_feature: Utility: Useful for accelerating flowering time
  misc_feature: Utility: Useful for delaying flowering time
  misc_feature: Utility: Useful for increasing seed/fruit yield or modifying fruit content
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with altered leaf shape eg curled leaves
  misc_feature: Utility: Useful for making plants with increased biomass and foliage
  misc_feature: Utility: Useful for making smaller plants
  misc_feature: Utility: Useful for making stronger plants
MGRGKIEIKRIENNTNRQVTFCKRRNGLLKKAYELSVLCDAEIALIVFSTRGRVYEYANNNIKGTIERYKKATAETSNACTTQELNAQFYQQESKKLRQQIQLLQNTNRHLVGEGLSALNVRELKQLENRLERGITRIRSKKHEMILAETENLQKREIQLEQENTFLRSKIAENERLQELSMMPATGQEYNAFQQYFARNMLQLNMMEGGVPSYDPLPAHDKKSLQLE

SEQ ID NO: 19 - protein, 242 aa, Glycine max
  misc_feature (1)..(242): Public GI no. 861081
  misc_feature: Utility: Useful for accelerating flowering time
  misc_feature: Utility: Useful for delaying flowering time
  misc_feature: Utility: Useful for increasing seed/fruit yield or modifying fruit content
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with altered leaf shape eg curled leaves
  misc_feature: Utility: Useful for making plants with increased biomass and foliage
  misc_feature: Utility: Useful for making smaller plants
  misc_feature: Utility: Useful for making stronger plants
MSFYDDQSGNLSPQRKLGRGKIEIKRIENTTNRQVTFCKRRNGLLKKAYELSVLCDAEVALIVFSTRGRLYEYANNSVKGTIERYKKACTDSPNTSSVSEANAQFYQQEASKLRQEISSIQKNNRNMMGESLGSLTVRDLKGLETKLEKGISRIRSKKNELLFAEIEYMQKKEIDLHNNNQYLRAKIAENERAQQHMNLMPGSSDYELAPPQSFDGRNYIQLNGLQPNNHYSRQDQTALQLV

SEQ ID NO: 20 - protein, 225 aa, Glycine max
  misc_feature (1)..(225): Public GI no. 1067169
  misc_feature: Utility: Useful for accelerating flowering time
  misc_feature: Utility: Useful for delaying flowering time
  misc_feature: Utility: Useful for increasing seed/fruit yield or modifying fruit content
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with altered leaf shape eg curled leaves
  misc_feature: Utility: Useful for making plants with increased biomass and foliage
  misc_feature: Utility: Useful for making smaller plants
  misc_feature: Utility: Useful for making stronger plants
MGRGKIEIKRIENNTNRQVTFCKRRNGLLKKAYELSVLCEAEIALIVFSTRGRVYEYSNNNIRAIIDRYKKATVETSNAFTTQELNAQFYQQESKKLRQQIQLIQNSNRHLVGEGLSSLNVRELKQLENRLERGIARIRSKKHEMILAESEDLQKREIQLEQENAFLRSKIAENERLQELSMMPAGGQEYNAIQQYLARNMLQLNMMEGVPSYPLPSDKKSLDLE

SEQ ID NO: 21 - protein, 223 aa, Glycine max
  misc_feature (1)..(223): Public GI no. 24967137
  misc_feature: Utility: Useful for accelerating flowering time
  misc_feature: Utility: Useful for delaying flowering time
  misc_feature: Utility: Useful for increasing seed/fruit yield or modifying fruit content
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with altered leaf shape eg curled leaves
  misc_feature: Utility: Useful for making plants with increased biomass and foliage
  misc_feature: Utility: Useful for making smaller plants
  misc_feature: Utility: Useful for making stronger plants
MGRGKIEIKRIENNTNRQVTFCKRRNGLLKKAYELSVLCDAEIALIVFSTRGRLYEYSNNNVKATIERYKKATAETSSAYTTQELNAQFYQQESKKLRQQIQMMQNTNRHLVGEGLSSLNVRELKQLENRLERGITRIRSKKHEAILAETEDLHKREIQLEQENAFLRSKIAENERLQELSMMPSGGEEYNAFQQYLARNMLQLNMMETALPSYDPLSPDHKR

SEQ ID NO: 22 - DNA, 721 bp, Arabidopsis thaliana
  misc_feature (1)..(721): Ceres CLONE ID no. 39319
  misc_feature (1)..(721): Also known as  Ceres CDNA ID no. 23372895
atttttctcaccgtcgagagaacaaaacacaagttgcagactttatccaaatttagggttttctttttcttcttactcagattatcatcagatcttcgaaaccccaaatttacaaatcagatcagcttcccggttagtactaccctcaaatcaactaagtttcatgtctgaacttgactcccaggttcccactgcctttgatccgtttgctgatgcgaatgttgaggactcaggtgccggaacaaaagaatacgttcatatccgtgtccagcagcgaaatggtaggaaaagcttgacaaccgtccagggcctgaagaaagagtacagctataccaagatacttaaggacctcaaaaaagagttttgctgcaacggcactgtggttcaggattcagaactcggacaggttatacagcttcaaggtgaccaacgtaagaacgtctccacattccttgtccaggctggtttggtgaagaaggataacatcaagatccatggtttctaagctatctagtggatcatattattaataaaaccatatctttctcttctttcatctcttgttgcgaattttgggtttgattcatcaaaatcgtcttcttcctagtgttcttcttctgtttggtattcgaattttaatggcttatgtccaccatacttcttcccctgttttcgtgttactctgtttcacatcttacttatcttataatatcagtttgtt

SEQ ID NO: 23 - protein, 113 aa, Arabidopsis thaliana
  misc_feature (25)..(106): Pfam Name: SUI1; Pfam Description: Translation initiation factor SUI1
  misc_feature (25)..(106): Pfam Name: SUI1; Pfam Description: Translation initiation factor SUI1
  misc_feature: Utility: Useful for accelerating flowering time
  misc_feature: Utility: Useful for making smaller plants
MSELDSQVPTAFDPFADANVEDSGAGTKEYVHIRVQQRNGRKSLTTVQGLKKEYSYTKILKDLKKEFCCNGTVVQDSELGQVIQLQGDQRKNVSTFLVQAGLVKKDNIKIHGF

SEQ ID NO: 24 - protein, 113 aa, Glycine max
  misc_feature (1)..(113): Ceres CLONE ID no. 1016818
  misc_feature: Utility: Useful for accelerating flowering time
  misc_feature: Utility: Useful for making smaller plants
  misc_feature (112)..(112): Xaa is any aa, unknown, or other
MSELDSQVPTAFDPFADANAEDSGAGTKEYVHIRVQQRNGRKSLTTVQGLKKEYSYTKILKDLKKEFCCNGTVVQDSELGQVIQLQGDQRKNVSTFLVQAGLVKKDNIKIHXF

SEQ ID NO: 25 - protein, 94 aa, Brassica napus
  misc_feature (1)..(94): Ceres CLONE ID no. 947724
  misc_feature: Utility: Useful for accelerating flowering time
  misc_feature: Utility: Useful for making smaller plants
MSKLDSQVPTAFDPFADANAEDSGAGTKEYVHIRVQQRNGRKSLTTVQGLKKEYSYTKILKDLKKEFCCNGTVVQDSELGQVIQLQGDQRKNVS

SEQ ID NO: 26 - protein, 113 aa, Brassica napus
  misc_feature (1)..(113): Public GI no. 6165638
  misc_feature: Utility: Useful for accelerating flowering time
  misc_feature: Utility: Useful for making smaller plants
MSELDSQVPTAFDPFADANAEDSGAGTKEYVHIRVQQRNGRKSLTTVQGLKKEYSYTKILKDLKKEFCCNGTVVQDSELGQVIQLQGDQRKNVSTFLVQAGLVKKDDIQIHGF

SEQ ID NO: 27 - protein, 75 aa, Brassica napus
  misc_feature (1)..(75): Ceres CLONE ID no. 1088967
  misc_feature: Utility: Useful for accelerating flowering time
  misc_feature: Utility: Useful for making smaller plants
MSELDSQVPTAFDPFADANAEDSGAGTKEYVHIRVQQRNGRKSLTTVQGLKKEYSYSKILKDLKKEFCCNGTVVQ

SEQ ID NO: 28 - protein, 121 aa, Arabidopsis thaliana
  misc_feature (1)..(121): Ceres CLONE ID no. 27929
  misc_feature: Utility: Useful for accelerating flowering time
  misc_feature: Utility: Useful for making smaller plants
MSELDSQVPTAFDPFADANVEDSGAGTKEYVHIRVQQRNGRKSLTTVQGLKKEYSYTKILKECCVGPKKRVVTLRQSLLTQTSRLALEEIKLKFIDTASIFGHGRFQTSLEKMRFYNRVTK

SEQ ID NO: 29 - protein, 113 aa, Arabidopsis thaliana
  misc_feature (1)..(113): Public GI no. 4585973
  misc_feature: Utility: Useful for accelerating flowering time
  misc_feature: Utility: Useful for making smaller plants
MSDLEVQVPTAFDPFADANAEDSGAGTKEYVHIRVQQRNGRKSLTTVQGLKKEYSYSKILKDLKKEFCCNGTVVQDSELGQVIQLQGDQRKNVSTFLVQAGLVKKDNIKIHGF

SEQ ID NO: 30 - protein, 75 aa, Zea mays
  misc_feature (1)..(75): Ceres CLONE ID no. 1555168
  misc_feature: Utility: Useful for accelerating flowering time
  misc_feature: Utility: Useful for making smaller plants
MRIQQRNGRKSLTTVQGLKKEFSYSKILKDLKKEFCCNGTVVQDPELGQAARYRSFSSRVIRGRTSRISSSRPAL

SEQ ID NO: 31 - protein, 115 aa, Triticum aestivum
  misc_feature (1)..(115): Ceres CLONE ID no. 774974
  misc_feature: Utility: Useful for accelerating flowering time
  misc_feature: Utility: Useful for making smaller plants
MSDLDVQVPTAFDPFAEANAEDSGAGAGSKNYVHVRVQQRNGRKSLTTVQGLKKDYSYNKILKDLKKEFCCNGTVVQDPELGQVIQLQGDQRKNVATFLVQAGLAKKESIKIHGF

SEQ ID NO: 32 - protein, 117 aa, Zea mays
  misc_feature (1)..(117): Ceres CLONE ID no. 705811
  misc_feature: Utility: Useful for accelerating flowering time
  misc_feature: Utility: Useful for making smaller plants
MSDLDVQLPSAFDPFAEANAEDSGAGPGTKDYVHVRIQQRNGRKSLTTVQGLKNEFSYNKILKDLKKEFCCNGTVVQDPELGQVRYENNAFQACKNGICRLVDILICLSAAGHSAPR

SEQ ID NO: 33 - protein, 153 aa, Glycine max
  misc_feature (1)..(153): Ceres CLONE ID no. 516874
  misc_feature: Utility: Useful for accelerating flowering time
  misc_feature: Utility: Useful for making smaller plants
  misc_feature (142)..(142): Xaa is any aa, unknown, or other
MVDLEIQVPTPFDPFAEARESDAPGAKEYVHIRIQQRNGKKSLTTVQGLKKEFSYEKILKDLKKEFCCNGTVVQDKELGKIIQLQGDQHVMHGATITSAFEGTWHMVLVSPFPSAPPLLLTWLWKRQQQWRVEHGQLNAKPXVAVLDRGSIAE

SEQ ID NO: 34 - protein, 112 aa, Brassica napus
  misc_feature (1)..(112): Ceres CLONE ID no. 1097485
  misc_feature: Utility: Useful for accelerating flowering time
  misc_feature: Utility: Useful for making smaller plants
MVELDIQVPLAYDPFAEAQDTDAPGTKEYIHVRIQQRNGKKSLTTVQGLKKEYSYEKILKDLKKDFCCNGNVVQDKVLGKIIQLQGDQRKKVSHFLVQTGIAKKDQIKIHGF

SEQ ID NO: 35 - protein, 85 aa, Brassica napus
  misc_feature (1)..(85): Ceres CLONE ID no. 1126017
  misc_feature: Utility: Useful for accelerating flowering time
  misc_feature: Utility: Useful for making smaller plants
  misc_feature (76)..(76): Xaa is any aa, unknown, or other
MVELDIQVPLAYDPFAEAQDTDAPGTKEYIHVRIQQRNGKKSLTTVQGLKKEYSYEKILKDLKKDFCCNGNVVQDXVLGKIIQLQ

SEQ ID NO: 36 - protein, 86 aa, Brassica napus
  misc_feature (1)..(86): Ceres CLONE ID no. 1084637
  misc_feature: Utility: Useful for accelerating flowering time
  misc_feature: Utility: Useful for making smaller plants
  misc_feature (24)..(24): Xaa is any aa, unknown, or other
  misc_feature (46)..(46): Xaa is any aa, unknown, or other
  misc_feature (79)..(79): Xaa is any aa, unknown, or other
  misc_feature (81)..(81): Xaa is any aa, unknown, or other
  misc_feature (85)..(85): Xaa is any aa, unknown, or other
MVELDIQVPSAFDPFAEAQESDAXGTKEYIHVRIQQRNGKKSLTTXQGLKKAYSYEKILKDLKKDFCCNGNVVQDKELXQXHSAXG

SEQ ID NO: 37 - DNA, 1490 bp, Arabidopsis thaliana
  misc_feature (1)..(1490): Ceres CLONE ID no. 41337
  misc_feature (1)..(1490): Also known as  Ceres CDNA ID no. 23388491
aaaaaagattcgatttttgactgcaaaaaagagaatttctaaaagcaaatcggagagcttcggcgatggcgttatcacgactttcttcacgatccaacactttcctaaagccggcgattaccgccttgccctcctccatccgccgtcatgtttccacagactcatcaccgatcacaatcgaaaccgccgtccctttcacatcgcatctatgtgaatcaccgtcacgctccgtcgagacttcatcggaggagatcttagcctttttccgtgacatggctcggatgaggaggatggagatcgcagcagattctctttacaaggcgaagctgatccgtgggttctgtcatttgtacgatggtcaagaggctttagcggtgggaatgsaagcggcgattaccaaaaaagatgcgattatcacatcgtatcgtgatcactgtactttcattggtcgtggtgggaagcttgttgatgctttctctgagcttatggggagaaaaactggttgttctcatggtaaaggaggatctatgcatttctataagaaagatgcttccttttatggtggacatgggattgttggtgctcagattccattgggatgtggtttggcttttgctcagaagtataataaggatgaggctgtgacttttgctttgtatggtgatggtgctgcgaatcagggacagttgtttgaggccttgaacatttcggctttgtgggatttgcctgcgattcttgtttgcgagaataaccattatggaatgggaacggctacatggaggtcggctaagtctccggcttatttcaagcgtggagattatgttcctggcttgaaggtggatggtatggatgcactggctgtgaaacaggcgtgcaagtttgccaaggagcatgctctcaagaatggtcctattatccttgagatggacacttacagataccacggtcactctatgtctgacccaggaagcacttaccgtactcgtgatgaaatctctggcgtgagacaggtgcgtgatccaattgaaagggtgcgaaagttgctcttaactcatgacatagctaccgaaaaagagcttaaggacatggagaaagagataaggaaagaagtagatgacgccgtagctcaggccaaggagagcccgataccagatgcatctgagctattcacaaacatgtacgtgaaagactgcggagttgagtcgtttggagcagacagaaaagaactcaaagtaacacttccatagaatcttgcttcccaaggagatgattggttcaataaatcagaaggcaaggctacacaaatctttttaacttgctaccaaaaatatttctggttttttttttttgtattttcatttcaagtgtaaagccattgcttcaccagtttgccaactttgtttcccacacttaaatttgacaccaagcaaaagaagcttcggatatcactctgtgagataaagttagagaaataagcagagagagtagtt

SEQ ID NO: 38 - protein, 393 aa, Arabidopsis thaliana
  misc_feature (68)..(365): Pfam Name: E1_dh; Pfam Description: Dehydrogenase E1 component
  misc_feature: Utility: Useful for accelerating flowering time
  misc_feature: Utility: Useful for increasing chlorophyll and photosynthetic capacity
  misc_feature: Utility: Useful for making ornamental plants with modified flowers
  misc_feature: Utility: Useful for making smaller plants
MALSRLSSRSNTFLKPAITALPSSIRRHVSTDSSPITIETAVPFTSHLCESPSRSVETSSEEILAFFRDMARMRRMEIAADSLYKAKLIRGFCHLYDGQEALAVGMEAAITKKDAIITSYRDHCTFIGRGGKLVDAFSELMGRKTGCSHGKGGSMHFYKKDASFYGGHGIVGAQIPLGCGLAFAQKYNKDEAVTFALYGDGAANQGQLFEALNISALWDLPAILVCENNHYGMGTATWRSAKSPAYFKRGDYVPGLKVDGMDALAVKQACKFAKEHALKNGPIILEMDTYRYHGHSMSDPGSTYRTRDEISGVRQVRDPIERVRKLLLTHDIATEKELKDMEKEIRKEVDDAVAQAKESPIPDASELFTNMYVKDCGVESFGADRKELKVTLP

SEQ ID NO: 39 - protein, 321 aa, Arabidopsis thaliana
  misc_feature (1)..(321): Ceres CLONE ID no. 37506
  misc_feature: Utility: Useful for accelerating flowering time
  misc_feature: Utility: Useful for increasing chlorophyll and photosynthetic capacity
  misc_feature: Utility: Useful for making ornamental plants with modified flowers
  misc_feature: Utility: Useful for making smaller plants
MRRMEIAADSLYKAKLIRGFCHLYDGQEAVAIGMEAAITKKDAIITAYRDHCIFLGRGGSLHEVFSELMGRQAGCSKGKGGSMHFYKKESSFYGGHGIVGAQVPLGCGIAFAQKYNKEEAVTFALYGDGAANQGQLFEALNISALWDLPAILVCENNHYGMGTAEWRAAKSPSYYKRGDYVPGLKVDGMDAFAVKQACKFAKQHALEKGPIILEMDTYRYHGHSMSDPGSTYRTRDEISGVRQERDPIERIKKLVLSHDLATEKELKDMEKEIRKEVDDAIAKAKDCPMPEPSELFTNVYVKGFGTESFGPDRKEVKASLP

SEQ ID NO: 40 - protein, 370 aa, Zea mays
  misc_feature (1)..(370): Ceres CLONE ID no. 293206
  misc_feature: Utility: Useful for accelerating flowering time
  misc_feature: Utility: Useful for increasing chlorophyll and photosynthetic capacity
  misc_feature: Utility: Useful for making ornamental plants with modified flowers
  misc_feature: Utility: Useful for making smaller plants
MAARPVSDSTAALTIETSVPFTSHLVDPPSRDVTTTPAELVTFFRDMSLMRRMEIAADSLYKAKLIRGFCHLYDGQEAVAVGMEAAITRSDSIITAYRDHCTYLARGGDLVSAFSELMGREGGCSRGKGGSMHFYKKDANFYGGHGIVGAQVPLGCGLAFAQKYKKEETATFALYGDGAANQGQLFEALNISALWKLPAILVCENNHYGMGTAEWRAAKSPAYYKRGDYVPGLKVDGMDVLAVKQACKFAKDHAVANGPIVLEMDTYRYHGHSMSDPGSTYRTRDEISGVRQERDPIERVRKLLLAHDLATAAELKDMEKEIRKQVDDAIAKAKESSMPDTSELFTNVYKKGFNVESFGPDRKELRATLP

SEQ ID NO: 41 - protein, 370 aa, Zea mays
  misc_feature (1)..(370): Ceres CLONE ID no. 297432
  misc_feature: Utility: Useful for accelerating flowering time
  misc_feature: Utility: Useful for increasing chlorophyll and photosynthetic capacity
  misc_feature: Utility: Useful for making ornamental plants with modified flowers
  misc_feature: Utility: Useful for making smaller plants
MAARPVSDSTAALTIETSVPFTSHLVDPPSRDVTTTPAELVTFFRDMSLMRRMEIAADSLYKAKLIRGFCHLYDGQEAVAVGMEAAITRSDSIITAYRDHCTYLARGGDLVSAFSELMGREGGCSRGKGGSMHFYKKDANFYGGHGIVGAQVPLGCGLAFAQKYKEEETATFALYGDGAANQGQLFEALNISALWKLPAILVCENNHYGMGTAEWRAAKSPAYYKRGDYVPGLKVDGMDVLAVKQACKFAKDHAVANGPIVLEMDTYRYHGHSMSDPGSTYRTRDEISGVRQERDPIERVRKLLLAHDLATAAELKDMEKEIRKQVDDAIAKAKESSMPDTSELFTNVYKKGFNVESFGPDRKELRATLP

SEQ ID NO: 42 - protein, 370 aa, Zea mays
  misc_feature (1)..(370): Ceres CLONE ID no. 246807
  misc_feature: Utility: Useful for accelerating flowering time
  misc_feature: Utility: Useful for increasing chlorophyll and photosynthetic capacity
  misc_feature: Utility: Useful for making ornamental plants with modified flowers
  misc_feature: Utility: Useful for making smaller plants
MAARPVSDSTAALTIETSVPFTSHLVDPPSRDVTTTPAELVTFFRDMSLMRRMEIAADSLYKAKLIRGFCHLYDGQEAVAVGMEAAITRSDSIITAYRDHCTYLARGGDLVSAFSELMGREGGCSRGKGGSMHFYKKDANFYGGHGIVGAQVPLGCGLAFAQKYKKEETATFALYGDCAANQGQLFEALNISALWKLPAILVCENNHYGMGTAEWRAAKSPAYYKRGDYVPGLKVDGMDVLAVKQACKFAKDHAVANGPIVLEMDTYRYHGHSMSDPGSTYRTRDEISGVRQERDPIERVRKLLLAHDLATAAELKDMEKEIRKQVDDAIAKAKESSMPDTSELFTNVYKKGFNVESFGPDRKELRATLP

SEQ ID NO: 43 - protein, 370 aa, Zea mays
  misc_feature (1)..(370): Ceres CLONE ID no. 246886
  misc_feature: Utility: Useful for accelerating flowering time
  misc_feature: Utility: Useful for increasing chlorophyll and photosynthetic capacity
  misc_feature: Utility: Useful for making ornamental plants with modified flowers
  misc_feature: Utility: Useful for making smaller plants
MAARPISDSTAAFTIETSVPFTSHLVDPPSRDVTTTPAELVTFFRDMSLMRRMEIAADSLYKAKLIRGFCHLYDGQEAVAVGMEAAITRSDSIITAYRDHCTYLARGGDLVSAFSELMGREAGCSRGKGGSMHFYKKDANFYGGHGIVGAQVPLGCGLAFAQKYKKEDTATFALYGDGAANQGQLFEALNISALWKLPAILVCENNHYGMGTAEWRAAKSPAYYKRGDYVPGLKVDGMDVLAVKQACKFAKDHAVANGPIVLEMDTYRYHGHSMSDPGSTYRTRDEISGVRQERDPIERVRKLLLTHDLANAAELKNMEKEIRKQVDDAIAKAKESSMPDTSELFTNVYKKGFGVESFGPDRKEMRASLP

SEQ ID NO: 44 - protein, 324 aa, Zea mays
  misc_feature (1)..(324): Ceres CLONE ID no. 994766
  misc_feature: Utility: Useful for accelerating flowering time
  misc_feature: Utility: Useful for increasing chlorophyll and photosynthetic capacity
  misc_feature: Utility: Useful for making ornamental plants with modified flowers
  misc_feature: Utility: Useful for making smaller plants
MSLMRRFEIAADSLYKAKLIRGFCHLYDGQEAVAVGMEAAATRADAIITAYRDHCAYLARGGDPVAAFAELMGRRDGCSRGKGGSMHFYKRDANFFGGHGIVGAQVPLGCGIAFAQRYRKEGTVTFDLYGDGAANQGQLFEALNMAALWKLPVILVCENNHYGMGTAEWRASKSPAYYKRGDYVPGLKVDGMDVLAVKQACKFAKEHALENGPIILEMDTYRYHGHSMSDPGSTYRTRDEIAGIRQERDPIERVRKLMLVHEFATAQELKDMEKEIRKQVDAAIAKAKECPLPDPSELFTNVYVNDCGLESFGVDRKEVRTVLP

SEQ ID NO: 45 - protein, 334 aa, Glycine max
  misc_feature (1)..(334): Ceres CLONE ID no. 554851
  misc_feature: Utility: Useful for accelerating flowering time
  misc_feature: Utility: Useful for increasing chlorophyll and photosynthetic capacity
  misc_feature: Utility: Useful for making ornamental plants with modified flowers
  misc_feature: Utility: Useful for making smaller plants
MHYFKEMSMMRRMEIALDNLYKAREIRGFCHLYDGQESIAMGIEAAVTFEDCLITAYRDHCQAYCRGDSVHQIIAELMGKRTGSTNGKGGSMHFYRKKTNFYGGHGIVGAQCALGTGLGFALKYQKKPNVAITMYGDGAANQGQLFEAANMAALWKLPVLYVCENNHYAMGTSTARGAASTEYYKRLMPVPGIRFAANNVFAVREVTKFAKEYSIKEGPICLEMQTYRYHGHSMSDPGVTYRKKQEIDEYRKTKDCITLVKQLIIDNKVATEEDLKEVERAIKKEVDETVEKVREDAYPDAKDLLKDVYIEDPKEPQHIRGVEYDKSFAPRGLP

SEQ ID NO: 46 - DNA, 468 bp, Arabidopsis thaliana
  misc_feature (1)..(468): Ceres CLONE ID no. 314
  misc_feature (1)..(468): Also known as  Ceres CDNA ID no. 23388929
aatcgaatacctgagaaaatggcgaagcctttgggaacaaccggcgaatttttccggcgaagagatgaatggaggaagcatccgatgctttcgaatcaaatgagacacgctcttcccggacttggaatcggcgtcgccgccttctgcgtttatctcgtcggtgagcagatctacaacaaagctttggctccttccaaatcatctcaccaccaccaggaacagactgctccgtctcactgaagagcatctttcttcttcgatgagatgcttgaaacagtggcacaaggctgaactcagggtctcttcttggttactagttttcgttggattgtcttaataatcatgtttaaatcgaatacaaagaatttgatatctatatttgaactgtaaagcttgttggctcaaaggttctctttgtatcgcacaagttaagatttctgcatattcttatcttatttgatacttgct

SEQ ID NO: 47 - protein, 73 aa, Arabidopsis thaliana
  misc_feature: Utility: Useful for delaying flowering time
  misc_feature: Utility: Useful for making larger plants
  misc_feature: Utility: Useful for making ornamental plants with modified flowers
  misc_feature: Utility: Useful for making plants sterile and for genetic confinement
  misc_feature: Utility: Useful for making stronger plants
MAKPLGTTGEFFRRRDEWRKHPMLSNQMRHALPGLGIGVAAFCVYLVGEQIYNKALAPSKSSHHHQEQTAPSH

SEQ ID NO: 48 - protein, 72 aa, Arabidopsis thaliana
  misc_feature (1)..(72): Ceres CLONE ID no. 13483
  misc_feature: Utility: Useful for delaying flowering time
  misc_feature: Utility: Useful for making larger plants
  misc_feature: Utility: Useful for making ornamental plants with modified flowers
  misc_feature: Utility: Useful for making plants sterile and for genetic confinement
  misc_feature: Utility: Useful for making stronger plants
MAKPLGTTGEFFRRRDEWRKHPMLSNQMRHALPGLGIGVGAFCVYLVGEQIYSKLMAPSSQSSHQKQPAPSH

SEQ ID NO: 49 - protein, 72 aa, Arabidopsis thaliana
  misc_feature (1)..(72): Public GI no. 21387015
  misc_feature: Utility: Useful for delaying flowering time
  misc_feature: Utility: Useful for making larger plants
  misc_feature: Utility: Useful for making ornamental plants with modified flowers
  misc_feature: Utility: Useful for making plants sterile and for genetic confinement
  misc_feature: Utility: Useful for making stronger plants
MAKPLGTTGEFFRRRDEWRKHPMLSNQMRHALPGIGIGVGAFCVYLVGEQIYSKLMAPSSQSSHQKQPAPSH

SEQ ID NO: 50 - protein, 73 aa, Glycine max
  misc_feature (1)..(73): Ceres CLONE ID no. 481859
  misc_feature: Utility: Useful for delaying flowering time
  misc_feature: Utility: Useful for making larger plants
  misc_feature: Utility: Useful for making ornamental plants with modified flowers
  misc_feature: Utility: Useful for making plants sterile and for genetic confinement
  misc_feature: Utility: Useful for making stronger plants
MGSGSGKHTGEFFRRRDAWRKHPMLTNQLRHATPGLGIAVVAFGIYLVGEQVYNRLYAPDPHSISHVKAGDHH

SEQ ID NO: 51 - protein, 67 aa, Zea mays
  misc_feature (1)..(67): Ceres CLONE ID no. 366717
  misc_feature: Utility: Useful for delaying flowering time
  misc_feature: Utility: Useful for making larger plants
  misc_feature: Utility: Useful for making ornamental plants with modified flowers
  misc_feature: Utility: Useful for making plants sterile and for genetic confinement
  misc_feature: Utility: Useful for making stronger plants
MASGGKGLNATGEFFRRRDEWRRHPMAGNQLRHATPGLGIAIVAFGIYLVGEAAYNRLYRPSGDNHH

SEQ ID NO: 52 - protein, 66 aa, Zea mays
  misc_feature (1)..(66): Public GI no. 50909577
  misc_feature: Utility: Useful for delaying flowering time
  misc_feature: Utility: Useful for making larger plants
  misc_feature: Utility: Useful for making ornamental plants with modified flowers
  misc_feature: Utility: Useful for making plants sterile and for genetic confinement
  misc_feature: Utility: Useful for making stronger plants
MAGKGLNATGEFFRRRDDWRRHPMVGNQLRHATPGLGIAIVAFGIYLVGEAAYNRLYRPSGDHHHH

SEQ ID NO: 53 - protein, 67 aa, Triticum aestivum
  misc_feature (1)..(67): Ceres CLONE ID no. 696513
  misc_feature: Utility: Useful for delaying flowering time
  misc_feature: Utility: Useful for making larger plants
  misc_feature: Utility: Useful for making ornamental plants with modified flowers
  misc_feature: Utility: Useful for making plants sterile and for genetic confinement
  misc_feature: Utility: Useful for making stronger plants
MATGGKGLNATGEFFRRRDEWRRHPMVGNQLRHATPGLGIAIVAFGIYLVGEAAYNRLYRRAGDNHH

SEQ ID NO: 54 - DNA, 1081 bp, Arabidopsis thaliana
  misc_feature (1)..(1081): Ceres CLONE ID no. 332
  misc_feature (1)..(1081): Also known as  Ceres CDNA ID no. 23367869
attatcatatcctcttcttccttcttcactatcaatcttcttctccactacaacacaaatggagaaatcatcctcaatgaaacaatggaagaagggtcctgctcggggtaaaggcggtccacaaaacgctctttgtcagtaccgtggagtcaggcaaaggacttggggcaaatgggtggctgagatcagagagcccaagaagagggcaagactttggcttggctctttcgctacagctgaagaagcagctatggcttatgatgaggctgccttgaaactctatgggcacgacgcatacctcaacttacctcatcttcagcggaatacaagaccttctctgagtaactctcagaggttcaaatgggtaccttcaaggaagtttatatctatgtttccttcatgtggtatgctaaacgtgaatgctcagcctagtgttcacataatccagcaaagactagaagaactcaagaaaactggacttttatctcaatcctattcttctagttcttcctccaccgaatcaaaaactaatactagctttcttgatgagaagaccagcaagggagaaacagacaatatgttcgaaggtggtgatcagaagaaaccagagatcgacctgaccgagtttcttcagcaactaggaatcttgaaggatgaaaatgaagcagaaccaagtgaggtagcagagtgtcattcccctccaccatggaacgagcaagaagaaactggaagtcctttcagaactgagaatttcagctgggataccctgatcgagatgccaagaagtgaaaccacaactatgcaatttgactccagcaacttcggaagctatgattttgaggatgatgtatccttcccttccatctgggactactacggaagcttagattgagtaaaagcaatttaaggtagatcaagattcagaagtacacaaatggttttggatttagtgtagcgttttggaaaagagacataggtagtgagagtgcagtcttttattatgcagcaataaagtgagtcagtgtacaaccgagttgttcgctttttttggtatattaattaagcatgttcattttttcgc

SEQ ID NO: 55 - protein, 277 aa, Arabidopsis thaliana
  misc_feature (26)..(89): Pfam Name: AP2; Pfam Description: AP2 domain
  misc_feature: Utility: Useful for delaying flowering time
  misc_feature: Utility: Useful for making larger plants
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with  enhanced chemical composition
  misc_feature: Utility: Useful for making plants with altered leaf shape eg curled leaves
  misc_feature: Utility: Useful for making plants with increased biomass
  misc_feature: Utility: Useful for making plants with increased biomass and foliage
  misc_feature: Utility: Useful for making shorter plants and plants with modified flowers
  misc_feature: Utility: Useful for making smaller plants
  misc_feature: Utility: Useful for making taller plants and plants with longer inflorescences
MEKSSSMKQWKKGPARGKGGPQNALCQYRGVRQRTWGKWVAEIREPKKRARLWLGSFATAEEAAMAYDEAALKLYGHDAYLNLPHLQRNTRPSLSNSQRFKWVPSRKFISMFPSCGMLNVNAQPSVHIIQQRLEELKKTGLLSQSYSSSSSSTESKTNTSFLDEKTSKGETDNMFEGGDQKKPEIDLTEFLQQLGILKDENEAEPSEVAECHSPPPWNEQEETGSPFRTENFSWDTLIEMPRSETTTMQFDSSNFGSYDFEDDVSFPSIWDYYGSLD

SEQ ID NO: 56 - protein, 292 aa, Arabidopsis thaliana
  misc_feature (1)..(292): Public GI no. 55168209
  misc_feature: Utility: Useful for delaying flowering time
  misc_feature: Utility: Useful for making larger plants
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with  enhanced chemical composition
  misc_feature: Utility: Useful for making plants with altered leaf shape eg curled leaves
  misc_feature: Utility: Useful for making plants with increased biomass
  misc_feature: Utility: Useful for making plants with increased biomass and foliage
  misc_feature: Utility: Useful for making shorter plants and plants with modified flowers
  misc_feature: Utility: Useful for making smaller plants
  misc_feature: Utility: Useful for making taller plants and plants with longer inflorescences
MDGEGGGLADLARAARAWHAPPPMEPSDDACTVAAPAAETAASSSGAGGGGGGGRTKKKAAGKGGPENGKFRYRGVRQRSWGKWVAEIREPRKRSRKWLGTFATAEDAARAYDRAALLLYGPRAHLNLTAPPPLPPPPPSSAAAAAASSSSAASSTSAPPLRPLLPRPPHLHPAFHHQPFHHHLLQPQPPPPPPPLYYAATASTSTVTTTTTAPPPQLAAAAPAAVLVAAAVSSTAETQAVVATAPEDAASAAAAAAAEEEAAWGFHGGDEEDYAAALLWSEPDPWFDLFLK

SEQ ID NO: 57 - protein, 300 aa, Arabidopsis thaliana
  misc_feature (1)..(300): Public GI no. 25992100
  misc_feature: Utility: Useful for delaying flowering time
  misc_feature: Utility: Useful for making larger plants
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with  enhanced chemical composition
  misc_feature: Utility: Useful for making plants with altered leaf shape eg curled leaves
  misc_feature: Utility: Useful for making plants with increased biomass
  misc_feature: Utility: Useful for making plants with increased biomass and foliage
  misc_feature: Utility: Useful for making shorter plants and plants with modified flowers
  misc_feature: Utility: Useful for making smaller plants
  misc_feature: Utility: Useful for making taller plants and plants with longer inflorescences
MAIMDEAANMVCVPLDYSRKRKSRSRRDRTKNVEETLAKWKEYNEKLDNEGKGKPVRKVPAKGSKKGCMRGKGGPENWRCKYRGVRQRIWGKWVAEIREPKRGSRLWLGTFGTAIEAALAYDDAARAMYGPCARLNLPNYACDSVSWATTSASASASDCTVASGFGEVCPVDGALHEADTPLSSVKDEGTAMDIVEPTSIDEDTLKSGWDCLDKLNMDEMFDVDELLAMLDSTPVFTKDYNSDGKHNNMVSDSQCQEPNAVVDPMTVDYGFDFLKPGRQEDLNFSSDDLAFIDLDSELVV

SEQ ID NO: 58 - protein, 263 aa, Arabidopsis thaliana
  misc_feature (1)..(263): Public GI no. 38099059
  misc_feature: Utility: Useful for delaying flowering time
  misc_feature: Utility: Useful for making larger plants
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with  enhanced chemical composition
  misc_feature: Utility: Useful for making plants with altered leaf shape eg curled leaves
  misc_feature: Utility: Useful for making plants with increased biomass
  misc_feature: Utility: Useful for making plants with increased biomass and foliage
  misc_feature: Utility: Useful for making shorter plants and plants with modified flowers
  misc_feature: Utility: Useful for making smaller plants
  misc_feature: Utility: Useful for making taller plants and plants with longer inflorescences
MSRKKKVRRRSTGPDSVSEIIKKWKEQNQKLQEENGARKAPAKGSKKGCMAGKGGPENSNCKYRGVRQRTWGKWVAEIREPNRGNRLWLGSFPTAVEAAHAYDEAARAMYGATARVNFSERSLDANSGCTSAPPVLMSNGPTAVSHPADGKDESESPSLRSDGPTATLRRSDAKDEPESAGTVVHEVKTEVSNDSTSVREERKTVEVFQPKGKALHKEEKVSYDYFNVEEVLDMIIVELSADRKMEVHEEYQDGDDGFSLFSY

SEQ ID NO: 59 - protein, 264 aa, Arabidopsis thaliana
  misc_feature (1)..(264): Public GI no. 45385108
  misc_feature: Utility: Useful for delaying flowering time
  misc_feature: Utility: Useful for making larger plants
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with  enhanced chemical composition
  misc_feature: Utility: Useful for making plants with altered leaf shape eg curled leaves
  misc_feature: Utility: Useful for making plants with increased biomass
  misc_feature: Utility: Useful for making plants with increased biomass and foliage
  misc_feature: Utility: Useful for making shorter plants and plants with modified flowers
  misc_feature: Utility: Useful for making smaller plants
  misc_feature: Utility: Useful for making taller plants and plants with longer inflorescences
MSRKKKVRRRSTGPDSVAEIIKKWKEQNQKLQEENGSRKAPAKGSKKGCMAGKGGPENSNCKYRGVRQRTWGKWVAEIREPNRGNRLWLGSFPTAVEAAHAYDEAARAMYGATARVNFSERSPDANSGCTSAPPVLMSNGPTAVSYPSDEKDESESPPSLMSDAPTATLHRSDAKGEPESAGTLVHEVKTEVSNDSRSIREERKTVEVFQPEGKALHKEEKVSYDYFNVEEVLDMIIVELSADRKMEVHEEYQDGDDGFSLFSY

SEQ ID NO: 60 - protein, 274 aa, Arabidopsis thaliana
  misc_feature (1)..(274): Public GI no. 58700406
  misc_feature: Utility: Useful for delaying flowering time
  misc_feature: Utility: Useful for making larger plants
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with  enhanced chemical composition
  misc_feature: Utility: Useful for making plants with altered leaf shape eg curled leaves
  misc_feature: Utility: Useful for making plants with increased biomass
  misc_feature: Utility: Useful for making plants with increased biomass and foliage
  misc_feature: Utility: Useful for making shorter plants and plants with modified flowers
  misc_feature: Utility: Useful for making smaller plants
  misc_feature: Utility: Useful for making taller plants and plants with longer inflorescences
MERGEGRRGDCSVQVRKKRTRRKSDGPDSIAETIKWWKEQNQKLQEENSSRKAPAKGSKKGCMAGKGGPENSNCAYRGVRQRTWGKWVAEIREPNRGRRLWLGSFPTALEAAHAYDEAARAMYGPTARVNFADNSTDANSGCTSAPSLMMSNGPATIPSDEKDELESPPFIVANGPAVLYQPDKKDVLERVVPEVQDVKTEGSNGLKRVCQERKNMEVCESEGIVLHKEVNISYDYFNVHEVVEMIIVELSADQKTEVHEEYQEGDDGFSLFSY

SEQ ID NO: 61 - protein, 281 aa, Arabidopsis thaliana
  misc_feature (1)..(281): Public GI no. 25989383
  misc_feature: Utility: Useful for delaying flowering time
  misc_feature: Utility: Useful for making larger plants
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with  enhanced chemical composition
  misc_feature: Utility: Useful for making plants with altered leaf shape eg curled leaves
  misc_feature: Utility: Useful for making plants with increased biomass
  misc_feature: Utility: Useful for making plants with increased biomass and foliage
  misc_feature: Utility: Useful for making shorter plants and plants with modified flowers
  misc_feature: Utility: Useful for making smaller plants
  misc_feature: Utility: Useful for making taller plants and plants with longer inflorescences
MLFRFVSCNVQLCGIIELPHWVRKKRTRRKSDGPDSIAETIKWWKEQNQKLQEENSSRKAPAKGSKKGCMAGKGGPENSNCAYRGVRQRTWGKWVAEIREPNRGRRLWLGSFPTALEAAHAYDEAARAMYGPTARVNFADNSTDANSGCTSAPSLMMSNGPATIPSDEKDELESPPFIVANGPAVLYQPDKKDVLERVVPEVQDVKTEGSNGLKRVCQERKNMEVCESEGIVLHKEVNISYDYFNVHEVVEMIIVELSADQKTEVHEEYQEGDDGFSLFSY

SEQ ID NO: 62 - protein, 250 aa, Arabidopsis thaliana
  misc_feature (1)..(250): Public GI no. 42822041
  misc_feature: Utility: Useful for delaying flowering time
  misc_feature: Utility: Useful for making larger plants
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with  enhanced chemical composition
  misc_feature: Utility: Useful for making plants with altered leaf shape eg curled leaves
  misc_feature: Utility: Useful for making plants with increased biomass
  misc_feature: Utility: Useful for making plants with increased biomass and foliage
  misc_feature: Utility: Useful for making shorter plants and plants with modified flowers
  misc_feature: Utility: Useful for making smaller plants
  misc_feature: Utility: Useful for making taller plants and plants with longer inflorescences
MERVEVLGGGSSAGQVRKKRMRRKSTGPDSIAETIKRWKEHNQKIHEDRKAPAKGSKKGCMAGKGGPENGNCAYRGVRQRTWGKWVAEIREPNRGRRLWLGSFPTALEAAHAYDEAARAMYGPTARVNFSESSADANSGCTSALSLLASNIPPASQRSDDKDEVESVETEVHEVKMEVNDDMRSVHVERKTLEVFQSEESVLRKEGDVSYDYFHVEDVLEMIIVELNAAKKIEVHEEYQDGDDGFSLFSY

SEQ ID NO: 63 - protein, 264 aa, Arabidopsis thaliana
  misc_feature (1)..(264): Public GI no. 52145406
  misc_feature: Utility: Useful for delaying flowering time
  misc_feature: Utility: Useful for making larger plants
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with  enhanced chemical composition
  misc_feature: Utility: Useful for making plants with altered leaf shape eg curled leaves
  misc_feature: Utility: Useful for making plants with increased biomass
  misc_feature: Utility: Useful for making plants with increased biomass and foliage
  misc_feature: Utility: Useful for making shorter plants and plants with modified flowers
  misc_feature: Utility: Useful for making smaller plants
  misc_feature: Utility: Useful for making taller plants and plants with longer inflorescences
MTRKKKVRRRSTGPDSVAETIKKWKEQNQKLQQENGSRKAPAKGSKKGCMAGKGGPENSNCAYRGVRQRTWGKWVAEIREPNRGNRLWLGSFPTAVEAARAYDDAARAMYGATARVNFPEHSPDANSGCTMAPSLLLSNGATAVSHPSDGKDESESPPSLVSNAPTAALHRSDAKDEFESSGTVAHKVKAEVSNDLRSTHEEHKALEVTQPKGKALHKEANVSYDYFNVEEVLDMIIVELSADVKMEAHEEYQEGDDGFSLFSY

SEQ ID NO: 64 - protein, 282 aa, Glycine max
  misc_feature (1)..(282): Ceres CLONE ID no. 557009
  misc_feature: Utility: Useful for delaying flowering time
  misc_feature: Utility: Useful for making larger plants
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with  enhanced chemical composition
  misc_feature: Utility: Useful for making plants with altered leaf shape eg curled leaves
  misc_feature: Utility: Useful for making plants with increased biomass
  misc_feature: Utility: Useful for making plants with increased biomass and foliage
  misc_feature: Utility: Useful for making shorter plants and plants with modified flowers
  misc_feature: Utility: Useful for making smaller plants
  misc_feature: Utility: Useful for making taller plants and plants with longer inflorescences
MDTCKKSPLKPWKKGPTRGKGGPQNASCEYRGVRQRTWGKWVAEIREPKKRTRLWLGSFATAEEAAMAYDEAARRLYGPDAYLNLPHLQPRSTSTITSGKFKWFPSKNFISMFPSCGLLNVNAQPSVHLIHQRLQELKRNSVVSQSSSSSSNDPKAEIQNVDSKNHGEDENPPKDVQTSSEEVLGDLQEKPQIDLHEFLQQMGILKEERQSERTDSSGSSTVREAVLTDDCDHLGVFSDKSVNWEALIEMHGLAGIQESEVTQLEAYEPNDDLTFSTSIWNF

SEQ ID NO: 65 - protein, 316 aa, Glycine max
  misc_feature (1)..(316): Public GI no. 27960757
  misc_feature: Utility: Useful for delaying flowering time
  misc_feature: Utility: Useful for making larger plants
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with  enhanced chemical composition
  misc_feature: Utility: Useful for making plants with altered leaf shape eg curled leaves
  misc_feature: Utility: Useful for making plants with increased biomass
  misc_feature: Utility: Useful for making plants with increased biomass and foliage
  misc_feature: Utility: Useful for making shorter plants and plants with modified flowers
  misc_feature: Utility: Useful for making smaller plants
  misc_feature: Utility: Useful for making taller plants and plants with longer inflorescences
MEGLQRSSSTFRRKKRPRRSRDGPNSVSETIKQWKEVKQQLEHDPQGAKRARKPPAKGSKKGCMQGKGGPENTQCGFRGVRQRTWGKWVAEIRESNRVSRLWLGTFPTAEVAAQAYDEAAKAMYGPLARTNFPVQDAQAAPTVVVQVATEGVVRGSSASCESTTTSNHSDVASSSHNKQLQIQAPEISSQSDLLESTQSVEYIQQQSVPDAVSSIAMSTSEEDVYEPLEPISNLPDGEAHCAISRCFGPRTWPETWTRRRRGCPAASSTPSSGVPAPALAPQRAEAVPSPRGGNGRRCRGSDRAMVDVMRAVFILE

SEQ ID NO: 66 - DNA, 800 bp, Arabidopsis thaliana
  misc_feature (1)..(800): Ceres CLONE ID no. 907
  misc_feature (1)..(800): Also known as  Ceres CDNA ID no. 23366311
atcatcattccttcttacatcaaatcaattcctaaaatcagagaaaaacatagggacaaaggaaacaacttcaaagatatggagatcaaagttgacgaaggtcatcaaaaaggtactaaagaagacattacaaggccactacttgaagaagacaaagacttcccggatatagaaagaacgacatggatacaaaaggcaataggtcaaacatttcaaaccactgctcatttagctaatctcttaccaacaggaaccgttctcgcgtttcagcttctatcgccaattttctcaaatggcggtcaatgcgatttagtgagcaagataatgacatcgacactggtagcaatatgtggattctcttgcttcatacttagcttcacagattcttacaaagacaaaaacggtactatttgctatggtcttgcaacaatccatgggttttggatcattgatggatccacaactcttcctcaagagttatctaagagatataagctaagatttatagattttgttcatgctttcatgtcgttattcgtgtttggtgcggtggttttattcgatcgaaatgcggtaaattgtttctttccatcaccgtcagcagaagcattggaagttcttacagctttgccggtaggcgtaggggtgttttctagtatgttgtttgcaacatttcctacaacacgcaatgggattggttttccactttctagtaaatgatatcaatatgctgttttttttttaatatcaatatgttattattatttgtaaggttgatttttatatataacttgtggttc

SEQ ID NO: 67 - protein, 213 aa, Arabidopsis thaliana
  misc_feature (43)..(208): Pfam Name: DUF679; Pfam Description: Protein of unknown function (DUF679)
  misc_feature: Utility: Useful for delaying flowering time
  misc_feature: Utility: Useful for increasing chlorophyll and photosynthetic capacity
  misc_feature: Utility: Useful for making lethal plants for genetic confinement systems
  misc_feature: Utility: Useful for making ornamental plants with modified leaves
  misc_feature: Utility: Useful for making plants sterile and for genetic confinement
  misc_feature: Utility: Useful for making plants with increased biomass and foliage
  misc_feature: Utility: Useful for making smaller plants
MEIKVDEGHQKGTKEDITRPLLEEDKDFPDIERTTWIQKAIGQTFQTTAHLANLLPTGTVLAFQLLSPIFSNGGQCDLVSKIMTSTLVAICGFSCFILSFTDSYKDKNGTICYGLATIHGFWIIDGSTTLPQELSKRYKLRFIDFVHAFMSLFVFGAVVLFDRNAVNCFFPSPSAEALEVLTALPVGVGVFSSMLFATFPTTRNGIGFPLSSK

SEQ ID NO: 68 - protein, 214 aa, Arabidopsis thaliana
  misc_feature (1)..(214): Public GI no. 9757729
  misc_feature: Utility: Useful for delaying flowering time
  misc_feature: Utility: Useful for increasing chlorophyll and photosynthetic capacity
  misc_feature: Utility: Useful for making lethal plants for genetic confinement systems
  misc_feature: Utility: Useful for making ornamental plants with modified leaves
  misc_feature: Utility: Useful for making plants sterile and for genetic confinement
  misc_feature: Utility: Useful for making plants with increased biomass and foliage
  misc_feature: Utility: Useful for making smaller plants
MEINVDEEAGIIKEETVPLLDDQNRNRDLPDIERNTMMQKAIGKTFQTTANLANLLPTGTVLAFQILSPICTNVGRCDLTSRFMTALLVSICGFSCFILSFTDSYKDLNGSVCYGFATIHGFWIIDGSATLPQELSKSYKLRFIDFVHAIMSFLVFGAVVLFDQNVVNCFYPEPSAEVVELLTTLPVAVGVFCSMVFAKFPTTRHGIGFPLSAK

SEQ ID NO: 69 - protein, 224 aa, Arabidopsis thaliana
  misc_feature (1)..(224): Public GI no. 50940339
  misc_feature: Utility: Useful for delaying flowering time
  misc_feature: Utility: Useful for increasing chlorophyll and photosynthetic capacity
  misc_feature: Utility: Useful for making lethal plants for genetic confinement systems
  misc_feature: Utility: Useful for making ornamental plants with modified leaves
  misc_feature: Utility: Useful for making plants sterile and for genetic confinement
  misc_feature: Utility: Useful for making plants with increased biomass and foliage
  misc_feature: Utility: Useful for making smaller plants
MASPAVVRQRPTVGKQAGEGESAAAAGDGGGGRPPAARRPSLLSQALASTASLANLLPTGTVMAFQLLAPTFTNNGACDATTSLLTAALLALLALSCVLASFTDSVRGPDGRVYYGLATPRGLWLLDYPPAGAGAPPQPDTSRYRMRAIDGVHALLSVGVFGVVAARDKNVVGCFWPSPAKGTEEVLGIVPLGVGVMCSLLFVVFPTTRHGIGYPVTNNTTSSS

SEQ ID NO: 70 - protein, 200 aa, Arabidopsis thaliana
  misc_feature (1)..(200): Public GI no. 52354409
  misc_feature: Utility: Useful for delaying flowering time
  misc_feature: Utility: Useful for increasing chlorophyll and photosynthetic capacity
  misc_feature: Utility: Useful for making lethal plants for genetic confinement systems
  misc_feature: Utility: Useful for making ornamental plants with modified leaves
  misc_feature: Utility: Useful for making plants sterile and for genetic confinement
  misc_feature: Utility: Useful for making plants with increased biomass and foliage
  misc_feature: Utility: Useful for making smaller plants
MEETKQSLIASLPSAPRKPKSKVERVVRKTFKGTAHLSNLLPTGSVMSFQIMCPVLTHQGQCPTITSRWLTCFLVSLCAISCFLFSFTDSIRDPNGKVRYGLATWSGLLVMDGSITLTEEEKEKYKLKILDFIHAIMSMLVFFAVSMFDQNVTRCLFPVPSEETKEILTSLPFVIGVICGAFFLAFPTRRHGIGSPLTKE

SEQ ID NO: 71 - DNA, 1296 bp, Arabidopsis thaliana
  misc_feature (1)..(1296): Ceres CLONE ID no. 1241
  misc_feature (1)..(1296): Also known as  Ceres CDNA ID no. 23366283
tgaatttcgaaaaatcagtccgttgtgaaagcccaagaataaggattctataatttcaggtctcatttaattatataaccgatctacactttgatctccgacaattcactttcccaataagaaccaactgagagagagagagcgccggagaagaagaattttagagagcgatggacgagggagttatagcagtttccgccatggatgctttcgagaagcttgagaaagttggtgaagggacatacgggaaagtttacagagccagagagaaagctaccgggaaaatcgtcgctctaaagaagacgcgtctccatgaggacgaagaaggcgttccttccaccactctccgcgagatctccattttgcgaatgctcgctcgtgatcctcacgtcgtcaggttaatggatgttaagcaaggactaagcaaagaaggcaaaactgtactgtacctggtttttgaatacatggacactgatgtcaagaaattcatcagaagtttccgtagcactggcaagaacattccaacccaaactatcaagagcttgatgtatcaactatgcaaaggtatggcattctgccatggtcacgggatattgcacagagatctcaagcctcacaatctcttgatggatcccaagacaatgaggctcaaaatagcagatcttggtttagccagagccttcactctgccaatgaagaagtatacccatgagatattaactctttggtatagagctccagaggttcttcttggtgccacccattactctacagctgtggatatgtggtctgttggctgcatatttgctgaacttgtgaccaaccaagcaatctttcagggagactctgagctccaacagctcctccatattttcaagttgtttgggacacccaatgaagaaatgtggccaggagtgagcacactcaagaactggcatgaatacccacagtggaaaccatcgactctatcctctgctgttccaaacctcgacgaggctggagttgatcttctatctaaaatgctgcagtacgagccagcgaaacgaatctcagcaaagatggctatggagcatccttactttgatgatctgccagaaaagtcctctctctaaggatttaaaatcttcagttagtatctttccaagttttatggtttttctagttttgcttctttcaagcatatctctagtgtgctgcttccccctctatgaatcatcctttctttagcataatatatcacttctgattgttgtttctttctattcaaatatttggattaacggctttaatgttctt

SEQ ID NO: 72 - protein, 313 aa, Arabidopsis thaliana
  misc_feature (14)..(304): Pfam Name: Pkinase; Pfam Description: Protein kinase domain
  misc_feature (14)..(210): Pfam Name: Pkinase_Tyr; Pfam Description: Protein tyrosine kinase
  misc_feature: Utility: Useful for delaying flowering time
  misc_feature: Utility: Useful for increasing chlorophyll and photosynthetic capacity
  misc_feature: Utility: Useful for making ornamental plants with modified leaves
  misc_feature: Utility: Useful for making plants with increased biomass and foliage
  misc_feature: Utility: Useful for making smaller plants
MDEGVIAVSAMDAFEKLEKVGEGTYGKVYRAREKATGKIVALKKTRLHEDEEGVPSTTLREISILRMLARDPHVVRLMDVKQGLSKEGKTVLYLVFEYMDTDVKKFIRSFRSTGKNIPTQTIKSLMYQLCKGMAFCHGHGILHRDLKPHNLLMDPKTMRLKIADLGLARAFTLPMKKYTHEILTLWYRAPEVLLGATHYSTAVDMWSVGCIFAELVTNQAIFQGDSELQQLLHIFKLFGTPNEEMWPGVSTLKNWHEYPQWKPSTLSSAVPNLDEAGVDLLSKMLQYEPAKRISAKMAMEHPYFDDLPEKSSL

SEQ ID NO: 73 - protein, 315 aa, Arabidopsis thaliana
  misc_feature (1)..(315): Public GI no. 15218072
  misc_feature: Utility: Useful for delaying flowering time
  misc_feature: Utility: Useful for increasing chlorophyll and photosynthetic capacity
  misc_feature: Utility: Useful for making ornamental plants with modified leaves
  misc_feature: Utility: Useful for making plants with increased biomass and foliage
  misc_feature: Utility: Useful for making smaller plants
MDNNGVKPAVSAMEAFEKLEKVGEGTYGKVYRAREKATGMIVALKKTRLHEDEEGVPPTTLREISILRMLARDPHIVRLMDVKQGINKEGKTVLYLVFEYVDTDLKKFIRSFRQAGQNIPQNTVKCLMYQLCKGMAFCHGHGVLHRDLKPHNLLMDRKTMTLKIADLGLARAFTLPMKKYTHEILTLWYRAPEVLLGATHYSTGVDMWSVGCIFAELVTKQAIFAGDSELQQLLRIFRLLGTPNEEVWPGVSKLKDWHEYPQWKPLSLSTAVPNLDEAGLDLLSKMLEYEPAKRISAKKAMEHPYFDDLPDKSSL

SEQ ID NO: 74 - protein, 303 aa, Arabidopsis thaliana
  misc_feature (1)..(303): Ceres CLONE ID no. 108339
  misc_feature: Utility: Useful for delaying flowering time
  misc_feature: Utility: Useful for increasing chlorophyll and photosynthetic capacity
  misc_feature: Utility: Useful for making ornamental plants with modified leaves
  misc_feature: Utility: Useful for making plants with increased biomass and foliage
  misc_feature: Utility: Useful for making smaller plants
MEAFEKLEKVGEGTYGKVYRAREKATGMIVALKKTRLHEDEEGVPPTTLREISILRMLARDPHIVRLMDVKQGINKEGKTVLYLVFEYVDTDLKKFIRSFRQAGQNIPQNTVKCLMYQLCKGMAFCHGHGVLHRDLKPHNLLMDRKTMTLKIADLGLARAFTLPMKKYTHEILTLWYRAPEVLLGATHYSTGVDMWSVGCIFAELVTKQAIFAGDSELQQLLRIFRLLGTPNEEVWPGVSKLKDWHEYPQWKPLSLSTAVPNLDEAGLDLLSKMLEYEPAKRISAKKAMEHPYFDDLPDKSSL

SEQ ID NO: 75 - protein, 303 aa, Arabidopsis thaliana; identical to SEQ ID NO: 74
  misc_feature (1)..(303): Public GI no. 21536682
  misc_feature: Utility: Useful for delaying flowering time
  misc_feature: Utility: Useful for increasing chlorophyll and photosynthetic capacity
  misc_feature: Utility: Useful for making ornamental plants with modified leaves
  misc_feature: Utility: Useful for making plants with increased biomass and foliage
  misc_feature: Utility: Useful for making smaller plants

SEQ ID NO: 76 - protein, 317 aa, Glycine max
  misc_feature (1)..(317): Ceres CLONE ID no. 473347
  misc_feature: Utility: Useful for delaying flowering time
  misc_feature: Utility: Useful for increasing chlorophyll and photosynthetic capacity
  misc_feature: Utility: Useful for making ornamental plants with modified leaves
  misc_feature: Utility: Useful for making plants with increased biomass and foliage
  misc_feature: Utility: Useful for making smaller plants
MEMEKTGAGVVVLSAKEAFEKLEKVGEGTYGKVYRAREKATGKIVALKKTRLHEDQDGVPPTTLREVSILRMLSRDPHVVRLMDVKQGQNKEGKTVLYLVFEYMDTDLKKFIRSFDQPGQNIPPETIKSLMYQLCKGIAFCHGHGILHRDLKPHNLLMDRKTMMLKIADLGLARAFTVPIKKYTHEILTLWYRAPEVLLGATHYSMAVDIWSVGCIFAELVTRRALFPGDSELQQLLHIFRLLGTPNEEVWPGVSKLKDWHEYPQWNSQSLSTAVPGLEELGLDLLSQMLEYEPSKRISAKKAMEHAYFDDLDKRNL

SEQ ID NO: 77 - protein, 303 aa, Zea mays
  misc_feature (1)..(303): Ceres CLONE ID no. 224792
  misc_feature: Utility: Useful for delaying flowering time
  misc_feature: Utility: Useful for increasing chlorophyll and photosynthetic capacity
  misc_feature: Utility: Useful for making ornamental plants with modified leaves
  misc_feature: Utility: Useful for making plants with increased biomass and foliage
  misc_feature: Utility: Useful for making smaller plants
MDLYEKLEKVGEGTYGKVYRAREKATGRIVALKKTRLPEDDEGVPPTAMREVSLLRMLSQDPHVVRLLDLKQGVNKEGQTILYLVFEYMDTDLKKFIRGHRSNNEKIPAATVKILMYQLCKGVAFVHGRGVLHRDLKPHNLLMDRKTMALKIADLGLSRAITVPVKKYTHEILTLWYRAPEILLGATHYSTPVDIWSVGCIFAELVTNQPLFPGDSELQQLLHIFKLLGTPNEQVWPGVGKLPNWHEYPQWKPTKLSALVPGLDADGYDLLEKLLEYEPAKRIPAKKALEHPYFKDVRKGDAH

SEQ ID NO: 78 - protein, 271 aa, Triticum aestivum
  misc_feature (1)..(271): Ceres CLONE ID no. 704321
  misc_feature: Utility: Useful for delaying flowering time
  misc_feature: Utility: Useful for increasing chlorophyll and photosynthetic capacity
  misc_feature: Utility: Useful for making ornamental plants with modified leaves
  misc_feature: Utility: Useful for making plants with increased biomass and foliage
  misc_feature: Utility: Useful for making smaller plants
MDDEGIPPTALREISLLRLLSSSLYVVRLLAVEQATKGGGAGGGGKPVLYLVFEFLDTDLKKFVDAYRRGPAPKPLPTQVVKSFLYQLCKGIAHCHGHGVLHRDLKPQNLLVDKEKMILKIADLGLSRAFTVPMKSYTHEIVTLWYRAPEVLLGATHYSTSVDIWSIGCIFAEMVRKQALFPGDSELQQLLHIFKLLGTPTEEDWPGVTALRDWHEFPQWKAQRLTRAVPTLEPEGIDLLSKMLQFDPANRISAKAALEHPYFNSLDKSQF

SEQ ID NO: 79 - DNA, 845 bp, Arabidopsis thaliana
  misc_feature (1)..(845): Ceres CLONE ID no. 1610
  misc_feature (1)..(845): Also known as  Ceres CDNA ID no. 23388204
ctcttaaagcttctcgttttctctgccgtctctctcattcgcgcgacgcaaacgatcttcagccatggccaccgccgcagatgttgacgctgagattcagcaggcgctcactaacgaagtcaagctcttcaaccgctggacctatgacgacgttacggtcacagacatcagtcttgttgactacattggagttcaggcagctaaacatgctacctttgttccccacaccgctggaagatactctgtgaagagattcaggaaggctcagtgccccattgttgagaggctcaccaactctctcatgatgcacgggaggaacaacggtaagaaattgatggctgtcaggatcatcaagcacgccatggagattatccacctcttgtctgacttgaacccaattcaggtcatcattgacgccattgtcaacagtggtccacgtgaagatgctaccagaattggatctgctggtgttgttaggagacaagctgttgatatctctcctctaagacgtgttaaccaggctatcttcttgattaccactggtgctcgtgaagctgctttcagaaacatcaagactatagctgagtgccttgctgatgaattgatcaacgcagccaagggctcttccaacagctatgccatcaagaagaaggatgagattgaaagagttgccaaggctaatcgttaaggattttccttttgccctgtgcgttacaatctcgtatcaatgagtttaatgttttatcttcatttagattgaaatatgtatctcagatgtttgctcttttgttttatgaagtttatttcgtctgaactactttgaatagataaatttttgatgcttc

SEQ ID NO: 80 - protein, 207 aa, Arabidopsis thaliana
  misc_feature (54)..(207): Pfam Name: Ribosomal_S7; Pfam Description: Ribosomal protein S7p/S5e
  misc_feature: Utility: Useful for delaying flowering time
  misc_feature: Utility: Useful for increasing chlorophyll and photosynthetic capacity
  misc_feature: Utility: Useful for increasing increasing anthocyanin content
  misc_feature: Utility: Useful for making lethal plants for genetic confinement systems
  misc_feature: Utility: Useful for making plants with increased biomass and foliage
  misc_feature: Utility: Useful for making smaller plants
MATAADVDAEIQQALTNEVKLFNRWTYDDVTVTDISLVDYIGVQAAKHATFVPHTAGRYSVKRFRKAQCPIVERLTNSLMMHGRNNGKKLMAVRIIKHAMEIIHLLSDLNPIQVIIDAIVNSGPREDATRIGSAGVVRRQAVDISPLRRVNQAIFLITTGAREAAFRNIKTIAECLADELINAAKGSSNSYAIKKKDEIERVAKANR

SEQ ID NO: 81 - protein, 207 aa, Arabidopsis thaliana [sequence omitted]

SEQ ID NO: 82 - protein, 207 aa, Arabidopsis thaliana [sequence omitted]

SEQ ID NO: 83 - protein, 207 aa, Arabidopsis thaliana
  misc_feature (1)..(207): Ceres CLONE ID no. 8397
  misc_feature: Utility: Useful for delaying flowering time
  misc_feature: Utility: Useful for increasing chlorophyll and photosynthetic capacity
  misc_feature: Utility: Useful for increasing increasing anthocyanin content
  misc_feature: Utility: Useful for making lethal plants for genetic confinement systems
  misc_feature: Utility: Useful for making plants with increased biomass and foliage
  misc_feature: Utility: Useful for making smaller plants
MAASAEIDAEIQQQLTNEVKLFNRWSFDDVSVTDISLVDYIGVQPSKHATFVPHTAGRYSVKRFRKAQCPIVERLTNSLMMHGRNNGKKLMAVRIVKHAMEIIHLLSDLNPIQVIIDAIVNSGPREDATRIGSAGVVRRQAVDISPLRRVNQAIFLLTTGAGEAAFRNIKTIAECLADELINAAKGSSNSYAIKKKDEIERVAKANR

SEQ ID NO: 84 - protein, 207 aa, Arabidopsis thaliana; identical to SEQ ID NO: 83
  misc_feature (1)..(207): Public GI no. 21617886
  misc_feature: Utility: Useful for delaying flowering time
  misc_feature: Utility: Useful for increasing chlorophyll and photosynthetic capacity
  misc_feature: Utility: Useful for increasing increasing anthocyanin content
  misc_feature: Utility: Useful for making lethal plants for genetic confinement systems
  misc_feature: Utility: Useful for making plants with increased biomass and foliage
  misc_feature: Utility: Useful for making smaller plants

SEQ ID NO: 85 - protein, 197 aa, Arabidopsis thaliana
  misc_feature (1)..(197): Public GI no. 3043428
  misc_feature: Utility: Useful for delaying flowering time
  misc_feature: Utility: Useful for increasing chlorophyll and photosynthetic capacity
  misc_feature: Utility: Useful for increasing increasing anthocyanin content
  misc_feature: Utility: Useful for making lethal plants for genetic confinement systems
  misc_feature: Utility: Useful for making plants with increased biomass and foliage
  misc_feature: Utility: Useful for making smaller plants
RSDPTQIEVKLFNRWSFDDVQLSDVSLIDYIGVVPSKHATYVPHTAGRYSVKRFRKAQCPIVERLTNSLMMHGRNNGKKLMAVRIIKHAMEIIHLLTDQNPIQVIVDAVVNSGPREDATRIGSAGVVRRQAVDISPLRRVNQAIYLLTTGAREAAFRNIKSIAECLADELINAAKGSSNSYAIKKKDEIERVAKANR

SEQ ID NO: 86 - protein, 204 aa, Glycine max
  misc_feature (1)..(204): Ceres CLONE ID no. 533766
  misc_feature: Utility: Useful for delaying flowering time
  misc_feature: Utility: Useful for increasing chlorophyll and photosynthetic capacity
  misc_feature: Utility: Useful for increasing increasing anthocyanin content
  misc_feature: Utility: Useful for making lethal plants for genetic confinement systems
  misc_feature: Utility: Useful for making plants with increased biomass and foliage
  misc_feature: Utility: Useful for making smaller plants
MADEAVVVPDPTQIDVKLFNRWSFDDIEITDISLADYIGVATSKHATYVPHTAGRYSVKRFRKAQCPIVERLTNSLMMHGRNNGKKLLAVRIIKHAMEIIHLLTDQNPIQVIVDAVINSGPREDATRIGSAGVVRRQAVDISPLRRVNQAIYLLTTGAREAAFRNIKTIAECLADELINAAKGSSNSYAIKKKDEIERVAKANR

SEQ ID NO: 87 - protein, 204 aa, Triticum aestivum
  misc_feature (1)..(204): Ceres CLONE ID no. 792839
  misc_feature: Utility: Useful for delaying flowering time
  misc_feature: Utility: Useful for increasing chlorophyll and photosynthetic capacity
  misc_feature: Utility: Useful for increasing increasing anthocyanin content
  misc_feature: Utility: Useful for making lethal plants for genetic confinement systems
  misc_feature: Utility: Useful for making plants with increased biomass and foliage
  misc_feature: Utility: Useful for making smaller plants
MAEIEATVPDPSQIDVKLFNRWSFDDVEVTDMSLADYIGVSPSKHATYVPHTAGRYSVKRFRKAQCPIVERLTNSLMMHGRNNGKKLMAVRIIKHAMEIIHLLTDLNPIQVIVDAVINSGPREDATRIGSAGVVRRQAVDISPLRRVNQAIYLLTTGAREAAFRNIKTIAECLADELINAAKGSSNSYAIKKKDEIERVAKANR

SEQ ID NO: 88 - protein, 204 aa, Glycine max; identical to SEQ ID NO: 87
  misc_feature (1)..(204): Ceres CLONE ID no. 471212
  misc_feature: Utility: Useful for delaying flowering time
  misc_feature: Utility: Useful for increasing chlorophyll and photosynthetic capacity
  misc_feature: Utility: Useful for increasing increasing anthocyanin content
  misc_feature: Utility: Useful for making lethal plants for genetic confinement systems
  misc_feature: Utility: Useful for making plants with increased biomass and foliage
  misc_feature: Utility: Useful for making smaller plants

SEQ ID NO: 89 - protein, 200 aa, Triticum aestivum
  misc_feature (1)..(200): Ceres CLONE ID no. 1033671
  misc_feature: Utility: Useful for delaying flowering time
  misc_feature: Utility: Useful for increasing chlorophyll and photosynthetic capacity
  misc_feature: Utility: Useful for increasing increasing anthocyanin content
  misc_feature: Utility: Useful for making lethal plants for genetic confinement systems
  misc_feature: Utility: Useful for making plants with increased biomass and foliage
  misc_feature: Utility: Useful for making smaller plants
MAVAEPVPGGDVKLFNRWTFEDVQVTDISLNDYLAVTSMKHYTFLPHSAGRYSAKRFRKAQCPIIERLTNSLMMHGRNNGKKIMAVRIIKHTMEIIHLLTDANPIQIIVDAIINSGPREDATRIGSAGVVRRQAVDISPLRRVNQAIYLLTTGARESAFRNVKTIAECLADELINAAKGSSNSYAIKKKDEIERVAKANR

SEQ ID NO: 90 - protein, 199 aa, Zea mays
  misc_feature (1)..(199): Ceres CLONE ID no. 1281072
  misc_feature: Utility: Useful for delaying flowering time
  misc_feature: Utility: Useful for increasing chlorophyll and photosynthetic capacity
  misc_feature: Utility: Useful for increasing increasing anthocyanin content
  misc_feature: Utility: Useful for making lethal plants for genetic confinement systems
  misc_feature: Utility: Useful for making plants with increased biomass and foliage
  misc_feature: Utility: Useful for making smaller plants
MAEVEQPQDAVKLFNRWTFDDVQVNDISLNDYLAVTAAKHATFLPHSAGRYSKKRFRKAQCAIVERLTNSLMMHGRNNGKKVMAVRIMKHTLEIIHLLTDTNPIQVVVDAIINSGPREDATRIGSAGVVRRQAVDISPLRRVNQAIYLLTTGARESAFRNIKTIAECLADELINAAKGSSNSYAIKKKDEIERVAKANR

SEQ ID NO: 91 - protein, 199 aa, Zea mays
  misc_feature (1)..(199): Ceres CLONE ID no. 287037
  misc_feature: Utility: Useful for delaying flowering time
  misc_feature: Utility: Useful for increasing chlorophyll and photosynthetic capacity
  misc_feature: Utility: Useful for increasing increasing anthocyanin content
  misc_feature: Utility: Useful for making lethal plants for genetic confinement systems
  misc_feature: Utility: Useful for making plants with increased biomass and foliage
  misc_feature: Utility: Useful for making smaller plants
MAEVEQQQDTPKLFNRWTFDDVQVNDISLNDYLAVNATKHAMYLPHTAGRYSKKRFRKAQCPIVERLTNSLMMHGRNNGKKVMAVRIIKHTLEIIHLLTDANPIQVVVDAIINSGPREDATRIGSAGVVRRQAVDISPLRRVNQAIYLLTTGARESAFRNIKTIAECLADELINAAKGSSNSYAIKKKDEIERVAKANR

SEQ ID NO: 92 - protein, 200 aa, Triticum aestivum
  misc_feature (1)..(200): Ceres CLONE ID no. 741488
  misc_feature: Utility: Useful for delaying flowering time
  misc_feature: Utility: Useful for increasing chlorophyll and photosynthetic capacity
  misc_feature: Utility: Useful for increasing increasing anthocyanin content
  misc_feature: Utility: Useful for making lethal plants for genetic confinement systems
  misc_feature: Utility: Useful for making plants with increased biomass and foliage
  misc_feature: Utility: Useful for making smaller plants
MAVVEPVPGGDVKLFNRWTFEDVQVTDISLNDYLAVTSMKHYTFLPHSAGRYSAKRFRKAQCPIIERLTNSLMMHGRNNGKKIMAVRIIKHTMEIIHLLTDANPIQIIVDAIINSGPREDATRIGSAGVVRRQAVDISPLRRVNQAIYLLTTGARESAFRNVKTIAECLADELINAAKGSSNSYAIKKKDEIERVAKANR

SEQ ID NO: 93 - protein, 200 aa, Triticum aestivum
  misc_feature (1)..(200): Public GI no. 34893994
  misc_feature: Utility: Useful for delaying flowering time
  misc_feature: Utility: Useful for increasing chlorophyll and photosynthetic capacity
  misc_feature: Utility: Useful for increasing increasing anthocyanin content
  misc_feature: Utility: Useful for making lethal plants for genetic confinement systems
  misc_feature: Utility: Useful for making plants with increased biomass and foliage
  misc_feature: Utility: Useful for making smaller plants
MAVVEQPQQQVVKLFNCWSFEDVQVNDISLADYLAVSSTKHATYLPHTAGRYSAKRFRKAQCPLVERLTNSLMMHGRNNGKKIMAVRIVKHAMEIIHLLTDANPIQVIVDAIINSGPREDATRIGSAGAVRRQAVDISPLRRVNQAIYLLTTGARESAFRNIKTIAECLADELINAAKGSSNSYAIKKKDEIERVAKANR

SEQ ID NO: 94 - protein, 212 aa, Triticum aestivum
  misc_feature (1)..(212): Public GI no. 40748265
  misc_feature: Utility: Useful for delaying flowering time
  misc_feature: Utility: Useful for increasing chlorophyll and photosynthetic capacity
  misc_feature: Utility: Useful for increasing increasing anthocyanin content
  misc_feature: Utility: Useful for making lethal plants for genetic confinement systems
  misc_feature: Utility: Useful for making plants with increased biomass and foliage
  misc_feature: Utility: Useful for making smaller plants
MDAGVVAATIPADGSLESKVHTDVMLFNRWSYDGVDINDMSVEDYITATANKHPVYMPHTAGRYQAKRFRKAQCPIVERLTNSLMMHGRNNGKKLMAVRIIKHAMEIIHLLTDQNPIQVIVDAVINSGPREDATRIGSAGVVRRQAVDISPLRRVNQAIYLLTTGARESAFRNIKTIAECLADELINAAKGSSNSYAIKKKDEIERVAKANR

SEQ ID NO: 95 - DNA, 632 bp, Arabidopsis thaliana
  misc_feature (1)..(632): Ceres CLONE ID no. 2403
  misc_feature (1)..(632): Also known as  Ceres CDNA ID no. 23358989
attccccatcgcacagacccgcctaagaatccgagagagaagaagagataatgcagatcttcgtcaaaaccctcaccggcaaaactataaccctagaggttgagagcagcgacaccatcgacaatgttaaagccaaaatccaggacaaatagggcataccacctgatcaacagaggctgatttttgctggtaagcaattggaagatggccggaccttagctgactacaacatccagaaagagtctactcttcatcttgtcctcaggctcagaggtggaaccatgatcaaggtgaagacactcactggaaaagaaatcgagattgatatcgaaccaaccgacactattgatcggatcaaagaacgtgttgaagagaaagaaggcatccctcctgttcaacaaaggctcatctatgccggaaaacagcttgctgatgacaaaacggccaaagattatgcgatagagggaggctctgttcttcatttggttcttgctcttaggggtggtcttctctgatctgaataaataagcttttcaacaaacatctttcccctcactattgtcctccttttgtggaattcatgacacacaaaaattgctatgggaaattggaatattatgatgttttttctc

SEQ ID NO: 96 - protein, 77 aa, Arabidopsis thaliana
  misc_feature (1)..(73): Pfam Name: ubiquitin; Pfam Description: Ubiquitin family
  misc_feature: Utility: Useful for delaying flowering time
  misc_feature: Utility: Useful for increasing chlorophyll and photosynthetic capacity
  misc_feature: Utility: Useful for making plants with increased tolerance to cold stress
  misc_feature: Utility: Useful for making smaller plants
MIKVKTLTGKEIEIDIEPTDTIDRIKERVEEKEGIPPVQQRLIYAGKQLADDKTAKDYAIEGGSVLHLVLALRGGLL

SEQ ID NO: 97 - protein, 154 aa, Zea mays
  misc_feature (1)..(154): Ceres CLONE ID no. 1482731
  misc_feature: Utility: Useful for delaying flowering time
  misc_feature: Utility: Useful for increasing chlorophyll and photosynthetic capacity
  misc_feature: Utility: Useful for making plants with increased tolerance to cold stress
  misc_feature: Utility: Useful for making smaller plants
MQIFVKTLTGKTITLEVESSDTIDNVKSKIQDKEGIPPDQQRLIFAGKQLEDGRTLADYNIQKESTLHLVLRLRGGTMIKVKTLTGKEIEIDIEPTDTIDRIKERVEEKEGIPPVQQRLIYAGKQLADDKTAKDYNIEGGSVLHLVLALRGGSD

SEQ ID NO: 98 - protein, 76 aa, Triticum aestivum
  misc_feature (1)..(76): Ceres CLONE ID no. 1005253
  misc_feature: Utility: Useful for delaying flowering time
  misc_feature: Utility: Useful for increasing chlorophyll and photosynthetic capacity
  misc_feature: Utility: Useful for making plants with increased tolerance to cold stress
  misc_feature: Utility: Useful for making smaller plants
MIKVKTLTGKEIEIDIEPTDTIDRIKERVEEKEGIPPVQQRLIYAGKQLADDKTAKDYNIEGGSVLHLVLALRGGQ

SEQ ID NO: 99 - protein, 145 aa, Brassica napus
  misc_feature (1)..(145): Ceres CLONE ID no. 1123804
  misc_feature: Utility: Useful for delaying flowering time
  misc_feature: Utility: Useful for increasing chlorophyll and photosynthetic capacity
  misc_feature: Utility: Useful for making plants with increased tolerance to cold stress
  misc_feature: Utility: Useful for making smaller plants
MQIFVKTLTGKTITLEVEGSDTIDNVKSKIQDKEGIPPDQQRLIFAGKQLEDGRTLADYNIQKESTLHLVLRLRGGTMIKVKTLTGKEIEIDIEPTDTIDRIKERVEEKEGIPPVQQRLIYAGKQLADDKTAKDYNIEGGSVLHL

SEQ ID NO: 100 - protein, 153 aa, Zea mays
  misc_feature (1)..(153): Ceres CLONE ID no. 273687
  misc_feature: Utility: Useful for delaying flowering time
  misc_feature: Utility: Useful for increasing chlorophyll and photosynthetic capacity
  misc_feature: Utility: Useful for making plants with increased tolerance to cold stress
  misc_feature: Utility: Useful for making smaller plants
MQIFVKTLTGKTITLEVESSDTVDNVKAKIQDKEGIPPDQQRLIFAGKQLEDGRTLADYNIQKESTLHLVLRLRGGTMIKVKTLTGKEIEIDIEPTDSIDRIKERVEEKEGIPPVQQRLIYAGKQLADDKTAKDYNIEGGSVLHLVLALRGGY

SEQ ID NO: 101 - protein, 77 aa, Glycine max
  misc_feature (1)..(77): Ceres CLONE ID no. 522921
  misc_feature: Utility: Useful for delaying flowering time
  misc_feature: Utility: Useful for increasing chlorophyll and photosynthetic capacity
  misc_feature: Utility: Useful for making plants with increased tolerance to cold stress
  misc_feature: Utility: Useful for making smaller plants
MIKVKTLTGKEIEIDIEPTDTIDRIKERVEEKEGIPPVQQRLIYAGKQLADDKTAKEYNIEGGSVLHLVLALRGGTY

SEQ ID NO: 102 - protein, 154 aa, Zea mays
  misc_feature (1)..(154): Ceres CLONE ID no. 1439969
  misc_feature: Utility: Useful for delaying flowering time
  misc_feature: Utility: Useful for increasing chlorophyll and photosynthetic capacity
  misc_feature: Utility: Useful for making plants with increased tolerance to cold stress
  misc_feature: Utility: Useful for making smaller plants
  misc_feature (151)..(151): Xaa is any aa, unknown, or other
MQIFVKTLTGKTITLEVESSNTIDNVKSKIQDKEGIPPDQQRLIFAGKQLEDGRTLADYNIQKESTLHLVLRLRGGTMIKVKTLTGKEIEIDIEPTDTIDRIKERVEEKEGIPPVQQRLIYAGKQLADDKTAKDYNIEGGSVLHLVLALRXGSD

SEQ ID NO: 103 - protein, 147 aa, Brassica napus
  misc_feature (1)..(147): Ceres CLONE ID no. 1036726
  misc_feature: Utility: Useful for delaying flowering time
  misc_feature: Utility: Useful for increasing chlorophyll and photosynthetic capacity
  misc_feature: Utility: Useful for making plants with increased tolerance to cold stress
  misc_feature: Utility: Useful for making smaller plants
  misc_feature (132)..(132): Xaa is any aa, unknown, or other
MQIFVKTLTGKTITLEVESSDTIDNVKAKIQDKEGIPPDQQRLIFAGKQLEDGRTLADYNIQKESTLHLVLRLRGGTMIKVKTLTGKEIEIDIEPTDTIDRIKERVEEKEGIPPVQQRLIYAGKQLADDKTXKDYNIEGGSVSASGS

SEQ ID NO: 104 - protein, 153 aa, Glycine max
  misc_feature (1)..(153): Ceres CLONE ID no. 513071
  misc_feature: Utility: Useful for delaying flowering time
  misc_feature: Utility: Useful for increasing chlorophyll and photosynthetic capacity
  misc_feature: Utility: Useful for making plants with increased tolerance to cold stress
  misc_feature: Utility: Useful for making smaller plants
  misc_feature (146)..(146): Xaa is any aa, unknown, or other
MQIFVKTLTGKTITLEVESSDTVDNVKAKIQDKEGIPPDQQRLIFAGKQLEDGRTLADYNIQKESTLHLVLRLRGGTMIKVKTLTGKEIEIDIEPTDSIDRIKERVEEKEGIPPVQQRLIYAGKQLADDKTAKDYNIEGGSVLHLXLALRGGY

SEQ ID NO: 105 - protein, 76 aa, Zea mays
  misc_feature (1)..(76): Ceres CLONE ID no. 1464066
  misc_feature: Utility: Useful for delaying flowering time
  misc_feature: Utility: Useful for increasing chlorophyll and photosynthetic capacity
  misc_feature: Utility: Useful for making plants with increased tolerance to cold stress
  misc_feature: Utility: Useful for making smaller plants
MIKVKTLTGKEIEINIEPNDTIDRIKERVEEREGIPPVQQRLIYAGKQLADDKTVKDYNIEGGSVLHLVLALRGGC

SEQ ID NO: 106 - protein, 76 aa, Zea mays
  misc_feature (1)..(76): Ceres CLONE ID no. 1453619
  misc_feature: Utility: Useful for delaying flowering time
  misc_feature: Utility: Useful for increasing chlorophyll and photosynthetic capacity
  misc_feature: Utility: Useful for making plants with increased tolerance to cold stress
  misc_feature: Utility: Useful for making smaller plants
  misc_feature (55)..(55): Xaa is any aa, unknown, or other
  misc_feature (56)..(56): Xaa is any aa, unknown, or other
MIKVKTLTGKEIEIDIEPTDTIDRIKERVEEKEGIPPVQQRLIYAGEALADDKTXXDYNIEGGSVLHLVLALRGGQ

SEQ ID NO: 107 - DNA, 638 bp, Arabidopsis thaliana
  misc_feature (1)..(638): Ceres CLONE ID no. 2835
  misc_feature (1)..(638): Also known as  Ceres CDNA ID no. 23387874
aacaccgaatctctcaacacaaacaaaatcacacatctctcttcatctttttgtttcctgcaagaatctgaatctgctttactattgtgtcatcatgatgaacatcgacgatacgacgtctccaatggcccacccgatcggtccatctcagcctccttccgaccaaaccaaacaagatccgccaagtttgccccaagaagcagcttcttctgtttcggccgacaagaaagatctagctttgcttgaagagaaaccgaagcagagtcaagaagaagatagagtggacactgggagagagaggttaaagaagcatcggagagagatcgctggtagggtttggataccggagatatggggacaagaagagcttcttaaggattggatcgattgttcaacgtttgacacgtgtctagtccctgccggaatctcgtctgcacgtactgctctcgtagaggaagctaggcgagctgcttcagcttctggtgggttacataatcgttgcttgatcttacgttgaatttaatataataagataacatacttataaatgtggttcttgttcctcaataatataaggcactattgttacattgttgataatattctaactcattttactcgtaactttatgaaacatt

SEQ ID NO: 108 - protein, 140 aa, Arabidopsis thaliana
  misc_feature: Utility: Useful for delaying flowering time
  misc_feature: Utility: Useful for making larger plants
  misc_feature: Utility: Useful for making plants with increased size and biomass
MMNIDDTTSPMAHPIGPSQPPSDQTKQDPPSLPQEAASSVSADKKDLALLEEKPKQSQEEDRVDTGRERLKKHRREIAGRVWIPEIWGQEELLKDWIDCSTFDTCLVPAGISSARTALVEEARRAASASGGLHNRCLILR

SEQ ID NO: 109 - protein, 138 aa, n/a
  misc_feature (1)..(138): Ceres CLONE ID no. 1048082
  misc_feature: Utility: Useful for delaying flowering time
  misc_feature: Utility: Useful for making larger plants
  misc_feature: Utility: Useful for making plants with increased size and biomass
MMNIDDTTSPMAHPIVPSQPPSDQTQQDPSSPNEASSVTDKKDDQAFPEEKPKQNQEEERVDTGREKLKKHRRDVAGRVWIPDIWGQEELLKDWIDCSTFDTCLVPAGISSARAALVDEARRAASASGGLHSRCLISR

SEQ ID NO: 110 - protein, 126 aa, Brassica napus
  misc_feature (1)..(126): Ceres CLONE ID no. 1085655
  misc_feature: Utility: Useful for delaying flowering time
  misc_feature: Utility: Useful for making larger plants
  misc_feature: Utility: Useful for making plants with increased size and biomass
MKNIDDTTSPMTRVIDPSQPPSDQSQQEPSLTNEASSVSDKKDQALPEEKPKQNQENERAVTGREKLKHHRREMAGRVWIPEIWGQEELLKDWIDCSTFDTCLVPNGISSARAALVEEARRAASAS

SEQ ID NO: 111 - protein, 135 aa, Brassica napus
  misc_feature (1)..(135): Ceres CLONE ID no. 1087946
  misc_feature: Utility: Useful for delaying flowering time
  misc_feature: Utility: Useful for making larger plants
  misc_feature: Utility: Useful for making plants with increased size and biomass
  misc_feature (7)..(7): Xaa is any aa, unknown, or other
MLHFSWXMKNIDDTTSPMTHLINPSQPPSDKTQQDPSLSTEACIVSDKKDQALPEEKPKQNQEAIIGRDKLKQHRREMAGRVWIPERWGQEDLLKDWIDCSKFDTCLVPNGISSARSALVEEARRAASASGGLHN

SEQ ID NO: 112 - protein, 179 aa, Glycine max
  misc_feature (1)..(179): Ceres CLONE ID no. 642424
  misc_feature: Utility: Useful for delaying flowering time
  misc_feature: Utility: Useful for making larger plants
  misc_feature: Utility: Useful for making plants with increased size and biomass
MAHQSSSSESDDRQIPSHHQPLDLNSPHPSKDIIFNNNMELQQEESNLNKHEYDEDIRDKDKDVVTTQNPSAASETTLLCCNEENMALQEEETSDVAAAKEEEEEEDSGRERLNRHRVEVAGRVWIPDIWGQEELLKDWIDCTAFDATLVPSRISTAREALVQECTRANSAGLRIENRC

SEQ ID NO: 113 - protein, 173 aa, Zea mays
  misc_feature (1)..(173): Ceres CLONE ID no. 1570772
  misc_feature: Utility: Useful for delaying flowering time
  misc_feature: Utility: Useful for making larger plants
  misc_feature: Utility: Useful for making plants with increased size and biomass
MASFSDVEALPETGEVDHQAKECEAETAVTEENLATLQEQHDDKAPVPYHQEVFAPEHAGEAPAPEEHGDEKDLQVAEPKAAADDQESTRDRLKRHRREMAGRVWVPETWGQEKLLKDWVDCAVFDRPMVPMGLLTARRALIAECCTRRPDRAASSSSSTSSSNPLRVRNGCS

SEQ ID NO: 114 - DNA, 1197 bp, Arabidopsis thaliana
  misc_feature (1)..(1197): Ceres CLONE ID no. 3000
  misc_feature (1)..(1197): Also known as  Ceres CDNA ID no. 23373149
atatcagtcacaccaccaacaaagtagttccctttttcttcaatcactagctcctccccaaggaactaagaacaaagttgcttcttcttcttctccttcctcttgtgctcctgcctattctctaatggagatccatcataacgaaatcgttgcaggaggaatcaacccttgctcctcttcctcttcttcagcctctgtcaaggccaagatcatggctcatcctcactaccaccgcctcttggccgcttatgtcaattgtcagaaggttggagcaccaccggaggttgtggcgaggctggaggaggcatgctcgtctgccgcagccgcagccgcatctatggggccaacagggtgtcttggtgaagatccagggcttgatcaattcatggaagcttactgtgaaatgctcgttaagtatgagcaagagctctccaaacctttcaaggaagctatggtcttccttcaacgtgtcgagtgtcaattcaaatccctctctctatcctcaccttcctctttctccggttatggagagacagcaattgataggaacaataatgggtcatccgaggaagaagtcgatatgaacaatgaatttgtagatccacaagctgaggatagagagcttaaaggacagctcttgcgcaagtacagtggttacttagggagcctcaagcaagagttcatgaagaagaggaagaaaggaaagctccctaaagaagctcgtcaacaactgcttgattggtggagccgccactacaaatggccttacccttcggagcaacaaaagctcgcccttgcggaatcaacggggctggaccagaaacagataaacaattggttcataaaccagaggaaacggcattggaagccgtcggaggacatgcagtttgtagtaatggacgcaacacatcctcaccattacttcatggataatgtcttgggcaatcctttcccaatggatcacatctcctccaccatgctttgatcgatcctttaaaacgttattttattatatttataatcattaaacatcttataatatgtataatctatggttctcggtatacttaggaacatatgaaacatgttccaattgatgaacaagcgtttgatgttgtggtgtgtatccttttgtgttggtctattgttatgtgaaattcctattcctattataatgatagtaaagcttttttgacc

SEQ ID NO: 115 - protein, 286 aa, Arabidopsis thaliana
  misc_feature (214)..(248): Pfam Name: Homeobox; Pfam Description: Homeobox domain
  misc_feature (23)..(67): Pfam Name: KNOX1; Pfam Description: KNOX1 domain
  misc_feature (74)..(125): Pfam Name: KNOX2; Pfam Description: KNOX2 domain
  misc_feature (166)..(187): Pfam Name: ELK; Pfam Description: ELK domain
  misc_feature: Utility: Useful for delaying flowering time
  misc_feature: Utility: Useful for increasing chlorophyll and photosynthetic capacity
  misc_feature: Utility: Useful for making larger plants
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with altered leaf shape eg curled leaves
  misc_feature: Utility: Useful for making plants with increased biomass
  misc_feature: Utility: Useful for making plants with increased biomass and foliage
  misc_feature: Utility: Useful for making plants with modified flowers
  misc_feature: Utility: Useful for making smaller plants
  misc_feature: Utility: Useful for modifying plant architecture, ie amount of  branching
  misc_feature: Utility: Useful for plants with fused leaves eg ornamentals
MEIHHNEIVAGGINPCSSSSSSASVKAKIMAHPHYHRLLAAYVNCQKVGAPPEVVARLEEACSSAAAAAASMGPTGCLGEDPGLDQFMEAYCEMLVKYEQELSKPFKEAMVFLQRVECQFKSLSLSSPSSFSGYGETAIDRNNNGSSEEEVDMNNEFVDPQAEDRELKGQLLRKYSGYLGSLKQEFMKKRKKGKLPKEARQQLLDWWSRHYKWPYPSEQQKLALAESTGLDQKQINNWFINQRKRHWKPSEDMQFVVMDATHPHHYFMDNVLGNPFPMDHISSTML

SEQ ID NO: 116 - protein, 350 aa, Glycine max
  misc_feature (1)..(350): Ceres CLONE ID no. 541719
  misc_feature: Utility: Useful for delaying flowering time
  misc_feature: Utility: Useful for increasing chlorophyll and photosynthetic capacity
  misc_feature: Utility: Useful for making larger plants
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with altered leaf shape eg curled leaves
  misc_feature: Utility: Useful for making plants with increased biomass
  misc_feature: Utility: Useful for making plants with increased biomass and foliage
  misc_feature: Utility: Useful for making plants with modified flowers
  misc_feature: Utility: Useful for making smaller plants
  misc_feature: Utility: Useful for modifying plant architecture, ie amount of  branching
  misc_feature: Utility: Useful for plants with fused leaves eg ornamentals
MTMMPLVTSHHATNPSNPSNNTNNNENTNCLFIPNCSNSSGTPSIMLHNNNNTDDDNNKTSTNTGLGYYFMESDHHHRNNNNNGSSSSSSSSAVKAKIMAHPHYHRLLAAYVNCQKVGAPPEVVARLEEACASAATMAGDAAAAAGSSCIGEDPALDQFMEAYCEMLTKYEQELSKPLKEAMLFLQRIECQFKNLTISSTDFACNEGAERNGSSEEDVDLHNMIDPQAEDRELKGQLLRKYSGYLGSLKQEFMKKRKKGKLPKEARQQLLEWWSRHYKWPYPSESQKLALAESTGLDQKQINNWFINQRKRHWKPSEDMQFVVMDPSHPHYYMDNVLGNPFPMDLSHPML

SEQ ID NO: 117 - protein, 352 aa, Glycine max
  misc_feature (1)..(352): Ceres CLONE ID no. 524559
  misc_feature: Utility: Useful for delaying flowering time
  misc_feature: Utility: Useful for increasing chlorophyll and photosynthetic capacity
  misc_feature: Utility: Useful for making larger plants
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with altered leaf shape eg curled leaves
  misc_feature: Utility: Useful for making plants with increased biomass
  misc_feature: Utility: Useful for making plants with increased biomass and foliage
  misc_feature: Utility: Useful for making plants with modified flowers
  misc_feature: Utility: Useful for making smaller plants
  misc_feature: Utility: Useful for modifying plant architecture, ie amount of  branching
  misc_feature: Utility: Useful for plants with fused leaves eg ornamentals
MTMMPLVTSHHAGHHPINPSNNNNVNTNCLFIPNCSNSTGTPSIMLHNNHNNNKTDDDDNNNNTGLGYYFMESDHHHHHHGNNNNNGSSSSSSSSAVKAKIMAHPHYHRLLAAYVNCQKVGAPPEVVARLEEACASAATMAGGDAAAGSSCIGEDPALDQFMEAYCEMLTKYEQELSKPLKEAMLFLQRIECQFKNLTISSSDFASNEGGDRNGSSEEDVDLHNMIDPQAEDRDLKGQLLRKYSGYLGSLKQEFMKKRKKGKLPKEARQQLLEWWNRHYKWPYPSESQKLALAESTGLDQKQINNWFINQRKRHWKPSEDMQFVVMDPSHPHYYMDNVLGNPFPMDLSHPML

SEQ ID NO: 118 - protein, 302 aa, Glycine max
  misc_feature (1)..(302): Ceres CLONE ID no. 537272
  misc_feature: Utility: Useful for delaying flowering time
  misc_feature: Utility: Useful for increasing chlorophyll and photosynthetic capacity
  misc_feature: Utility: Useful for making larger plants
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with altered leaf shape eg curled leaves
  misc_feature: Utility: Useful for making plants with increased biomass
  misc_feature: Utility: Useful for making plants with increased biomass and foliage
  misc_feature: Utility: Useful for making plants with modified flowers
  misc_feature: Utility: Useful for making smaller plants
  misc_feature: Utility: Useful for modifying plant architecture, ie amount of  branching
  misc_feature: Utility: Useful for plants with fused leaves eg ornamentals
MDMTNMETNRKFLSLPLSNNNNSGDNRRVPVTSNSIAQEHHYSHHHNPTDTCSVRDKIMAHPLFPRLLSSYLNCLKVGAPPEVVASLEESYAKYESFNASSGRIGGGSIGEDPALDQFMEAYCEMLIKYEQELTKPFKEAMLFFSRIECQLKALAVSSDFGQSETSSKNEVDVHENNLDSQAEDRELKVQLLRKYSGYLGSLKKEFLKKKKNGKLPKEARQQLLDWWNRHYKWPYPSESQKQALAESTGLDMKQINNWFINQRKRHWKPSEDMQFAVMDATNYYMENVMCKPFPMDSMPMLL

SEQ ID NO: 119 - protein, 194 aa, Triticum aestivum
  misc_feature (1)..(194): Ceres CLONE ID no. 1250120
  misc_feature: Utility: Useful for delaying flowering time
  misc_feature: Utility: Useful for increasing chlorophyll and photosynthetic capacity
  misc_feature: Utility: Useful for making larger plants
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with altered leaf shape eg curled leaves
  misc_feature: Utility: Useful for making plants with increased biomass
  misc_feature: Utility: Useful for making plants with increased biomass and foliage
  misc_feature: Utility: Useful for making plants with modified flowers
  misc_feature: Utility: Useful for making smaller plants
  misc_feature: Utility: Useful for modifying plant architecture, ie amount of  branching
  misc_feature: Utility: Useful for plants with fused leaves eg ornamentals
MEAYHEMLVKYREELTRPLQEAMEFLRRVETQLNSLSISGRSLRNILSSGSSEEDQEGSGGETELPEIDAHGVDQELKHHLLKKYSGYLSSLKQELSKKKKKGKLPKDARQQLLSWWEMHYKWPYPSESQKVALAESTGLDLKQINNWFINQRKRHWKPSDEMQFVMMDAYHPPNAAFYMDGHFVNDSGLYRFG

SEQ ID NO: 120 - protein, 275 aa, Zea mays
  misc_feature (1)..(275): Ceres CLONE ID no. 276087
  misc_feature: Utility: Useful for delaying flowering time
  misc_feature: Utility: Useful for increasing chlorophyll and photosynthetic capacity
  misc_feature: Utility: Useful for making larger plants
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with altered leaf shape eg curled leaves
  misc_feature: Utility: Useful for making plants with increased biomass
  misc_feature: Utility: Useful for making plants with increased biomass and foliage
  misc_feature: Utility: Useful for making plants with modified flowers
  misc_feature: Utility: Useful for making smaller plants
  misc_feature: Utility: Useful for modifying plant architecture, ie amount of  branching
  misc_feature: Utility: Useful for plants with fused leaves eg ornamentals
MSAAEADAIKAKIVAHPQYSALLAAYLDCQKVGAPPDLLERLTAMAAKLDARPPGRHGPRDPELDQFMEAYCNMLVKYREELTRPIDEAMEFLKRVEAQLDSIAGGGSSSSARLSLADGKSSEGAGSSEDDDMDPSGRENEPPEIDPRAEDKELKYQLLKKYSGYLSSLRQEFSKKKKKGKLPKEARQKLLHWWELHYKWPYPSETEKIALAEATGLDQKQINNWFINQRKRHWKPSEDMPFVMMEGFHPQTAAALYLDGGAFMADGMTTYRLGS

SEQ ID NO: 121 - protein, 275 aa, Zea mays; identical to SEQ ID NO: 120
  misc_feature (1)..(275): Ceres CLONE ID no. 1060946
  misc_feature: Utility: Useful for delaying flowering time
  misc_feature: Utility: Useful for increasing chlorophyll and photosynthetic capacity
  misc_feature: Utility: Useful for making larger plants
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with altered leaf shape eg curled leaves
  misc_feature: Utility: Useful for making plants with increased biomass
  misc_feature: Utility: Useful for making plants with increased biomass and foliage
  misc_feature: Utility: Useful for making plants with modified flowers
  misc_feature: Utility: Useful for making smaller plants
  misc_feature: Utility: Useful for modifying plant architecture, ie amount of  branching
  misc_feature: Utility: Useful for plants with fused leaves eg ornamentals

SEQ ID NO: 122 - protein, 270 aa, Zea mays
  misc_feature (1)..(270): Ceres CLONE ID no. 303119
  misc_feature: Utility: Useful for delaying flowering time
  misc_feature: Utility: Useful for increasing chlorophyll and photosynthetic capacity
  misc_feature: Utility: Useful for making larger plants
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with altered leaf shape eg curled leaves
  misc_feature: Utility: Useful for making plants with increased biomass
  misc_feature: Utility: Useful for making plants with increased biomass and foliage
  misc_feature: Utility: Useful for making plants with modified flowers
  misc_feature: Utility: Useful for making smaller plants
  misc_feature: Utility: Useful for modifying plant architecture, ie amount of  branching
  misc_feature: Utility: Useful for plants with fused leaves eg ornamentals
MSAAEAEAIKAKIVAHPQYSALLAAYLDCQKVGAPPDVLERLTAMAAKLDASAAGRHEPRDPELDQFMEAYCNMLVKYREELTRPIDEAMEFLKRVEAQLDCISGGGGSSSARLSLADGKSEGVGSSEDDMDPNGRENDPPEIDPRAEDKELKYQLLKKYSGYLSSLRQEFSKKKKKGKLPKEARQKLLHWWELHYKWPYPSETEKIALAESTGLDQKQINNWFINQRKRHWKPSEDMPFVMMEGFHPQNAAALYMDGPFMRDGMYRLGS

SEQ ID NO: 123 - DNA, 1394 bp, Arabidopsis thaliana
  misc_feature (1)..(1394): Ceres CLONE ID no. 3036
  misc_feature (1)..(1394): Also known as  Ceres CDNA ID no. 23388317
aacgcagtgtctctgattttcacttggttaaagacctctagcttcacggtcaaacatcataaaccttttgccgccgtcactaataggaattaactgatctcgtcaatggcggaggtggaggagattgcgcacgaggagcagaatatcgagaagagggagaagaagaaaggtaaacacgagaagccgaagccatgggatgatgacccaaacatcgaccgttggacaatcgagaagtttgatccggcatggaaccccactggtatgactgaaaccagcacgttctcaacactctttcctcaatacagagagaagtatcttcaggagtgttggcctagagttgaatctgctcttaaggagtacggtgtcgcctgcaagctcaacttggttgaaggttctatgactgtttcgacgacgaggaagacaagagatccatacatcattgtcaaagctagggatttgattaagcttctttccagaagtgtccctgctcctcaggcaattaagattctcgaagatgaggtgcaatgtgatatcatcaagatcggtaacttggttagaaataaggaaagatttgttaaaagaaggcagcggcttgtgggtcctaattcttctaccttgaaggcgctggaaatattaaccaactgttacattctagttcagggaagtactgtagccgctatgggtccatttaaaggtctcaaacagctcagaaggattgtggaagactgcgtacagaatataatgcatcctgtataccatataaagactctcatgatgaaaaaagaactggagaaggatccagctcttgcaaatgaaagctgggataggtttcttcccacattcaggaagaaaaatgttaagcaaaagaaacccaaaagcaaggagaagaagccatacacacctttcccacctcctcaaccacctagcaagattgatatgcagttggagtctggagaatacttcatgagagataaaaagaagtcagagaaaaaatggcaggagaagcaagagaaacagtcagagaagagcacagagaacaaaagaaagagagatgcctcattcctcccacctgaggagcctatgaacaacaatagcaacgcaaacaaatcagaggatggaaagaatgatataaccgagttaacaaattccttgaagagcaagacgaaggagttgaaaaagcagaaaaagacacacgagagagtgaatgcggaggagtatattgctggtccatcttcttctgctgataaatcttccaagaagtccaaaaagattagagattaattctaaatcctgttttttttttttaaaaaaaaagagagaaaagattgaaacttatctatgctcaaaactgtaaaaacaagttaaatctttatttcagccgtcaagttacttcg

SEQ ID NO: 124 - protein, 391 aa, Arabidopsis thaliana
  misc_feature: Utility: Useful for delaying flowering time
  misc_feature: Utility: Useful for increasing chlorophyll and photosynthetic capacity
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with increased biomass and foliage
  misc_feature: Utility: Useful for making smaller plants
  misc_feature: Utility: Useful for modifying plant structure, ie increased branching
MAEVEEIAHEEQNIEKREKKKGKHEKPKPWDDDPNIDRWTIEKFDPAWNPTGMTETSTFSTLFPQYREKYLQECWPRVESALKEYGVACKLNLVEGSMTVSTTRKTRDPYIIVKARDLIKLLSRSVPAPQAIKILEDEVQCDIIKIGNLVRNKERFVKRRQRLVGPNSSTLKALEILTNCYILVQGSTVAAMGPFKGLKQLRRIVEDCVQNIMHPVYHIKTLMMKKELEKDPALANESWDRFLPTFRKKNVKQKKPKSKEKKPYTPFPPPQPPSKIDMQLESGEYFMRDKKKSEKKWQEKQEKQSEKSTENKRKRDASFLPPEEPMNNNSNANKSEDGKNDITELTNSLKSKTKELKKQKKTHERVNAEEYIAGPSSSADKSSKKSKKIRD

SEQ ID NO: 125 - protein, 395 aa, Arabidopsis thaliana
  misc_feature (1)..(395): Public GI no. 31432429
  misc_feature: Utility: Useful for delaying flowering time
  misc_feature: Utility: Useful for increasing chlorophyll and photosynthetic capacity
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with increased biomass and foliage
  misc_feature: Utility: Useful for making smaller plants
  misc_feature: Utility: Useful for modifying plant structure, ie increased branching
MASEEGEEANAASSAEEVGRKKPPRHKGKHDKPKPWDDDPNIDHWKIEKFDPSWNEGGMLEVSSFSTLFPQYREKYLQEAWPIVKGALKEFGVACELNLVEGSMTVSTTRKTRDPYIIVKAKELIKLLSRSVPAPQAIKILNDEMSCDIIKIGSIIRNKERFVKRRERLLGPNLSTLKAIEILTGCYILVQGNTVAAMGSWKGLKQVRRVVEDCIKNIKHPVYHIKELLIKRELAKNPALANESWDRFLPKFKKKNVKQKKPITKEKKPYTPFPPPQQPSKIDLELESGEYFMSDKKKSAKKWQEKLEKQSEKAEENKRKREAAFVPPKEDTATPYESAKSTSNNDEIADMAKSLKKKAKEFRKSEAQENVRLESYVASNEGSRPKKKHKSSKSK

SEQ ID NO: 126 - protein, 336 aa, Zea mays
  misc_feature (1)..(336): Ceres CLONE ID no. 278965
  misc_feature: Utility: Useful for delaying flowering time
  misc_feature: Utility: Useful for increasing chlorophyll and photosynthetic capacity
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with increased biomass and foliage
  misc_feature: Utility: Useful for making smaller plants
  misc_feature: Utility: Useful for modifying plant structure, ie increased branching
MLEVSSFSTLFPQYREKYLQEAWPVVKGALKEYGISCELNLVEGSMTVSTTRKTRDPFAIIKARELIKLLSRSVPAPQAIKILDDEMNCDIIKIGGLVRNKERFVKRRERLLGPNLSTLKAIEILTGCYILVQGNTVAAMGNYRGRGLKQVRRIVEDCMKNVKHPVYHIKELLIKRELAKNPALANENWDRFLPKFKKKNVKQKKPQTKEKKPYTPFPPPQQPSKIDLELENGEYFMSDKKKSAKKWQEKLDKQSGRAEENKRKREAAFVPPKENTAGPSKSDKNASDNSEIADIAKSLKRKAKEFRKNEAQESVIAESYIASNDELRQKKEKEIN

SEQ ID NO: 127 - protein, 421 aa, Zea mays
  misc_feature (1)..(421): Public GI no. 56785318
  misc_feature: Utility: Useful for delaying flowering time
  misc_feature: Utility: Useful for increasing chlorophyll and photosynthetic capacity
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with increased biomass and foliage
  misc_feature: Utility: Useful for making smaller plants
  misc_feature: Utility: Useful for modifying plant structure, ie increased branching
MASEGDASALVAAAEGRKPRHKGKHDKPKPWDDDPNIDHWKIEEFDPSWNEGGMLEVTSFSTLFPQYRGKSPHPTPPSALSWFLPRSAIDWFCLVVKKYLQEAWPIVKGALKEFGVACELNLVEGSMTVSTTRKTKDPYIIIKANELIKLLSRSVPAPQAIKILNDEMSCAIIKIGSIIRNKERFVKRRGRLLGPNLSTLKAIEILTGCYILVQGNTAAAMGYWKGLKQVVRVVEDCIKNVKHPVYHIKELLIKRELVKNPALAHESWDKFLPKFKKKNVKQKKPLTKEKKQYTPFPPPQQPSKIDLELESGECFMSDKKKSAKEWQEKLEKQSQKAEENKRKREAAFVHPNEDIATPYESAKSIINNGEIADMAKSLKKKAKELRKNEEQENVRLESYVASNEGSRPKKKHKLSKYSQPE

SEQ ID NO: 128 - DNA, 631 bp, Arabidopsis thaliana
  misc_feature (1)..(631): Ceres CLONE ID no. 3363
  misc_feature (1)..(631): Also known as  Ceres CDNA ID no. 23358733
aaacagtatcaaatcaaaaccatcacagcaaaaataactcactccctagaaaagtttgaaaatggcgaaggcagataagaaaccagcggagaagaaaccggcagagaaaactccggcagccgaaccagcagcagcggcagagaagaaaccaaaagccggaaagaaactccccaaggaaccagccgtcgccggagacaagaagaagaagagatcaaagaagaacgttgagacatacaagatctacatcttcaaggtgttgaagcaagttcatccagacatcggaatctcaagcaaagccatgggaatcatgaacagtttcatcaacgatatctttgagaagcttgctggtgagtcttcgaagcttgcaaggtacaacaagaagccgacgattacttccagggagattcagactgcggttagacttgtgttgcccggtgagttggcgaaacatgctgtgtctgaagggactaaggcggttacgaagtttacaagttcttagatttggaatgtggttttgtaatggtggagaagtagtagtaaaatgtgaaatagggtttatgcttttgggtatctttgaaggttatgtaatttgggaattagggtttttatttatggcacggctatgaaatcc

SEQ ID NO: 129 - protein, 145 aa, Arabidopsis thaliana
  misc_feature (52)..(124): Pfam Name: Histone; Pfam Description: Core histone H2A/H2B/H3/H4
  misc_feature: Utility: Useful for delaying flowering time
  misc_feature: Utility: Useful for increasing chlorophyll and photosynthetic capacity
  misc_feature: Utility: Useful for making plants sterile and for genetic confinement
  misc_feature: Utility: Useful for making plants with altered leaf shape eg curled leaves
  misc_feature: Utility: Useful for making plants with increased biomass and foliage
  misc_feature: Utility: Useful for making smaller plants
MAKADKKPAEKKPAEKTPAAEPAAAAEKKPKAGKKLPKEPAVAGDKKKKRSKKNVETYKIYIFKVLKQVHPDIGISSKAMGIMNSFINDIFEKLAGESSKLARYNKKPTITSREIQTAVRLVLPGELAKHAVSEGTKAVTKFTSS

SEQ ID NO: 130 - protein, 140 aa, Triticum aestivum
  misc_feature (1)..(140): Ceres CLONE ID no. 1053095
  misc_feature: Utility: Useful for delaying flowering time
  misc_feature: Utility: Useful for increasing chlorophyll and photosynthetic capacity
  misc_feature: Utility: Useful for making plants sterile and for genetic confinement
  misc_feature: Utility: Useful for making plants with altered leaf shape eg curled leaves
  misc_feature: Utility: Useful for making plants with increased biomass and foliage
  misc_feature: Utility: Useful for making smaller plants
MAPKAAEKKPAEKKPAEKAPAEKKPKAGKKLPKDPSAVAGDKKKKRSKKSVETYKIYIFKVLKQVHPDIGISSKAMGIMNSFINDIFEKLAGESSKLARYNKKPTITSREIQTAVRLVLPGELAKHAVSEGTKAVTKFTS

SEQ ID NO: 131 - protein, 141 aa, Glycine max
  misc_feature (1)..(141): Ceres CLONE ID no. 1059204
  misc_feature: Utility: Useful for delaying flowering time
  misc_feature: Utility: Useful for increasing chlorophyll and photosynthetic capacity
  misc_feature: Utility: Useful for making plants sterile and for genetic confinement
  misc_feature: Utility: Useful for making plants with altered leaf shape eg curled leaves
  misc_feature: Utility: Useful for making plants with increased biomass and foliage
  misc_feature: Utility: Useful for making smaller plants
MAKADKKPAEKKPAETTTAAAAEKKPKAGKKLPKDPAVAGDKKKKRTKKSVETYKIYIFKVLKQVHPDIGISSKAMGIMNSFINDIFEKLAGESSKLARYNKKPTITSREIQTAVRLVLPGELAKHAVSEGTKAVTKFTSS

SEQ ID NO: 132 - protein, 141 aa, Zea mays
  misc_feature (1)..(141): Ceres CLONE ID no. 1382087
  misc_feature: Utility: Useful for delaying flowering time
  misc_feature: Utility: Useful for increasing chlorophyll and photosynthetic capacity
  misc_feature: Utility: Useful for making plants sterile and for genetic confinement
  misc_feature: Utility: Useful for making plants with altered leaf shape eg curled leaves
  misc_feature: Utility: Useful for making plants with increased biomass and foliage
  misc_feature: Utility: Useful for making smaller plants
MAPKAAEKKPAEKKTAEKAPAEKKPKAGKKLPKDPSAVAGDKKKKRSKKSVETYKIYIFKVLKQVHPDIGISSKAMGIMNSFINDIFEKLAGESSKLARYNKKPTITSREIQTAVRLVLPGELAKHAVSEGTKAVTKFTSS

SEQ ID NO: 133 - protein, 141 aa, Brassica napus
  misc_feature (1)..(141): Ceres CLONE ID no. 952003
  misc_feature: Utility: Useful for delaying flowering time
  misc_feature: Utility: Useful for increasing chlorophyll and photosynthetic capacity
  misc_feature: Utility: Useful for making plants sterile and for genetic confinement
  misc_feature: Utility: Useful for making plants with altered leaf shape eg curled leaves
  misc_feature: Utility: Useful for making plants with increased biomass and foliage
  misc_feature: Utility: Useful for making smaller plants
  misc_feature (107)..(107): Xaa is any aa, unknown, or other
MAPKAAEKKPAEKKTAEKAPAEKKPKAGKKLPKDPSAVAGDKKKKRSKKSVETYKIYIFKVLKQVHPDIGISSKAMGIMNSFINDIFEKLAGESSKLARYNKKPTIXSREIQTAVRLVLPGELAKHAVSEGTKAVTKFTSS

SEQ ID NO: 134 - protein, 141 aa, Triticum aestivum
  misc_feature (1)..(141): Ceres CLONE ID no. 1032859
  misc_feature: Utility: Useful for delaying flowering time
  misc_feature: Utility: Useful for increasing chlorophyll and photosynthetic capacity
  misc_feature: Utility: Useful for making plants sterile and for genetic confinement
  misc_feature: Utility: Useful for making plants with altered leaf shape eg curled leaves
  misc_feature: Utility: Useful for making plants with increased biomass and foliage
  misc_feature: Utility: Useful for making smaller plants
  misc_feature (15)..(15): Xaa is any aa, unknown, or other
  misc_feature (131)..(131): Xaa is any aa, unknown, or other
MAPKAAEKKPAEKKXAEKAPAEKKPKAGKKLPKDPSAVAGDKKKKRSKKSVETYKIYIFKVLKQVHPDIGISSKAMGIMNSFINDIFEKLAGESSKLARYNKKPTITSREIQTAVRLVLPGELAKHAVSEXTKAVTKFTSS

SEQ ID NO: 135 - protein, 144 aa, Brassica napus
  misc_feature (1)..(144): Ceres CLONE ID no. 1123883
  misc_feature: Utility: Useful for delaying flowering time
  misc_feature: Utility: Useful for increasing chlorophyll and photosynthetic capacity
  misc_feature: Utility: Useful for making plants sterile and for genetic confinement
  misc_feature: Utility: Useful for making plants with altered leaf shape eg curled leaves
  misc_feature: Utility: Useful for making plants with increased biomass and foliage
  misc_feature: Utility: Useful for making smaller plants
MAKADKKPAEKKPAAETTTAAAAAEKKPKAGKKLPKDPSAVAGDKKKKRSKKSVETYKIYIFKVLKQVHPDVGISSKAMGIMNSFINDIFEKLAGESSKLARYNKKPTITSREIQTAVRLVLPGELAKHAVSEGTKAVTKFTSS

SEQ ID NO: 136 - protein, 141 aa, Zea mays
  misc_feature (1)..(141): Ceres CLONE ID no. 1379029
  misc_feature: Utility: Useful for delaying flowering time
  misc_feature: Utility: Useful for increasing chlorophyll and photosynthetic capacity
  misc_feature: Utility: Useful for making plants sterile and for genetic confinement
  misc_feature: Utility: Useful for making plants with altered leaf shape eg curled leaves
  misc_feature: Utility: Useful for making plants with increased biomass and foliage
  misc_feature: Utility: Useful for making smaller plants
  misc_feature (7)..(7): Xaa is any aa, unknown, or other
  misc_feature (48)..(48): Xaa is any aa, unknown, or other
  misc_feature (52)..(52): Xaa is any aa, unknown, or other
  misc_feature (60)..(60): Xaa is any aa, unknown, or other
  misc_feature (81)..(81): Xaa is any aa, unknown, or other
  misc_feature (115)..(115): Xaa is any aa, unknown, or other
MAPKAAXKKPAEKKPAEKAPAEKKPKAGKKLPKDPSAVAGDKKKKRSXKSVXTYKIYIFXVLKQVHPDIGISSKAMGIMNXFINDIFEKLAGESSKLARYNKKPTITSREIQTAXRLVLPGELAKHAVSEGTKAVTKFTSS

SEQ ID NO: 137 - protein, 142 aa, Glycine max
  misc_feature (1)..(142): Ceres CLONE ID no. 1101282
  misc_feature: Utility: Useful for delaying flowering time
  misc_feature: Utility: Useful for increasing chlorophyll and photosynthetic capacity
  misc_feature: Utility: Useful for making plants sterile and for genetic confinement
  misc_feature: Utility: Useful for making plants with altered leaf shape eg curled leaves
  misc_feature: Utility: Useful for making plants with increased biomass and foliage
  misc_feature: Utility: Useful for making smaller plants
MAPKAEKKPAEEKSKAEKAPAEKKPKAGKKLPKEAGAGAGGDKKKKTKKKSVETYKIYIFKVLKQVHPDIGISSKAMGIMNSFINDIFEKLAGEASKLARYNKKPTITSREIQTAVRLVLPGELAKHAVSEGTKAVTKFTSS

SEQ ID NO: 138 - protein, 142 aa, Zea mays; identical to SEQ ID NO: 137
  misc_feature (1)..(142): Ceres CLONE ID no. 1463543
  misc_feature: Utility: Useful for delaying flowering time
  misc_feature: Utility: Useful for increasing chlorophyll and photosynthetic capacity
  misc_feature: Utility: Useful for making plants sterile and for genetic confinement
  misc_feature: Utility: Useful for making plants with altered leaf shape eg curled leaves
  misc_feature: Utility: Useful for making plants with increased biomass and foliage
  misc_feature: Utility: Useful for making smaller plants

SEQ ID NO: 139 - protein, 151 aa, Arabidopsis thaliana
  misc_feature (1)..(151): Ceres CLONE ID no. 38506
  misc_feature: Utility: Useful for delaying flowering time
  misc_feature: Utility: Useful for increasing chlorophyll and photosynthetic capacity
  misc_feature: Utility: Useful for making plants sterile and for genetic confinement
  misc_feature: Utility: Useful for making plants with altered leaf shape eg curled leaves
  misc_feature: Utility: Useful for making plants with increased biomass and foliage
  misc_feature: Utility: Useful for making smaller plants
MAPKAGKKPAEKKPAEKAPAEEEKVAEKAPAEKKPKAGKKLPKEAVTGGVEKKKKRVKKSTETYKIYIFKVLKQVHPDIGISSKAMGIMNSFINDIFEKLAQEASKLARYNKKPTITSREIQTAVRLVLPGELAKHAVSEGTKAVTKFTSS

SEQ ID NO: 140 - protein, 150 aa, Arabidopsis thaliana
  misc_feature (1)..(150): Ceres CLONE ID no. 20822
  misc_feature: Utility: Useful for delaying flowering time
  misc_feature: Utility: Useful for increasing chlorophyll and photosynthetic capacity
  misc_feature: Utility: Useful for making plants sterile and for genetic confinement
  misc_feature: Utility: Useful for making plants with altered leaf shape eg curled leaves
  misc_feature: Utility: Useful for making plants with increased biomass and foliage
  misc_feature: Utility: Useful for making smaller plants
MAPKAEKKPAEKKPASEKPVEEKSKAEKAPAEKKPKAGKKLPKEAGAGGDKKKKMKKKSVETYKIYIFKVLKQVHPDIGISSKAMGIMNSFINDIFEKLAQEASKLARYNKKPTITSREIQTAVRLVLPGELAKHAVSEGTKAVTKFTSS

SEQ ID NO: 141 - protein, 149 aa, Zea mays
  misc_feature (1)..(149): Ceres CLONE ID no. 1438404
  misc_feature: Utility: Useful for delaying flowering time
  misc_feature: Utility: Useful for increasing chlorophyll and photosynthetic capacity
  misc_feature: Utility: Useful for making plants sterile and for genetic confinement
  misc_feature: Utility: Useful for making plants with altered leaf shape eg curled leaves
  misc_feature: Utility: Useful for making plants with increased biomass and foliage
  misc_feature: Utility: Useful for making smaller plants
MAPKAEKKPAEKKPAEEKKSTVGDKAPAEKKPKAGKKLPKEGGAGGEGGKKKKRNKKSVETYKIYIFKVLKQVHPDIGISSKAMGIMNSFINDIFEKLAQESSRLARYNKKPTITSREIQTAVRLVLPGELAKHAVSEGTKAVTKFTSS

SEQ ID NO: 142 - protein, 149 aa, Glycine max
  misc_feature (1)..(149): Ceres CLONE ID no. 652242
  misc_feature: Utility: Useful for delaying flowering time
  misc_feature: Utility: Useful for increasing chlorophyll and photosynthetic capacity
  misc_feature: Utility: Useful for making plants sterile and for genetic confinement
  misc_feature: Utility: Useful for making plants with altered leaf shape eg curled leaves
  misc_feature: Utility: Useful for making plants with increased biomass and foliage
  misc_feature: Utility: Useful for making smaller plants
  misc_feature (55)..(55): Xaa is any aa, unknown, or other
MAPKAEKKPAEKKPAEEKKSTVGDKAPAEKKPKAGKKLPKEGGAGGEGGKKKKRXKKSVETYKIYIFKVLKQVHPDIGISSKAMGIMNSFINDIFEKLAQESSRLARYNKKPTITSREIQTAVRLVLPGELAKHAVSEGTKAVTKFTSS

SEQ ID NO: 143 - protein, 149 aa, Triticum aestivum
  misc_feature (1)..(149): Ceres CLONE ID no. 632635
  misc_feature: Utility: Useful for delaying flowering time
  misc_feature: Utility: Useful for increasing chlorophyll and photosynthetic capacity
  misc_feature: Utility: Useful for making plants sterile and for genetic confinement
  misc_feature: Utility: Useful for making plants with altered leaf shape eg curled leaves
  misc_feature: Utility: Useful for making plants with increased biomass and foliage
  misc_feature: Utility: Useful for making smaller plants
MAPKAEKKPAAKKPAEEEPAAEKAPAAKKPKAEKRLPAGKSAAGKDGDKKGKKKAKKSVETYKIYIFKVLKQVHPDIGISSKAMSIMNSFINDIFEKLAGEAAKLARYNKKPTITSREIQTSVRLVLPGELAKHAVSEGTKAVTKFTSS

SEQ ID NO: 144 - protein, 152 aa, Triticum aestivum
  misc_feature (1)..(152): Ceres CLONE ID no. 570063
  misc_feature: Utility: Useful for delaying flowering time
  misc_feature: Utility: Useful for increasing chlorophyll and photosynthetic capacity
  misc_feature: Utility: Useful for making plants sterile and for genetic confinement
  misc_feature: Utility: Useful for making plants with altered leaf shape eg curled leaves
  misc_feature: Utility: Useful for making plants with increased biomass and foliage
  misc_feature: Utility: Useful for making smaller plants
MAPKAEKKPAAKKPAEEEPAAEKAEKTPAGKKPKAEKRLPAGKSAAKEGGDKKGKKKAKKSVETYKIYIFKVLKQVHPDIGISSKAMSIMNSFINDIFEKLAGEAAKLARYNKKPTITSREIQTSVRLVLPGELAKHAVSEGTKAVTKFTSS

SEQ ID NO: 145 - protein, 152 aa, Zea mays; identical to SEQ ID NO: 144
  misc_feature (1)..(152): Ceres CLONE ID no. 1453911
  misc_feature: Utility: Useful for delaying flowering time
  misc_feature: Utility: Useful for increasing chlorophyll and photosynthetic capacity
  misc_feature: Utility: Useful for making plants sterile and for genetic confinement
  misc_feature: Utility: Useful for making plants with altered leaf shape eg curled leaves
  misc_feature: Utility: Useful for making plants with increased biomass and foliage
  misc_feature: Utility: Useful for making smaller plants

SEQ ID NO: 146 - protein, 150 aa, Zea mays
  misc_feature (1)..(150): Ceres CLONE ID no. 302748
  misc_feature: Utility: Useful for delaying flowering time
  misc_feature: Utility: Useful for increasing chlorophyll and photosynthetic capacity
  misc_feature: Utility: Useful for making plants sterile and for genetic confinement
  misc_feature: Utility: Useful for making plants with altered leaf shape eg curled leaves
  misc_feature: Utility: Useful for making plants with increased biomass and foliage
  misc_feature: Utility: Useful for making smaller plants
MAPKAEKKPAAKKPAEEEPATEKAEKAPAGKKPKAEKRLPAGKSGAGEGKKGKKKAKKSVETYKIYIFKVLKQVHPDIGISSKAMSIMNSFINDIFEKLAAEAAKLARYNKKPTITSREIQTSVRLVLPGELAKHAVSEGTKAVTKFTSS

SEQ ID NO: 147 - DNA, 366 bp, n/a
  misc_feature (1)..(366): Ceres CLONE ID no. 3510
  misc_feature (1)..(366): Also known as  Ceres CDNA ID no. 13496297
aatactcgtatcttgtagcagccactaaagcaaaattctgagatcgaaaaagctataaaaaaaaaaaactgcttccgtttcatcgattttgtccagatcttccccttcttccggtaatcgaagcttacgagatagttgagtgaagatgatctatgatgtgaactctggtctattcagatccttcctgagccagaagggtagctcgtccgacaaaaggaaaatggaagataagccaagagaacagaagcccaaagccagcgacaacaaacctgttatgaatgaatgagaacagattacatcttcttgtaatttctctttacctatttcagttgtaagcatcattttaatgaattaagtttctttcct

SEQ ID NO: 148 - protein, 46 aa, n/a
  misc_feature (1)..(46): Pfam Name: Wound_ind; Pfam Description: Wound-inducible basic protein family
  misc_feature (1)..(46): Pfam Name: Wound_ind; Pfam Description: Wound-inducible basic protein family
  misc_feature: Utility: Useful for delaying flowering time
  misc_feature: Utility: Useful for making smaller plants
MIYDVNSGLFRSFLSQKGSSSDKRKMEDKPREQKPKASDNKPVMNE

SEQ ID NO: 149 - protein, 45 aa, Brassica napus
  misc_feature (1)..(45): Ceres CLONE ID no. 1070119
  misc_feature: Utility: Useful for delaying flowering time
  misc_feature: Utility: Useful for making smaller plants
MIYDVNSVLFKSFLSSKFSTDKRRGEDKPREQKPKASDNKPVMNE

SEQ ID NO: 150 - protein, 47 aa, Glycine max
  misc_feature (1)..(47): Ceres CLONE ID no. 553538
  misc_feature: Utility: Useful for delaying flowering time
  misc_feature: Utility: Useful for making smaller plants
MIYDVNSPLFRSFLSQKGGSSDKRKTDEQKPKEQKPKASENKPIMTE

SEQ ID NO: 151 - protein, 47 aa, Glycine max
  misc_feature (1)..(47): Ceres CLONE ID no. 857804
  misc_feature: Utility: Useful for delaying flowering time
  misc_feature: Utility: Useful for making smaller plants
MIYDVNSPLFRSFLSQKGGSSDKRKSDEQKPKEQKPKASENKPIMTE

SEQ ID NO: 152 - protein, 46 aa, Zea mays
  misc_feature (1)..(46): Ceres CLONE ID no. 644900
  misc_feature: Utility: Useful for delaying flowering time
  misc_feature: Utility: Useful for making smaller plants
MIYDVNSPLFRSFLSQKGGADKRKMEEHKPKEQRPKANENKPVMNE

SEQ ID NO: 153 - protein, 46 aa, Zea mays; identical to SEQ ID NO: 152
  misc_feature (1)..(46): Ceres CLONE ID no. 300291
  misc_feature: Utility: Useful for delaying flowering time
  misc_feature: Utility: Useful for making smaller plants

SEQ ID NO: 154 - protein, 46 aa, Zea mays; identical to SEQ ID NO: 152
  misc_feature (1)..(46): Ceres CLONE ID no. 421214
  misc_feature: Utility: Useful for delaying flowering time
  misc_feature: Utility: Useful for making smaller plants

SEQ ID NO: 155 - protein, 48 aa, Triticum aestivum
  misc_feature (1)..(48): Ceres CLONE ID no. 678746
  misc_feature: Utility: Useful for delaying flowering time
  misc_feature: Utility: Useful for making smaller plants
MIYDVNSPLFRSFLSQKGGASSDKRKMEEQKPKDQRFKANENKPVMNE

SEQ ID NO: 156 - protein, 48 aa, Triticum aestivum; identical to SEQ ID NO: 155
  misc_feature (1)..(48): Ceres CLONE ID no. 753703
  misc_feature: Utility: Useful for delaying flowering time
  misc_feature: Utility: Useful for making smaller plants

SEQ ID NO: 157 - protein, 48 aa, Triticum aestivum; identical to SEQ ID NO: 155
  misc_feature (1)..(48): Ceres CLONE ID no. 927400
  misc_feature: Utility: Useful for delaying flowering time
  misc_feature: Utility: Useful for making smaller plants

SEQ ID NO: 158 - protein, 48 aa, Triticum aestivum; identical to SEQ ID NO: 155
  misc_feature (1)..(48): Ceres CLONE ID no. 1316352
  misc_feature: Utility: Useful for delaying flowering time
  misc_feature: Utility: Useful for making smaller plants

SEQ ID NO: 159 - protein, 47 aa, Glycine max
  misc_feature (1)..(47): Ceres CLONE ID no. 810742
  misc_feature: Utility: Useful for delaying flowering time
  misc_feature: Utility: Useful for making smaller plants
  misc_feature (6)..(6): Xaa is any aa, unknown, or other
MIYDVXSPLFRSFLSQKGGSSDKRKTDEQKPKEQKPKASENKPIMTE

SEQ ID NO: 160 - protein, 47 aa, Glycine max
  misc_feature (1)..(47): Public GI no. 81888
  misc_feature: Utility: Useful for delaying flowering time
  misc_feature: Utility: Useful for making smaller plants
MIYDVNSPLFRSFLSQKGGSSDKRKTEEQKPKEHRPKASENKPIMTE

SEQ ID NO: 161 - DNA, 1660 bp, Arabidopsis thaliana
  misc_feature (1)..(1660): Ceres CLONE ID no. 3699
  misc_feature (1)..(1660): Also known as  Ceres CDNA ID no. 23431464
acccacttcgattaccaactccgaccgccagaggcagcgagtttcagatcaaagatgtcggcgacgcttacaggatcgggaactgctttggggttttcgtgttcctcgaagatctcgaaaagagtttcttcttcaccagcttctaaccgatgctgcatcaagatgtctgtttccgtcgacgagaagaagaaaagtttcagtcttcagaaatctgaggaagctttcaatgctgcttaagaatctaatgcctggaggtgtgaattcccctgttcgagcattcaaatccgttggtggacaacctgttttgattgattcagttaaaggctcaaaaatgtgggacattgatggaaatgagtatattgactacgttggctcttggggaccagctattattggccatgctgatgacgaggttcttgcggctctagctgagacgatgaagaaaggaacaagctttggtgctccttgtctcttagagaatgttttagctgagatggttatatcagctgttcccagcattgaaatggttcggtttgttaattctggtactgaaacgtgtatgggtgtgcttcgtcttgccagagctttcactaacaaagagaagttcattaagtttgaagggtgctatcacggtcatgctaacgccttccttgttaaagctggtagtggtgttgccactttggggctaccggactctccaggtgtccctaaagcagctacttcagatactttaacagctccgtacaatgatcttgaagctgttgagaagctctttgctgcgcataaaggggagatttctgcggtaattctcgaacctgttgttggtaactccggattcattcctcctactccggaattcatcaacggtttacgccagcttactaaagacaatggtgttcttctcatcttcgatgaagtcatgacgggatttcgtctagcctatggtggagcccaagaatactttggaatcacccctgatctaacaactcttggtaaaattattggtgggggtcttcccgtgggagcatacggtggcagacgcgatattatggagatggttgcgcccgctggaccaatgtaccaagccgggactctaagtggtaatccgctggcaatgactgcagggattcacacgctgaagcggctaaagcaggcaggaacatatgagtatttagacaagatcacgaaggaactaaccaacggaatcttagaagccggaaagaaaacagggcatccaatgtgcggcggttacataagcggtatgtttggattctttttcacagaaggaccggtttacaactttgcagatgcaaagaagagcgacacagagaagtttggtaggtttttcaggggaatgttggaagaaggtgtttactttgcaccgtctcagtttgaggccgggtttacgagcttggctcacactcccgaggatatacagttaacaattgctgcggctgagagggtactgagtaggatctagaatgttcccaaccctgagtctagtttcacaatcttcatgttttggggacgatgtgtatggtttgatgagcggatggaataattcttgtgtagtgagttgaattttgtttcatcagtagagcttgagattttttgtattttaagatcatctgttaatgtaatggttttatgttatctcctc

SEQ ID NO: 162 - protein, 492 aa, Arabidopsis thaliana
  misc_feature (102)..(405): Pfam Name: Aminotran_3; Pfam Description: Aminotransferase class-III
  misc_feature: Utility: Useful for delaying flowering time
  misc_feature: Utility: Useful for making lethal plants for genetic confinement systems
PTSITNSDRQRQRVSDQRCRRRLQDRELLWGFRVPRRSRKEFLLHQLLTDAASRCLFPSTRRRKVSVFRNLRKLSMLLKNLMPGGVNSPVRAFKSVGGQPVLIDSVKGSKMWDIDGNEYIDYVGSWGPAIIGHADDEVLAALAETMKKGTSFGAPCLLENVLAEMVISAVPSIEMVRFVNSGTETCMGVLRLARAFTNKEKFIKFEGCYHGHANAFLVKAGSGVATLGLPDSPGVPKAATSDTLTAPYNDLEAVEKLFAAHKGEISAVILEPVVGNSGFIPPTPEFINGLRQLTKDNGVLLIFDEVMTGFRLAYGGAQEYFGITPDLTTLGKIIGGGLPVGAYGGRRDIMEMVAPAGPMYQAGTLSGNPLAMTAGIHTLKRLKQAGTYEYLDKITKELTNGILEAGKKTGHPMCGGYISGMFGFFFTEGPVYNFADAKKSDTEKFGRFFRGMLEEGVYFAPSQFEAGFTSLAHTPEDIQLTIAAAERVLSRI

SEQ ID NO: 163 - protein, 473 aa, Arabidopsis thaliana
  misc_feature (1)..(473): Public GI no. 28972461
  misc_feature: Utility: Useful for delaying flowering time
  misc_feature: Utility: Useful for making lethal plants for genetic confinement systems
MSATLTGSGTALGFSCSSKISKRVSSSPSTRCSIKMSVSVDEKKKSFTLQKSEEAFNAAKNLMPGGVNSPVRAFKSVGGQPVLIDSVKGSKMWDIDGNEYIDYVGSWGPAIIGHADDEVLAALAETMKKGTSFGAPCLLENVLAEMVISAVPSIEMVRFVNSGTEACMGVLRLARAFTNKEKFIKFEGCYHGHANAFLVKAGSGVATLGLPDSPGVPKAATSDTLTAPYNDIEAVAKLFEAHKGEISAVILEPVVGNSGFITPTPEFINGLRQLTKDNGALLIFDEVMTGFRLAYGGAQEYFGITPDLTTLGKIIGGGLPVGAYGGRRDIMEMVAPAGPMYQAGTLSGNPLAMTAGIHTLKRLKQPGTYEYLDKITKELTNGILEAGKKTGHPMCGGYISGMFGFFFAEGPVYNFADAKKSDTEKFGKFFRGMLEEGVYFAPSQFEAGFTSLAHTSEDIQFTISAAERVLGRI

SEQ ID NO: 164 - protein, 473 aa, Brassica napus
  misc_feature (1)..(473): Ceres CLONE ID no. 1039319
  misc_feature: Utility: Useful for delaying flowering time
  misc_feature: Utility: Useful for making lethal plants for genetic confinement systems
MSATLTGSGTALGFSCSSKIPKRVSPSSSNRCSIKMSVSVDEKKKSFTLQKSEEAFNAAKDLMPGGVNSPVRAFKSVGGQPVLIDSVKGSKMWDIDGNEYIDYVGSWGPAIIGHADDEVLAALAETMKKGTSFGAPCLLENVLAEMVISAVPSIEMVRFVNSGTEACMGVLRLARAFTNKEKFIKFEGCYHGHANAFLVKAGSGVATLGLPDSPGVPKAATSDTLTAPYNDIEAVAKLFEAHKGEISAVILEPVVGNSGFITPTLEFINGLRQLSRDNGALLIFDEVMTGFRLAYGGAQEYFGITPDLTTLGKIIGGGLPVGAYGGRRDIMEMVAPAGPMYQAGTLSGNPLAMTAGIHTLKRLKQPGTYEYLDKITKELTNGILEAGKKTGHAMCGGYISGMFGFFFTEGPVYNFADAKKSDTEKFGRFFRGMLEEGVYFAPSQFEAGFTSLAHTTEDVQFTIAAAERVLGRI

SEQ ID NO: 165 - protein, 473 aa, Brassica napus; identical to SEQ ID NO: 164
  misc_feature (1)..(473): Public GI no. 28972463
  misc_feature: Utility: Useful for delaying flowering time
  misc_feature: Utility: Useful for making lethal plants for genetic confinement systems

SEQ ID NO: 166 - protein, 438 aa, Arabidopsis thaliana
  misc_feature (1)..(438): Ceres CLONE ID no. 1354315
  misc_feature: Utility: Useful for delaying flowering time
  misc_feature: Utility: Useful for making lethal plants for genetic confinement systems
MSVSVEEKTKKFTLQKSEEAFNAAKNLMPGGVNSPVRAFKSVGGQPVVMDSAKGSRIRDIDGNEYIDYVGSWGPAIIGHADDEVLAALAETMKKGTSFGAPCLLENVLAEMVISAVPSIEMVRFVNSGTEACMGVLRLARAFTGKQKFIKFEGCYHGHANSFLVKAGSGVATLGLPDSPGVPKAATSDTLTAPYNDIAAVEKLFEANKGEIAAIILEPVVGNSGFITPKPEFIEGIRRITKDNGALLIFDEVMTGFRLAYGGAQEYFGITPDLTTLGKIIGGGLPVGAYGGRRDIMEMVAPAGPMYQAGTLSGNPLAMTAGIHTLKRLSQPGTYEYLDKITKELTNGILEAGKKTGHAMCGGYISGMFGFFFTEGPVYDFSDAKKSDTEKFGKFFRGMLEEGVYLAPSQFEAGFTSLAHTSEDIQFTIAAAEKVLSRL

SEQ ID NO: 167 - protein, 472 aa, Arabidopsis thaliana
  misc_feature (1)..(472): Public GI no. 6523104
  misc_feature: Utility: Useful for delaying flowering time
  misc_feature: Utility: Useful for making lethal plants for genetic confinement systems
MAATLTGSGIALGFSCSAKFSKRASSSSNRRCIKMSVSVEEKTKKFTLQKSEEAFNAAKNLMPGGVNSPVRAFKSVGGQPVVMDSAKGSRIRDIDGNEYIDYVGSWGPAIIGHADDEVLAALAETMKKGTSFGAPCLLENVLAEMVISAVPSIEMVRFVNSGTEACMGVLRLARAFTGKQKFIKFEGCYHGHANSFLVKAGSGVATLGLPDSPGVPKAATSDTLTAPYNDIAAVEKLFEANKGEIAAIILEPVVGNSGFITPKPEFIEGIRRITKDNGALLIFDEVMTGFRLAYGGAQEYFGITPDLTTLGKIIGGGLPVGAYGGRRDIMEMVAPAGPMYQAGTLSGNPLAMTAGIHTLKRLSQPGTYEYLDKITKELTNGILEAGKKTGHAMCGGYISGMFGFFFTEGPVYDFSDAKKSDTEKFGKFFRGMLEEGVYLAPSQFEAGFTSLAHTSEDIQFTIAAAEKVLSRL

SEQ ID NO: 168 - protein, 472 aa, Arabidopsis thaliana
  misc_feature (1)..(472): Public GI no. 498914
  misc_feature: Utility: Useful for delaying flowering time
  misc_feature: Utility: Useful for making lethal plants for genetic confinement systems
MAATLTGSGIALGFSSSAKFSKRASSSSNRRCIKMSVSVEEKTKKFTLQKSEEAFNAAKNLMPGGVNSPVRAFKSVGGQPVVMDSAKGSRIRDIDGNEYIDYVGSWGPAIIGHADDEVLAALAETMKKGTSFGAPCLLENVLAEMVISAVPSIEMVRFVNSGTEACMGVLRLARAFTGKQKFIKFEGCYHGHAKSFLVKAGSGVATLGLPDSPGVPKAATSDTLTAPYNDIAAVEKLFEANKGEIAAIILEPVVGNSGFITPKPEFIEGIRRITKDNGALLILDEVMTGFRLAYGGAQEYFGITPDLTTLGKIIGGGLPVGAYGGRRDIMEMVAPAGPMYQAGTLSGNPLAMTAGIHTLKRLSQPGTYEYLDKITKELTNGILEAGKKTGHAMCGGYISGMFGFFFTEGPVYDFSDAKKSDTEKFGKFFRGMLEEGVYLAPSQFEAGFTSLAHTSEDIQFTIAAAEKVLSRL

SEQ ID NO: 169 - protein, 481 aa, Arabidopsis thaliana
  misc_feature (1)..(481): Public GI no. 642911
  misc_feature: Utility: Useful for delaying flowering time
  misc_feature: Utility: Useful for making lethal plants for genetic confinement systems
MAAVNGVGLSWPSKLTKNQTPKWGFSPSHRRCNPSSSSSATIRMTASVDEKKKTFTLEKSEEAFSKAKELMPGGVNSPVRAFKSVGGQPIIIDSVKGSRMRDIDGNEYIDYVGSWGPAIIGHADDEVLAALAETMKKGTSFGAPCLLENTLAEMVISAVPSIEMVRFVNSGTEACMGVLRLARAFTCRPKIIKFEGCYHGHADPFLVKAGSGVATLGLPDSPGVPKAATIDTLTAPYNDISAVESLFEEHKGEIAAVILEPVVGNAGFIPPKLEFLAAIRKITKENDALLIFDEVMTGFRLAYGGAQEYFGITPDLTTLGKIIGGGLPVGAYGGRRDIMEMVAPAGPMYQAGTLSGNPLAMTAGIHTLKRLQGQGTYEHLDKITAELTQGILDAGKKTGHAMCGGSIRGMFGFFFADGPIYNFSDAKKSDTEKFGRFYRGMLEEGVYFAPSQFEAGFTSLAHTPEDIQRTVAAAEKVLKQI

SEQ ID NO: 170 - protein, 478 aa, Arabidopsis thaliana
  misc_feature (1)..(478): Public GI no. 19875
  misc_feature: Utility: Useful for delaying flowering time
  misc_feature: Utility: Useful for making lethal plants for genetic confinement systems
MAAVNGVGISWPSKLTQSQRPKLVFSPSPRRCTPSSSTIKMTASVDEKKKTFTLQKSEEAFSKAKELMPGGVNSPVRAFKSVGGQPIIIDSVKGSRMRDIDGNDYIDYVGSWGPAIIGHADDEVLAALAETMKKGTSFGAPCLLENTLAEMVISAVPSIEMVRFVNSGTEACMGVLRLARAFTGRPKIIKFEGCYHGHADPFLVKAGSGVATLGLPDSPGVPKAATTDTLTAPYNDISAVESLFKEHKGEVAAIILEPVVGNAGFIQPNPDFLAAIRKITKENDALLIFDEVMTGFRLAYGGAQEYFGITPDLTTLGKIIGGGLPVGAYGGRRDIMEMVAPAGPMYQAGTLSGNPLAMTAGIHTLKRLQGPGTYDYLDKITGELTQGILDAGKKTGHAMCGGYIRGMFGFFFVEGPVNNFSDAKKSDTEKFGRFYRGMLEEGVYFAPSQFEAGFTSLAHTSEDIQRTVAAAEKVLKQI

SEQ ID NO: 171 - protein, 478 aa, Arabidopsis thaliana
  misc_feature (1)..(478): Public GI no. 19873
  misc_feature: Utility: Useful for delaying flowering time
  misc_feature: Utility: Useful for making lethal plants for genetic confinement systems
MAAVNGVGISWPSKLTQGQRPKLVFSPSPRRCTPSSSTIKMTASVDEKKKTFTLQKSEEAFSKAKELMPGGVNSPVRAFKSVGGQPIIIDSVKGSRMRDIDGNEYIDYVGSWGPAIIGHADDEVLAALAETMKKGTSFGAPCLLENTLAEMVISAVPSIEMVRFVNSGTEACMGVLRLARAFTGRPKIIKFEGCYHGHADPFLVKAGSGVATLGLPDSPGGPKAATSDTLTAPYNDISAVESLFEEHKGEVAAIILEPVVGNAGFIQPNLDFLAAIRKITKENDALLIFDEVMTGFRLAYGGAQEYFGITPDLTTLGKIIGGGLPVGAYGGRRDIMEMVAPAGPMYQAGTLSGNPLAMTAGIHTLKRLQGPGTYEYLDKITGELTQGILDAGKKTGHAMCGGYIRGMFGFLFAEGPVNNFSDAKKSDTEKFGRFYRGMLEEGVYFAPSQFEAGFTSLAHTSEDIQKTVAAAEKVLKQI

SEQ ID NO: 172 - protein, 473 aa, Zea mays
  misc_feature (1)..(473): Ceres CLONE ID no. 297802
  misc_feature: Utility: Useful for delaying flowering time
  misc_feature: Utility: Useful for making lethal plants for genetic confinement systems
MAGAAAAAVASGVSARPAAPMRASAGRRARLSVVRAAISLEKGEKAYTVQKSEEIFNAAKELMPGGVNSPVRAFKSVGGQPVVFDSVKGSRMWDVDGNEYIDYVGSWGPAIIGHADDKVNAALIETLKKGTSFGAPCLLENVLAEMVISAVPSIEMVRFVNSGTEACMGALRLVRAFTGREKIIKFEGCYHGHADSFLVKAGSGVATLGLPDSPGVPKGATYETLTAPYNDVEAVKKLFEDNAGEIAAVFLEPVVGNAGFIPPQPGFLNALRDLTKQDGALLVFDEVMTGFRLSYGGAQEYFGITPDVTTLGKIIGGGLPVGAYGGRRDIMEMVAPAGPMYQAGTLSGNPLAMTAGIHTLKRLTEPGTYEYLDKITGELVRGILDVGAKAGHDMCGGHIRGMFGFFFTGGPVHNFGDAKKSDTEKFGRFYRGMLEEGVYFAPSQFEAGFTSLAHTSQDIEKTVEAAEKVLKRI

SEQ ID NO: 173 - protein, 452 aa, Glycine max
  misc_feature (1)..(452): Ceres CLONE ID no. 523191
  misc_feature: Utility: Useful for delaying flowering time
  misc_feature: Utility: Useful for making lethal plants for genetic confinement systems
MSLSSSTRSRTVAMAVSIDPKTDNKLTLTKSEEAFAAAKELMPGGVNSPVRAFKSVGGQPIVIDSVKGSRMWDIDGNEYIDYVGSWGPAIIGHADDQVLAALGETMKKGTSFGAPCLLENTLAELVIDAVPSIEMVRFVNSGTEACMGALRLARAYTGREKIIKFEGCYHGHADPFLVKAGSGVATLGLPDSPGVPKAATFETLTAPYNDTEAIEKLFEANKGEIAAVFLEPVVGNAGFIVPKPDFHSFLRKITKENNTLLVFDEVMTGFRLSYGGAQEYFGITPDITTLGKIIGGGLPVGAYGGRRDIMEKVAPAGPMYQAGTLSGNPLAMTAGIETLQRIKEPGTYEYLDKITGELVEGIIEAGKRAGHAICGGHIRGMFGFFFTEGPVYNFADAKKSDTAKFARFFWGMLAEGVYLAPSQFEAGFTSLAHTSDDIKKTIAAAEKVFREI

SEQ ID NO: 174 - DNA, 528 bp, Arabidopsis thaliana
  misc_feature (1)..(528): Ceres CLONE ID no. 3817
  misc_feature (1)..(528): Also known as  Ceres CDNA ID no. 23366332
attcatgttcatcttcgtcgtcttcttctccttcttctttctctgcacctaccaagtcccatacccaagaagaagacatcaacacacaaaccaaagatcaagaatcccaagaaaaagaagatgaagtagttgattcttatcatcatcaagattttaagattagggtttaccttatctctctctactttttcatttagatcggttcttgatcatcatcatcaacatcatcatatgtttgtatcttcatccacgtgtgcgtacgagatccaaaaggggaatcaagcgtctcggtccgatccttcgctgcatcaaagcgatcttcatcttgaaaattaccaaatcaagtgtgtgtgtttttactctttcttttctttttgtgtttctttttcttttgactaccctttgtatttctatttgcttctttttttcttctkccgaatatctcctttttccgatcggtgttttggtctgactgatttagacttatgaatctacatgtatgadcactatatatccckatgtwcttcc

SEQ ID NO: 175 - protein, 85 aa, Arabidopsis thaliana
  misc_feature: Utility: Useful for delaying flowering time
  misc_feature: Utility: Useful for making larger plants
  misc_feature: Utility: Useful for making ornamental plants with modified leaves
  misc_feature: Utility: Useful for making plants sterile and for genetic confinement
  misc_feature: Utility: Useful for making plants that grow better in shade
  misc_feature: Utility: Useful for making plants with altered leaf shape eg curled leaves
  misc_feature: Utility: Useful for making smaller plants
MFVSSSTCAYEIQKGNQASRSDPSLHQSDLHLENYQIKCVCFYSFFSFCVSFSFDYPLYFYLLLFFFFRISPFSDRCFGLTDLDL

SEQ ID NO: 176 - DNA, 688 bp, Arabidopsis thaliana
  misc_feature (1)..(688): Ceres CLONE ID no. 3858
  misc_feature (1)..(688): Also known as  Ceres CDNA ID no. 23360607
atcagaaaacaggaataaaagcactcaaaagtcaaagcgcgcgcgcgcacacacacaaaaaaaaacaatccaaagctaattgattcatcaatggcgatgtcgggaacatacgtgacggatgtgcctcttaagggatcggcggagaaacactataagaggtggaggagcgagaaccacctcgtccctgaagctatcggccacctcatccaaggtgtcaccgtccatgacggcgattgggactctcacggcaccatcaaaatctggaactacactcgtgatgggaaagaggaagtattgaaggagaggatagagatggacgacgagaatatggcggtgacgatcaatggactcgatggtcacgtcatggaggtcctcaaggtttatgtcacgacgttacatttcatccccgagtccaaagatggctgcgtctgcaaaattactatggtctgggagaaacgcaccgaagactccccagagcccatcgaattcatgaagttcgtggaacagatgattgctcacatggacgaccacatcctccaaaaccaggaatgatggatcgatgcttaatcatcatcacatcctccttttatttatcttaattaatgtgtgtccatctcgtacatgatattaatatcatcatggtgttgtatatccaacgtttatttataaaagtattgttgttcgtttc

SEQ ID NO: 177 - protein, 153 aa, Arabidopsis thaliana
  misc_feature (2)..(151): Pfam Name: Bet_v_I; Pfam Description: Pathogenesis-related protein Bet v I family
  misc_feature: Utility: Useful for delaying flowering time
  misc_feature: Utility: Useful for increasing chlorophyll and photosynthetic capacity
  misc_feature: Utility: Useful for making plants with increased biomass
  misc_feature: Utility: Useful for making plants with increased biomass and foliage
  misc_feature: Utility: Useful for making smaller plants
MAMSGTYVTDVPLKGSAEKHYKRWRSENHLVPEAIGHLIQGVTVHDGDWDSHGTIKIWNYTRDGKEEVLKERIEMDDENMAVTINGLDGHVMEVLKVYVTTLHFIPESKDGCVCKITMVWEKRTEDSPEPIEFMKFVEQMIAHMDDHILQNQE

SEQ ID NO: 178 - protein, 155 aa, Arabidopsis thaliana
  misc_feature (1)..(155): Public GI no. 16191591
  misc_feature: Utility: Useful for delaying flowering time
  misc_feature: Utility: Useful for increasing chlorophyll and photosynthetic capacity
  misc_feature: Utility: Useful for making plants with increased biomass
  misc_feature: Utility: Useful for making plants with increased biomass and foliage
  misc_feature: Utility: Useful for making smaller plants
MAMSGKYVAEVPLKGSAEKHYRRWRSQNNLFPDAIGHHVQGVTVHDGDWDSHGSIKSWNYTLDGKPEVIKEKREIDDEKMALTFRGLEGHVMEKYKKYEVILQFIPKSNEGCVCKVTLIWENRNEDSPEPINYMKFVKSLVADMDDHILKGQNKA

SEQ ID NO: 179 - protein, 159 aa, Brassica napus
  misc_feature (1)..(159): Ceres CLONE ID no. 1115030
  misc_feature: Utility: Useful for delaying flowering time
  misc_feature: Utility: Useful for increasing chlorophyll and photosynthetic capacity
  misc_feature: Utility: Useful for making plants with increased biomass
  misc_feature: Utility: Useful for making plants with increased biomass and foliage
  misc_feature: Utility: Useful for making smaller plants
  misc_feature (32)..(32): Xaa is any aa, unknown, or other
STITTQNKQVEALKQREGEREMATSGTYVTEXPLKGTAEKHYKRWKSENHVFPDAIGHHIQNVTVHEGEHDSHGSIRSWNYTWDGKEEMFKEKREVDDENLTLTLRGLEGHVMEQLKVYDVIYQFIPKTEDTCACKITIVWEKRNDDSPEPSTYMKFVK

SEQ ID NO: 180 - protein, 151 aa, Brassica napus
  misc_feature (1)..(151): Ceres CLONE ID no. 1079413
  misc_feature: Utility: Useful for delaying flowering time
  misc_feature: Utility: Useful for increasing chlorophyll and photosynthetic capacity
  misc_feature: Utility: Useful for making plants with increased biomass
  misc_feature: Utility: Useful for making plants with increased biomass and foliage
  misc_feature: Utility: Useful for making smaller plants
MATSGTYVTEVPLKGTAEKHYKRWKSENHVFPDAIGHHIQNVTVHEGEHDSHGSIRSWNYTWDGKEEMFKEKREVDDENLTLTLRGLEGHVMEQLKVYDVIYQFIPKTEDTCACKITMIWEKRNDEVPEPSSYMKLVKSMVSEMQEHVHKA

SEQ ID NO: 181 - protein, 141 aa, Brassica napus
  misc_feature (1)..(141): Public GI no. 31559433
  misc_feature: Utility: Useful for delaying flowering time
  misc_feature: Utility: Useful for increasing chlorophyll and photosynthetic capacity
  misc_feature: Utility: Useful for making plants with increased biomass
  misc_feature: Utility: Useful for making plants with increased biomass and foliage
  misc_feature: Utility: Useful for making smaller plants
MVLAGKLEAEIDINAPADKYYRIFKGQAHHVPNISPGIIQEVNVHEGDWDTHGSIKIWNYTVDGKTEVFKERVEFDDEKRAATLTGVEGSTVLNHSKTFKGTYQVTPKGNGSLAKLTLVYEKVKEDVPDPVKYLALDDWYY

SEQ ID NO: 182 - protein, 152 aa, Brassica napus
  misc_feature (1)..(152): Public GI no. 33323059
  misc_feature: Utility: Useful for delaying flowering time
  misc_feature: Utility: Useful for increasing chlorophyll and photosynthetic capacity
  misc_feature: Utility: Useful for making plants with increased biomass
  misc_feature: Utility: Useful for making plants with increased biomass and foliage
  misc_feature: Utility: Useful for making smaller plants
MSNLKGKAETVIEIEASPEQYYNIWKQAHHIPNVAGDHIQGVDVHEGDWHSHGGVKSWKYTVDGISGVFKEKVEFDDENKAVILNGLEGDVFKEYKSYKPVYHVLPNPKGKGSLVKLSIEYEKLHEGVSPPDIYVKLMVNISKDLDVHLNKA

SEQ ID NO: 183 - protein, 170 aa, Glycine max
  misc_feature (1)..(170): Ceres CLONE ID no. 464464
  misc_feature: Utility: Useful for delaying flowering time
  misc_feature: Utility: Useful for increasing chlorophyll and photosynthetic capacity
  misc_feature: Utility: Useful for making plants with increased biomass
  misc_feature: Utility: Useful for making plants with increased biomass and foliage
  misc_feature: Utility: Useful for making smaller plants
LSSLLISLFHFLLLNFLIMSLAGKISIEIGVHASAAKWFNLFATQLHHVQNLTERVHETKLHHGDDWHHNESIKHWTCTIDGKVTTYHESIESVDEPNKTITYKIFGEDIDHQYKVFKVIFQAIHKDHGGAFIKWTIEYERVGEEVDLPFGFIEYLNKGSRDVDGHLLKA

SEQ ID NO: 184 - protein, 161 aa, Glycine max
  misc_feature (1)..(161): Public GI no. 32165478
  misc_feature: Utility: Useful for delaying flowering time
  misc_feature: Utility: Useful for increasing chlorophyll and photosynthetic capacity
  misc_feature: Utility: Useful for making plants with increased biomass
  misc_feature: Utility: Useful for making plants with increased biomass and foliage
  misc_feature: Utility: Useful for making smaller plants
MVSGTSSTEEVVQVEARRLWNATAKDSHNFLPKVLPEVFTSVTLLQGDGGVGTVKQLNFTPGKKDFSFIKERVDELDEENFVYKYTAIEGGPLGKKLSSACFEVKLVPRKEGGCVAKWTCNYETLPGVQPDEGKFKEIKEDSFGMLKKVEQYLLSNPNLYC

SEQ ID NO: 185 - protein, 161 aa, Glycine max
  misc_feature (1)..(161): Public GI no. 32165470
  misc_feature: Utility: Useful for delaying flowering time
  misc_feature: Utility: Useful for increasing chlorophyll and photosynthetic capacity
  misc_feature: Utility: Useful for making plants with increased biomass
  misc_feature: Utility: Useful for making plants with increased biomass and foliage
  misc_feature: Utility: Useful for making smaller plants
MVSGTSSTEEVVQVEARRLWNATTKDSHNFLPKVLPEAFTSVTLLQGDGGVGTVKQLNFTPGKKDFSFIKERVDELDEENFVYKYTAIEGGPLGKKLSSACFEVKLVPRKEGGCVAKWTCNYETLPGVQPDEGKFKEIKEDSFGMLKKVEQYLLSNPNLYF

SEQ ID NO: 186 - protein, 161 aa, Glycine max
  misc_feature (1)..(161): Public GI no. 32165466
  misc_feature: Utility: Useful for delaying flowering time
  misc_feature: Utility: Useful for increasing chlorophyll and photosynthetic capacity
  misc_feature: Utility: Useful for making plants with increased biomass
  misc_feature: Utility: Useful for making plants with increased biomass and foliage
  misc_feature: Utility: Useful for making smaller plants
MVSGTSSTEEVVQVEARRLWNATTKDSHNFLPKVLPGVFTSVTLLQGDGGVGTVKQLNFTPGKKDFSFIKERVDELDEENFVYKYTAIEGGPLGKKLSSACFEVKLVPRKEGGCVAKWTCNYETLPGVQPDEGKFKEIKEDSFGMLKKVEQYLLSNPNLYC

SEQ ID NO: 187 - protein, 161 aa, Glycine max
  misc_feature (1)..(161): Public GI no. 32165476
  misc_feature: Utility: Useful for delaying flowering time
  misc_feature: Utility: Useful for increasing chlorophyll and photosynthetic capacity
  misc_feature: Utility: Useful for making plants with increased biomass
  misc_feature: Utility: Useful for making plants with increased biomass and foliage
  misc_feature: Utility: Useful for making smaller plants
MVSGTSSTEEVVQVEARRLWNATTKDSHNFLPKVLPEVFTSVTLLQGDGGVGTVKQLNFTPGKKDFSFIKERVDELDEENFVYKYTAIEGGPLGKKLSSACFEVKLVPRKEGGCVAKWTCNYETLPGVQPDEGKFKEIKEDSFGMLKKVEQYLLSNPNLYC

SEQ ID NO: 188 - protein, 173 aa, Glycine max
  misc_feature (1)..(173): Ceres CLONE ID no. 476943
  misc_feature: Utility: Useful for delaying flowering time
  misc_feature: Utility: Useful for increasing chlorophyll and photosynthetic capacity
  misc_feature: Utility: Useful for making plants with increased biomass
  misc_feature: Utility: Useful for making plants with increased biomass and foliage
  misc_feature: Utility: Useful for making smaller plants
SPIFVCSISCFLLLLLASFFTMSLAGKITTEIGVHATAAKWFNLFATQLHHVQNLTDRVHGTKLHQGEDWHHNETVKHWTYTIDGKATTCLESIESIDEQNKTITYKLFSGDIDHKYKKFKFTFQAIDKDQGGAFIKWTVEYERLAEEVDPPYGYIEYLHKCTKDIDVHLLKA

SEQ ID NO: 189 - protein, 153 aa, Glycine max
  misc_feature (1)..(153): Ceres CLONE ID no. 641520
  misc_feature: Utility: Useful for delaying flowering time
  misc_feature: Utility: Useful for increasing chlorophyll and photosynthetic capacity
  misc_feature: Utility: Useful for making plants with increased biomass
  misc_feature: Utility: Useful for making plants with increased biomass and foliage
  misc_feature: Utility: Useful for making smaller plants
MSLAGKITTEIGVHATATKWFNLFATQLHHVQNLTDRVHGTKLHQGEDWHHNETVKHWTYTIDGKVTTCLESIESIDEQSKTITYKLFSGDIDHNYKNFKFIFQAIDDNDHGGTIIKWTVEYERLREEVDPPYGHIEYLHKCTKDIDGHLLKA

SEQ ID NO: 190 - protein, 146 aa, Glycine max
  misc_feature (1)..(146): Public GI no. 256141
  misc_feature: Utility: Useful for delaying flowering time
  misc_feature: Utility: Useful for increasing chlorophyll and photosynthetic capacity
  misc_feature: Utility: Useful for making plants with increased biomass
  misc_feature: Utility: Useful for making plants with increased biomass and foliage
  misc_feature: Utility: Useful for making smaller plants
MGLKGKLIAQIEMKCAGDLLHEHFKSNPHQTSTMSPNKITNFTLHEGQLGSTGSVVSWKFVLGGKERHAKQVLHIDDAKKSITFNFVEGDMNELYKSMTATLTAEGNWMTWTFVYEKLNENIPEPLDIFELAICLLKDLEPHHVGK

SEQ ID NO: 191 - DNA, 606 bp, Arabidopsis thaliana
  misc_feature (1)..(606): Ceres CLONE ID no. 5597
  misc_feature (1)..(606): Also known as  Ceres CDNA ID no. 23384094
atcttcaccaaattctctcaatcactcaatggcgatttctcaagctcagcctctgcttcttctcctcttatcagtcttcttcttacctgctttgcacgccacttctttcacctactgcgataagaggctcgatcccgttaaggtcacgggtgtgaagatctcccctgaccctgttgtgagtggtgcagccgcaacatttaagatttttggttctactggcgaagacatctctggaggaaaagtagtgatcagggttttatacgttgggattcctgtccataccgaaactcatgacctctgcgatgagacggcatgtccggttgcacctggcagctttgtgctttctcattctcaaacactcccttcaattacaccacctggtacttacacgctaaagatgacaatcaacgacaagaatggcggaagactaacgtgtatcagcttcaaattcaagatcacagtaggttctgcggtctttgctagttaagttttatggtgtaaattgtgtctttgtgaatctctctctcgtttacttttgtggtgtccaaataaagaatgctctttagagacttgagttgatctacatgaaacaaagagtcacaaacc

SEQ ID NO: 192 - protein, 152 aa, Arabidopsis thaliana
  misc_feature (23)..(143): Pfam Name: E1_DerP2_DerF2; Pfam Description: ML domain
  misc_feature: Utility: Useful for delaying flowering time
  misc_feature: Utility: Useful for increasing chlorophyll and photosynthetic capacity
  misc_feature: Utility: Useful for making larger plants
  misc_feature: Utility: Useful for making plants sterile and for genetic confinement
  misc_feature: Utility: Useful for making stronger plants
  misc_feature: Utility: Useful for making taller plants and plants with longer inflorescences
MAISQAQPLLLLLLSVFFLPALHATSFTYCDKRLDPVKVTGVKISPDPVVSGAAATFKIFGSTGEDISGGKVVIRVLYVGIPVHTETHDLCDETACPVAPGSFVLSHSQTLPSITPPGTYTLKMTINDKNGGRLTCISFKFKITVGSAVFAS

SEQ ID NO: 193 - protein, 152 aa, Brassica napus
  misc_feature (1)..(152): Ceres CLONE ID no. 970267
  misc_feature: Utility: Useful for delaying flowering time
  misc_feature: Utility: Useful for increasing chlorophyll and photosynthetic capacity
  misc_feature: Utility: Useful for making larger plants
  misc_feature: Utility: Useful for making plants sterile and for genetic confinement
  misc_feature: Utility: Useful for making stronger plants
  misc_feature: Utility: Useful for making taller plants and plants with longer inflorescences
  misc_feature (148)..(148): Xaa is any aa, unknown, or other
MAISHAQPLLLLLFSLFLLPSLRATSFHNCDKRLDPVKVTGVEISPDPVVSGKAATFKITGSTDEDISGGEVVISVSLYGVHIHTETHDLCDESSCPIAPGTFVLSHSQTLPSITPPGTYTLKMTINDKNGGRLTCISFKFKITLFSXVSAS

SEQ ID NO: 194 - protein, 157 aa, Glycine max
  misc_feature (1)..(157): Ceres CLONE ID no. 619936
  misc_feature: Utility: Useful for delaying flowering time
  misc_feature: Utility: Useful for increasing chlorophyll and photosynthetic capacity
  misc_feature: Utility: Useful for making larger plants
  misc_feature: Utility: Useful for making plants sterile and for genetic confinement
  misc_feature: Utility: Useful for making stronger plants
  misc_feature: Utility: Useful for making taller plants and plants with longer inflorescences
MEFQSLSGFYLLLSLTILFLAPFHAQAKIKVTYCDKKADYPVKVSGVEISPDPVESGKPATFKISATSSKAIYGGEVVIGVSYVGVPVHTERIDLCHEVSCPVANGNFLISHTQTLPSITPPGPYSLKMTLKNDRDEVLTCIKFNFKIVFGSFVSDM

SEQ ID NO: 195 - protein, 156 aa, Glycine max
  misc_feature (1)..(156): Public GI no. 50355738
  misc_feature: Utility: Useful for delaying flowering time
  misc_feature: Utility: Useful for increasing chlorophyll and photosynthetic capacity
  misc_feature: Utility: Useful for making larger plants
  misc_feature: Utility: Useful for making plants sterile and for genetic confinement
  misc_feature: Utility: Useful for making stronger plants
  misc_feature: Utility: Useful for making taller plants and plants with longer inflorescences
MATDHRRFPVFLAAALLTLLLLPASAAATDVEYCRQGRDYPVKVSGVEIVPDPVVSGQPATFKISASTDKSITKGKLVIDVKYFFFHVHSESHNLCEETSCPVTGEFVLAHEQTLPSITPPGSYTLTMRLLDDGNKELTCISFGFSIGFISPLALI

SEQ ID NO: 196 - protein, 152 aa, Zea mays
  misc_feature (1)..(152): Ceres CLONE ID no. 504766
  misc_feature: Utility: Useful for delaying flowering time
  misc_feature: Utility: Useful for increasing chlorophyll and photosynthetic capacity
  misc_feature: Utility: Useful for making larger plants
  misc_feature: Utility: Useful for making plants sterile and for genetic confinement
  misc_feature: Utility: Useful for making stronger plants
  misc_feature: Utility: Useful for making taller plants and plants with longer inflorescences
MAAKHLNLFAAALLLLLLPSGSSATAVEYCKKGWDYPVKVSSVEVVPDPVVRGQPATFKISASTDKNITKGKLTIDVAYFIFHVHSETHNLCDETSCPVTGEFVLASQQTLPSFTPPGSYTLTMKLLGDSNEELTCISFGFSIGFVAPNPVI

SEQ ID NO: 197 - protein, 155 aa, Triticum aestivum
  misc_feature (1)..(155): Ceres CLONE ID no. 618484
  misc_feature: Utility: Useful for delaying flowering time
  misc_feature: Utility: Useful for increasing chlorophyll and photosynthetic capacity
  misc_feature: Utility: Useful for making larger plants
  misc_feature: Utility: Useful for making plants sterile and for genetic confinement
  misc_feature: Utility: Useful for making stronger plants
  misc_feature: Utility: Useful for making taller plants and plants with longer inflorescences
MATKQSLLAAAAVCLLLLLPLPAAYAVTDVEYCNKGKNYPVKVSGVEIVPDPVERGVPATFKISATTDKNITEGKLVIDVKYWIFNVYSETDDICTKTQCPATSDFELSHSQTLPSITPPGSYTIQMKMLGKHDEELSCISFGFNIGFLAPVALS

SEQ ID NO: 198 - protein, 157 aa, Parthenium argentatum
  misc_feature (1)..(157): Ceres CLONE ID no. 1610116
  misc_feature: Utility: Useful for delaying flowering time
  misc_feature: Utility: Useful for increasing chlorophyll and photosynthetic capacity
  misc_feature: Utility: Useful for making larger plants
  misc_feature: Utility: Useful for making plants sterile and for genetic confinement
  misc_feature: Utility: Useful for making stronger plants
  misc_feature: Utility: Useful for making taller plants and plants with longer inflorescences
  misc_feature (64)..(64): Xaa is any aa, unknown, or other
  misc_feature (65)..(65): Xaa is any aa, unknown, or other
  misc_feature (110)..(110): Xaa is any aa, unknown, or other
  misc_feature (111)..(111): Xaa is any aa, unknown, or other
MAGFQSKLLVVFLCSLHLIAPLTHAIDVKYCNKKNNYDVKVSGVDITPYPIERGTETTFTISAXXETPISGGNLVIDVSYYWFGVYSETSDLCTKTTCPVATGDFAISHXXSLPSVTPPGSYTLTMKLQDSNKNELTCITFDFSIGWYSSEEAVASS

SEQ ID NO: 199 - DNA, 590 bp, Arabidopsis thaliana
  misc_feature (1)..(590): Ceres CLONE ID no. 5605
  misc_feature (1)..(590): Also known as  Ceres CDNA ID no. 23448926
atctctcgctctttcgattttggagatatttacaggtacgcttgcttttcccttcacaacatcttcttcttcctgctcctctgtttcaaattccgaaaatcagataaaaaatgggagcttcgaaactttccgggatgcaaaagcaagtcttgagtctctacagaggatttctaagagcagctcgttcaagaccaatagaagacaggaagagaatagagatgattgtgtcaacagagttccgccacaactctaaggaggtcgaccgtaagaattttcagtacatcgagtatttgcttcggttaggtactaaacagcttgatcaactcaaaagccctgccatagttagcctctcctcgatcaaggtcgttacatctaaaacctgataccttattttatagcttgttgctctagtgaccatagataacaaagctgaggaaattgattcgttttcctctttttacattgagttatgtatgtatgatgatggatgttcaaggtccattataaaataaagagaattgtgatcacaattgaatatatatatacactttcacacaattatgtgcatctgctaatagtctagagattgc

SEQ ID NO: 200 - protein, 90 aa, Arabidopsis thaliana
  misc_feature (8)..(74): Pfam Name: Complex1_LYR; Pfam Description: Complex 1 protein (LYR family)
  misc_feature: Utility: Useful for delaying flowering time
  misc_feature: Utility: Useful for making larger plants
  misc_feature: Utility: Useful for making smaller plants
MGASKLSGMQKQVLSLYRGFLRAARSRPIEDRKRIEMIVSTEFRHNSKEVDRKNFQYIEYLLRLGTKQLDQLKSPAIVSLSSIKVVTSKT

SEQ ID NO: 201 - protein, 76 aa, Brassica napus
  misc_feature (1)..(76): Ceres CLONE ID no. 1040415
  misc_feature: Utility: Useful for delaying flowering time
  misc_feature: Utility: Useful for making larger plants
  misc_feature: Utility: Useful for making smaller plants
MQKQVLSLYRGFLRAARSTEDRKRIQTIVSTEFRKNSKEVDRKNFQYIEYLLRLAHKQLDQLKSPDMVSISSVKIN

SEQ ID NO: 202 - protein, 79 aa, Brassica napus
  misc_feature (1)..(79): Ceres CLONE ID no. 970237
  misc_feature: Utility: Useful for delaying flowering time
  misc_feature: Utility: Useful for making larger plants
  misc_feature: Utility: Useful for making smaller plants
  misc_feature (71)..(71): Xaa is any aa, unknown, or other
MQKQVLSLYRGFLRAARSKPTTEDRKRIETVVSTEFRKNSKEVDRKNFQYIEYLLRLAHKQLDQLKSPDMXSISSVKIN

SEQ ID NO: 203 - protein, 86 aa, Glycine max
  misc_feature (1)..(86): Ceres CLONE ID no. 599624
  misc_feature: Utility: Useful for delaying flowering time
  misc_feature: Utility: Useful for making larger plants
  misc_feature: Utility: Useful for making smaller plants
MQKQVLSLYRGFLRAARSKSEEERCKIESIISQEFRRNAEDVDRKNFLYIEYLLRRGNKQLDQLKNPGTTGLSSLQLHYSHPSSKG

SEQ ID NO: 204 - protein, 96 aa, Glycine max
  misc_feature (1)..(96): Public GI no. 50943407
  misc_feature: Utility: Useful for delaying flowering time
  misc_feature: Utility: Useful for making larger plants
  misc_feature: Utility: Useful for making smaller plants
MASRSKLSGIQRQVLALYRGFLRTARLKSPEERHRIESVVSAEFRENARNIDRKNFVYIEYLLRRGKKQLEQLKDPDITGLSTLEINKVYKPLNLK

SEQ ID NO: 205 - protein, 93 aa, Glycine max
  misc_feature (1)..(93): Public GI no. 50943405
  misc_feature: Utility: Useful for delaying flowering time
  misc_feature: Utility: Useful for making larger plants
  misc_feature: Utility: Useful for making smaller plants
MASRSKLSGIQRQVLALYRGFLRTARLKSPEERHRIESVVSAEFRENARNIDRKNFVYIEYLLRRGKKQLEQLKDPDITGLSTLEINKASSLH

SEQ ID NO: 206 - protein, 88 aa, Zea mays
  misc_feature (1)..(88): Ceres CLONE ID no. 993322
  misc_feature: Utility: Useful for delaying flowering time
  misc_feature: Utility: Useful for making larger plants
  misc_feature: Utility: Useful for making smaller plants
MASRPKLSGIQKQVLALYRGFLRTARLKAPEERRRIESVVFAEFRDNARSVDRRNFVHIEYLLRRGKKQLEQLKNPDITGLATLVVKK

SEQ ID NO: 207 - protein, 88 aa, Zea mays; identical to SEQ ID NO: 206
  misc_feature (1)..(88): Ceres CLONE ID no. 1466290
  misc_feature: Utility: Useful for delaying flowering time
  misc_feature: Utility: Useful for making larger plants
  misc_feature: Utility: Useful for making smaller plants

SEQ ID NO: 208 - protein, 88 aa, Zea mays
  misc_feature (1)..(88): Ceres CLONE ID no. 229182
  misc_feature: Utility: Useful for delaying flowering time
  misc_feature: Utility: Useful for making larger plants
  misc_feature: Utility: Useful for making smaller plants
MASRPKLSGIQKQVLALYRGFLRTARLKAPEERHRIESVVLAEFRDKAKSVDRRNFIHIEYLLRSGKKQLEQLKNPDITGLATLVVKK

SEQ ID NO: 209 - protein, 88 aa, Zea mays
  misc_feature (1)..(88): Ceres CLONE ID no. 1398876
  misc_feature: Utility: Useful for delaying flowering time
  misc_feature: Utility: Useful for making larger plants
  misc_feature: Utility: Useful for making smaller plants
MASRPKLSGIQKQVLALYRGFLRTARLKAPEERHRIESVVLAEFRDKARRVDRRNFIHIEYLLRSGKKQLEQLKNPGITGLATLVVKK

SEQ ID NO: 210 - DNA, 1208 bp, Arabidopsis thaliana
  misc_feature (1)..(1208): Ceres CLONE ID no. 6685
  misc_feature (1)..(1208): Also known as  Ceres CDNA ID no. 23374073
ataacgaagcggttggaagaagatgaaactgttcgacgcgcactgtcaccttcaagacccgaggattatcaccaaagctcctcagataatcacctccgccgttgcttccggcgtctctgctttcgccgtcaatggagtctccgagaaagattggagtttggtcaaagagatgggagctaaatacccttctgttgttccttgctttgggatccatccatggtatgtagcagagaggagtcctcaatggtttgagacataagagtttctttgagaccactcctactgctgctgttggagaaattggtttggacaaagggtctaagggaagggagattgatttctcagaacaggttaccgtctttcgtcaacagcttgaacttgcaaaggaattgaagaaacctgcgtcagttcattgtgttcgtgcatttggggatctactcgagatattaaaatctgtagggccttttccttctggggtcatgcttcactcgtatttgggttctgctgagatggttcctgaatttgctaagctcggtgcatatttctccttctccggtttccttatgtccatgagtgagaaaaaagccaagaagatgttgaaagcagttccatctgataggatcttattggagacggattcaccagatgcactaccaaaggcagagtcaggttgtctctactttgtagacggagatccttctctacccgaagaaggaaattcagctcaggatcttgattctgcttcatatgataagcctaatgtgtctagtgactcgatgaagttaacaaaggaaacacttaatcacccggctaatattcatatcgtactcggatatgtagcgcagttgttggatatgaagaatgaagaactcgcggaactaagttatcaaaatgctgttcggttattctcttacgaaggttcaaagatacttcttgacagaggtactggtgatgtctctggtcacactcaaaaccagtcaacaacacatgtatcatgagttcttacttcttaagaaatcgtagtgtttctcatcactctattacgagtctttgaatttggactctctcttttttttttctttttttttgaatgtttgaatttggaattattgtactagtgttatagacaatcacacttttctttgtacaaactacaaaggttctgattttgtgtgaaaattaattcagttaatgatgtgattagagcc

SEQ ID NO: 211 - protein, 172 aa, Arabidopsis thaliana
  misc_feature (1)..(144): Pfam Name: TatD_DNase; Pfam Description: TatD related DNase
  misc_feature: Utility: Useful for delaying flowering time
  misc_feature: Utility: Useful for making plants with increased biomass
  misc_feature: Utility: Useful for making plants with increased biomass and foliage
  misc_feature: Utility: Useful for making smaller plants
MLHSYLGSAEMVPEFAKLGAYFSFSGFLMSMSEKKAKKMLKAVPSDRILLETDSPDALPKAESGCLYFVDGDPSLPEEGNSAQDLDSASYDKPNVSSDSMKLTKETLNHPANIHIVLGYVAQLLDMKNEELAELSYQNAVRLFSYEGSKILLDRGTGDVSGHTQNQSTTHVS

SEQ ID NO: 212 - protein, 147 aa, Glycine max
  misc_feature (1)..(147): Ceres CLONE ID no. 463486
  misc_feature: Utility: Useful for delaying flowering time
  misc_feature: Utility: Useful for making plants with increased biomass
  misc_feature: Utility: Useful for making plants with increased biomass and foliage
  misc_feature: Utility: Useful for making smaller plants
  misc_feature (141)..(141): Xaa is any aa, unknown, or other
MVHEFSKLGAYFSFSGFLMSLKASKAKKMLKMVPPDRILLETDAPDALPMSNIDSLYFVEGDTSLTEELLAQTTTSSTSGSSLGNSSHVLADASMLPKETLNHPANIHNVLDYVASMLEITKEELAELSYQNAVRLLSYEXSKVLQK

SEQ ID NO: 213 - DNA, 1014 bp, Arabidopsis thaliana
  misc_feature (1)..(1014): Ceres CLONE ID no. 8161
  misc_feature (1)..(1014): Also known as  Ceres CDNA ID no. 23356714
ctctctctcttaaagctctcttctttggctctttcgaagaagaaccatttttatttcctaagagagacgacggagttcttttctaaagcaccggagaggaggagaagcaacgatggagaatgattgcacggtgaatattgtctctctggagaaggatcgcgatgtttcggaggcgtcggctgaatctcagagcgagtcgactctttcgaactcgctcgattccggtgttacggctgagacctctcgttctgatgctgattccaaactggatgaatgtactgcttggacgaatgagaaacacaactcatatcttgattatttagagagctcgtttgttaggcaattatactccttgcttggaggtgggactcagagactttctagaactcgtgatgtgcagtctaactctcataaatcagctgatcagtttaccgtcctacaaaatggttgctggcagaaggttaactttggaaagaaacaatcttgtttggagacttcatctgagtttcgttttcacagaaattcattgagaaataagcctgaaaattccaacggaaattacaccatgggaactactgtccaaggagatgtgttatgtcatgacgaaaccaaacactcagaggcgtcagggcagaatttcagagaagaagaagaagaagaagagaagggagaggtgagcaaaaaacgagaaagagaagcaaataacgatgatagttcattgaaggaggatcaggttgtgccggtaaggatggtgaagcccagaacgtgaaagcattaggaagtgtagatgaaatactatgaatagagataaagaaatagaagaaggtgtggttacgaatgtggagagggttttgtttgttgtatagcgtgaggctaaagagagccttccttataaagggatccaatgggatatggaaataggattggtgtttgttttcgttaaattttgtctaatgttaactaggggaaaagttatctgatagtattagcatcttatggcaattttattctttt

SEQ ID NO: 214 - protein, 218 aa, Arabidopsis thaliana
  misc_feature: Utility: Useful for delaying flowering time
  misc_feature: Utility: Useful for making larger plants
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with increased biomass
  misc_feature: Utility: Useful for making plants with increased size and biomass
  misc_feature: Utility: Useful for making shorter plants and plants with modified flowers
  misc_feature: Utility: Useful for making smaller plants
  misc_feature: Utility: Useful for making taller plants and plants with longer inflorescences
MENDCTVNIVSLEKDRDVSEASAESQSESTLSNSLDSGVTAETSRSDADSKLDECTAWTNEKHNSYLDYLESSFVRQLYSLLGGGTQRLSRTRDVQSNSHKSADQFTVLQNGCWQKVNFGKKQSCLETSSEFRFHRNSLRNKPENSNGNYTMGTTVQGDVLCHDETKHSEASGQNFREEEEEEEKGEVSKKREREANNDDSSLKEDQVVPVRMVKPRT

SEQ ID NO: 215 - DNA, 914 bp, Arabidopsis thaliana
  misc_feature (1)..(914): Ceres CLONE ID no. 8265
  misc_feature (1)..(914): Also known as  Ceres CDNA ID no. 23383100
tcgcatcactctttcaaagcctcgtgtcttgatttctttcaccaaactcatataatcacatatctctccaagttcatcaagaaaataatataaacacacacatacaagaactgaagaatgagcagacccggagattggaactgcaggtcatgcagccatctcaacttccagcgccgtgactcttgccagcgatgcggtgactctcgttccggccccggtggagttggtggcttagactttggtaatttcggtggcagagccatgtctgttttcggattcaccaccggctccgacgttcgtcccggtgattggtactgcaccgtgggaaactgcgggacacacaacttcgccagtcgctccacctgcttcaaatgcggcactttcaaggacgagaccggcgctggaggcggaggtggtggcatcggcggtccggccatgtttgacgccgacattatgcggtctagagtccccggtaacggtggtcgctctagctggaaatccggcgactggatttgcactaggattggttgcaatgagcataactttgcaagcagaatggaatgcttcaggtgcaatgcaccaagggacttcagcaacagaacctctttctaagttatacaaactgcttttgaagtagccttgtctccaatttcttaggcaccgtttcgatcaatggaaaggagaagcaggagcaaaagagagaattaaaagatgataattttgttagatgttgcaatgagagccaatattgtaactttagctgtcgtgcttttggatgtattatccatttttattaagatttcttttcattttctccttaattcgtaatttttcttttgcagtttctttttaagagttttattattctaatcattgtacgctgcatgtctttcttaaaagaagattctcttcgc

SEQ ID NO: 216 - protein, 164 aa, Arabidopsis thaliana
  misc_feature (3)..(32): Pfam Name: zf-RanBP; Pfam Description: Zn-finger in Ran binding protein and others
  misc_feature: Utility: Useful for delaying flowering time
  misc_feature: Utility: Useful for increasing chlorophyll and photosynthetic capacity
  misc_feature: Utility: Useful for making larger plants
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with increased biomass and foliage
  misc_feature: Utility: Useful for making smaller plants
  misc_feature: Utility: Useful for making stronger plants
MSRPGDWNCRSCSHLNFQRRDSCQRCGDSRSGPGGVGGLDFGNFGGRAMSVFGFTTGSDVRPGDWYCTVGNCGTHNFASRSTCFKCGTFKDETGAGGGGGGIGGPAMFDADIMRSRVPGNGGRSSWKSGDWICTRIGCNEHNFASRMECFRCNAPRDFSNRTSF

SEQ ID NO: 217 - protein, 146 aa, Glycine max
  misc_feature (1)..(146): Ceres CLONE ID no. 540561
  misc_feature: Utility: Useful for delaying flowering time
  misc_feature: Utility: Useful for increasing chlorophyll and photosynthetic capacity
  misc_feature: Utility: Useful for making larger plants
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with increased biomass and foliage
  misc_feature: Utility: Useful for making smaller plants
  misc_feature: Utility: Useful for making stronger plants
MSRPGDWNCRSCQHLNFQRRDSCQRCGDSKYGDRVVDFGGFGGRGGSSFGLTGSDVRPGDWYCAAANCGAHNFASRSSCFKCGAFKDDLAGGGYNSSDILRSRAFGGSGRPGWKSGDWICSRSGCNEHNFASRMECFKCSAPRDTY

SEQ ID NO: 218 - protein, 166 aa, Glycine max
  misc_feature (1)..(166): Public GI no. 50906111
  misc_feature: Utility: Useful for delaying flowering time
  misc_feature: Utility: Useful for increasing chlorophyll and photosynthetic capacity
  misc_feature: Utility: Useful for making larger plants
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with increased biomass and foliage
  misc_feature: Utility: Useful for making smaller plants
  misc_feature: Utility: Useful for making stronger plants
MNRKPGDWDCRACQHLNFSRRDLCQRCGEPRGAADRGSGGGGDYANFGGRGGSSFGGGFGTGSDVRPGDWYCNCGAHNFASRSSCFKCAAFKDDAAVNSGGAGAFDGGDMSRSRGYGFGSGAVRASRPGWKSGDWICTRSGCNEHNFASRMECFRCNAPRDSGTEV

SEQ ID NO: 219 - protein, 182 aa, Zea mays
  misc_feature (1)..(182): Ceres CLONE ID no. 1560255
  misc_feature: Utility: Useful for delaying flowering time
  misc_feature: Utility: Useful for increasing chlorophyll and photosynthetic capacity
  misc_feature: Utility: Useful for making larger plants
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with increased biomass and foliage
  misc_feature: Utility: Useful for making smaller plants
  misc_feature: Utility: Useful for making stronger plants
MNRKPGDWDCRACQHLNFSRRDICQRCSEPRGVADRGGGGGGGDYASFGGRGGSSFGGGFGAAGSDVRPGDWYCSCGAHNFASRSSCFKCSAYKEEAAVNSGAGGFDGDMSRSRGYGFGSGAAGAGAGAARTTNRPGWKSGDWICTRSGCNEHNFASRMECFRCNAPRDSGSAAMTYENYLH

SEQ ID NO: 220 - protein, 145 aa, Zea mays
  misc_feature (1)..(145): Public GI no. 5679336
  misc_feature: Utility: Useful for delaying flowering time
  misc_feature: Utility: Useful for increasing chlorophyll and photosynthetic capacity
  misc_feature: Utility: Useful for making larger plants
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with increased biomass and foliage
  misc_feature: Utility: Useful for making smaller plants
  misc_feature: Utility: Useful for making stronger plants
MNIQRKPGDWNCKSCQHLNFSRRDYCQRCHTPRQDLPLGDGYVPGGVLSSLDIRPGDWYCNCGYHNFASRASCFKCGAIVKDLPAGQGGGVANGDFARALDSSAVRAGWKAGDWICTRPGCNVHNFASRIECYRCNAPREAGNVK

SEQ ID NO: 221 - DNA, 960 bp, Arabidopsis thaliana
  misc_feature (1)..(960): Ceres CLONE ID no. 8490
  misc_feature (1)..(960): Also known as  Ceres CDNA ID no. 23371594
atttttgtttctctctttctctctgatatttttcattttcttcttcttctctctctctctccacaaagataagccaacaatggttggtgattacagaggacgctttagtagccgtcgtttctccgatgactctgacgattcttccgacgatgcttcttccgtggagggagagaccacttcttccatgtactctgcggggaaagagtatatggaaacagaatggactaatgagaagcatagtttatatcttaaatctatggaagcttcattcgtagatcagttatataactcgctcggagctctcgggaagaacgagaatgtatccgaatcaacgaggttcggtagcggtagaaaaccgtctcaagaacagttcaaggttcttcatgatggtttctggcagaagattaatgtgaaacaacctgaacatcggattaacggaaggcacggtggtaattctcatgagtttcttaggagtccatggattaagcattataaacctttagtaaagacacaaatcccggtaacggatgagcccgaaaatcaagttgttagcagctctaatgggaagaagggaatatgcagctctggctcagcctctagtctcaagcagctaagctctcattcgcgtgaccacgaccaaatcagcgttggagaagcagaggtatcggatcagaactttgttaacgaaggaataaaaggcgaaaacggaagctcgaagaagatgaagacggtgatgatgagtgaatcgtcgagtaccgatcaggttgttccactcaataaactcttgcaacatgacgtaaatttgaagtctgtttcttgagaggtcagatggtgaagctttatatgaggagagaattttgtaatgtatatatatttgcataacttataagtcaaatatactatccttagttacaagtttcttcatcatatatccctaactataaatatatttatatgccc

SEQ ID NO: 222 - protein, 246 aa, Arabidopsis thaliana
  misc_feature: Utility: Useful for delaying flowering time
  misc_feature: Utility: Useful for making plants with increased size and biomass
  misc_feature: Utility: Useful for making taller plants and plants with longer inflorescences
MVGDYRGRFSSRRFSDDSDDSSDDASSVEGETTSSMYSAGKEYMETEWTNEKHSLYLKSMEASFVDQLYNSLGALGKNENVSESTRFGSGRKPSQEQFKVLHDGFWQKINVKQPEHRINGRHGGNSHEFLRSPWIKHYKPLVKTQIPVTDEPENQVVSSSNGKKGICSSGSASSLKQLSSHSRDHDQISVGEAEVSDQNFVNEGIKGENGSSKKMKTVMMSESSSTDQVVPLNKLLQHDVNLKSVS

SEQ ID NO: 223 - protein, 163 aa, Zea mays
  misc_feature (1)..(163): Ceres CLONE ID no. 305463
  misc_feature: Utility: Useful for delaying flowering time
  misc_feature: Utility: Useful for making plants with increased size and biomass
  misc_feature: Utility: Useful for making taller plants and plants with longer inflorescences
MSAGWTDERHRLYISSMEASFVDQLYNHGSRPRNANGTAFKALRREYVEYEKTDAPVRRGAKCCGVPANPWMQHFRPRSDGGNNARGDGLGDSVGDLESGTEANRKSLSASHGRERDACEGEPQLLHESREVSDQNFADDEAEAETESMKAYKKRRLSRTMIN

SEQ ID NO: 224 - protein, 167 aa, Zea mays
  misc_feature (1)..(167): Ceres CLONE ID no. 258437
  misc_feature: Utility: Useful for delaying flowering time
  misc_feature: Utility: Useful for making plants with increased size and biomass
  misc_feature: Utility: Useful for making taller plants and plants with longer inflorescences
MSAGWTDERHMLYISSMEASFVDQLYNHGNHPHDANGAGFKVLRRGVWEYIEYEKTSAPVRSGAKCCVPANPWIRHFRPRDCGSNAQSDAVEASVGDHESGTQASRKSPSVSHGRERGACKGEPQILHESTEVSDQNFADDEAEAETESMKACKKRRLSRALHSGAE

SEQ ID NO: 225 - protein, 167 aa, Zea mays; identical to SEQ ID NO: 224
  misc_feature (1)..(167): Ceres CLONE ID no. 219341
  misc_feature: Utility: Useful for delaying flowering time
  misc_feature: Utility: Useful for making plants with increased size and biomass
  misc_feature: Utility: Useful for making taller plants and plants with longer inflorescences

SEQ ID NO: 226 - protein, 209 aa, Triticum aestivum
  misc_feature (1)..(209): Ceres CLONE ID no. 929917
  misc_feature: Utility: Useful for delaying flowering time
  misc_feature: Utility: Useful for making plants with increased size and biomass
  misc_feature: Utility: Useful for making taller plants and plants with longer inflorescences
MGEVYLGLDRSARPEPEPADVGIAQGNQVTNLVSAGWTDERHTDYISSMEASFINRLFNHGNNANRKDSGTNGFKVLQGGAGVWKKVEFARPGACAQVGAKQSLPANPWIQHFRSRDCSSSSSSARGDGAQTLVGDHESGIRTTPGGTPLSHGRELGACKGENLLDQNSEVSDQNFADDDEAEVGAESSRTCKKRRLSSSSTYCAQTIQ

SEQ ID NO: 227 - protein, 202 aa, Triticum aestivum
  misc_feature (1)..(202): Ceres CLONE ID no. 923677
  misc_feature: Utility: Useful for delaying flowering time
  misc_feature: Utility: Useful for making plants with increased size and biomass
  misc_feature: Utility: Useful for making taller plants and plants with longer inflorescences
MGEVYLDRSVKPEPADVGIAQGNQVTTLMSAGWTDERHTDYISSMEASFIKRLYNHGNNVNKKDPGTTGFKVLQGGAGVWKKVEFERPNACAQVGAKQNLPANPWIQHFRSRDCSSSARGVGAQTSVGDHESGIRTVPGSTPLSHGRELGACKGENLLDENTEVSDQNFADDDEAEVGAESSKACKKRRLSSSSTYFTQMIQ

SEQ ID NO: 228 - DNA, 1063 bp, Arabidopsis thaliana
  misc_feature (1)..(1063): Ceres CLONE ID no. 8500
  misc_feature (1)..(1063): Also known as  Ceres CDNA ID no. 23357152
atttttcttcagaatctctcaattctcttttgtcgatttcgcagtagaagagtcctttcgccgtctccgagaaactcgttgcagcgtcacgaccagttggagaaaatgtcttctagaggaaaaaggaaagacgaagatgtcagagcatcagatgacgaatctgaaacccacgcgccggctaagaaagtcgcaaagccagcagacgattccgaccagtctgacgatatcgtcgtctgcaacatatctaagaataggagagtctctgtaaggaattggaacgggaagatttggattgacattcgtgagttctatgtcaaggacggaaagactttgcctggcaagaaaggtaactttattttgtaatttaaaccaatgccccttggctctcataattcattatttctagtaatgtgtttcctcatctcttagttttatatttcgttactgttttgctttgttaagtttctgcatttagtcaggtttatagaattgcatatcttagggttttataataggcaattctgcttattgagactgtttatggacttgtaagtatgagcggagatggtgcagagtgtttgcttttgtacaacaacgttttgtttattttggtgctattgctccttcatgtctttctctagagacagctatattagtttatctctacataattaatcatgttgacaagattatctctatgtttgttatacgttgcaggtatctctctaagcgtggatcaggtactcacatctctttctatctctctccactgttttatgtctcctagaagtgtttctgttttcttgttatttgcttattacacagcttttccttaatgcagtggaacactcttcggaaccacgcagaggatatcgagaaggccctctctgacctttcttaggttttaaaacttgtatcattggttgtacgtctattagaatatggctcagttgttttggttgtttttgtagaacaacaccatgttctgctagtgtaagctgcttcaaattagttggtgtatggaatctttcacttttggttcagacaagctttggttggtatt

SEQ ID NO: 229 - protein, 85 aa, Arabidopsis thaliana
  misc_feature (13)..(81): Pfam Name: PC4; Pfam Description: Transcriptional Coactivator p15 (PC4)
  misc_feature: Utility: Useful for delaying flowering time
  misc_feature: Utility: Useful for making lethal plants for genetic confinement systems
  misc_feature: Utility: Useful for making ornamental plants with modified flowers
  misc_feature: Utility: Useful for making plants sterile and for genetic confinement
  misc_feature: Utility: Useful for making plants with increased biomass and foliage
  misc_feature: Utility: Useful for making smaller plants
  misc_feature: Utility: Useful for making taller plants and plants with longer inflorescences
MSSRGKRKDEDVRASDDESETHAPAKKVAKPADDSDQSDDIVVCNISKNRRVSVRNWNGKIWIDIREFYVKDGKTLPGKKGNFIL

SEQ ID NO: 230 - DNA, 1002 bp, Arabidopsis thaliana
  misc_feature (1)..(1002): Ceres CLONE ID no. 9683
  misc_feature (1)..(1002): Also known as  Ceres CDNA ID no. 23387890
attcaatttttggtggtcttttcaaaagtggaaatacaacaaaacaatgtcgggacttagaagattggatggcaagatcgcaattataacaggcggagctagtgggattggagctgaagcggttaggttgttcacggaccatggagctaaagtggtcatcgtggacatacaagaagagcttggccaaaacctcgccgtttcgatagggctagacaaagcaagtttttaccgttgtaatgtaaccgacgagacggatgtcgagaacgccgttaagttcaccgttgaaaaacacggaaagcttgacgttctgtttagtaacgccggggtcttggaagcgtttggaagcgttcttgatttggatcttgaggcgtttgatcgaacgatggcggttaacgttcgcggtgcggctgcgtttatcaaacacgcggcacgttcgatggtggctagtggtactcgtggctccattgtatgtacgacgagtattgcggcagagataggtggtccgggacctcatagttacacggcttctaagcacgcgcttctcgggctgatccgatcagcgtgtgctggactggggcagtacggtattagagtcaacggtgttgcaccgtatggggttgccactgggatgactagcgcctacaatgaggaagcggtgaagatgcttgaagaatatggtgaagccctagggaatctcaaaggtgtggtgcttaaagctcgccacatcgcagaagcagctttgtttttggcttctgatgattcggtttatattagcggtcagaatctggtggttgatggtggttttagcgtcgttaagctcatgagcacgtgagaaacaactaaaaaatgagggcatagactctcttgacactttcattttatttcttgaataaaaattgaatttataagtactttcgatcattgtgttgtatgttaggctcttgagtttatataaaccttgagtttaataatttactttttcttttagtttctcaattctat

SEQ ID NO: 231 - protein, 261 aa, Arabidopsis thaliana
  misc_feature (10)..(177): Pfam Name: adh_short; Pfam Description: short chain dehydrogenase
  misc_feature: Utility: Useful for delaying flowering time
  misc_feature: Utility: Useful for increasing chlorophyll and photosynthetic capacity
  misc_feature: Utility: Useful for making larger plants
  misc_feature: Utility: Useful for making plants sterile and for genetic confinement
  misc_feature: Utility: Useful for making plants with increased biomass and foliage
  misc_feature: Utility: Useful for making smaller plants
MSGLRRLDGKIAIITGGASGIGAEAVRLFTDHGAKVVIVDIQEELGQNLAVSIGLDKASFYRCNVTDETDVENAVKFTVEKHGKLDVLFSNAGVLEAFGSVLDLDLEAFDRTMAVNVRGAAAFIKHAARSMVASGTRGSIVCTTSIAAEIGGPGPHSYTASKHALLGLIRSACAGLGQYGIRVNGVAPYGVATGMTSAYNEEAVKMLEEYGEALGNLKGVVLKARHIAEAALFLASDDSVYISGQNLVVDGGFSVVKLMST

SEQ ID NO: 232 - protein, 257 aa, Arabidopsis thaliana
  misc_feature (1)..(257): Public GI no. 17104783
  misc_feature: Utility: Useful for delaying flowering time
  misc_feature: Utility: Useful for increasing chlorophyll and photosynthetic capacity
  misc_feature: Utility: Useful for making larger plants
  misc_feature: Utility: Useful for making plants sterile and for genetic confinement
  misc_feature: Utility: Useful for making plants with increased biomass and foliage
  misc_feature: Utility: Useful for making smaller plants
MSGKRLDGKIVIITGGASGIGAESVRLFTEHGARVVIVDVQDELGQNVAVSIGEDKASYYHCDVTNETEVENAVKFTVEKYGKLDVLFSNAGVIEPFVSILDLNLNELDRTIAINLRGTAAFIKHAARAMVEKGIRGSIVCTTSVAAEIAGTAPHGYTTSKHGLLGLIKSASGGLGKYGIRVNGVAPFGVATPLVCNGFKMEPNVVEQNTSASANLKGIVLKARHVAEAALFLASDESAYVSGQNLAVDGGYSVVKP

SEQ ID NO: 233 - protein, 275 aa, Glycine max
  misc_feature (1)..(275): Ceres CLONE ID no. 605144
  misc_feature: Utility: Useful for delaying flowering time
  misc_feature: Utility: Useful for increasing chlorophyll and photosynthetic capacity
  misc_feature: Utility: Useful for making larger plants
  misc_feature: Utility: Useful for making plants sterile and for genetic confinement
  misc_feature: Utility: Useful for making plants with increased biomass and foliage
  misc_feature: Utility: Useful for making smaller plants
  misc_feature (227)..(227): Xaa is any aa, unknown, or other
MATSTSALNKRLEGKVALITGGASGIGKRTAEVFAQQGAKVVIADIQDELGHSVAQSIGPSTCCYVHCDVTDENQIKNAVQKAVDAYGKLDIMFNNAGIVDPNKNRIIDNDKADFERVLSVNVTGVFLGMKHAAQAMIPARSGSIISTASISSYVGGAASHAYCCAKHAVVGLTKNAAVELGQFGIRVNCLSPYALATPLATKFVGANDEELETIMNSLANLKGVTXKAEDVANAALYFASDDSRYVSGQNLLIDGGFSIVNPSFHMFQYPDSES

SEQ ID NO: 234 - DNA, 600 bp, Arabidopsis thaliana
  misc_feature (1)..(600): Ceres CLONE ID no. 9897
  misc_feature (1)..(600): Also known as  Ceres CDNA ID no. 23386145
atataaaccctctcggcgctgccattgaaactctttcaaggagagagctgctactctgcaaccatgtcgaagcgaggaagaggaggaacctctggtaacaagttcaggatgtcactgggtcttccagtggcagccactgtgaactgtgctgacaacaccggagctaagaacctttacatcatttcggttaaaggaatcaagggtcgtcttaaccgtttgccatcagcttgtgttggtgatatggttatggctactgttaagaaaggtaagcctgatctccgtaagaaggtgcttcctgctgtcattgttaggcagaggaagccttggcgccgaaaggacggtgtcttcatgtatttcgaagataatgctggtgtcattgtcaatcccaagggtgatatgaaaggatctgctatcactggaccaatcggaaaggagtgtgctgatctgtggccaagaatcgcaagtgctgcgaacgccatcgtttaagcaagcttgagatctctatgttttgtgttgaacgtttagcattatctctatttgggattgttttttgtttttgtcttagacttttgttatgccttaaagctgattctagttctc

SEQ ID NO: 235 - protein, 140 aa, Arabidopsis thaliana
  misc_feature (19)..(140): Pfam Name: Ribosomal_L14; Pfam Description: Ribosomal protein L14p/L23e
  misc_feature: Utility: Useful for delaying flowering time
  misc_feature: Utility: Useful for increasing chlorophyll and photosynthetic capacity
  misc_feature: Utility: Useful for increasing seed/fruit yield or modifying fruit content
  misc_feature: Utility: Useful for making ornamental plants with modified leaves
  misc_feature: Utility: Useful for making plants sterile and for genetic confinement
  misc_feature: Utility: Useful for making plants with increased biomass and foliage
  misc_feature: Utility: Useful for making smaller plants
MSKRGRGGTSGNKFRMSLGLPVAATVNCADNTGAKNLYIISVKGIKGRLNRLPSACVGDMVMATVKKGKPDLRKKVLPAVIVRQRKPWRRKDGVFMYFEDNAGVIVNPKGDMKGSAITGPIGKECADLWPRIASAANAIV

SEQ ID NO: 236 - protein, 140 aa, Brassica napus
  misc_feature (1)..(140): Ceres CLONE ID no. 1083013
  misc_feature: Utility: Useful for delaying flowering time
  misc_feature: Utility: Useful for increasing chlorophyll and photosynthetic capacity
  misc_feature: Utility: Useful for increasing seed/fruit yield or modifying fruit content
  misc_feature: Utility: Useful for making ornamental plants with modified leaves
  misc_feature: Utility: Useful for making plants sterile and for genetic confinement
  misc_feature: Utility: Useful for making plants with increased biomass and foliage
  misc_feature: Utility: Useful for making smaller plants
MSKRGRGGTSGNKFRMSLGLPVAATVNCADNTGAKNLYIISVKGIKGRLNRLPSACVGDMVMATVKKGKPDLRKKVMPAVIVRQRKPWRRKDGVFMYFEDNAGVIVNPKGEMKGSAITGPIGKECADLWPRIASAANAIV

SEQ ID NO: 237 - protein, 140 aa, Brassica napus
  misc_feature (1)..(140): Public GI no. 13430182
  misc_feature: Utility: Useful for delaying flowering time
  misc_feature: Utility: Useful for increasing chlorophyll and photosynthetic capacity
  misc_feature: Utility: Useful for increasing seed/fruit yield or modifying fruit content
  misc_feature: Utility: Useful for making ornamental plants with modified leaves
  misc_feature: Utility: Useful for making plants sterile and for genetic confinement
  misc_feature: Utility: Useful for making plants with increased biomass and foliage
  misc_feature: Utility: Useful for making smaller plants
MSKRGRGGSAGNKFRMSLGLPVAATVNCADNTGAKNLYIISVKGIKGRLNRLPSACVGDMVMATVKKGKPDLRKKVLPAVIVRQRKPWRRKDGVFMYFEDNAGVIVNPKGEMKGSAITGPIGKECADLWPRIASAANAIV

SEQ ID NO: 238 - protein, 140 aa, Triticum aestivum
  misc_feature (1)..(140): Ceres CLONE ID no. 568627
  misc_feature: Utility: Useful for delaying flowering time
  misc_feature: Utility: Useful for increasing chlorophyll and photosynthetic capacity
  misc_feature: Utility: Useful for increasing seed/fruit yield or modifying fruit content
  misc_feature: Utility: Useful for making ornamental plants with modified leaves
  misc_feature: Utility: Useful for making plants sterile and for genetic confinement
  misc_feature: Utility: Useful for making plants with increased biomass and foliage
  misc_feature: Utility: Useful for making smaller plants
MSKRGRGGSAGNKFRMSLGLPVAATVNCADNTGAKNLYIISVKGIKGRLNRLPSACVGDMVMATVKKGKPDLRKKVMPAVIVRQRKPWRRKDGVFMYFEDNAGVIVNPKGEMKGSAITGPIGKECADLWPRIASAANAIV

SEQ ID NO: 239 - protein, 140 aa, Glycine max; identical to SEQ ID NO: 238
  misc_feature (1)..(140): Ceres CLONE ID no. 1073644
  misc_feature: Utility: Useful for delaying flowering time
  misc_feature: Utility: Useful for increasing chlorophyll and photosynthetic capacity
  misc_feature: Utility: Useful for increasing seed/fruit yield or modifying fruit content
  misc_feature: Utility: Useful for making ornamental plants with modified leaves
  misc_feature: Utility: Useful for making plants sterile and for genetic confinement
  misc_feature: Utility: Useful for making plants with increased biomass and foliage
  misc_feature: Utility: Useful for making smaller plants

SEQ ID NO: 240 - protein, 140 aa, Zea mays; identical to SEQ ID NO: 238
  misc_feature (1)..(140): Ceres CLONE ID no. 1447299
  misc_feature: Utility: Useful for delaying flowering time
  misc_feature: Utility: Useful for increasing chlorophyll and photosynthetic capacity
  misc_feature: Utility: Useful for increasing seed/fruit yield or modifying fruit content
  misc_feature: Utility: Useful for making ornamental plants with modified leaves
  misc_feature: Utility: Useful for making plants sterile and for genetic confinement
  misc_feature: Utility: Useful for making plants with increased biomass and foliage
  misc_feature: Utility: Useful for making smaller plants

SEQ ID NO: 241 - protein, 140 aa, Parthenium argentatum; identical to SEQ ID NO: 238
  misc_feature (1)..(140): Ceres CLONE ID no. 1605872
  misc_feature: Utility: Useful for delaying flowering time
  misc_feature: Utility: Useful for increasing chlorophyll and photosynthetic capacity
  misc_feature: Utility: Useful for increasing seed/fruit yield or modifying fruit content
  misc_feature: Utility: Useful for making ornamental plants with modified leaves
  misc_feature: Utility: Useful for making plants sterile and for genetic confinement
  misc_feature: Utility: Useful for making plants with increased biomass and foliage
  misc_feature: Utility: Useful for making smaller plants

SEQ ID NO: 242 - DNA, 1533 bp, Arabidopsis thaliana
  misc_feature (1)..(1533): Ceres CLONE ID no. 12272
  misc_feature (1)..(1533): Also known as  Ceres CDNA ID no. 23359650
aaaaaaagctttgaaattctctctcgacaatggtgtcggaccaggatctagcgaaaggagtcgagactttgcttcgacaatccgaccctagctctctcacatcgttaagcagtattgttcagcagcttgaagctaagttagggttagacctcacggagaagacgactttcatcagagatcagatcaatatcctcctccgtgctcaccaaaacccttctgcctccgtcgcctccgcttcatccgtacaacaatctcaccctcctcctccgccgtcttctcaccagcagcagaatttgcattccggcgtcaatgttcctccgatggcgaaagggcatttcacacttagccatccttcgcaattctctgtttcttctcaatcacaacaatatccttcacatttcgctcttcagcctccttatcactcttatgacctaaatttccggcagccttatccggtttacatgccgccgcaacagcaccagcatcagcagcagtctccgcgacaacaacaatcctctgtgatgctctcacatggcgggaatgcttctctatctgttaatcaagccccaaaagaaagtgctccggctggaactaaaagaaagggtggtcctggaggactaaacaaagtctgtagggtttctccagaacttgaagtagttgttggtgaacctgctcttcctagaactgagattgtgaggcaattgtgggcttatataaggaagaataaccttcaagacccgagtaacaagcggaagatcatctgtgatgatgcgttgcgtgtggtttttgagactgattgcactgacatgttcaagatgaataagttgcttgctaagcatattctcccgcttgatccatcaaaggactctggtcaagcaaaaaaggcaaaaactgaggtggagactaagactgagaccaccgagcctgttagttcaactgctattagttcaactgttacattatctgagccacttggtaagttctttggcactggtgagacggagatggcagacgaagagattattcgccgtgtttgggaatacataaaactcaacaatttagaggacccagtaaatccaatggctattcagtgtgatgaaaagctccgagatcttcttggatgtgaaagcatttcagctgtggggataaatgagatgctgaggcgccatatgtacaagcagtcgtgatatcttctggtctgacttaattaactaggaactactagtgtgtgtatctagggaacctacttatgactccttgctgtagaactctgatagggaagaaaagatcctttttcacttttaacttcctttaatgctattttaatcttccgttgggttctttgttttagttggttgtgtatcgacatgcttaggttgatgttgtatttagtattgtaccgaaactctagtgttaagggtgaaacggcgcagatgttttgtattaaacgccattcacccatgaatgtcttaggaaaaaaaaactcatgtgtttaactatgttttccctgttggaaatatttgcatcctactg

SEQ ID NO: 243 - protein, 385 aa, Arabidopsis thaliana
  misc_feature (197)..(272): Pfam Name: SWIB; Pfam Description: SWIB/MDM2 domain
  misc_feature: Utility: Useful for delaying flowering time
  misc_feature: Utility: Useful for making larger plants
  misc_feature: Utility: Useful for making ornamental plants with modified leaves
  misc_feature: Utility: Useful for making plants with altered leaf shape eg curled leaves
  misc_feature: Utility: Useful for making plants with enhanced abiotic stress tolerance
  misc_feature: Utility: Useful for making plants with increased biomass
  misc_feature: Utility: Useful for making plants with increased biomass and foliage
  misc_feature: Utility: Useful for making smaller plants
MVSDQDLAKGVETLLRQSDPSSLTSLSSIVQQLEAKLGLDLTEKTTFIRDQINILLRAHQNPSASVASASSVQQSHPPPPPSSHQQQNLHSGVNVPPMAKGHFTLSHPSQFSVSSQSQQYPSHFALQPPYHSYDLNFRQPYPVYMPPQQHQHQQQSPRQQQSSVMLSHGGNASLSVNQAPKESAPAGTKRKGGPGGLNKVCRVSPELEVVVGEPALPRTEIVRQLWAYIRKNNLQDPSNKRKIICDDALRVVFETDCTDMFKMNKLLAKHILPLDPSKDSGQAKKAKTEVETKTETTEPVSSTAISSTVTLSEPLGKFFGTGETEMADEEIIRRVWEYIKLNNLEDPVNPMAIQCDEKLRDLLGCESISAVGINEMLRRHMYKQS

SEQ ID NO: 244 - protein, 329 aa, Glycine max
  misc_feature (1)..(329): Ceres CLONE ID no. 541471
  misc_feature: Utility: Useful for delaying flowering time
  misc_feature: Utility: Useful for making larger plants
  misc_feature: Utility: Useful for making ornamental plants with modified leaves
  misc_feature: Utility: Useful for making plants with altered leaf shape eg curled leaves
  misc_feature: Utility: Useful for making plants with enhanced abiotic stress tolerance
  misc_feature: Utility: Useful for making plants with increased biomass
  misc_feature: Utility: Useful for making plants with increased biomass and foliage
  misc_feature: Utility: Useful for making smaller plants
MVTDQDIAKGVESLLRHSDPNSITTVNGVVQQLEAKLGLDLSHKASFIRDQIDHLLRSQPQTFAPHPPPLHKDYFAPHTQLHFPTTHFAPHFALHDEINFLQHPHPPPPRKVETFPPQNVAPPQVPKESVQTGSKRRGGAGGLNKVCGVSPELQAVVGEPAMPRTEIVRQLWAYIKKNNLQDPGNKRKIICDDALRLVFETDCTDMFKMNQLLAKHIIPLGPTKESQAKRVKVDTEIKTESAEPAPSTVAISEALAKFLGTEGREMQQSEAIRLVWEYIKLHHLEDPLNSMVILCDAKLQELLGCESISALGIPEMLARHHLFKQSDTR

SEQ ID NO: 245 - protein, 329 aa, Glycine max; identical to SEQ ID NO: 244
  misc_feature (1)..(329): Ceres CLONE ID no. 528932
  misc_feature: Utility: Useful for delaying flowering time
  misc_feature: Utility: Useful for making larger plants
  misc_feature: Utility: Useful for making ornamental plants with modified leaves
  misc_feature: Utility: Useful for making plants with altered leaf shape eg curled leaves
  misc_feature: Utility: Useful for making plants with enhanced abiotic stress tolerance
  misc_feature: Utility: Useful for making plants with increased biomass
  misc_feature: Utility: Useful for making plants with increased biomass and foliage
  misc_feature: Utility: Useful for making smaller plants

SEQ ID NO: 246 - protein, 128 aa, Glycine max
  misc_feature (1)..(128): Ceres CLONE ID no. 855912
  misc_feature: Utility: Useful for delaying flowering time
  misc_feature: Utility: Useful for making larger plants
  misc_feature: Utility: Useful for making ornamental plants with modified leaves
  misc_feature: Utility: Useful for making plants with altered leaf shape eg curled leaves
  misc_feature: Utility: Useful for making plants with enhanced abiotic stress tolerance
  misc_feature: Utility: Useful for making plants with increased biomass
  misc_feature: Utility: Useful for making plants with increased biomass and foliage
  misc_feature: Utility: Useful for making smaller plants
MVTDQDIAKGVESLLRHSDPNSITTVNGVVQQLEAKLGLDLSHKASFIRDQIDHLLRSQPQAFVPHPPPLHKDYFAPHPQPHFPTTHFPSHFALHDEINFQQHPRAPPPCKVETFPPQNAHTVAPPQV

SEQ ID NO: 247 - protein, 330 aa, Glycine max
  misc_feature (1)..(330): Ceres CLONE ID no. 563093
  misc_feature: Utility: Useful for delaying flowering time
  misc_feature: Utility: Useful for making larger plants
  misc_feature: Utility: Useful for making ornamental plants with modified leaves
  misc_feature: Utility: Useful for making plants with altered leaf shape eg curled leaves
  misc_feature: Utility: Useful for making plants with enhanced abiotic stress tolerance
  misc_feature: Utility: Useful for making plants with increased biomass
  misc_feature: Utility: Useful for making plants with increased biomass and foliage
  misc_feature: Utility: Useful for making smaller plants
MVTEEEISEAVQSLLRESNPSRFTTLNQVVEELQAKLGHDLTHKIDFITAQINLLFGSRQPPQNPHRQLQQPKDHFAPPPNPNFHSAPVSVGFQLQNFSSSNAVVAAATAADASRIEAPSAPVVVEGNQVPKESTQTKVKRRGGPGGLTKICGVSPELQVIVGQPALSRTEIVKQLWAYIRKNNLQDPSNKRKIICNDELRVVFETDCTDMFKMNKLLSKHIIPLEPTKKPVPKKQKVDVESGTRSAEPTPSVIISDALANFFGITGREMLQSEVLRRIWEYIKVNQLEDPANPMAIVCDGKLQEIFGCESISALGIPEVLGRHHIFRSS

SEQ ID NO: 248 - protein, 387 aa, Zea mays
  misc_feature (1)..(387): Ceres CLONE ID no. 246369
  misc_feature: Utility: Useful for delaying flowering time
  misc_feature: Utility: Useful for making larger plants
  misc_feature: Utility: Useful for making ornamental plants with modified leaves
  misc_feature: Utility: Useful for making plants with altered leaf shape eg curled leaves
  misc_feature: Utility: Useful for making plants with enhanced abiotic stress tolerance
  misc_feature: Utility: Useful for making plants with increased biomass
  misc_feature: Utility: Useful for making plants with increased biomass and foliage
  misc_feature: Utility: Useful for making smaller plants
MVSDQEIASCVESVLRGSAGGPGEVSLTAVLQQAEATLGVDLSHKAGFIRDQMDLFFGPRLQPQPLTTPQLAPPPPQAVVAPADAVPQPQPQHQVLPQAPPSAQQMQPQQLAPLQPQLMFQTIHQLPAISPVPVVSAPPAMAFYPPPPLAFRYTTGLAGAATGGTVSFQQPAPGAGGTASPTAAPQVAGDNKESSSKRKRGGPGGLNKVCAISPELQTIVGETAMSRTQIVKQLWAYIRQNNLQDPDDKRKIICNDELRVVFETDTTDMFKMNKLLAKHITPLDPKSQLHEVKRMKAPTMSPQPGRPIDQPSIVISDALAKFIGTDGTFPQDDALKYLWDYIKANQLEDVINESILCDSKLQELFGCESIPMSGLSEMLGHHFIKKT

SEQ ID NO: 249 - DNA, 851 bp, Arabidopsis thaliana
  misc_feature (1)..(851): Ceres CLONE ID no. 12514
  misc_feature (1)..(851): Also known as  Ceres CDNA ID no. 23383342
ataagatcttctttaaaatccaaaatcgtaggccactatttcattatacttatgtaatatatgtgatacagatacatctatatacaaattaaacacgaaaccatacatgcacggtgtgatcacacacgcacacacatagaaacataaacacgcaataatttctatacagtttaatttcatttttaacttacttctttttttttggtgaagattcttgagagaaaagaaatcgaagatggcaacaaaatccaccggaggtaccgagaaaaccaagtcgatagaagtgaagaagaaactaatcaacgtgttgatcgtcgatgatgatccattaaaccgtagactccacgagatgatcatcaaaacgatcggaggaatttctcagactgcaaagaatggcgaggaggcagtgatcctccaccgtgacggcgaagcatctttcgaccttattctaatggataaggaaatgcctgagagggatggagtttcgacaactaagaagctaagagaaatgaaagtgacgtcaatgatcgttggggtaacgtcattagctgaccaagaagaagagcgtaaggcttttatggaagctgggctcaaccattgcttggaaaaacccttaaccaaggccaagatcttcccgctcattagccacctcttcgatgcttgatggatgaaggctcattaatgtatctatattttcaatcatgaaatcacctacacgtgtatttgacacaaaaatctgcatttgttgtgatatagggtttctcatatctatgtttgatttattttcttatcgtccgaggtaaaatcatgcaagtcatttcttttggctaataaaatattaaaataagggc

SEQ ID NO: 250 - protein, 71 aa, Arabidopsis thaliana
  misc_feature (22)..(36): Pfam Name: Response_reg; Pfam Description: Response regulator receiver domain
  misc_feature: Utility: Useful for delaying flowering time
  misc_feature: Utility: Useful for increasing chlorophyll and photosynthetic capacity
  misc_feature: Utility: Useful for making plants with enhanced abiotic stress tolerance
  misc_feature: Utility: Useful for making plants with increased biomass and foliage
  misc_feature: Utility: Useful for making smaller plants
MATKSTGGTEKTKSIEVKKKLINVLIVDDDPLNRRLHEMIIKTIGGISQTAKNGEEAVILHRDGEHLSTLF

SEQ ID NO: 251 - DNA, 472 bp, Arabidopsis thaliana
  misc_feature (1)..(472): Ceres CLONE ID no. 12935
  misc_feature (1)..(472): Also known as  Ceres CDNA ID no. 23356753
aaccaccattcaattttctataaagagataacaaacttcagaaacttctagggccatttttattccggtgcatcctaatcatgatatctgttgtaatcatcactgagttacttttggagtacacgacggctcttgctaaactcaccgccggggttcttccgagacggcaaggcgacagaaatgttatacgtattggcggtttctctctgccttgtcctcctagatcctcacctgttccagatttttcttctcatcttgtcgatttctgaactctgcgctacgccttaatctcaattttggtttttcaccggagattatgactgccaagacttttttcccggcgtctgatctctccgtctgtagaataccttttttgtattttcttaaattttttttttgttcctgaattttgaatggctcagagttgtaaaagatgtatcgaattataatagagactatgatttaactcttc

SEQ ID NO: 252 - protein, 62 aa, Arabidopsis thaliana
  misc_feature: Utility: Useful for delaying flowering time
  misc_feature: Utility: Useful for making ornamental plants with modified flowers
  misc_feature: Utility: Useful for making ornamental plants with modified leaves
  misc_feature: Utility: Useful for making plants with increased biomass
  misc_feature: Utility: Useful for making plants with increased biomass and foliage
  misc_feature: Utility: Useful for making smaller plants
  misc_feature: Utility: Useful for modifying plant architecture, ie amount of  branching
MISVVIITELLLEYTTALAKLTAGVLPRRQGDRNVIRIGGFSLPCPPRSSPVPDFSSHLVDF

SEQ ID NO: 253 - protein, 70 aa, Arabidopsis thaliana
  misc_feature (1)..(70): Ceres CLONE ID no. 1025550
  misc_feature: Utility: Useful for delaying flowering time
  misc_feature: Utility: Useful for making ornamental plants with modified flowers
  misc_feature: Utility: Useful for making ornamental plants with modified leaves
  misc_feature: Utility: Useful for making plants with increased biomass
  misc_feature: Utility: Useful for making plants with increased biomass and foliage
  misc_feature: Utility: Useful for making smaller plants
  misc_feature: Utility: Useful for modifying plant architecture, ie amount of  branching
MISVVIIAELLVEYTTALAKLTAGILPSRRRGDSNVVRIGGFSLPCPSPSSSSTSRSSAIPDFSSHLVDF

SEQ ID NO: 254 - protein, 70 aa, Arabidopsis thaliana; identical to SEQ ID NO: 253
  misc_feature (1)..(70): Public GI no. 21593750
  misc_feature: Utility: Useful for delaying flowering time
  misc_feature: Utility: Useful for making ornamental plants with modified flowers
  misc_feature: Utility: Useful for making ornamental plants with modified leaves
  misc_feature: Utility: Useful for making plants with increased biomass
  misc_feature: Utility: Useful for making plants with increased biomass and foliage
  misc_feature: Utility: Useful for making smaller plants
  misc_feature: Utility: Useful for modifying plant architecture, ie amount of  branching

SEQ ID NO: 255 - protein, 62 aa, Arabidopsis thaliana
  misc_feature (1)..(62): Ceres CLONE ID no. 8827
  misc_feature: Utility: Useful for delaying flowering time
  misc_feature: Utility: Useful for making ornamental plants with modified flowers
  misc_feature: Utility: Useful for making ornamental plants with modified leaves
  misc_feature: Utility: Useful for making plants with increased biomass
  misc_feature: Utility: Useful for making plants with increased biomass and foliage
  misc_feature: Utility: Useful for making smaller plants
  misc_feature: Utility: Useful for modifying plant architecture, ie amount of  branching
MISIVIITELLVEYTTALAKLTAGILPRRQGDGDVVRIGGFSLYCPPRSSPIPDFSSHLVNF

SEQ ID NO: 256 - protein, 62 aa, Arabidopsis thaliana; identical to SEQ ID NO: 255
  misc_feature (1)..(62): Public GI no. 21617917
  misc_feature: Utility: Useful for delaying flowering time
  misc_feature: Utility: Useful for making ornamental plants with modified flowers
  misc_feature: Utility: Useful for making ornamental plants with modified leaves
  misc_feature: Utility: Useful for making plants with increased biomass
  misc_feature: Utility: Useful for making plants with increased biomass and foliage
  misc_feature: Utility: Useful for making smaller plants
  misc_feature: Utility: Useful for modifying plant architecture, ie amount of  branching

SEQ ID NO: 257 - protein, 62 aa, Brassica napus
  misc_feature (1)..(62): Ceres CLONE ID no. 951883
  misc_feature: Utility: Useful for delaying flowering time
  misc_feature: Utility: Useful for making ornamental plants with modified flowers
  misc_feature: Utility: Useful for making ornamental plants with modified leaves
  misc_feature: Utility: Useful for making plants with increased biomass
  misc_feature: Utility: Useful for making plants with increased biomass and foliage
  misc_feature: Utility: Useful for making smaller plants
  misc_feature: Utility: Useful for modifying plant architecture, ie amount of  branching
MISVVIITELLVEYTTALAKLAAGILPRRRGDGDVIRIGGFSLRFPSRSTPVPDFSSHLVDF

SEQ ID NO: 258 - protein, 68 aa, Brassica napus
  misc_feature (1)..(68): Ceres CLONE ID no. 1126078
  misc_feature: Utility: Useful for delaying flowering time
  misc_feature: Utility: Useful for making ornamental plants with modified flowers
  misc_feature: Utility: Useful for making ornamental plants with modified leaves
  misc_feature: Utility: Useful for making plants with increased biomass
  misc_feature: Utility: Useful for making plants with increased biomass and foliage
  misc_feature: Utility: Useful for making smaller plants
  misc_feature: Utility: Useful for modifying plant architecture, ie amount of  branching
MISVVILAELLVEYTSAIAKLTVGMLPRRQSGDSNVVRVGGFILPCPSPTSTNRSSPFPDFSSHLVDF

SEQ ID NO: 259 - protein, 62 aa, Brassica napus
  misc_feature (1)..(62): Ceres CLONE ID no. 1070103
  misc_feature: Utility: Useful for delaying flowering time
  misc_feature: Utility: Useful for making ornamental plants with modified flowers
  misc_feature: Utility: Useful for making ornamental plants with modified leaves
  misc_feature: Utility: Useful for making plants with increased biomass
  misc_feature: Utility: Useful for making plants with increased biomass and foliage
  misc_feature: Utility: Useful for making smaller plants
  misc_feature: Utility: Useful for modifying plant architecture, ie amount of  branching
  misc_feature (33)..(33): Xaa is any aa, unknown, or other
  misc_feature (35)..(35): Xaa is any aa, unknown, or other
  misc_feature (50)..(50): Xaa is any aa, unknown, or other
  misc_feature (52)..(52): Xaa is any aa, unknown, or other
  misc_feature (61)..(61): Xaa is any aa, unknown, or other
MISVVIITELLVEYTTALAKLTAGILPRRRGDXDXIRIGGFSLRFPSRSXPXPDFSSHLVXF

SEQ ID NO: 260 - protein, 63 aa, Zea mays
  misc_feature (1)..(63): Ceres CLONE ID no. 1461734
  misc_feature: Utility: Useful for delaying flowering time
  misc_feature: Utility: Useful for making ornamental plants with modified flowers
  misc_feature: Utility: Useful for making ornamental plants with modified leaves
  misc_feature: Utility: Useful for making plants with increased biomass
  misc_feature: Utility: Useful for making plants with increased biomass and foliage
  misc_feature: Utility: Useful for making smaller plants
  misc_feature: Utility: Useful for modifying plant architecture, ie amount of  branching
MISVVIITEYLVEYTTALAKLTAGILPRRTGDRNVLRIGGFLLPSPSSAVSRIPDFSAHLVDF

SEQ ID NO: 261 - protein, 62 aa, Brassica napus
  misc_feature (1)..(62): Ceres CLONE ID no. 1127491
  misc_feature: Utility: Useful for delaying flowering time
  misc_feature: Utility: Useful for making ornamental plants with modified flowers
  misc_feature: Utility: Useful for making ornamental plants with modified leaves
  misc_feature: Utility: Useful for making plants with increased biomass
  misc_feature: Utility: Useful for making plants with increased biomass and foliage
  misc_feature: Utility: Useful for making smaller plants
  misc_feature: Utility: Useful for modifying plant architecture, ie amount of  branching
  misc_feature (8)..(8): Xaa is any aa, unknown, or other
  misc_feature (10)..(10): Xaa is any aa, unknown, or other
  misc_feature (22)..(22): Xaa is any aa, unknown, or other
  misc_feature (26)..(26): Xaa is any aa, unknown, or other
  misc_feature (28)..(28): Xaa is any aa, unknown, or other
  misc_feature (30)..(30): Xaa is any aa, unknown, or other
  misc_feature (34)..(34): Xaa is any aa, unknown, or other
  misc_feature (44)..(44): Xaa is any aa, unknown, or other
  misc_feature (62)..(62): Xaa is any aa, unknown, or other
MISVVIIXEXLLEYTAALAKLXAGIXPXRXGDGXVVRIGGFSLXCPPRSSPIPDFSSHLVDX

SEQ ID NO: 262 - DNA, 736 bp, Arabidopsis thaliana
  misc_feature (1)..(736): Ceres CLONE ID no. 13092
  misc_feature (1)..(736): Also known as  Ceres CDNA ID no. 23383122
aaataattttaattagtttcttctgtgcgatagagatcgatcgagagatgggtgcttcatcatcatcatctgtgtcggagaaatcaatccatcaattcaccgtcaaggatagctccggcaaggaggttgacctaagcgtgtatcaagggaaagtgctgctcgtcgtcaacgtcgcttctaaatgcggattcacggagtccaattacacccagctgacggaactttaccggaaatataaagatcaaggttttgtggtattggcgtttccttgcaaccagtttctgtcccaagagcctggcaccagcgaagaggctcatcaatttgcttgtactcgctttaaggctgaataccctgttttccaaaaggtgcgtgtaaatggacaaaacgctgcaccagtctacaaattcctcaaatctaagaaaccctcttttcttggaagtcgtatcaaatggaacttcaccaagttcttggtcggcaaagatggtcaagtaattgatcgttatggcacaactgtttcacctctatccatccagaaagacatcgagaaagcccttgcacaagaattgtgaacacgcacagagatatttgactcctttggaagaaacttctctcatactctcggtcatgcagtcaagtttctacatttcccattgcaccttccatatgggccttgtattcatcttatgtgtaactctactagccatttcttttgtgaaatttgatcaaaggtgattcc

SEQ ID NO: 263 - protein, 173 aa, Arabidopsis thaliana
  misc_feature (13)..(122): Pfam Name: GSHPx; Pfam Description: Glutathione peroxidase
  misc_feature: Utility: Useful for delaying flowering time
  misc_feature: Utility: Useful for increasing seed/fruit yield or modifying fruit content
  misc_feature: Utility: Useful for making plants sterile and for genetic confinement
  misc_feature: Utility: Useful for making smaller plants
MGASSSSSVSEKSIHQFTVKDSSGKEVDLSVYQGKVLLVVNVASKCGFTESNYTQLTELYRKYKDQGFVVLAFPCNQFLSQEPGTSEEAHQFACTRFKAEYPVFQKVRVNGQNAAPVYKFLKSKKPSFLGSRIKWNFTKFLVGKDGQVIDRYGTTVSPLSIQKDIEKALAQEL

SEQ ID NO: 264 - protein, 171 aa, Arabidopsis thaliana
  misc_feature (1)..(171): Public GI no. 25285637
  misc_feature: Utility: Useful for delaying flowering time
  misc_feature: Utility: Useful for increasing seed/fruit yield or modifying fruit content
  misc_feature: Utility: Useful for making plants sterile and for genetic confinement
  misc_feature: Utility: Useful for making smaller plants
MGASASVPERSVHQFTVKDSSGKDLNMSIYQGKVLLIVNVASKCGFTETNYTQLTELYRKYKDQDFEILAFPCNQFLYQEPGTSQEAHEFACERFKAEYPVFQKVRVNGQNAAPIYKFLKASKPTFLGSRIKWNFTKFLVGKDGLVIDRYGTMVTPLSIEVSVLYISKVPM

SEQ ID NO: 265 - protein, 170 aa, Zea mays
  misc_feature (1)..(170): Ceres CLONE ID no. 288261
  misc_feature: Utility: Useful for delaying flowering time
  misc_feature: Utility: Useful for increasing seed/fruit yield or modifying fruit content
  misc_feature: Utility: Useful for making plants sterile and for genetic confinement
  misc_feature: Utility: Useful for making smaller plants
MGAAESVPETSIHEFTVKDCNGKEVSLETYKGKVLLVVNVASKCGFTETNYTQLTELYQKYRDKDFEILAFPCNQFLRQEPGTDQQIQDFACTRFKAEYPVFQKVRVNGPDAAPVYKFLKASKPGLFGSSRIKWNFTKFLVDKDGKVIERYGTSTAPMAIEKDIQKALEE

SEQ ID NO: 266 - protein, 169 aa, Zea mays
  misc_feature (1)..(169): Public GI no. 27544804
  misc_feature: Utility: Useful for delaying flowering time
  misc_feature: Utility: Useful for increasing seed/fruit yield or modifying fruit content
  misc_feature: Utility: Useful for making plants sterile and for genetic confinement
  misc_feature: Utility: Useful for making smaller plants
MAAAASSASSVHDFTVKDASGKDVDLSTYKGKVLLIVNVASQCGLTNSNYTELAQLYEKYKDQGFEILAFPCNQFGGQEPGTNEEIVQFACTRFKAEYPIFDKVDVNGDNVAPVYKFLKSSKGSLFGDNIKWNFSKFLVDKDGNVVDRYAPTTSPLSIEKDIKKLLASS

SEQ ID NO: 267 - protein, 169 aa, Zea mays
  misc_feature (1)..(169): Public GI no. 11544696
  misc_feature: Utility: Useful for delaying flowering time
  misc_feature: Utility: Useful for increasing seed/fruit yield or modifying fruit content
  misc_feature: Utility: Useful for making plants sterile and for genetic confinement
  misc_feature: Utility: Useful for making smaller plants
MGAAESVPETSIHEFTVKDCNGKEVSLEMYKGKVLIVVNVASKCGFTETNYTQLTELYQKHRDKDFEILAFPCNQFLRQEPGSDQQIKDFACTRFKAEYPVFQKVRVNGPDAAPLYKFLKASKPGLFGSRIKWNFTKFLIDKNGKVINRYSTATSPLSFEKDILKALED

SEQ ID NO: 268 - protein, 187 aa, Glycine max
  misc_feature (1)..(187): Ceres CLONE ID no. 1059504
  misc_feature: Utility: Useful for delaying flowering time
  misc_feature: Utility: Useful for increasing seed/fruit yield or modifying fruit content
  misc_feature: Utility: Useful for making plants sterile and for genetic confinement
  misc_feature: Utility: Useful for making smaller plants
MGASESVPETSVHEFTVKDCNGKEVCLDTYKGKVLLIVNVASKCGFTETNYTQLTELYQKYREKDFEILAFPCNQFLRQEPGSDQQIQDFACTRFKAEYPVFQKVRVNGPDAAPLYKFLKASKPGLFGSRIKWNFTKFLVDKNGKVINRYATATTPFSFEKDIQKALEEEPSDSQTKKEEESSDSQK

SEQ ID NO: 269 - protein, 187 aa, Triticum aestivum
  misc_feature (1)..(187): Ceres CLONE ID no. 639745
  misc_feature: Utility: Useful for delaying flowering time
  misc_feature: Utility: Useful for increasing seed/fruit yield or modifying fruit content
  misc_feature: Utility: Useful for making plants sterile and for genetic confinement
  misc_feature: Utility: Useful for making smaller plants
MGASESVLETSVHEFTVKDCNGKEVCLDTYKGKVLLIVNVASKCGFTETNYTQLTELYQKYREKDFEILAFPCNQFLRQEPGSDQQIQDFACTRFKAEYPVFQKVRVNGPDAAPLYKFLKANKPGLFGSRIKWNFTKFLVDKNGKVINRYATATTPFSFEKDIQKALEEEPSDSQTKKEEESSDSQK

SEQ ID NO: 270 - DNA, 1199 bp, Arabidopsis thaliana
  misc_feature (1)..(1199): Ceres CLONE ID no. 13263
  misc_feature (1)..(1199): Also known as  Ceres CDNA ID no. 23368972
agtgtctcttcatatttacataaatagatatctctctctctctctctctaaaccacatcttcctctccaccgttctttctcttccttctctctctggacttcaacttctggagaagtacaagacatttataaagtactgctcatcacccaacactaaacacaattgtcaaaagggtgtggtggaaggagaatctacttctatctgaacatcgatcagtcatatcttttcaatcaaatcaaagccctcctctctctcttactccttttttgttttaaatcaagaaaaagactccatgtcgagcatgtccatgtcgtcctcctcagctccagcttttccaccggaccacttctcatctacggaccagctctgttacgtccattgcagcttctgcgacactgtccttgctgtgagtgttcctccgagtagtttgttcaagacggtgacggtcagatgcggccactgttcgaaccttttgtcggtgaccgtgagcatgagagctcttcttcttccatccgtttccaaccttggccattcctttttacctccccctcctcctcctcctcctccaaatcttttggaggaaatgcgaagcggagggcagaatataaacatgaacatgatgatgagccatcacgcttcagctcaccacccgaacgagcatttggttatggcgactcgcaacggaagatcagtggatcatctacaagagatgcctcggccaccaccagccaatagacccccagagaagcgacaaagagtaccatctgcatacaaccgattcatcaaagaggagatccaacgtataaaggcaggcaaccctgatatcagccacagagaagccttcagtgctgctgccaaaaactgggctcatttccctcacatacactttggactcatggctgaccatcctcccacgaagaaggctaacgtgcgccaacaggaaggagaggatgggatgatgggaagagaagggttttacggttcagctgccaacgttggggtggcccataactagctacgaagactttcccaatcttttgtaatcttcaaaatgtggttactttcagctcaaacttaactttcttattactattttatgatatttgataatctatcaggagaccttttttttttttcttaaagaaattttcggaactactagaattttctcttggaattgaaaatatattgttttccc

SEQ ID NO: 271 - protein, 240 aa, Arabidopsis thaliana
  misc_feature (16)..(201): Pfam Name: YABBY; Pfam Description: YABBY protein
  misc_feature: Utility: Useful for delaying flowering time
  misc_feature: Utility: Useful for delaying senescence
  misc_feature: Utility: Useful for increasing chlorophyll and photosynthetic capacity
  misc_feature: Utility: Useful for increasing increasing anthocyanin content
  misc_feature: Utility: Useful for increasing seed/fruit yield or modifying fruit content
  misc_feature: Utility: Useful for making ornamental plants with modified leaves
  misc_feature: Utility: Useful for making plants sterile and for genetic confinement
  misc_feature: Utility: Useful for making plants with altered leaf shape eg curled leaves
  misc_feature: Utility: Useful for making plants with increased biomass and foliage
  misc_feature: Utility: Useful for making smaller plants
MSSMSMSSSSAPAFPPDHFSSTDQLCYVHCSFCDTVLAVSVPPSSLFKTVTVRCGHCSNLLSVTVSMRALLLPSVSNLGHSFLPPPPPPPPPNLLEEMRSGGQNINMNMMMSHHASAHHPNEHLVMATRNGRSVDHLQEMPRPPPANRPPEKRQRVPSAYNRFIKEEIQRIKAGNPDISHREAFSAAAKNWAHFPHIHFGLMADHPPTKKANVRQQEGEDGMMGREGFYGSAANVGVAHN

SEQ ID NO: 272 - protein, 260 aa, Zea mays
  misc_feature (1)..(260): Ceres CLONE ID no. 227877
  misc_feature: Utility: Useful for delaying flowering time
  misc_feature: Utility: Useful for delaying senescence
  misc_feature: Utility: Useful for increasing chlorophyll and photosynthetic capacity
  misc_feature: Utility: Useful for increasing increasing anthocyanin content
  misc_feature: Utility: Useful for increasing seed/fruit yield or modifying fruit content
  misc_feature: Utility: Useful for making ornamental plants with modified leaves
  misc_feature: Utility: Useful for making plants sterile and for genetic confinement
  misc_feature: Utility: Useful for making plants with altered leaf shape eg curled leaves
  misc_feature: Utility: Useful for making plants with increased biomass and foliage
  misc_feature: Utility: Useful for making smaller plants
MSSSSSSSSSAACCFPLDHLAPSPTEQLCYVHCNCCDTILAVGVPCSSLFKTVTVRCGHCANLLSVNLRGLLLPPAAPAPPNHLNFAHSLLSPTSPHGLLDELALQQAPSFLMEQASANLSSTMTGRSSNSSCASNLPPPAPMPAAQPVQQEAELPKTAPSVNRPPEKRQRVPSAYNRFIKDEIQRIKAGNPDITHREAFSAAAKNWAHFPHIHFGLMPDQGLKKTFKTHQDGAEDMLLKDDLYAAAAAAAAANMGITPF

SEQ ID NO: 273 - protein, 258 aa, Zea mays
  misc_feature (1)..(258): Ceres CLONE ID no. 228481
  misc_feature: Utility: Useful for delaying flowering time
  misc_feature: Utility: Useful for delaying senescence
  misc_feature: Utility: Useful for increasing chlorophyll and photosynthetic capacity
  misc_feature: Utility: Useful for increasing increasing anthocyanin content
  misc_feature: Utility: Useful for increasing seed/fruit yield or modifying fruit content
  misc_feature: Utility: Useful for making ornamental plants with modified leaves
  misc_feature: Utility: Useful for making plants sterile and for genetic confinement
  misc_feature: Utility: Useful for making plants with altered leaf shape eg curled leaves
  misc_feature: Utility: Useful for making plants with increased biomass and foliage
  misc_feature: Utility: Useful for making smaller plants
MMSSSSSSSAACCFPLDHLAPSPTEQLCYVHCNCCDTILAVGVPCSSLFKTVTVRCGHCANLLSVNLRGLLLPPAAPAPPNHLNFAHSLLSPTSPHGLLDELALQQAPSFLMEQASANLSSTMTGRSSNSSCASNLPPPAPMPAAQPVQQEAELPKTAPSVNRPPEKRQRVPSAYNRFIKDEIQRIKAGNPDITHREAFSAAAKNWAHFPHIHFGLMPDQGLKKTFKTQDGAEDMLLKDDLYAAAAAAAAANMGITPF

SEQ ID NO: 274 - DNA, 1126 bp, Arabidopsis thaliana
  misc_feature (1)..(1126): Ceres CLONE ID no. 13757
  misc_feature (1)..(1126): Also known as  Ceres CDNA ID no. 23357445
aattctcttccttctgaaattagggttttttttatcccttcctctctctttcttgtctaccaaaaaaggttttatcgaattactctcaaatcgtatggtgaggaagtcaaaatcttgagagatctgagattgtaagaagatgaatcaagaagataaagagaagcctatcgaagaagcttcttcatcaatggagagagaacacatgttcgacaaagtagtaacaccaagcgacgttggcaaactaaaccgactcgtgatccctaagcaacacgcagagagatacttcccattagataactccacaacaaacgacagcaacaaaggtttgcttctaaacttcgaagatcgaagtggaaactcatggaggttccgttactcttactggaacagtagtcaaagctatgtcatgactaaaggttggagccgttttgtcaaagacaagaagcttgatgctggagacatcgtttcttttcagagagattcttgtaataaagacaagctttacatcgattggaggagacgacctaagattcccgatcatcatcatcagcagttcgccggagctatgttccctaggttttacacttttcctcatcctcagatgccgacaaattacgaaactcacaacctttatcatcgatttcatcaacgagatctaggaattggatactatgtgaggtcaatggagaggagtcatccaacggctgtgattgaatctgtgccggtgataatgcaaaggagagcacaagtggcttcaatggcttcgagaggagagaagcggttaaggctgtttggtgtagatatggagtgcggaggaggaggagggagtgtgaatagtacggaggaagagtcgtcgtcttccggtggaagtatgccacgtggcagagtttctatggttggtgctggttctctcctccagttgaggttagtgagcagtgatgatgagtctttagtagcaatggaagctgcaagtcttgaggatcatcacttctttacaaagaaaggaaaatcttctttgtcttttgatttggataggtgatgattatcatgagatgaatcactatttaaaaatgcatatatatgataatttataccatatataatatatgacacaaagatgtctttc

SEQ ID NO: 275 - protein, 299 aa, Arabidopsis thaliana
  misc_feature (22)..(131): Pfam Name: B3; Pfam Description: B3 DNA binding domain
  misc_feature: Utility: Useful for delaying flowering time
  misc_feature: Utility: Useful for delaying senescence
  misc_feature: Utility: Useful for increasing chlorophyll and photosynthetic capacity
  misc_feature: Utility: Useful for increasing increasing anthocyanin content
  misc_feature: Utility: Useful for increasing seed/fruit yield or modifying fruit content
  misc_feature: Utility: Useful for making larger plants
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants that grow better in shade
  misc_feature: Utility: Useful for making plants with altered leaf shape eg curled leaves
  misc_feature: Utility: Useful for making plants with increased biomass
  misc_feature: Utility: Useful for making plants with increased biomass and foliage
  misc_feature: Utility: Useful for making shorter plants and plants with modified flowers
  misc_feature: Utility: Useful for making smaller plants
  misc_feature: Utility: Useful for modifying plant architecture, ie amount of  branching
  misc_feature: Utility: Useful for modifying plant structure, ie increased branching
MNQEDKEKPIEEASSSMEREHMFDKVVTPSDVGKLNRLVIPKQHAERYFPLDNSTTNDSNKGLLLNFEDRSGNSWRFRYSYWNSSQSYVMTKGWSRFVKDKKLDAGDIVSFQRDSCNKDKLYIDWRRRPKIPDHHHQQFAGAMFPRFYTFPHPQMPTNYETHNLYHRFHQRDLGIGYYVRSMERSHPTAVIESVPVIMQRRAQVASMASRGEKRLRLFGVDMECGGGGGSVNSTEEESSSSGGSMPRGRVSMVGAGSLLQLRLVSSDDESLVAMEAASLEDHHFFTKKGKSSLSFDLDR

SEQ ID NO: 276 - DNA, 552 bp, Arabidopsis thaliana
  misc_feature (1)..(552): Ceres CLONE ID no. 14583
  misc_feature (1)..(552): Also known as  Ceres CDNA ID no. 23416892
tcgttttcataaagagtctttcgtaagaccaaagagccattttcgattccagggctaaaactagggtttcacagttcatgatgaagaagagacagatggtaatcaagcagagatcaagaaactccaacacatcttcctcttggactactacttcgtcttcttcttcttcctccgagatcagtaacgtccgttacgtggagtgtcagaagaatcacgctgctaacatcggaggctacgccgtcgacggttgccgtgagttcatggccgccggagttgaaggaaccgttgatgctttgagatgcgcggcttgtggttgtcaccggaattttcaccggaaggaagttgatactgaggttgtttgtgagtattctccacctaacgcttgatttttagaggattttacttttttcttcttttggtttggatttatcgattgatttttaaagatgaatttgttagaggatatttgtatatgaatattgatgtgtatatcaaaaacagcataccgcccatctatatctataggtatatataaaattgcttgttggtttg

SEQ ID NO: 277 - protein, 102 aa, Arabidopsis thaliana
  misc_feature (34)..(93): Pfam Name: ZF-HD_dimer; Pfam Description: ZF-HD protein dimerisation region
  misc_feature (34)..(93): Pfam Name: ZF-HD_dimer; Pfam Description: ZF-HD protein dimerisation region
  misc_feature: Utility: Useful for delaying flowering time
  misc_feature: Utility: Useful for increasing chlorophyll and photosynthetic capacity
  misc_feature: Utility: Useful for increasing seed/fruit yield or modifying fruit content
  misc_feature: Utility: Useful for making ornamental plants with modified flowers
  misc_feature: Utility: Useful for making plants sterile and for genetic confinement
  misc_feature: Utility: Useful for making plants with enhanced abiotic stress tolerance
  misc_feature: Utility: Useful for making shorter plants and plants with modified flowers
  misc_feature: Utility: Useful for making smaller plants
MMKKRQMVIKQRSRNSNTSSSWTTTSSSSSSSEISNVRYVECQKNHAANIGGYAVDGCREFMAAGVEGTVDALRCAACGCHRNFHRKEVDTEVVCEYSPPNA

SEQ ID NO: 278 - protein, 97 aa, Brassica napus
  misc_feature (1)..(97): Ceres CLONE ID no. 1119033
  misc_feature: Utility: Useful for delaying flowering time
  misc_feature: Utility: Useful for increasing chlorophyll and photosynthetic capacity
  misc_feature: Utility: Useful for increasing seed/fruit yield or modifying fruit content
  misc_feature: Utility: Useful for making ornamental plants with modified flowers
  misc_feature: Utility: Useful for making plants sterile and for genetic confinement
  misc_feature: Utility: Useful for making plants with enhanced abiotic stress tolerance
  misc_feature: Utility: Useful for making shorter plants and plants with modified flowers
  misc_feature: Utility: Useful for making smaller plants
MKKRQVVIKQRSRNSNTSSSWTTTSSSATSSIRYVECQKNHAANIGGYAVDGCREFMAAGVEGTDDSLRCAACGCHRNFHRKEVNTEVVCEYSPPNA

SEQ ID NO: 279 - protein, 71 aa, Glycine max
  misc_feature (1)..(71): Ceres CLONE ID no. 649770
  misc_feature: Utility: Useful for delaying flowering time
  misc_feature: Utility: Useful for increasing chlorophyll and photosynthetic capacity
  misc_feature: Utility: Useful for increasing seed/fruit yield or modifying fruit content
  misc_feature: Utility: Useful for making ornamental plants with modified flowers
  misc_feature: Utility: Useful for making plants sterile and for genetic confinement
  misc_feature: Utility: Useful for making plants with enhanced abiotic stress tolerance
  misc_feature: Utility: Useful for making shorter plants and plants with modified flowers
  misc_feature: Utility: Useful for making smaller plants
MRNIRYGECQKNHAANIGGYAVDGCREFMASTGEGAGGALTCAACGCHRNFHRREVNTEVVCEYSPPNSGR

SEQ ID NO: 280 - protein, 100 aa, Arabidopsis thaliana
  misc_feature (1)..(100): Ceres CLONE ID no. 29087
  misc_feature: Utility: Useful for delaying flowering time
  misc_feature: Utility: Useful for increasing chlorophyll and photosynthetic capacity
  misc_feature: Utility: Useful for increasing seed/fruit yield or modifying fruit content
  misc_feature: Utility: Useful for making ornamental plants with modified flowers
  misc_feature: Utility: Useful for making plants sterile and for genetic confinement
  misc_feature: Utility: Useful for making plants with enhanced abiotic stress tolerance
  misc_feature: Utility: Useful for making shorter plants and plants with modified flowers
  misc_feature: Utility: Useful for making smaller plants
MRKRQVVLRRASPEEPSRSSSTASSLTVRTVRYGECQKNHAAAVGGYAVDGCREFMASRGEEGTVAALTCAACGCHRSFHRREIETEVVCDCNSPPSTGN

SEQ ID NO: 281 - protein, 100 aa, Brassica napus
  misc_feature (1)..(100): Ceres CLONE ID no. 1100582
  misc_feature: Utility: Useful for delaying flowering time
  misc_feature: Utility: Useful for increasing chlorophyll and photosynthetic capacity
  misc_feature: Utility: Useful for increasing seed/fruit yield or modifying fruit content
  misc_feature: Utility: Useful for making ornamental plants with modified flowers
  misc_feature: Utility: Useful for making plants sterile and for genetic confinement
  misc_feature: Utility: Useful for making plants with enhanced abiotic stress tolerance
  misc_feature: Utility: Useful for making shorter plants and plants with modified flowers
  misc_feature: Utility: Useful for making smaller plants
MRKRQVVLRRASPEEPSRSSSTASSLTVRGVRYGECQKNHAAAVGGYAVDGCREFMASNGEEGSVAALTCAACGCHRSFHRREIETEVVCDCNSPPSTGN

SEQ ID NO: 282 - protein, 97 aa, Glycine max
  misc_feature (1)..(97): Ceres CLONE ID no. 1042725
  misc_feature: Utility: Useful for delaying flowering time
  misc_feature: Utility: Useful for increasing chlorophyll and photosynthetic capacity
  misc_feature: Utility: Useful for increasing seed/fruit yield or modifying fruit content
  misc_feature: Utility: Useful for making ornamental plants with modified flowers
  misc_feature: Utility: Useful for making plants sterile and for genetic confinement
  misc_feature: Utility: Useful for making plants with enhanced abiotic stress tolerance
  misc_feature: Utility: Useful for making shorter plants and plants with modified flowers
  misc_feature: Utility: Useful for making smaller plants
MRRVILRRDGSRRCSNNSPVTIVRQVKYGKCCRNLACRIGGHVVDGCTEFVASGAEGTREAMTCATCGCHRNFHMKEEITQVLCACSSHPTTRTVGD

SEQ ID NO: 283 - DNA, 850 bp, Arabidopsis thaliana
  misc_feature (1)..(850): Ceres CLONE ID no. 14909
  misc_feature (1)..(850): Also known as  Ceres CDNA ID no. 23383636
cctctcacgttcgaagaccatttcttgttctttggacgaccatcggcgacagtgttaagtctagagtcttcttcttcttcggcgtagttttttccccggcttgaaaaatgggtctatccttcggaaagttgttcagcaagctctttgcaaagaaagagatgcgtatcctcatggtgggtctcgatgcagctggtaagactacgatcttgtacaagctcaagcttggagagatcgtgactacgattccaaccattggtttcaatgtggagactgtggaatacaagaacattagctttaccgtgtgggatgtcgggggtcaagacaagattcgtccattgtggaggcactacttccagaacactcagggacttatctttgtggtggacagcaatgatcgtgaccgtgttgtggaagccagagatgagcttcacagaatgttgaacgaagatgagttgagagatgctgtgcttctcgtttttgctaacaagcaagatcttccaaattgcgatgaacgccgctgagataaccgataagcttggacttcactctctccgtcaacgacactggtacatacagagcacatgtgctacctccggagaagggctttatgagggacttgactggctctctaacaacatcgcaaacaaggcttaggagaacaacgtgtggtttggtttttaatcgaggagagtcttgtcttcttccttctatcttttgttctttcgtctcaaactcttatcatttcatactctttgttcttcgctctaataatttacaagttttttttttgttgcttttatcctataattcagactcttataaaatggggcccaatttcggcggatattcc

SEQ ID NO: 284 - protein, 181 aa, Arabidopsis thaliana
  misc_feature (4)..(177): Pfam Name: Arf; Pfam Description: ADP-ribosylation factor family
  misc_feature (18)..(129): Pfam Name: MMR_HSR1; Pfam Description: GTPase of unknown function
  misc_feature (19)..(179): Pfam Name: Ras; Pfam Description: Ras family
  misc_feature: Utility: Useful for delaying flowering time
  misc_feature: Utility: Useful for making larger plants
  misc_feature: Utility: Useful for making smaller plants
MGLSFGKLFSKLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIANKA

SEQ ID NO: 285 - protein, 164 aa, Zea mays
  misc_feature (1)..(164): Ceres CLONE ID no. 380874
  misc_feature: Utility: Useful for delaying flowering time
  misc_feature: Utility: Useful for making larger plants
  misc_feature: Utility: Useful for making smaller plants
MRILMVGLDAAGKTTILYKLKLGEIVTTIPTIGFNVETVEYKNISFTVWDVGGQDKIRPLWRHYFQNTQGLIFVVDSNDRDRVVEAKDELHRMLNEDELRDAVLLVFANKQDLPNAMNAAEITDKLGLHSLRQRHWYIQSTCATTGEGLYEGLDWLSNNIANKA

SEQ ID NO: 286 - protein, 164 aa, Zea mays
  misc_feature (1)..(164): Ceres CLONE ID no. 276776
  misc_feature: Utility: Useful for delaying flowering time
  misc_feature: Utility: Useful for making larger plants
  misc_feature: Utility: Useful for making smaller plants
MRILMVGLDAAGKTTILYKLKLGEIVTTIPTIGFNVETVEYKNISFTVWDVGGQDKIRPLWRHYFQNTQGLIFVVDSNDRERVVEARDELHRMLNEDELRDAVLLVFANKQDLPNAMNAAEITDKLGLHSLRQRHWYIQSTCATSGEGLYEGLDWLSNNIANKS

SEQ ID NO: 287 - protein, 164 aa, Glycine max
  misc_feature (1)..(164): Ceres CLONE ID no. 529239
  misc_feature: Utility: Useful for delaying flowering time
  misc_feature: Utility: Useful for making larger plants
  misc_feature: Utility: Useful for making smaller plants
  misc_feature (67)..(67): Xaa is any aa, unknown, or other
  misc_feature (110)..(110): Xaa is any aa, unknown, or other
MRILMVGLDAAGKTTILYKLKLGEIVTTIPTIGFNVETVEYKNISFTVWDVGGQDKIRPLWRHYFQXTQGLIFVVDSNDRDRVVEARDELHRMLNEDELRDAVLLVFANXQDLPNAMNAAEITDKLGLHSLRQRHWYIQSTCATSGEGLYEGLDWLSNNIANKA

SEQ ID NO: 288 - protein, 164 aa, Zea mays; identical to SEQ ID NO: 286
  misc_feature (1)..(164): Ceres CLONE ID no. 240510
  misc_feature: Utility: Useful for delaying flowering time
  misc_feature: Utility: Useful for making larger plants
  misc_feature: Utility: Useful for making smaller plants

SEQ ID NO: 289 - protein, 164 aa, Zea mays
  misc_feature (1)..(164): Ceres CLONE ID no. 1535974
  misc_feature: Utility: Useful for delaying flowering time
  misc_feature: Utility: Useful for making larger plants
  misc_feature: Utility: Useful for making smaller plants
MRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATTGEGLYEGLDWLSSNIASKA

SEQ ID NO: 290 - protein, 181 aa, Triticum aestivum
  misc_feature (1)..(181): Ceres CLONE ID no. 738726
  misc_feature: Utility: Useful for delaying flowering time
  misc_feature: Utility: Useful for making larger plants
  misc_feature: Utility: Useful for making smaller plants
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRERVVEARDELHRMLNEDELRDAVLLVFANKQDLPNAMNAAEITDKLGLHSLRQRHWYIQSTCATSGEGLYEGLDWLSNNIANKA

SEQ ID NO: 291 - protein, 181 aa, Zea mays
  misc_feature (1)..(181): Ceres CLONE ID no. 1428788
  misc_feature: Utility: Useful for delaying flowering time
  misc_feature: Utility: Useful for making larger plants
  misc_feature: Utility: Useful for making smaller plants
MGLAFGKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATTGEGLYEGLDWLSSNIASKA

SEQ ID NO: 292 - protein, 181 aa, Triticum aestivum
  misc_feature (1)..(181): Ceres CLONE ID no. 631823
  misc_feature: Utility: Useful for delaying flowering time
  misc_feature: Utility: Useful for making larger plants
  misc_feature: Utility: Useful for making smaller plants
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATTGEGLYEGLDWLSSNIASKP

SEQ ID NO: 293 - protein, 181 aa, Zea mays
  misc_feature (1)..(181): Ceres CLONE ID no. 416460
  misc_feature: Utility: Useful for delaying flowering time
  misc_feature: Utility: Useful for making larger plants
  misc_feature: Utility: Useful for making smaller plants
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLNSLRQRHWYIQSTCATTGEGLYEGLDWLSSNIATKS

SEQ ID NO: 294 - protein, 181 aa, Zea mays
  misc_feature (1)..(181): Ceres CLONE ID no. 1561415
  misc_feature: Utility: Useful for delaying flowering time
  misc_feature: Utility: Useful for making larger plants
  misc_feature: Utility: Useful for making smaller plants
MGLSFGKLFSRLFAKKEMRILMVGLDAAGKTTILYKLKLGEIVTTIPTIGFNVETVEYKNISFTVWDVGGQDKIRPLWRHYFQNTQGLIFVVDSNDRERVVEARDELHRMLNEDELRAPVLLVFPNNQDLPNAMNAPEITANLGLHSLRQRHWSIQSPCAPSGEGLYEGLDWLSTNISTKS

SEQ ID NO: 295 - DNA, 1623 bp, Arabidopsis thaliana
  misc_feature (1)..(1623): Ceres CLONE ID no. 16412
  misc_feature (1)..(1623): Also known as  Ceres CDNA ID no. 23369620
aaaaataaaaatgaaacctttctctagagtgttcattattttggtcatcgttttgttaacaagctacatagatgcctttaccagaaacgattttccagaggattttctcttcggagctgccacttctgcttatcagtgggaaggagctgttgatgaagatggaagaactcctagcgtctgggacacgacctctcactgttatagtggaagtaatggagatgtagcatgtgatgggtatcacaagtacaaggaagatgttaagttgatggtagatatgggcttacaagcattcagattctctatctcctggccaagacctaatggaagaggatccatgaacccaaaaggtctattgttttacaagaacctcatcaaagaattacggagccatggaattgaaccacacgttacactttaccactacgatcttccgcagcctcttgaagatgagtacggaggatggatcaaccgaaaaatcatagaagactttactgcttttgcagatgtatgcttcagagagtttggcgatgatgtgaagttatggactacaatcaacgaagctacaatattcgccattgctacttatggcgaaggtgtcacgtttggacattgtactcctaccaaattcaccaattgttcttccgggaattcttgtacagaaacatatattgcagggcataacatgttgctagcacatgcctctgcttcaaatttgtataaactaaagtatcagagtaagcaaagaggatccataggccttagtatatatgcattcgggttatctccttatacaaactccaaggacgatgaaatcgcaactcaaagagctaaagctttcctctatggatggatgttgaagccattggtatttggggactatccggatgaaatgaagagaaccttgggatcgagattaccggttttctcagaggcagagtcggaacaaatgaaagggtcatctgactttgtaggaattattcactacacgacagtctatgtcacaaaccaacccgcaccttatatctttcccagcagcgtcaacaaaggcttctttaaagatatgggcgcatatattatatccactgggaattcttcattatttgagtttgaagcaactccatggggtcttgaaggtgttcttgagtatctaaagcagagctataacaatcctccaatctatattcttgaaaatggtacaccaatgaaacacgattcgatgctacaagacacaccaagagttgaatacattcaagcttacattggtgctgtgctcaacgccatcaagaatggatcggacacgagaggttacttcgtatggtcgctgatagatttgtatgagataataggtggatataaaagcagcttcggaatgtaccatgtcaatttcagcgatcctgctcgcaagaggtcgtcaaagctctctgcttcttggtactcaggttttctcaatggtacaattgatgttgcttctcaaaatattactaagttgcagaacaagttctctggctcttcttcattgtaatgttcttaaactaaagtagcctggtttgattttgatctatctattctatgataaagacctcagggatttgcatatgaataaatgatgtgtcttgtgagacc

SEQ ID NO: 296 - protein, 503 aa, Arabidopsis thaliana
  misc_feature (24)..(484): Pfam Name: Glyco_hydro_1; Pfam Description: Glycosyl hydrolase family 1
  misc_feature: Utility: Useful for delaying flowering time
  misc_feature: Utility: Useful for making ornamental plants with modified leaves
  misc_feature: Utility: Useful for making plants with altered leaf shape eg curled leaves
  misc_feature: Utility: Useful for making plants with increased biomass and foliage
  misc_feature: Utility: Useful for making smaller plants
MKPFSRVFIILVIVLLTSYIDAFTRNDFPEDFLFGAATSAYQWEGAVDEDGRTPSVWDTTSHCYSGSNGDVACDGYHKYKEDVKLMVDMGLQAFRFSISWPRPNGRGSMNPKGLLFYKNLIKELRSHGIEPHVTLYHYDLPQPLEDEYGGWINRKIIEDFTAFADVCFREFGDDVKLWTTINEATIFAIATYGEGVTFGHCTPTKFTNCSSGNSCTETYIAGHNMLLAHASASNLYKLKYQSKQRGSIGLSIYAFGLSPYTNSKDDEIATQRAKAFLYGWMLKPLVFGDYPDEMKRTLGSRLPVFSEAESEQMKGSSDFVGIIHYTTVYVTNQPAPYIFPSSVNKGFFKDMGAYIISTGNSSLFEFEATPWGLEGVLEYLKQSYNNPPIYILENGTPMKHDSMLQDTPRVEYIQAYIGAVLNAIKNGSDTRGYFVWSLIDLYEIIGGYKSSFGMYHVNFSDPARKRSSKLSASWYSGFLNGTIDVASQNITKLQNKFSGSSSL

SEQ ID NO: 297 - protein, 497 aa, Arabidopsis thaliana
  misc_feature (1)..(497): Public GI no. 51971769
  misc_feature: Utility: Useful for delaying flowering time
  misc_feature: Utility: Useful for making ornamental plants with modified leaves
  misc_feature: Utility: Useful for making plants with altered leaf shape eg curled leaves
  misc_feature: Utility: Useful for making plants with increased biomass and foliage
  misc_feature: Utility: Useful for making smaller plants
MKHFNLLSIILVIVLATSYIDAFTRNDFPEDFLFGAGTSAYQWEGAANEDGRTPSVWDTTSHCYNGSNGDIACDGYHKYKEDVKLMAEMGLESFRFSISWSRLIPNGRGRINPKGLLFYKNLIKELRSHGIEPHVTLYHYDLPQSLEDEYGGWINHKIIEDFTAFADVCFREFGEDVKLWTTINEATIFAFAFYGKDVRYGNCTTGNYCMETYIAGHNMLLAHASASNLYKLKYKSKQRGSIGLSIFALGLTPYTNSKDDEIATQRAKAFLYGWMLKPLVFGDYPDEMKRTLGSRLPVFSEEESEQVKGSSDFVGIIHYTTVYVTNQPAPYIFPSSTNKDFFTDMGAYIISTGNSSSFVFDAVPWGLEGVLQHIKHRYNNPPIYILENGSPMKHDSMLQDTPRVEYIQAYIGAVLNAIKSGSDTRGYFVWSLIDLFEVQVGYKSSFGMYYVNFSDPGRKRSPKLSASWYTGFLNGTIDVASQDMTQLQRNFSGSSSL

SEQ ID NO: 298 - protein, 506 aa, Arabidopsis thaliana
  misc_feature (1)..(506): Public GI no. 30687750
  misc_feature: Utility: Useful for delaying flowering time
  misc_feature: Utility: Useful for making ornamental plants with modified leaves
  misc_feature: Utility: Useful for making plants with altered leaf shape eg curled leaves
  misc_feature: Utility: Useful for making plants with increased biomass and foliage
  misc_feature: Utility: Useful for making smaller plants
MKHFSLLFIFLVILLATSYSDAFTRNSFPKDFLFGAATSAYQWEGAVAEDGRTPSVWDTFSNSYDTGNGDVTSDGYHKYKEDVKLMATMGLESFRFSISWSRLIPNGRGLINPKGLLFYNNLIKDLKSHGIEPHVTLYHYDLPQSLEDEYGGWINRKIIEDFTAYADVCFREFGEDVKLWTTINEATIFAIGSYDQGTAPPGHCSPNKFVNCSTGNSSTEPYIAGHNILLAHASASKLYKLKYKSKQKGSIGLSIFAFGLSPYTNSKDDEIATQRAKTFLYGWMLKPLVFGDYPDEMKKTVGSRLPVFSEEESEQVKGSSDFIGIIHYTTFYVTNHQPSASLFPSMGEGFFKDMGVYIIPTGNSSFLVWEATPWGLEGILEYIKQSYNNPPVYILENGMPMVRDSTLQDTQRIEYIQAYIDAVLNAMKNGSDTRGYFVWSMVDVYEILSGYTTSFGMYHVNFSDPGRKRTPKLSASWYTGFLNGTIDVASQDTIQLWSNFSVSSSL

SEQ ID NO: 299 - protein, 508 aa, Arabidopsis thaliana
  misc_feature (1)..(508): Ceres CLONE ID no. 1352771
  misc_feature: Utility: Useful for delaying flowering time
  misc_feature: Utility: Useful for making ornamental plants with modified leaves
  misc_feature: Utility: Useful for making plants with altered leaf shape eg curled leaves
  misc_feature: Utility: Useful for making plants with increased biomass and foliage
  misc_feature: Utility: Useful for making smaller plants
MKLYSLLSVFLVILLATSDSDAFTRNNFPKDFLFGAATSAYQWEGAVAEDGRTPSVWDTFSHTYNRGNLGNGDITSDGYHKYKEDVKLMAEMGLESFRFSISWSRLIPNGRGLINPKGLLFYKNLIKELISHGIEPHVTLYHYDLPQSLEDEYGGWINRKIIEDFTAYADVCFREFGEDVKLWTTINEATIFAIGSYDQGISPPGHCSPNKFINCTSGNSSTEPYLAGHNILLAHASASKLYKLKYKSTQKGSIGLSIFAFGLSPYTNSKDDEIATQRAKAFFYGWMLKPLVFGDYPDEMKRTVGSRLPVFSEEESEQLKGSSDFIGIIHYTTFYVTNKPSPSIFPSMNEGFFKDMGVYMISAANSSFLLWEATPWGLEGILEYIKQSYNNPPIYILENGMPMGRDSTLQDTQRIEFIQAYIGAMLNAIKNGSDTRGYFVWSMIDLYELLSGYTTSFGMYYVNFSDPGRKRTPKLSASWYTGFLNGTIDVATQDTIQLQSNISGSSSL

SEQ ID NO: 300 - protein, 508 aa, Arabidopsis thaliana; identical to SEQ ID NO: 299
  misc_feature (1)..(508): Public GI no. 27363302
  misc_feature: Utility: Useful for delaying flowering time
  misc_feature: Utility: Useful for making ornamental plants with modified leaves
  misc_feature: Utility: Useful for making plants with altered leaf shape eg curled leaves
  misc_feature: Utility: Useful for making plants with increased biomass and foliage
  misc_feature: Utility: Useful for making smaller plants

SEQ ID NO: 301 - protein, 502 aa, Arabidopsis thaliana
  misc_feature (1)..(502): Public GI no. 42566152
  misc_feature: Utility: Useful for delaying flowering time
  misc_feature: Utility: Useful for making ornamental plants with modified leaves
  misc_feature: Utility: Useful for making plants with altered leaf shape eg curled leaves
  misc_feature: Utility: Useful for making plants with increased biomass and foliage
  misc_feature: Utility: Useful for making smaller plants
MKPFSQFFVFVVTVSATSYIDAFTRNDFPNDFLFGAATSAYQWEGAFDEDGKSPSVWDTTSHCDSGSNNGDIACDGYHKYKEDVMLMAEMGLESFRFSISWSRLIPNGRGRINPKGLLFYKNLIKELRSHGIEPQVTLYHYDLPQSLEDEYGGWINRKIIEDFTAFADVCFREFGEDVKLWTKINEATLFAIGSYGDGMRYGHCPPMNYSTANVCTETYIAGHNMLLAHSSASNLYKLKYKTKQRGSVGLSIYAYGLSPYTDSKDDETATERAEAFLFGWMLKPLVVGDYPDIMKRTLGSRLPVFSEEESKQVKGSSDFVGVVHYNTFYVTNRPAPSLVTSINKLFFADIGAYLIAAGNASLFEFDAVPWGLEGILQHIKQSYNNPPIYILENGKPMKHGSTLQDTPRAEFIQAYIGAVHNAITNGSDTRGYFVWSMIDLYELIGRYMTSYGMYYVNFSDPGRKRSPKLSASWYTGFLNGTIDVASQDTIQLQRKCSGSSSL

SEQ ID NO: 302 - protein, 498 aa, Arabidopsis thaliana
  misc_feature (1)..(498): Public GI no. 7269635
  misc_feature: Utility: Useful for delaying flowering time
  misc_feature: Utility: Useful for making ornamental plants with modified leaves
  misc_feature: Utility: Useful for making plants with altered leaf shape eg curled leaves
  misc_feature: Utility: Useful for making plants with increased biomass and foliage
  misc_feature: Utility: Useful for making smaller plants
MKHFSLLFIFLVILLATSYSDAFTRNSFPKDFLFGAATSAYQWEGAVAEDGRTPSVWDTFSNSYDTGNGDVTSDGYHKYKEDVKLMATMGLESFRFSISWSRLIPNGRGLINPKGLLFYNNLIKDLKSHGIEPHVTLYHYDLPQSLEDEYGGWINRKIIEDFTAYADVCFREFGEDVKLWTTINEATIFAIGSYDQGTAPPGHCSPNKFVNCSTGNSSTEPYIAGHNILLAHASASKLYKLKYKSKQKGSIGLSIFAFGLSPYTNSKDDEIATQRAKTFLYGWMLKPLVFGDYPDEMKKTVGSRLPVFSEEESEQVKGSSDFIGIIHYTTFYVTNHQPSASLFPSMGEGFFKDMGLLFLKWEATPWGLEGILEYIKQSYNNPPVYILENGMPMVRDSTLQDTQRIEYIQAYIDAVLNAMKNGSDTRGYFVWSMVDVYEILSGYTTSFGMYHVNFSDPGRKRTPKLSASWYTGFLNGTIDVASQDTIQLWSNFSVSSSL

SEQ ID NO: 303 - protein, 507 aa, Arabidopsis thaliana
  misc_feature (1)..(507): Public GI no. 22328869
  misc_feature: Utility: Useful for delaying flowering time
  misc_feature: Utility: Useful for making ornamental plants with modified leaves
  misc_feature: Utility: Useful for making plants with altered leaf shape eg curled leaves
  misc_feature: Utility: Useful for making plants with increased biomass and foliage
  misc_feature: Utility: Useful for making smaller plants
MELTLSLLTIFLLFFALSGRCSDKNDFPEGFIFGSATSAYQWEGAFDEDGRKPSVWDTFLHTRNLSNGDITSDGYHKYKEDVKLMVETGLDAFRFSISWSRLIPNGRGPVNPKGLQFYKNFIQELVSHGIEPHVTLFHYDHPQYLEDEYGGWINRRIIQDFTAYANVCFREFGHHVKFWTTINEANIFTIGGYNDGITPPGRCSSPGRNCSSGNSSTEPYIVGHNLLLAHASASRLYKQKYKDMQGGSVGFSLFSLGFTPSTSSKDDDIAVQRAKDFYFGWMLEPFIFGDYPDEMKRTVGSRLPVFSKEESEQVKGSSDFIGIIHYLAASVTSIKIKPSISGNPDFYSDMGVSMTWTVLGNFSAFEYAVAPWAMESVLEYIKQSYGNPPIYILENGTPMKQDLQLQQKDTPRIEYLHAYIAAVLKSIRNGSDTRGYFIWSFMDLYELVKGYEFSFGLYSVNFSDPHRTRSPKLSAHWYSAFLKGNTTFLGSQGIMQMQSNFSSSASS

SEQ ID NO: 304 - DNA, 834 bp, Arabidopsis thaliana
  misc_feature (1)..(834): Ceres CLONE ID no. 16461
  misc_feature (1)..(834): Also known as  Ceres CDNA ID no. 23388889
atattagtttgttatacaactcacttagaataatgtagattacatttcagccaaattcatgtaaaagatgcttttctttgtgatgtttttaaaatgctttcttttcactttttttctttcttaactataaatcttgatgcaatgcctaccttcttagaacataagatcttctttaaaatccaaaatcattcttgagagaaaagaaatcgaagatggcaacaaaatccaccggaggtaccgagaaaaccaagtcgatagaagtgaagaagaaactaatcaacgtgttgatcgtcgatgatgatccattaaaccgtagactccacgagatgatcatcaaaacgatcggaggaatttctcagactgcaaagaatggcgaggaggcagtgatcctccaccgtgacggcgaagcatctttcgaccttattctaatggataaggaaatgcctgagagggatggagtttcgacaactaagaagctaagagaaatgaaagtgacgtcaatgatcgttggggtaacgtcagtagctgaccaagaagaagagcgtaaggcttttatggaagctgggctcaaccattgcttggaaaaacccttaaccaaggccaagatcttcccgctcattagccacctcttcgatgcttgatggatgaaggctcattaatgtatctatattttcaatcatgaaatcacctacacgtgtatttgacacaaaaatctgcatttgttgtgatatagggtttctcatatctatgtttgatttattttcttatcgtccgaggtaaaatcatgcaagtcatttcttttggctaataaaatattaaaataaggttttctcc

SEQ ID NO: 305 - protein, 142 aa, Arabidopsis thaliana
  misc_feature (22)..(142): Pfam Name: Response_reg; Pfam Description: Response regulator receiver domain
  misc_feature: Utility: Useful for delaying flowering time
  misc_feature: Utility: Useful for increasing chlorophyll and photosynthetic capacity
  misc_feature: Utility: Useful for making larger plants
  misc_feature: Utility: Useful for making ornamental plants with modified leaves
  misc_feature: Utility: Useful for making smaller plants
MATKSTGGTEKTKSIEVKKKLINVLIVDDDPLNRRLHEMIIKTIGGISQTAKNGEEAVILHRDGEASFDLILMDKEMPERDGVSTTKKLREMKVTSMIVGVTSVADQEEERKAFMEAGLNHCLEKPLTKAKIFPLISHLFDA

SEQ ID NO: 306 - protein, 136 aa, Arabidopsis thaliana
  misc_feature (1)..(136): Public GI no. 3687688
  misc_feature: Utility: Useful for delaying flowering time
  misc_feature: Utility: Useful for increasing chlorophyll and photosynthetic capacity
  misc_feature: Utility: Useful for making larger plants
  misc_feature: Utility: Useful for making ornamental plants with modified leaves
  misc_feature: Utility: Useful for making smaller plants
MATKSMGDIEKIKKKLNVLIVDDDPLNLIIHEKIIKAIGGISQTANNGEEAVIIHRDGGSSFDLILMDKEMPERDGVSTTKKLREMEVKSMIVGVTSLADNEEERRAFMEAGLNHCLAKPLTKDKIIPLINQLMDA

SEQ ID NO: 307 - protein, 132 aa, Glycine max
  misc_feature (1)..(132): Ceres CLONE ID no. 1051749
  misc_feature: Utility: Useful for delaying flowering time
  misc_feature: Utility: Useful for increasing chlorophyll and photosynthetic capacity
  misc_feature: Utility: Useful for making larger plants
  misc_feature: Utility: Useful for making ornamental plants with modified leaves
  misc_feature: Utility: Useful for making smaller plants
MAPKNLGTKLTALVVDDNILNRKIHQNLLESVGVKNQGVENGQEAVDIHCHGQIFDLILMDMDMPIMNGIEATKELRSMGIGSMIVGVSSRCTEAEIRKFMEAGLNDYHEKPLNNAKLSSILDKINPSFTRN

SEQ ID NO: 308 - protein, 127 aa, Glycine max
  misc_feature (1)..(127): Public GI no. 50918565
  misc_feature: Utility: Useful for delaying flowering time
  misc_feature: Utility: Useful for increasing chlorophyll and photosynthetic capacity
  misc_feature: Utility: Useful for making larger plants
  misc_feature: Utility: Useful for making ornamental plants with modified leaves
  misc_feature: Utility: Useful for making smaller plants
MARKMIRVLLVEDEEINRVVARAALKAAGGGDVVDEAENGEVAVQRVRDAAAPYDLVLMDKQMPVMDGHEATRRIRGMGVTTPIVAVSSDGLPADVDAFITAGADDFTSKPLSKEKLGVILAKFRLA

SEQ ID NO: 309 - DNA, 934 bp, Arabidopsis thaliana
  misc_feature (1)..(934): Ceres CLONE ID no. 17409
  misc_feature (1)..(934): Also known as  Ceres CDNA ID no. 23373418
gttttgtcctccttctacgccgcacactatcttttcctctcactcagacttcctcttcatctcaagagaaatggctgaatccaaggtagtggttccagagtctgtgctaaagaagatcaagaggcaagaggaatgggcattggccaagaaagatgaagctgtagctgcaaagaagaagagtgttgaggcccgcaagcttatcttcaagagagctgagcagtatgccaaagaatacgctgagaaggataacgagttgatccgattgaagcgggaggctaagttgaaaggaggtttctacgttgaccctgaggctaagttgctctttatcattcgtatccgtggtatcaatgccattgacccaaaaaccaagaagattctgcagctcctgcgtttgagacagatcttcaatggtgtgtttcttaaggtgaacaaggcaacagtaaacatgctgcgccgagttgaaccatacgtgacttacggatacccaaacttgaagagcgttaaggaactgatctacaaaagaggttatggaaagctgaaccaccagaggatagcacttactgacaactccattgtggatcaggctctcggaaagcatgggatcatctgcgttgaggatctcatccacgagatcatgactgttggacctcacttcaaggaagccaacaacttcctgtggccattccaattgaaggcaccactcggtggccttaagaagaagagaaaccactacgtcgaaggtggtgatgctggaaacagggagaatttcatcaacgagcttgtcaggagaatgaattgatgaaagcttccttctttatctttgcaaatttcaaagattttgggaccgagtttttttttttttttgttcaagttatcagagacttgtgatcttttatccgagataggctttttatgactaatcatgttattttcc

SEQ ID NO: 310 - protein, 242 aa, Arabidopsis thaliana
  misc_feature (82)..(134): Pfam Name: Ribosomal_L30; Pfam Description: Ribosomal protein L30p/L7e
  misc_feature (11)..(81): Pfam Name: Ribosomal_L30_N; Pfam Description: Ribosomal L30 N-terminal domain
  misc_feature: Utility: Useful for delaying flowering time
  misc_feature: Utility: Useful for making larger plants
  misc_feature: Utility: Useful for making plants with altered leaf shape eg curled leaves
  misc_feature: Utility: Useful for making smaller plants
MAESKVVVPESVLKKIKRQEEWALAKKDEAVAAKKKSVEARKLIFKRAEQYAKEYAEKDNELIRLKREAKLKGGFYVDPEAKLLFIIRIRGINAIDPKTKKILQLLRLRQIFNGVFLKVNKATVNMLRRVEPYVTYGYPNLKSVKELIYKRGYGKLNHQRIALTDNSIVDQALGKHGIICVEDLIHEIMTVGPHFKEANNFLWPFQLKAPLGGLKKKRNHYVEGGDAGNRENFINELVRRMN

SEQ ID NO: 311 - protein, 242 aa, Glycine max
  misc_feature (1)..(242): Ceres CLONE ID no. 1073780
  misc_feature: Utility: Useful for delaying flowering time
  misc_feature: Utility: Useful for making larger plants
  misc_feature: Utility: Useful for making plants with altered leaf shape eg curled leaves
  misc_feature: Utility: Useful for making smaller plants
MGEAKALVPESVVKKEKRNEEWALAKKQELDAAKKMRFETRKLIFNRAKQYSKEYDEQQKELIRLKREAKLKGGFYVEPEAKLLFIIRIRGINAMDPKTRKILQLLRLRQIFNGVFLKVNKATVNMLHRVEPYVTYGYPNLKSVRELIYKRGYGKVNKQRIALTDNSIIEQTLGKHGIICVEDLIHEIMTVGPHFKEANNFLWPLKLKAPLGGLEKKRNHYVEGGDAGNREDYINELIRRMN

SEQ ID NO: 312 - protein, 244 aa, Zea mays
  misc_feature (1)..(244): Ceres CLONE ID no. 240836
  misc_feature: Utility: Useful for delaying flowering time
  misc_feature: Utility: Useful for making larger plants
  misc_feature: Utility: Useful for making plants with altered leaf shape eg curled leaves
  misc_feature: Utility: Useful for making smaller plants
MSSVASKVAVPESVLRKRKREEQWATEKKEKALVEKKKSIESRKLIFTRAKQYAEEYDAQEKELVQLKREARLKGGFYVSPEAKLLFVVRIRGINAMHPKTRKILQLLRLRQIFNGVFLKVNKATINMLRRVEPYVAYGYPNLKSVRELIYKRGYGKLNKQRIPLSNNQVIEEGLGKHNIICIEDLVHEIMTVGPHFKEANNFLWPFKLKAPLGGLKKKRNHYVEGGDAGNRENYINELIKRMN

SEQ ID NO: 313 - protein, 244 aa, Zea mays
  misc_feature (1)..(244): Ceres CLONE ID no. 281173
  misc_feature: Utility: Useful for delaying flowering time
  misc_feature: Utility: Useful for making larger plants
  misc_feature: Utility: Useful for making plants with altered leaf shape eg curled leaves
  misc_feature: Utility: Useful for making smaller plants
MSSEAVKVAVPESVLRKRKREEQWAAEKKEKSLAERKKSIENRKLIFTRAKQYAEEYDAQEKELVQLKREARLKGGFYVSPEAKLLFVIRIRGINAMHPKTRKILQLLRLRQIFNGVFLKVNKATINMLRRVEPYVAYGYPNLKSVRELIYKRGYGKLNKQRIPLSNNQVIEEGLGKHNIICIEDLVHEIMTVGPHFKEANNFLWPFKLKAPLGGLKKKRNHYVEGGDAGNRENYINELIKRMN

SEQ ID NO: 314 - protein, 245 aa, Zea mays
  misc_feature (1)..(245): Ceres CLONE ID no. 225601
  misc_feature: Utility: Useful for delaying flowering time
  misc_feature: Utility: Useful for making larger plants
  misc_feature: Utility: Useful for making plants with altered leaf shape eg curled leaves
  misc_feature: Utility: Useful for making smaller plants
MSAAEAKAAAVPESVLRKRKREEQWAADKKEKALADRKKALESRKIIFARAKQYAEEYHAQEKELVQLKREARLKGGFYVSPEAKLLFVVRIRGINAMHPKTRKILQLLRLRQIFNGVFLKVNKATINMLRRVEPYVAYGYPNLKSVRELIYKRGYGKLNKQRIPLSNNSVIEEGLGKHNIICIEDLVHEIMTVGPHFKEANNFLWPFKLKAPLGGLKKKRNHYVEGGDAGNRENYINELIKRMN

SEQ ID NO: 315 - protein, 244 aa, Triticum aestivum
  misc_feature (1)..(244): Ceres CLONE ID no. 779692
  misc_feature: Utility: Useful for delaying flowering time
  misc_feature: Utility: Useful for making larger plants
  misc_feature: Utility: Useful for making plants with altered leaf shape eg curled leaves
  misc_feature: Utility: Useful for making smaller plants
  misc_feature (152)..(152): Xaa is any aa, unknown, or other
  misc_feature (159)..(159): Xaa is any aa, unknown, or other
  misc_feature (181)..(181): Xaa is any aa, unknown, or other
  misc_feature (221)..(221): Xaa is any aa, unknown, or other
MSSEAAKMVVPESVLLKRKREELWAAEKKTKAVEEKKKSSENIKVIYARAKQYAEEYDAQDKELVQLKREARMKGGFYVSPEAKLLFVVRIRGINAMHPKTKKILQLLRLRQIFNGVFLKVNKATINMLRRVEPYVAYGYPNLKSVRELIYXRGYGKLXKQRIPLTNNKVIEEGLGKHNIXCIEDLVHEILTVGPHFKEANNFLWPFKLKAPLGGLKKKRXHYVEGGDAGNRENYINQLVRRMN

SEQ ID NO: 316 - DNA, 948 bp, Arabidopsis thaliana
  misc_feature (1)..(948): Ceres CLONE ID no. 17482
  misc_feature (1)..(948): Also known as  Ceres CDNA ID no. 23357748
acacataacacacacacatcttcttcctctctttatcttcttcttctctgtttctctaagaagatagaacaatcccaagaatctcctcttatttgatcaaccatgtcgaatgtcttgctatccccaaacggctacgtatttgcatcgcctaaacctcttggcagattcatcaattcaaagtccggcggacggaaacttttcttctccgtcgttagagcttcttccgatgatgctgattgtaatgccgaagaatgtgctcccgagaaggaggtaggaacagtgagtatggaatggttagctggagagaagaccaaagtggtgggaacatttcctcctcggaagccgcgtggttggactggctatgtagagaaagatactgctggtcagactaatgtttactccattgagcctgcagtatatgttgcagagagcgcgattagctcaggtactgcaggatcatcggctgatggggctgagaacacagcagcaatcgtagcaggcattgctcttatcgcagtcgctgcagcttcctctatactcctccaagtcgggaaagatgccccaactcgacccaaagcagtggattacagtggaccgtctcttagctactacatcaacaagttcaagccttctgaaattgttcaaccttctaccccctccgtcacagaagccccaccggtggccgagctagaaacttcactgccagaaactccaccggtggctcagcaagaaacctcactgccggaaactatggctagtgaggctcagccagaggcgtcttttgttccaacaacaagtagtacctcttaggggcttagcctaggattatatctttgtgtaaaaatgagatgaagcatataccaagattatgcattctgttaatattcggatatacctatatgtatgtatacactctgtcactcttctctttgagtgaatgattatacc

SEQ ID NO: 317 - protein, 235 aa, Arabidopsis thaliana
  misc_feature: Utility: Useful for delaying flowering time
  misc_feature: Utility: Useful for making lethal plants for genetic confinement systems
  misc_feature: Utility: Useful for making plants with altered leaf shape eg curled leaves
  misc_feature (128)..(128): Xaa is any aa, unknown, or other
MSNVLLSPNGYVFASPKPLGRFINSKSGGRKLFFSVVRASSDDADCNAEECAPEKEVGTVSMEWLAGEKTKVVGTFPPRKPRGWTGYVEKDTAGQTNVYSIEPAVYVAESAISSGTAGSSADGAENTXAIVAGIALIAVAAASSILLQVGKDAPTRPKAVDYSGPSLSYYINKFKPSEIVQPSTPSVTEAPPVAELETSLPETPPVAQQETSLPETMASEAQPEASFVPTTSSTS

SEQ ID NO: 318 - protein, 238 aa, Arabidopsis thaliana
  misc_feature (1)..(238): Public GI no. 51457942
  misc_feature: Utility: Useful for delaying flowering time
  misc_feature: Utility: Useful for making lethal plants for genetic confinement systems
  misc_feature: Utility: Useful for making plants with altered leaf shape eg curled leaves
MACAALSANSCTIASSSTGRLSFSTYQKDSKLRQRHSLVRFRVRASTDDSDCNAEECAPDKEVGKVSMEWVAMDNTKVVGTFPPRKPRGWTGYVEKDTAGQTNIYSVEPAVYVAESAISSGTAGTSSDGAENTKAISAGIALISVAAASSILLQVGKNSPPPIQTVEYRGPSLSYYINKLKPAEIVQASITEAPTAPETEEVAITPEVESSAPEAPAPQVEVQSEAPQDTSSSSSNIS

SEQ ID NO: 319 - protein, 223 aa, Glycine max
  misc_feature (1)..(223): Ceres CLONE ID no. 658444
  misc_feature: Utility: Useful for delaying flowering time
  misc_feature: Utility: Useful for making lethal plants for genetic confinement systems
  misc_feature: Utility: Useful for making plants with altered leaf shape eg curled leaves
MACALQATLAANTYAFSSRRFSLKHQKNSKRRFSLFTVRADSDDSDCNEEECAPDKEVGKVSVEWLAGEKTKVVGTFPPRRKPGWTGYVEKDTAGQTNIYSVEPAVYVAESAISSGTAGSSSDGAENTAAIVAGLALISIAAASSILLQVGKNAPPQIQTAQYSGPSLSYYINKFTPPEITQVSVPSEAELSSSVQPESPPPEVSQVQVEAQASETSSVNIES

SEQ ID NO: 320 - protein, 231 aa, Zea mays
  misc_feature (1)..(231): Ceres CLONE ID no. 1559567
  misc_feature: Utility: Useful for delaying flowering time
  misc_feature: Utility: Useful for making lethal plants for genetic confinement systems
  misc_feature: Utility: Useful for making plants with altered leaf shape eg curled leaves
MACPAQSMLSASGCILLRSKPRASSSHVRGGIIGGGCSSRPFQLTCNASSSPSPPSPAPAQEDPDCNDEECAPEKEVGSLRAEWLAEERTQVVGTFPPRKRGWTGLVEKDTAGQTNIYSVEPVVYVAESAISSGAAGMSAEGAENTAAIAAGLVLITVAAASSILIQVNKSQPQVPEAAYNGPPLSYYVAKFQPAQTLEAPAPAEAVEAQDGAATVQDSAAPEAQEAVLIS

SEQ ID NO: 321 - DNA, 1266 bp, Arabidopsis thaliana
  misc_feature (1)..(1266): Ceres CLONE ID no. 17632
  misc_feature (1)..(1266): Also known as  Ceres CDNA ID no. 23374596
aaaatctcatctttttccctcgacgacaaccaccttagggttaggtttattttctcgcttattctctctaactctttttccctattccgatttcgatttgtcttctccgattcgcttttcctttcgctctctagactctagagtcaatttgatttctactctcgtatcggatctatacttaatcatggatactcgtaagagaggacggcctgaagctggctcattcaactccaatggcggcggatacaagaagtctaagcaagagatggaatcatattcaactggtttaggaagcaaatcgaagccatgcacaaaatttttcagtacttctggctgtcctttcggagagaattgccatttcttgcattatgttcccggaggatacaatgctgtatcgcagatgacaaatatgggaccacccattcctcaagtttccagaaacatgcaaggttctggtaatggaggccgattctcagggaggggagagtctgggcctggccatgtctctaactttggtgactcagccactgccagattcagtgttgatgcctctttagccggtgcaatcattgggaaaggcggagtcagttcaaagcagatatgtcgtcagacgggagtaaaattatcaattcaagatcacgagagagacccaaacttgaagaacattgtgcttgaaggaacacttgagcagataagcgaagcgagtgcaatggtaaaagatttgattgggaggcttaattcagcagctaagaaaccacctggtggtggtcttggtggtggtggtggcatgggttctgaagggaaaccacatccagggagcaacttcaagactaagatatgtgagagattctcaaaaggaaactgtacatttggtgatagatgtcactttgctcatggggaagcagagctacgcaagtcaggaatcgtctagttgttgcttgcagatagagaatttgctggtaaaactagtttcttatttagtggtggtgatatctgatatcatcttcacctactttgtttttgtttgttatgagagaatacaattttagtttcattatcattgtaagtctatttggtgtttttttttaatagctttagtttttggttaattctgagtatgaattgagatgggaggaagcttgaagagaatgattgacaaaactcagaaacagtggttaggattgtatgacgccttttattcatattcttgttatctccgttatgtcatgtgtgtgaatcacttatataattttcgtaagattttcc

SEQ ID NO: 322 - protein, 248 aa, Arabidopsis thaliana
  misc_feature (37)..(63): Pfam Name: zf-CCCH; Pfam Description: Zinc finger C-x8-C-x5-C-x3-H type (and similar)
  misc_feature (115)..(177): Pfam Name: KH_1; Pfam Description: KH domain
  misc_feature: Utility: Useful for delaying flowering time
  misc_feature: Utility: Useful for increasing chlorophyll and photosynthetic capacity
  misc_feature: Utility: Useful for making plants with increased biomass and foliage
  misc_feature: Utility: Useful for making smaller plants
MDTRKRGRPEAGSFNSNGGGYKKSKQEMESYSTGLGSKSKPCTKFFSTSGCPFGENCHFLHYVPGGYNAVSQMTNMGPPIPQVSRNMQGSGNGGRFSGRGESGPGHVSNFGDSATARFSVDASLAGAIIGKGGVSSKQICRQTGVKLSIQDHERDPNLKNIVLEGTLEQISEASAMVKDLIGRLNSAAKKPPGGGLGGGGGMGSEGKPHPGSNFKTKICERFSKGNCTFGDRCHFAHGEAELRKSGIV

SEQ ID NO: 323 - protein, 295 aa, Glycine max
  misc_feature (1)..(295): Ceres CLONE ID no. 473410
  misc_feature: Utility: Useful for delaying flowering time
  misc_feature: Utility: Useful for increasing chlorophyll and photosynthetic capacity
  misc_feature: Utility: Useful for making plants with increased biomass and foliage
  misc_feature: Utility: Useful for making smaller plants
MDIRKRGRPEPGFSLNGGFKKSKQEMESLSTGVGSKSKPCTKFFSTAGCPFGEGCHFLHYVPGGYNAVAHMMNLTPAAPLPPTRNVAALPHVPNGSAPSAVKTRICNKFNTAEGCKFGDKCHFAHGEWELGKHIAPSFDDHRAMGPPGAGRLAGRMEPPGPAASFGANSTAKISVEASLAGAIIGKGGVNSKQICRQTGAKLSIREHESDPNLRNIELEGSFEQIKEASNMVKDLLLTLQMSAPPKTTPGVPGAPASHGSNFKTKLCENFAKGSCTFGDRCHFAHGASELRKSGV

SEQ ID NO: 324 - protein, 300 aa, Glycine max
  misc_feature (1)..(300): Public GI no. 50905911
  misc_feature: Utility: Useful for delaying flowering time
  misc_feature: Utility: Useful for increasing chlorophyll and photosynthetic capacity
  misc_feature: Utility: Useful for making plants with increased biomass and foliage
  misc_feature: Utility: Useful for making smaller plants
MEVGGRKRGKPDGANGAGGKRARESESFQTGVGSKSKPCTKFFSTSGCPFGEGCHFLHHFPGGYQAVAKMTNLGGPAIAPPPGRMPMGNAVPDGPPTPTVKTRLCNKYNTAEGCKWGDKCHFAHGERELGKPMLMDSSMPPPMGPRPTGHFAPPPMPSPAMSTPASFGASATAKISVDASLAGGIIGRGGVNTKQISRVTGAKLAIRDHESDTNLKNIELEGTFDQIKNASAMVRELIVSIGGGAPPQGKKPVGGSHRGGGPGSNFKTKLCENFTKGSCTFGDRCHFAHGENELRKSAAA

SEQ ID NO: 325 - protein, 299 aa, Triticum aestivum
  misc_feature (1)..(299): Ceres CLONE ID no. 703717
  misc_feature: Utility: Useful for delaying flowering time
  misc_feature: Utility: Useful for increasing chlorophyll and photosynthetic capacity
  misc_feature: Utility: Useful for making plants with increased biomass and foliage
  misc_feature: Utility: Useful for making smaller plants
MDAGRKRAVPEGANGGAAVKRARESESVQTGVGSKSKPCTKFFSTAGCPFGSSCHFLHNFPGGHQAVSKMTNLGGPAVSAPQGRMPMGPGVPDGPPTPSLKTRLCNKFNTAEGCKWGNKCHFAHGERELGKPMLLNNSMAPPMGPRPNGHFQPPPMPGPDMVPPSTFGASATAKISVDASLAGAIIGKGGVNTKHISRMTGAKLAIRDNEADPNHKNIELEGSFDQVNHASAMVKELILRIGGNAPPQAKNPGRGPAGGGGGSNFKTKLCDNFNKGSCTFGDRCHFAHGESELRKSAAA

SEQ ID NO: 326 - protein, 339 aa, Zea mays
  misc_feature (1)..(339): Ceres CLONE ID no. 277297
  misc_feature: Utility: Useful for delaying flowering time
  misc_feature: Utility: Useful for increasing chlorophyll and photosynthetic capacity
  misc_feature: Utility: Useful for making plants with increased biomass and foliage
  misc_feature: Utility: Useful for making smaller plants
FLHFSASDLVANRTGGLGFRCASAIGREARLGMEGTAAARKRSRPETANGAAAAGKRSKDTESFQTGLSSKSKPCTKFFSTIGCPFGEGCHFLHFVPGGYPAVAKMLNLSSSAVSAPSRTHVDHAALTGASHPASTVKTRMCTKYNTTEGCKFGDKCHFAHSERELAKPAYMSQEGPPMGGRYGRAEPMQPAAMGPPAGNFGASATAKISVDASLAGGIIGKGGVNTKQISRITGVKLSIRDHESNPNLKNIELEGNFDQIKQASDLVRDLIATISASMPAKNPSAAAAPAGGGRGGGPGGKSSNYKTKLCENFLKGACTFGDRCHFAHGETEQRRGAA

SEQ ID NO: 327 - protein, 306 aa, Zea mays
  misc_feature (1)..(306): Ceres CLONE ID no. 1459706
  misc_feature: Utility: Useful for delaying flowering time
  misc_feature: Utility: Useful for increasing chlorophyll and photosynthetic capacity
  misc_feature: Utility: Useful for making plants with increased biomass and foliage
  misc_feature: Utility: Useful for making smaller plants
MDAAARKRSRPESANGGAAGGKRSRESESQQTGLSSKSKPCTKFFSTVGCPFGEGCHFAHFVPGGYQAVSKSHSLGHAAVSAPSRAPADHAASGVKTRMCTKYNTAEGCKFGDKCHFAHGERELGRPPSSYMSQESSYAPPMGGRYGGRHEPPLPASMGPPAGNFGASSTCKVSVDAALAGGIIGKGGVNTKQICRITGVKLSIRDHESNPDLKNIELEGSFDQIKQANDMVRDLIASISASTPSKNPASAAAPAGRGGGGGGGGPGGRSNYKTKICENFLKGTCTFGERCHFAHGETEQRKGAAV

SEQ ID NO: 328 - DNA, 1787 bp, Arabidopsis thaliana
  misc_feature (1)..(1787): Ceres CLONE ID no. 18612
  misc_feature (1)..(1787): Also known as  Ceres CDNA ID no. 23381084
aaaagcttataaacacatacaaataaatccacttcaaagtttttctcttttttctctgcattattatcacttcaccacattcacaacaatcccaaatttttctttctcatacttcatattttgattactacttctcagagattcttttgagaaagagagtgagggcaataaaaaaagctatggatttcgatttgaacggaggaaacaaacgagtcttcaacagactcggtggcggcggcggcgtcggcggcgggtcaactcgtccgatggcaccaacggatacaagacaaaaggtttgtttccactggcgagctgggcgttgtaatcgttctccttgtccttatctacatcgggaattaccgggtcctggtccgggtcagggtcaaggtccgggttatacgaacaaaagggttgctgaggaatctggttttgcgggtccgagtcatcggagaggacctgggtttaatgggaactcgagtagtagttgggggagatttggtgggaacagaacggtgacgaagactgagaaagtttgcaacttttgggtagatgggaattgcacatacggtgataagtgtagatacttgcattgttggagtaaaggagagagctttgcgttgttgactcagcttgatggtcatgagaagcttgttagtggtattgctttgccttctggttctgataagctttacactggaagtaaagatgagaccttgcgtgtttgggattgtgcttctggacagtgtacaggagtactcaaacttggtggggaaattggctgtgtgcttagtgaaggcccgaggctattagttggcatgccaaatcttgtcaaggcgtggaatattgaaaccaatgctgaccagagtctaagtggacctgttggccaagtctattctcttgttgtgggtactgatctgctctttgctggaacacaggatggctctattttggcatggagatataatgctgccactaactgttttgaaccagcagcgtcactgacgggccatacacttgcagttgttaccttatatgttggggcaaacagactttattcaggttccatggacaaaactataaaagtttggagtttggataatctacagtgtatacaaacactcacggatcatacatcagttgtgatgtctcttatttgctgggatcagtttcttttgtcttgttcattggacaacacggttaagatatgggctgcaattgaaggtggcaatttggaagtaacatatactcacaaagaagaacatggagtgctagctctatgtggtgtacatgatgcagaagccaagcctgttttgttatgcgcttgcaatgacaacaccttgcgcctctacgacttaccatcatttacggagaggggaaaaatctttgcaaagcaagagatacgggcgatccagataggtcccgggggcatatttttcacgggtgatggaactggtcaagttaaagtatggaaatggtgcactgaaccaaccgcggctttgccttgagaaagtttgatgctatcgtcaactagatgttttctacgattttcttgtaccattatatatgagtctatttttgagacttttctttcttgttgaggtcctagtagaagccacggtttgatgaaatggacagtggccaagatcgtgtcatgttaggagttttgagacagaattgggagaatttaggtccctttttgtccaatttcagcatttgtcttgtaacacttggattgtattggtcaatttatcataaaggattatcttattcaagagagattcagagtt

SEQ ID NO: 329 - protein, 441 aa, Arabidopsis thaliana
  misc_feature (352)..(391): Pfam Name: WD40; Pfam Description: WD domain, G-beta repeat
  misc_feature (114)..(139): Pfam Name: zf-CCCH; Pfam Description: Zinc finger C-x8-C-x5-C-x3-H type (and similar)
  misc_feature: Utility: Useful for delaying flowering time
  misc_feature: Utility: Useful for making ornamental plants with modified leaves
  misc_feature: Utility: Useful for making plants sterile and for genetic confinement
  misc_feature: Utility: Useful for making plants with increased biomass and foliage
  misc_feature: Utility: Useful for making smaller plants
MDFDLNGGNKRVFNRLGGGGGVGGGSTRPMAPTDTRQKVCFHWRAGRCNRSPCPYLHRELPGPGPGQGQGPGYTNKRVAEESGFAGPSHRRGPGFNGNSSSSWGRFGGNRTVTKTEKVCNFWVDGNCTYGDKCRYLHCWSKGESFALLTQLDGHEKLVSGIALPSGSDKLYTGSKDETLRVWDCASGQCTGVLKLGGEIGCVLSEGPRLLVGMPNLVKAWNIETNADQSLSGPVGQVYSLVVGTDLLFAGTQDGSILAWRYNAATNCFEPAASLTGHTLAVVTLYVGANRLYSGSMDKTIKVWSLDNLQCIQTLTDHTSVVMSLICWDQFLLSCSLDNTVKIWAAIEGGNLEVTYTHKEEHGVLALCGVHDAEAKPVLLCACNDNTLRLYDLPSFTERGKIFAKQEIRAIQIGPGGIFFTGDGTGQVKVWKWCTEPTAALP

SEQ ID NO: 330 - protein, 430 aa, Arabidopsis thaliana
  misc_feature (1)..(430): Ceres CLONE ID no. 1359803
  misc_feature: Utility: Useful for delaying flowering time
  misc_feature: Utility: Useful for making ornamental plants with modified leaves
  misc_feature: Utility: Useful for making plants sterile and for genetic confinement
  misc_feature: Utility: Useful for making plants with increased biomass and foliage
  misc_feature: Utility: Useful for making smaller plants
MDLDMNGGNKRVFQRLGGGSNRPTTDSNQKVCFHWRAGRCNRYPCPYLHRELPGPGSGPVAASSNKRVADESGFAGPSHRRGPGFSGTANNWGRFGGNRTVTKTEKLCKFWVDGNCPYGDKCRYLHCWSKGDSFSLLTQLDGHQKVVTGIALPSGSDKLYTASKDETVRIWDCASGQCTGVLNLGGEVGCIISEGPWLLVGMPNLVKAWNIQNNADLSLNGPVGQVYSLVVGTDLLFAGTQDGSILVWRYNSTTSCFDPAASLLGHTLAVVSLYVGANRLYSGAMDNSIKVWSLDNLQCIQTLTEHTSVVMSLICWDQFLLSCSLDNTVKIWAATEGGNLEVTYTHKEEYGVLALCGVHDAEAKPVLLCSCNDNSLHLYDLPSFTERGKILAKQEIRSIQIGPGGIFFTGDGSGQVKVWKWSTESTPILS

SEQ ID NO: 331 - protein, 430 aa, Arabidopsis thaliana; identical to SEQ ID NO: 330
  misc_feature (1)..(430): Public GI no. 12057164
  misc_feature: Utility: Useful for delaying flowering time
  misc_feature: Utility: Useful for making ornamental plants with modified leaves
  misc_feature: Utility: Useful for making plants sterile and for genetic confinement
  misc_feature: Utility: Useful for making plants with increased biomass and foliage
  misc_feature: Utility: Useful for making smaller plants

SEQ ID NO: 332 - protein, 427 aa, Zea mays
  misc_feature (1)..(427): Ceres CLONE ID no. 374674
  misc_feature: Utility: Useful for delaying flowering time
  misc_feature: Utility: Useful for making ornamental plants with modified leaves
  misc_feature: Utility: Useful for making plants sterile and for genetic confinement
  misc_feature: Utility: Useful for making plants with increased biomass and foliage
  misc_feature: Utility: Useful for making smaller plants
MDIEADGRFGNKRVHNRLGPGSGGAPPSTNGKVCNYWRAGRCNRFPCPFLHSELPEAAPPKRPTGPGGNVWRNPNTGGRGGGHHNRWGKGPGGGSGIASHKPPERPCKYFLAGTECSYGERCRYPHSYCISDSIAMLTLLKGHEQGVTGIALPAGSDKLYSGSKDGTVRMWDCQTGQCAGVITMGREVGCMIIEGPWLFVGIPDAVKVWNMQTAAEMSLTGPTGQVYALAVASELLFAATQAGRILAWRFSAATNCFEPAASLDGHKLAVVSLIVGGMRLYSASMDKTIRVWDLATLQCIQTLSDHTDVVMSVLCWDQFLLSCSLDQTIKVWAATESGNLEVTYTHKEDQGALALSGMPDAQSKPVLLCSLNDNTVRLYDLPSFSDRGRLFSKKEIRAIQMGPGGLFFTGDGTGELKVWQWVDLAQT

SEQ ID NO: 333 - protein, 427 aa, Zea mays
  misc_feature (1)..(427): Public GI no. 50919691
  misc_feature: Utility: Useful for delaying flowering time
  misc_feature: Utility: Useful for making ornamental plants with modified leaves
  misc_feature: Utility: Useful for making plants sterile and for genetic confinement
  misc_feature: Utility: Useful for making plants with increased biomass and foliage
  misc_feature: Utility: Useful for making smaller plants
MAAVQLLPLPPAAPPQPRRGKPGCWNTPPAPPKVCHYWKSGRCSRNPCRFLHTDAPDPAPPIAAVNTRSNTWVNPSCVAANSDGKGRAPPVQPAKRQVEAPPETPAKRRCGGGAWCVGDGFCGVARLKGHAKAVTGFALPEGSDKLFSGSLDSTVRAWDCSTGQCVRVEEMQEGEVHKLIAMGPWVLAGVRGAVKAIHTGTGKELRLRGPASQITAMLAEDEDHLFAGAEDGAVFMWRMNQEQQSFDEVAALTGHYKAVVSLAQGKGALYSGSTDGSIRVWDLDTHRCIYSFAGHSSTVTALLCWERFLLSSSDDGTVKVWQWKPDHDDLDLEVHYTHKEDERVVSMDGTYDADEKPVLLVSRGDGVVRVYDLPSLKKRGDIICDDEVRTISVRSRGVVFTGDASGEVRVVKWTSLSDAAESYLAMA

SEQ ID NO: 334 - protein, 441 aa, Triticum aestivum
  misc_feature (1)..(441): Ceres CLONE ID no. 925629
  misc_feature: Utility: Useful for delaying flowering time
  misc_feature: Utility: Useful for making ornamental plants with modified leaves
  misc_feature: Utility: Useful for making plants sterile and for genetic confinement
  misc_feature: Utility: Useful for making plants with increased biomass and foliage
  misc_feature: Utility: Useful for making smaller plants
MAAVQRRQPLPPASHQLRRADPACPGTAPPPVCRYWKSGHCGRNPCRFLHADPAPPPPVVVVAKKRSNTWVNTSSKIAKPSATTDEGEAAVPPVPPPTKAKPSPATNAREAAVPLPPPERVQEPPGSGAWCVGDGIRGVARLEGHSKAVTGVAVPEGSGKLFSGSLDGTVRAWDCATGQCVRVAPVQEGEVGRLIAMGPWVLVRVRGAVRAFQAGSGEELRLRLPVAAAQVTALLAEDDERLFAGVEDGAIYMWRLDPGRQRFDEVAALAGHDGHAVASLAQGKGALYSGAADGGIRVWDLETRRCVCSFAGHASMVTALLCWDRFLLSSSVDGTVKAWRSKPDRAGDVEPELEVHYTHREEGERVVAMDGTHDADKKPVLLVSRGDGVVRVCDLPSFKPRGQIRCNGEVTAMSLRTPGVIFTGDKSGEVRVVKWTPAAAA

SEQ ID NO: 335 - DNA, 1326 bp, Arabidopsis thaliana
  misc_feature (1)..(1326): Ceres CLONE ID no. 18820
  misc_feature (1)..(1326): Also known as  Ceres CDNA ID no. 23386374
agccttttcatctctcttgcatcacaagtaaacctctcatcattcatttccacacagcactgaaactcgagcatttgctctctcgaatcccatttccctagctaaaaggttcggaattccacaacaacaacaaaagacctattttgtgaatcttttctctaaattaagagttattagggcaaatttctacatagcatgggctacatctccaacaacaacctcatcaactatttgcccctctctactactcaacctcctcttcttctcacccactgtgatattaacggcaatgatcaccatcagctcataaccgcatcatcaggagaacacgatattgatgaacggaaaaacaacattcctgcggcggcgactttgagatggaatccgacgccagagcagatcacgacgctagaagagctttacagaagcggaacacggacgccgacgacggaacagatccaacagatagcatctaagcttcgtaaatatgggagaatcgaagggaagaacgttttctattggtttcagaatcataaggctagagagagactaaaacgccgccgtcgtgaaggtggtgctattatcaaaccacataaagacgtcaaggattcatcatcaggtggtcatcgagttgatcagacaaagctctgcccatcttttccacacacaaaccgaccacagccacagcatgaattagatcctgcgagttacaataaagacaacaatgctaataatgaagatcatgggacgactgaagaatctgatcagagggcatcagaggttggtaaatacgccacatggagaaatcttgttacttggtcgataactcaacaaccggaagagattaatatcgacgaaaatgtcaacggagaagaagaagaaacgagggacaaccggactttaaatctctttccggttagggagtaccaagagaaaacaggccggttgatagagaagacgaaagcatgcaactactgttactactacgagttcatgcctctgaagaactgaaacaaaaaacccatgtgtgaataataaataggactttaatgaaggttttatttgttgttttgtccacgaatggtaagtgatgtgttcttataatagaagagaagcgtttgaagatggagacgtgtagtaaatgttatataggagcgtttgaagattattattgttagttattacccaaatgagaaggtggaccatgttggggcttgggtttggagttgcaactatctatacatatgtctgaaagtgaaactgaaagcttcgatggttccttgtcaatgtaaggaatatatattaattagatgtttgttagtaatc

SEQ ID NO: 336 - protein, 271 aa, Arabidopsis thaliana
  misc_feature (58)..(119): Pfam Name: Homeobox; Pfam Description: Homeobox domain
  misc_feature: Utility: Useful for delaying flowering time
  misc_feature: Utility: Useful for making ornamental plants with modified leaves
  misc_feature: Utility: Useful for making plants that grow better in shade
  misc_feature: Utility: Useful for making plants with altered leaf shape eg curled leaves
  misc_feature: Utility: Useful for making plants with enhanced abiotic stress tolerance
  misc_feature: Utility: Useful for making plants with increased biomass and foliage
  misc_feature: Utility: Useful for making smaller plants
MGYISNNNLINYLPLSTTQPPLLLTHCDINGNDHHQLITASSGEHDIDERKNNIPAAATLRWNPTPEQITTLEELYRSGTRTPTTEQIQQIASKLRKYGRIEGKNVFYWFQNHKARERLKRRRREGGAIIKPHKDVKDSSSGGHRVDQTKLCPSFPHTNRPQPQHELDPASYNKDNNANNEDHGTTEESDQRASEVGKYATWRNLVTWSITQQPEEINIDENVNGEEEETRDNRTLNLFPVREYQEKTGRLIEKTKACNYCYYYEFMPLKN

SEQ ID NO: 337 - protein, 250 aa, Zea mays
  misc_feature (1)..(250): Ceres CLONE ID no. 277479
  misc_feature: Utility: Useful for delaying flowering time
  misc_feature: Utility: Useful for making ornamental plants with modified leaves
  misc_feature: Utility: Useful for making plants that grow better in shade
  misc_feature: Utility: Useful for making plants with altered leaf shape eg curled leaves
  misc_feature: Utility: Useful for making plants with enhanced abiotic stress tolerance
  misc_feature: Utility: Useful for making plants with increased biomass and foliage
  misc_feature: Utility: Useful for making smaller plants
MRLHHFHVAYLDKAAGSPPPSSSPPSISPASHSHSSSSAATIVPLALQQYCLRPLAPKISFPEARKMVVLPEFARVRNASSRLLNCTVQVPPTTTTVGGTTRWNPSPDQIRVLEMLYRGGMRTPNSFQIEQITEELGKYGRIEGKNVFYWFQNHKARERQKQKRAALLTLSTTTTASTLLPPAAETKEGVETKKEEACEDASSRKRRCRAWEDVVVHGGGDDAGTEVADDYYTDDDVTLELFPLRPDQGK

SEQ ID NO: 338 - protein, 264 aa, Brassica napus
  misc_feature (1)..(264): Ceres CLONE ID no. 978584
  misc_feature: Utility: Useful for delaying flowering time
  misc_feature: Utility: Useful for making ornamental plants with modified leaves
  misc_feature: Utility: Useful for making plants that grow better in shade
  misc_feature: Utility: Useful for making plants with altered leaf shape eg curled leaves
  misc_feature: Utility: Useful for making plants with enhanced abiotic stress tolerance
  misc_feature: Utility: Useful for making plants with increased biomass and foliage
  misc_feature: Utility: Useful for making smaller plants
  misc_feature (118)..(118): Xaa is any aa, unknown, or other
  misc_feature (119)..(119): Xaa is any aa, unknown, or other
HFRNKDIRAMKVHEFSNGFSSWEQHDSPSSLSLSCKRLRPLGPKLSGSPCSPSSSSGVTSATFDLKSFIKPDQTGPRKFEYSIEHQRDLPHVGTHQGGTRWNPTQEQIGILEMLYKGXXRTPNAQQIENITSQLGKYGKIEGKNVFYWFQNHKARERQKQKRNNFISLSCLSSFKTTNINNASVTTKTTTSSNDVIRRDSMVEKGELVEEAEYKRTCRSWGFENLEIDSRRNINSSKNATMATTFNKIIENVTLELFPLHPEGR

SEQ ID NO: 339 - protein, 231 aa, Glycine max
  misc_feature (1)..(231): Ceres CLONE ID no. 673690
  misc_feature: Utility: Useful for delaying flowering time
  misc_feature: Utility: Useful for making ornamental plants with modified leaves
  misc_feature: Utility: Useful for making plants that grow better in shade
  misc_feature: Utility: Useful for making plants with altered leaf shape eg curled leaves
  misc_feature: Utility: Useful for making plants with enhanced abiotic stress tolerance
  misc_feature: Utility: Useful for making plants with increased biomass and foliage
  misc_feature: Utility: Useful for making smaller plants
MKVHQFARGFWEHEPSLTLGCKRLRPLAPKLSNTDTISPPHHPVTTFDLKSFIKPESASRKLGIGSSDDNTNKRDPSSPQGQAETHIPGGTRWNPTQEQIGILEMLYRGGMRTPNAQQIEQITAQLSKYGKIEGKNVFYWFQNHKARERQKQKRNNLGLAHSPRTTLTTSPPFSCCVITTMDTTKRGEVVEREEEDSPLKKCRSWAFEYLEDQREEEHRTLELFPLHPEGR

SEQ ID NO: 340 - protein, 235 aa, Triticum aestivum
  misc_feature (1)..(235): Ceres CLONE ID no. 1018883
  misc_feature: Utility: Useful for delaying flowering time
  misc_feature: Utility: Useful for making ornamental plants with modified leaves
  misc_feature: Utility: Useful for making plants that grow better in shade
  misc_feature: Utility: Useful for making plants with altered leaf shape eg curled leaves
  misc_feature: Utility: Useful for making plants with enhanced abiotic stress tolerance
  misc_feature: Utility: Useful for making plants with increased biomass and foliage
  misc_feature: Utility: Useful for making smaller plants
MRVHHLHAPSYLEKAASASPSPATAPSTSPPSALFPFGAFQCLRPLAPKISLPDQPKKLVAPPDVLGRVRNATKLLSCTVRNHTVQVPVGGTTRWNPSAEQIKVLEALYRGGMRTPNSAQIERITEELGRHGRIEGKNVFYWFQNHKARERQKQKRAALLTLSTLDSSSLPATATKDGAGDKKEDCDEATNSCKRRCMKWSAGHGDAAAEVAAPDGCTDNVTLELFPLRPQGKAA

SEQ ID NO: 341 - DNA, 950 bp, Arabidopsis thaliana
  misc_feature (1)..(950): Ceres CLONE ID no. 19188
  misc_feature (1)..(950): Also known as  Ceres CDNA ID no. 23366917
acctaaaaccacaagcaaattgaacccttctcccttttttcatctacaaaccatcttttcttctcaagtctctgccatggcgactctcaaagcttcctttttgatcaaaaccctcgacaatgacgtcaccggagattttctctccgatctggaacgtcgtgggtcaggtgctgttcatgttatcatgggtcctatgttttctgggaaatcgacctctctccttcgccgaatcaagtcagagatcagcgacggaagaagtgttgcgatgctgaaatcgagtaaggatacgagatacgcaaaagattcggtggtgacacatgatggaattggattcccttgctgggctcttccagatctcatgtcatttcctgagaaattcggactagatgcttataacaagcttgatgtgattggtattgatgaggctcagttctttggagatctttatgagttttgctgcaaagtcgctgatgatgatggtaaaattgtgatcgttgctggcctagatggtgactatttaaggaggagttttggggctgtacttgacattataccaatagctgattctgtgactaagctaactgcaaggtgtgaggtctgtggacataaagctttcttcactttaagaaagaattgtgacaccagaactgagcttattggtggagctgatgtctatatgcctgtttgtcgcaagcattacatcactaatcatattgttattaaagcctctaagaaagtcttggaagattctgacaaggctagagctgaatcctgtgttgctgctacaatctaactataaatgatatggaacaagcaacatatgttatggtgaagttttctttcttttttggttgtttggtttctttactggtctggtttatccttaatgttgtctttgaaatacacttgtgatgttcattgtatataaatataagtttgatgctttctct

SEQ ID NO: 342 - protein, 238 aa, Arabidopsis thaliana
  misc_feature (31)..(208): Pfam Name: TK; Pfam Description: Thymidine kinase
  misc_feature: Utility: Useful for delaying flowering time
  misc_feature: Utility: Useful for increasing chlorophyll and photosynthetic capacity
  misc_feature: Utility: Useful for making larger plants
  misc_feature: Utility: Useful for making smaller plants
MATLKASFLIKTLDNDVTGDFLSDLERRGSGAVHVIMGPMFSGKSTSLLRRIKSEISDGRSVAMLKSSKDTRYAKDSVVTHDGIGFPCWALPDLMSFPEKFGLDAYNKLDVIGIDEAQFFGDLYEFCCKVADDDGKIVIVAGLDGDYLRRSFGAVLDIIPIADSVTKLTARCEVCGHKAFFTLRKNCDTRTELIGGADVYMPVCRKHYITNHIVIKASKKVLEDSDKARAESCVAATI

SEQ ID NO: 343 - protein, 234 aa, Brassica napus
  misc_feature (1)..(234): Ceres CLONE ID no. 953088
  misc_feature: Utility: Useful for delaying flowering time
  misc_feature: Utility: Useful for increasing chlorophyll and photosynthetic capacity
  misc_feature: Utility: Useful for making larger plants
  misc_feature: Utility: Useful for making smaller plants
MATPKASVLLSDISKDEGHLGSGAIHVITGPMFSGKSTSLLRRIKTEISVGRSVAMVKSSKDTRYAKDSVVTHDGIGFPCWALPDLMSFPERFGQDAYDKLDVIGIDEAQFFGDLYEFCCKVADVDGKTVVVAGLDGDYLRRRFGAILDIIPIADSVTKLTARCEVCGQKGFFTLRKTCDTRTELIGGADVYMPVCRKHYVNNQIVINASKKVLDSDKERAESCVDTVATMVQV

SEQ ID NO: 344 - protein, 216 aa, Triticum aestivum
  misc_feature (1)..(216): Ceres CLONE ID no. 901252
  misc_feature: Utility: Useful for delaying flowering time
  misc_feature: Utility: Useful for increasing chlorophyll and photosynthetic capacity
  misc_feature: Utility: Useful for making larger plants
  misc_feature: Utility: Useful for making smaller plants
MASSSSLSLDTAKDLSNSSGEVHVIVGPMFAGKTTALLCRIESELNAAKNVVLLKSSKDTRYAIDSVVTHDGIKFPCRALPDLLSFREKHGDDAYQKLDVIGIDEAQFFEDLYEFCCKAADEDGKTVIVAGLDGDYLRRSFGSVLHIIPLADSVTKLTARCELCGKRAFFTLRKTEQRETELIGGADLYMPVCRLHYLNSQVAERSVLESQNFKTD

SEQ ID NO: 345 - protein, 194 aa, Glycine max
  misc_feature (1)..(194): Ceres CLONE ID no. 524628
  misc_feature: Utility: Useful for delaying flowering time
  misc_feature: Utility: Useful for increasing chlorophyll and photosynthetic capacity
  misc_feature: Utility: Useful for making larger plants
  misc_feature: Utility: Useful for making smaller plants
MFAGKTTSLLRRIQSETTNGRNVAIIKSSKDTRYGLDSIVTHDGAELPCWALANLSSFKQKFGIDAYEKLDVIGIDEAQFFDDLYEFCLQAADHDGKTVIVAGLDGNYLRRSFGSVLDIIPLADSVTKLTARCEICGKRACFTLRKTQDKQIELIGGVDVYMPVCRQHYVSGQVAMEATRHVLESHKVECASHT

SEQ ID NO: 346 - protein, 234 aa, Glycine max
  misc_feature (1)..(234): Public GI no. 33325041
  misc_feature: Utility: Useful for delaying flowering time
  misc_feature: Utility: Useful for increasing chlorophyll and photosynthetic capacity
  misc_feature: Utility: Useful for making larger plants
  misc_feature: Utility: Useful for making smaller plants
MAFSSSARNPVDLRNGSKNSFCPVGEIHVIVGPMFAGKTTALLRRVNLESNDGRNVVLIKSSKDARYAVDAVVTHDGTRFPCWSLPDLSSFKQRFGKDAYEKVDVIGIDEAQFFGDLYEFCCNAADFDGKIIVVAGLDGDYLRKSFGSVLDIIPLADTVTKLTARCELCNRRAFFTFRKTNETETELIGGADIYMPVCRQHYVNGQSVNESAKMVLESHKVSNELILESPLVDP

SEQ ID NO: 347 - protein, 270 aa, Glycine max
  misc_feature (1)..(270): Public GI no. 27476082
  misc_feature: Utility: Useful for delaying flowering time
  misc_feature: Utility: Useful for increasing chlorophyll and photosynthetic capacity
  misc_feature: Utility: Useful for making larger plants
  misc_feature: Utility: Useful for making smaller plants
MRSLLAASTFLRSGASPLLRPLSRPLPSRLNLSRFGPVRPVSAAAAAADKSRGGGGSAMEAQPSYPGEIHVIVGPMFAGKTTALLRRVQVEAGTGRNVALIKSDKDNRYGLDSVVTHDGTKMPCWALPELSSFQDKLGTEAYDKVDVIGIDEAQFFDDLHDFCCKAADRDGKIVVVAGLDGDYKRNKFGSVLDIIPLADSVTKLTARCELCGRRAFFTLRKTRETKTELIGGADVYMPVCRQHYLDGQIVIEATRIVLDLEKSKVIHAFK

SEQ ID NO: 348 - protein, 212 aa, Glycine max
  misc_feature (1)..(212): Public GI no. 3411152
  misc_feature: Utility: Useful for delaying flowering time
  misc_feature: Utility: Useful for increasing chlorophyll and photosynthetic capacity
  misc_feature: Utility: Useful for making larger plants
  misc_feature: Utility: Useful for making smaller plants
MEAQPSYPGEIHVIVGPMFAGKTTALLRRVQVEAGTGRNVALIKSDKDNRYGLDSVVTHDGTKMPCWALPELSSFQDKLGTEAYDKVDVIGIDEAQFFDDLHDFCCKAADRDGKIVVVAGLDGDYKRNKFGSVLDIIPLADSVTKLTARCELCGRRAFFTLRKTRETKTELIGGADVYMPVCRQHYLDGQIVIEATRIVLDLEKSKVIHAFK

SEQ ID NO: 349 - protein, 281 aa, Zea mays
  misc_feature (1)..(281): Ceres CLONE ID no. 284998
  misc_feature: Utility: Useful for delaying flowering time
  misc_feature: Utility: Useful for increasing chlorophyll and photosynthetic capacity
  misc_feature: Utility: Useful for making larger plants
  misc_feature: Utility: Useful for making smaller plants
MRSMFATRSLLAAAAAASAPTVLRASAFASRSLLLYLPFRRGRAARNMLGAARSISSAAPARVGGGAAMEVRAAQSGEIHVIVGPMFAGKTTALLRRVQAEAGNGRSVALIKSDKDNRYGLDSVVTHDGTKMACWALSELSSFHDKLGIDAYNKVDVIGIDEAQFFDDLYDFCCKAADRDGKIVVVAGLDGDYKRRKFGSILDIVPLADSVTKLTARCELCGRRAFFTLRKTQETKTELIGGADVYMPVCRQHYMDGQIVIEATRIVLDLDRSTVTAKALK

SEQ ID NO: 350 - protein, 234 aa, Zea mays
  misc_feature (1)..(234): Ceres CLONE ID no. 226318
  misc_feature: Utility: Useful for delaying flowering time
  misc_feature: Utility: Useful for increasing chlorophyll and photosynthetic capacity
  misc_feature: Utility: Useful for making larger plants
  misc_feature: Utility: Useful for making smaller plants
MLGAARSISSAAPSRVGGRAAMEVRAAQSGEIHVIVGPMFAGKTTALLRRVQAEAGNGRSVALIKSDKDNRYGLDSVVTHDGTKMACWALSELSSFHDKLGIEAYNKVDVIGIDEAQFFDDLYDFCCKAADRDGKIVVVAGLDGDYKRRKFGSILDIVPLADSVTKLTARCELCGRRAFFTLRKTQETKTELIGGADVYMPVCRQHYMDGQIVIEATRIVLDLDRSTVTAKALK

SEQ ID NO: 351 - DNA, 487 bp, Arabidopsis thaliana
  misc_feature (1)..(487): Ceres CLONE ID no. 20257
  misc_feature (1)..(487): Also known as  Ceres CDNA ID no. 23356894
aaaatctcaggtagtaaattgtcaaagctgaggagaaagaaagctttttcggtctgaaattgaagtgcgaatcggggaatctagggtttcgagagagagataatgggtggaggaggacatggcggaggtataacttacaagggagtcactgttcacactcccaagacttggcacaccgtcaccggaaaaggcttgtgcgccgttatgtggttctggattctgtacagggcaaagcaagatggtcctgtagttatgggatggaggcacccttgggatggtcatggtgatcacggtcacggagatcatcactaggtctcactgaacctttgaagatcatgagaaaaaaggatcgtctcttgtttttttcttaattttcagcttcatatgtcgaaataaagagaactgtgaagaagacgtgaattgtttttgtacacaactttgtaagacttgctgcttctgttttaagttactacttgtgtgttgcact

SEQ ID NO: 352 - protein, 69 aa, Arabidopsis thaliana
  misc_feature: Utility: Useful for delaying flowering time
MGGGGHGGGITYKGVTVHTPKTWHTVTGKGLCAVMWFWILYRAKQDGPVVMGWRHPWDGHGDHGHGDHH

SEQ ID NO: 353 - protein, 67 aa, Brassica napus
  misc_feature (1)..(67): Ceres CLONE ID no. 1038259
  misc_feature: Utility: Useful for delaying flowering time
MGGGGGITYKGVTVHTPKTWHTVAGKGLCGVMWFWILYRAKQDGPVVMGWRHPWDGHGDHGHGGDHH

SEQ ID NO: 354 - protein, 58 aa, Brassica napus
  misc_feature (1)..(58): Ceres CLONE ID no. 957946
  misc_feature: Utility: Useful for delaying flowering time
MTYKGVSVQTPKTWHTVAGKGLCGVMWFWILYRAKQDGPVVMGWRHPWDGHGDHGDHH

SEQ ID NO: 355 - protein, 67 aa, Glycine max
  misc_feature (1)..(67): Ceres CLONE ID no. 855445
  misc_feature: Utility: Useful for delaying flowering time
MGGGQGHGTTYKGVTIHQPKRWHTITGKGLCAVMWFWVFYRAKQDGPVVLGWRHPWEGHHDDHGKGH

SEQ ID NO: 356 - protein, 65 aa, Zea mays
  misc_feature (1)..(65): Ceres CLONE ID no. 1447025
  misc_feature: Utility: Useful for delaying flowering time
MGGGGAHGGTTYKGYTIPHNKRWHTIAGKGLCATMWFWIFYRAKQDGAVLLGMRHPWDGHDDHAH

SEQ ID NO: 357 - protein, 80 aa, Zea mays
  misc_feature (1)..(80): Ceres CLONE ID no. 291379
  misc_feature: Utility: Useful for delaying flowering time
MGGGGAHGGTTYKGYTIPHNKRWHTVAGKGLCAVMWFWVFYRAKQDGATLLGLRHPWDGHDDHSHGHGHGHEASSSSSSH

SEQ ID NO: 358 - protein, 80 aa, Zea mays; identical to SEQ ID NO: 357
  misc_feature (1)..(80): Ceres CLONE ID no. 327661
  misc_feature: Utility: Useful for delaying flowering time

SEQ ID NO: 359 - protein, 83 aa, Triticum aestivum
  misc_feature (1)..(83): Ceres CLONE ID no. 1047513
  misc_feature: Utility: Useful for delaying flowering time
  misc_feature (40)..(40): Xaa is any aa, unknown, or other
MGGGGAHGGTTYKGYTIPHNKRWHTIAGKGLCATMWFWIXYRAKQDGAVLLGMRHPWDGHDDHAHGHGHAHEHEASSSSSPSH

SEQ ID NO: 360 - protein, 80 aa, Triticum aestivum
  misc_feature (1)..(80): Ceres CLONE ID no. 639625
  misc_feature: Utility: Useful for delaying flowering time
MGGGGGTTYKGYTIPHNKRWHTIAGKGLCATMWFWIFYRAKQDGAVLLGMRHPWDGHDDHAHGHGHAHEQEASSSSSPSH

SEQ ID NO: 361 - protein, 75 aa, Triticum aestivum
  misc_feature (1)..(75): Ceres CLONE ID no. 1317381
  misc_feature: Utility: Useful for delaying flowering time
  misc_feature (12)..(12): Xaa is any aa, unknown, or other
  misc_feature (39)..(39): Xaa is any aa, unknown, or other
  misc_feature (45)..(45): Xaa is any aa, unknown, or other
  misc_feature (47)..(47): Xaa is any aa, unknown, or other
  misc_feature (67)..(67): Xaa is any aa, unknown, or other
  misc_feature (68)..(68): Xaa is any aa, unknown, or other
MGGGGGAHGGTXYKGYTIPHNKRWHTIAGKGLCATMWFXIFYRAXQXGAVLLGMRHPWDGHDDHAHXXFWTCTRA

SEQ ID NO: 362 - DNA, 862 bp, Arabidopsis thaliana
  misc_feature (1)..(862): Ceres CLONE ID no. 21068
  misc_feature (1)..(862): Also known as  Ceres CDNA ID no. 23367701
aaaccgaaaacagagtagtcaagaaacagagtattttttctacatggatccacttttaattcagtccccattctccggcttctcaccggaatattctatcggatcttctccagaatctttctcatcctcttcttctaacaattactctcttcccttcaacgagaacgactcagaggaaatgtttctctacggtctaatcgagcaatccacgcaacaaacctatatcgactcggaacttcaagaccttccgatcaaatccgtaagctcaagaaagtcagagaagtcttacagaggcgtaagacgacggccatgggggaaattcgcggcggagataagagattcgactagaaacggtattagggtttggctcgggacgttcgaaagcgcggaagaggcggctttagcatacgatcaagccgctttctcgatgagagggtcctcggcgattctcaacttttcggcggagagagttcaagagtcgctttcggagattaagtgtacctacgaggatggttgttctccggttgtggcgttgaagaggaaacactcgatgagacggagaatgaccaataagaaaacgaaagatagtgactttgatcaccgctccgtgaagttagataatgtagttgtctttgaggatttgggagaacagtaccttgaggagcttttgggttcttctgaaaatagtgggacttggtgaaagattaggatttgtgttagggaccttaagtttgaagtggttgattaattttaaccctaatatgttttttgtttgcttaaatatttgattctattgagaaacatcgaaaacagtttgtatgtatttttgtgatacttgactttatcaatttcaagttagtgc

SEQ ID NO: 363 - protein, 218 aa, Arabidopsis thaliana
  misc_feature (80)..(144): Pfam Name: AP2; Pfam Description: AP2 domain
  misc_feature: Utility: Useful for delaying flowering time
  misc_feature: Utility: Useful for increasing chlorophyll and photosynthetic capacity
  misc_feature: Utility: Useful for making ornamental plants with modified leaves
  misc_feature: Utility: Useful for making smaller plants
MDPLLIQSPFSGFSPEYSIGSSPESFSSSSSNNYSLPFNENDSEEMFLYGLIEQSTQQTYIDSELQDLPIKSVSSRKSEKSYRGVRRRPWGKFAAEIRDSTRNGIRVWLGTFESAEEAALAYDQAAFSMRGSSAILNFSAERVQESLSEIKCTYEDGCSPVVALKRKHSMRRRMTNKKTKDSDFDHRSVKLDNVVVFEDLGEQYLEELLGSSENSGTW

SEQ ID NO: 364 - protein, 245 aa, Arabidopsis thaliana
  misc_feature (1)..(245): Public GI no. 25992126
  misc_feature: Utility: Useful for delaying flowering time
  misc_feature: Utility: Useful for increasing chlorophyll and photosynthetic capacity
  misc_feature: Utility: Useful for making ornamental plants with modified leaves
  misc_feature: Utility: Useful for making smaller plants
MDSSSSSSQFFYSMNSDLNSSDSSYEWSNFNTQSYLPFNVNDSEEMLLFGVLNAAHEETTSETVTSHRVKEEEVTSESEVIEAIPAKEKSYRGVRRRPWGKFAAEIRDSTRNGVRVWLGTFDSAEDAALAYDQAAFSMRGNSAILNFPVETVRDSLRDMKCHVDDDCSPVVALKKRHSMRKRSTNSKKVNSISKVVREVKMENVNNVVVFEDLGADYLEQLLSTSCQVIKVVVMQLISVHGKIKD

SEQ ID NO: 365 - protein, 240 aa, Arabidopsis thaliana
  misc_feature (1)..(240): Public GI no. 23452024
  misc_feature: Utility: Useful for delaying flowering time
  misc_feature: Utility: Useful for increasing chlorophyll and photosynthetic capacity
  misc_feature: Utility: Useful for making ornamental plants with modified leaves
  misc_feature: Utility: Useful for making smaller plants
MDSSSSSSQFFYSMNSDLNSSDSSYEWSNFNTQSYLPFNVNDSEEMLLFGVLNAAHEETTSETVTSHRVKEEEVTSESEVIEAIPAKEKSYRGVRRRPWGKFAAEIRDSTRNGVRVWLGTFDSAEDAALAYDQAAFSMRGNSAILNFPVETVRDSLRDMKCHVDDDCSPVVALKKRHSMRKRSTNSKKVNSISKVVREVKMENVNNVVVFEDLGADYLEQLLSSSSSDQSSCDATYFSPW

SEQ ID NO: 366 - protein, 234 aa, Arabidopsis thaliana
  misc_feature (1)..(234): Public GI no. 52547872
  misc_feature: Utility: Useful for delaying flowering time
  misc_feature: Utility: Useful for increasing chlorophyll and photosynthetic capacity
  misc_feature: Utility: Useful for making ornamental plants with modified leaves
  misc_feature: Utility: Useful for making smaller plants
MSSNSSPLEIDTSFSHSNFFFLQDQSPILQWDDDLFFNDPWFDDDQSPIIPCNSEKDENHQVFEESSDNTIMSKGSSHGQELEEVTSQEEKEKEEEEKHYIGVRKRPWGKYAAEIRDSTRNGIRVWLGTFDTAEEAALAYDQAALSMRGPWSLLNFPLEKVKKSLEKIEYSCKDGLSPAAVLKATHKTRRVKHKRSSRKKKNKETHNVIVFEDLGAELLEELLMTSSQHSCRRD

SEQ ID NO: 367 - DNA, 522 bp, Arabidopsis thaliana
  misc_feature (1)..(522): Ceres CLONE ID no. 22461
  misc_feature (1)..(522): Also known as  Ceres CDNA ID no. 23356890
catcttcttcattatcatcatctccatctctctctctctctctctctctcattttcttgaaaaagatgagaaccttaaagactcagaccacaaggggaagaagaagagcaaatgtgtcgtcacgtacgagagttttacacacgtgctgtggaaatggtagtagcgacggagggaagacggtgatggagaagcttcttgcgttaaagagccttcttcctccaccggtgaatgtcggtggtggagagacggaggagctgtttcaagagacggcggagtatatcgtgaagcttagaacacaagtcgtggtgttgaagaaactgattgagatttacgataactcttctgatcagaagaaagatgttgttttataatgttcatttatattttctttaatttaaattatttcaggtttttctgtttttttttgttataaacttataattattatattgtgatccgtaattgttttaggttgtcgatgtctttaatgtattggttaaaaggaaaaagtattgatgattg

SEQ ID NO: 368 - protein, 101 aa, Arabidopsis thaliana
  misc_feature: Utility: Useful for delaying flowering time
  misc_feature: Utility: Useful for increasing chlorophyll and photosynthetic capacity
  misc_feature: Utility: Useful for making ornamental plants with modified flowers
  misc_feature: Utility: Useful for making ornamental plants with modified leaves
  misc_feature: Utility: Useful for making smaller plants
MRTLKTQTTRGRRRANVSSRTRVLHTCCGNGSSDGGKTVMEKLLALKSLLPPPVNVGGGETEELFQETAEYIVKLRTQVVVLKKLIEIYDNSSDQKKDVVL

SEQ ID NO: 369 - protein, 119 aa, Glycine max
  misc_feature (1)..(119): Ceres CLONE ID no. 601676
  misc_feature: Utility: Useful for delaying flowering time
  misc_feature: Utility: Useful for increasing chlorophyll and photosynthetic capacity
  misc_feature: Utility: Useful for making ornamental plants with modified flowers
  misc_feature: Utility: Useful for making ornamental plants with modified leaves
  misc_feature: Utility: Useful for making smaller plants
MTTITRHSYKLSLKRATKRITRRRRRNPHNHRKRSTSTTIDPFKPKCSNNNKVCEKLETLKNLIPGGEEAVKPDQLFKETAEYIVLLRTRVVVLQKLIEYYGNKDDTQDENEHDAVLFS

SEQ ID NO: 370 - DNA, 736 bp, Arabidopsis thaliana
  misc_feature (1)..(736): Ceres CLONE ID no. 23118
  misc_feature (1)..(736): Also known as  Ceres CDNA ID no. 23375835
aattaagatctctctttactgttttcccacttttcctttgagaaaactcaaaacaaagtaaacaaacaaaccagaaaaaggaatggcactgagaatgtgggcttcctctagcaaatgctctcaagctctcttcttctgcctccaaatctcatctcttgccagctttctccatctccagatgcttctcctcagtgttggaaggacttaagtatgcaaattcacatgagtgggtgaaacatgaaggctcagttgctacaattggtatcactgaccatgcgcaggaccatttaggagaagttgtgtttgtggagctgcctgaagcaaacagttcagtgagcaaagaaaaaagctttggagctgttgagagtgttaaggccacaagtgagattctatctccaatctctggtgaagtcattgaggttaacacaaagctcaccgagtcacctggtttgatcaactcaagcccttatgaagatggttggatgataaaggtgaaaccgagcagccccgcggagttggaagctctgatgggtccaaaggaatacaccaagttctgcgaagaagaagacgctgctcactagggtttcttcgccttttatctttcccaaatgttcgaaaaacagagcaaaacaagagaatccatgctttagtttcaatctttcatttctcaatgtttcttaccactctcaacttgtatcagtgtgatactaatttgattaaaagatcatccaatgag

SEQ ID NO: 371 - protein, 41 aa, Arabidopsis thaliana
  misc_feature: Utility: Useful for delaying flowering time
  misc_feature: Utility: Useful for increasing chlorophyll and photosynthetic capacity
  misc_feature: Utility: Useful for making ornamental plants with modified flowers
  misc_feature: Utility: Useful for making plants sterile and for genetic confinement
  misc_feature: Utility: Useful for making plants with increased biomass and foliage
  misc_feature: Utility: Useful for making smaller plants
  misc_feature: Utility: Useful for making stronger plants
MALRMWASSSKCSQALFFCLQISSLASFLHLQMLLLSVGRT

SEQ ID NO: 372 - DNA, 611 bp, Arabidopsis thaliana
  misc_feature (1)..(611): Ceres CLONE ID no. 23203
  misc_feature (1)..(611): Also known as  Ceres CDNA ID no. 23373175
aatcaaaacacgtctcacttatctctcttcttcatttcttctctcttcaagctccaagatgtgtttaagttcttcagaaacattttcagacacacccacgagattagttttatacctcaaaacacaaagtcacgttcgtatccctcgtctctccaggaggagacggatgtggcgggaagagaaaaagatggagatgattaatctaaagctttacgtggagaatcaaaacatcataagagagaacgagaaacttaagaagaaagctcttcttcttcaccaagaaaacaaaactctcttctctctgcttcagaccaaaaaactctcctctgtccataaataaaatcttaccatcatcaccaatcactaagatcatcatattcttctttctttactgaaataataataagatctcaaggctccaagaaaaaaaaaacagaaaaatttgggttttacaagcaagggtttagttattattagtgggtatacatctaatttttatcttctttttagtgtgtcatctctttgtaatctttgtatctgagttcttttgttaaataatggtgtaatctactttcttattcaaagttttggatattaatctttttaatccc

SEQ ID NO: 373 - protein, 109 aa, Arabidopsis thaliana
  misc_feature: Utility: Useful for delaying flowering time
  misc_feature: Utility: Useful for making ornamental plants with modified leaves
  misc_feature: Utility: Useful for making plants that grow better in shade
  misc_feature: Utility: Useful for making plants with altered leaf shape eg curled leaves
  misc_feature: Utility: Useful for making plants with increased biomass and foliage
  misc_feature: Utility: Useful for making smaller plants
RLTYLSSSFLLSSSSKMCLSSSETFSDTPTRLVLYLKTQSHVRIPRLSRRRRMWREEKKMEMINLKLYVENQNIIRENEKLKKKALLLHQENKTLFSLLQTKKLSSVHK

SEQ ID NO: 374 - protein, 91 aa, Brassica napus
  misc_feature (1)..(91): Ceres CLONE ID no. 961876
  misc_feature: Utility: Useful for delaying flowering time
  misc_feature: Utility: Useful for making ornamental plants with modified leaves
  misc_feature: Utility: Useful for making plants that grow better in shade
  misc_feature: Utility: Useful for making plants with altered leaf shape eg curled leaves
  misc_feature: Utility: Useful for making plants with increased biomass and foliage
  misc_feature: Utility: Useful for making smaller plants
  misc_feature (78)..(78): Xaa is any aa, unknown, or other
  misc_feature (79)..(79): Xaa is any aa, unknown, or other
  misc_feature (85)..(85): Xaa is any aa, unknown, or other
  misc_feature (87)..(87): Xaa is any aa, unknown, or other
MCLRSSESFPDTRKMTSASRHNKRKPKTQTHLRVLSLTRRRRMLRAEKEMEMRNMKLFLENQSIIRENEALKKKALFXXQENNAXFXLLHP

SEQ ID NO: 375 - protein, 116 aa, Brassica napus
  misc_feature (1)..(116): Public GI no. 52076162
  misc_feature: Utility: Useful for delaying flowering time
  misc_feature: Utility: Useful for making ornamental plants with modified leaves
  misc_feature: Utility: Useful for making plants that grow better in shade
  misc_feature: Utility: Useful for making plants with altered leaf shape eg curled leaves
  misc_feature: Utility: Useful for making plants with increased biomass and foliage
  misc_feature: Utility: Useful for making smaller plants
MCSGSWNSKNKIYLSLVVFRQDNQQQQQRKQPAHAPMALRRKRLRLRRRRETMRRSDGMEMEMVNLKLYLENRCILEENERLREKASALHRENLALRADLRNTSSPATTAAAASSC

SEQ ID NO: 376 - protein, 110 aa, Glycine max
  misc_feature (1)..(110): Ceres CLONE ID no. 582490
  misc_feature: Utility: Useful for delaying flowering time
  misc_feature: Utility: Useful for making ornamental plants with modified leaves
  misc_feature: Utility: Useful for making plants that grow better in shade
  misc_feature: Utility: Useful for making plants with altered leaf shape eg curled leaves
  misc_feature: Utility: Useful for making plants with increased biomass and foliage
  misc_feature: Utility: Useful for making smaller plants
MCSFSSKQTLYLALPRPWTSKRHHHSHRHLRLGMLNRRRAHLKEARQRKRIVVKSEIQMKNLKLYMENQTIIEENEKLRKQAMLLHKENQALSSQLQKKLSGQNNNTNNN

SEQ ID NO: 377 - protein, 114 aa, Zea mays
  misc_feature (1)..(114): Ceres CLONE ID no. 226408
  misc_feature: Utility: Useful for delaying flowering time
  misc_feature: Utility: Useful for making ornamental plants with modified leaves
  misc_feature: Utility: Useful for making plants that grow better in shade
  misc_feature: Utility: Useful for making plants with altered leaf shape eg curled leaves
  misc_feature: Utility: Useful for making plants with increased biomass and foliage
  misc_feature: Utility: Useful for making smaller plants
MCSGSWSWSSSSSKKRPSLVVVNLKRQQLQKTPPPTPPRASVAIRRKRLRLRRLRAGAEAMEMVNLKLYLENRCIIAENERLRERASALRRENLALLQDLSKTPPVPEAGAGAA

SEQ ID NO: 378 - protein, 114 aa, Zea mays
  misc_feature (1)..(114): Ceres CLONE ID no. 1424939
  misc_feature: Utility: Useful for delaying flowering time
  misc_feature: Utility: Useful for making ornamental plants with modified leaves
  misc_feature: Utility: Useful for making plants that grow better in shade
  misc_feature: Utility: Useful for making plants with altered leaf shape eg curled leaves
  misc_feature: Utility: Useful for making plants with increased biomass and foliage
  misc_feature: Utility: Useful for making smaller plants
MCSGSWSWSSSKKRPSLVVVNLKRQQLQKTPPPTPPRASVAIRRKRLRLRRLRAGAEAMEMVNLKLYLENRCIIAENERLRERASALRRENLALLQDLSKTPAVPEAGAGAGAA

SEQ ID NO: 379 - protein, 114 aa, Zea mays; identical to SEQ ID NO: 378
  misc_feature (1)..(114): Ceres CLONE ID no. 488797
  misc_feature: Utility: Useful for delaying flowering time
  misc_feature: Utility: Useful for making ornamental plants with modified leaves
  misc_feature: Utility: Useful for making plants that grow better in shade
  misc_feature: Utility: Useful for making plants with altered leaf shape eg curled leaves
  misc_feature: Utility: Useful for making plants with increased biomass and foliage
  misc_feature: Utility: Useful for making smaller plants

SEQ ID NO: 380 - protein, 107 aa, Zea mays
  misc_feature (1)..(107): Ceres CLONE ID no. 372782
  misc_feature: Utility: Useful for delaying flowering time
  misc_feature: Utility: Useful for making ornamental plants with modified leaves
  misc_feature: Utility: Useful for making plants that grow better in shade
  misc_feature: Utility: Useful for making plants with altered leaf shape eg curled leaves
  misc_feature: Utility: Useful for making plants with increased biomass and foliage
  misc_feature: Utility: Useful for making smaller plants
MCSGSWSWSSSSSKKRPSLVVVNLKRQQLQKTPPPTPPRASVAIRRKRLRLRRLRAGAEAMEMVNLKLYLENRCIIAENERLRERASALRRENLALMPHCSPGIRFC

SEQ ID NO: 381 - protein, 116 aa, Glycine max
  misc_feature (1)..(116): Ceres CLONE ID no. 607279
  misc_feature: Utility: Useful for delaying flowering time
  misc_feature: Utility: Useful for making ornamental plants with modified leaves
  misc_feature: Utility: Useful for making plants that grow better in shade
  misc_feature: Utility: Useful for making plants with altered leaf shape eg curled leaves
  misc_feature: Utility: Useful for making plants with increased biomass and foliage
  misc_feature: Utility: Useful for making smaller plants
MCSFSSEQSSPYDDLPLVHPPWPSKRQPQHLRFSLHKRRRAQLQEARRRKRMIILKTEIKMRNLKLYMENQSIIEENEKLRKQAVLLHKENEALLFQLQKKLSEQNNSKTNQIAVS

SEQ ID NO: 382 - DNA, 1095 bp, Arabidopsis thaliana
  misc_feature (1)..(1095): Ceres CLONE ID no. 26907
  misc_feature (1)..(1095): Also known as  Ceres CDNA ID no. 24374217
gtagatctttttctgctctttctctctctctctctctctctctctctctctctctcttgtattatttctatctcccccgccgtcgaaagagaaacgtcgatcggagaacctttgaaatgtcgactggattagatatgtctctcgacgacatgatcgccaagaaccgtaagtctcgtggtggagccggccccgctcgtggaaccggatccggatccggaccgggtccgactcgccgcaacaaccctaatcggaaatcaacccgatctgctccataccaatcagccaaggcgccggagtccacctggggtcacgacatgttctccgatagatctgaagatcaccgatcgggacgttcctccgccggaatcgaaactggaaccaagctctacatttccaatttggattacggtgtcatgaacgaagacatcaaggaactgtttgctgaagttggagaacttaaacgctacacagttcattttgatagaagtggaagatcaaagggaactgctgaagtagtgtattctcggcgtggcgatgcactcgcagctgtgaagaagtataatgatgttcagctggatggaaaacccatgaagatagagattgtgggcactaatcttcaaactgctgcagccccgtctggtagacctgcgaatggaaactccaatggtgctccatggagaggaggacaagggagaggaggtcaacgaggtggtggacgaggaggcggtggccgaggtggtggtggtcgtggtaggcgtcctggtaagggccctgcagagaagatttctgcggaagatcttgatgcggatcttgataagtaccattctggagatatggagacaaactaaggaacgtgactgatcttctcaaaccggtaggggttttaggaggaagagaatcgagaaaatgtttgccagaggctttaccacttagcgcctttttggctgtgttgttcatttgtttcattagaatgactttacagaattgagaatatgtgttatttaaagttgttgtctatcttaataccctcaagtgaaaggcagaggaaggaataccaatttcgtttacagatcatatgcaggcaaaagagttttc

SEQ ID NO: 383 - protein, 243 aa, Arabidopsis thaliana
  misc_feature (90)..(160): Pfam Name: RRM_1; Pfam Description: RNA recognition motif. (a.k.a. RRM, RBD, or RNP domain)
  misc_feature: Utility: Useful for delaying flowering time
  misc_feature: Utility: Useful for making larger plants
  misc_feature: Utility: Useful for making ornamental plants with modified leaves
  misc_feature: Utility: Useful for making plants with increased biomass and foliage
  misc_feature: Utility: Useful for making smaller plants
  misc_feature: Utility: Useful for making stronger plants
MSTGLDMSLDDMIAKNRKSRGGAGPARGTGSGSGPGPTRRNNPNRKSTRSAPYQSAKAPESTWGHDMFSDRSEDHRSGRSSAGIETGTKLYISNLDYGVMNEDIKELFAEVGELKRYTVHFDRSGRSKGTAEVVYSRRGDALAAVKKYNDVQLDGKPMKIEIVGTNLQTAAAPSGRPANGNSNGAPWRGGQGRGGQRGGGRGGGGRGGGGRGRRPGKGPAEKISAEDLDADLDKYHSGDMETN

SEQ ID NO: 384 - protein, 247 aa, Glycine max
  misc_feature (1)..(247): Ceres CLONE ID no. 564029
  misc_feature: Utility: Useful for delaying flowering time
  misc_feature: Utility: Useful for making larger plants
  misc_feature: Utility: Useful for making ornamental plants with modified leaves
  misc_feature: Utility: Useful for making plants with increased biomass and foliage
  misc_feature: Utility: Useful for making smaller plants
  misc_feature: Utility: Useful for making stronger plants
MSAAMDMSLDDIIKNNKKSGSGSSRGRIRPSGSGPSRRFPNRAANRAAPYATAKAPEATWQHDLYADQQVAAAGYPAQGGRAASIETGTKLYISNLDYGVSSDDIKELFAEVGDLKRHAVHYDRSGRSKGTAEVVFSRRADAVAAVKRYNNVQLDGKPMKIEIVGTNISTPGVAPARNGAIGNFDGVPRSGQGRGGALRRPGGRGQGVRRDRGRGRGRGGAGRGEKVSADDLDADLEKYHAEAMQLN

SEQ ID NO: 385 - protein, 252 aa, Glycine max
  misc_feature (1)..(252): Public GI no. 51490665
  misc_feature: Utility: Useful for delaying flowering time
  misc_feature: Utility: Useful for making larger plants
  misc_feature: Utility: Useful for making ornamental plants with modified leaves
  misc_feature: Utility: Useful for making plants with increased biomass and foliage
  misc_feature: Utility: Useful for making smaller plants
  misc_feature: Utility: Useful for making stronger plants
MAEAALDMSLDDLIKKNKTDTGGKRRGRGRGGASGPGPARRFPNRSANRAAPYSTAKAPEAAWNHDMFAAADQAFPFGQAGGDQAASSISTGTKLYISNLDYGVSNEDIKELFSEAGDLKRYAIHYDRSGRSKGTAEVVFSRRQDALAAVKRYNNVQLDGKPMKIEIVGTNIATPAAPAFNGAFGFGDTNGGPRTDQARSGGFGRSRGGRGRGRGFRGGSRGRGRGDRGEKVSAEDLDADLMKYHTEAMQTN

SEQ ID NO: 386 - protein, 243 aa, Glycine max
  misc_feature (1)..(243): Ceres CLONE ID no. 473087
  misc_feature: Utility: Useful for delaying flowering time
  misc_feature: Utility: Useful for making larger plants
  misc_feature: Utility: Useful for making ornamental plants with modified leaves
  misc_feature: Utility: Useful for making plants with increased biomass and foliage
  misc_feature: Utility: Useful for making smaller plants
  misc_feature: Utility: Useful for making stronger plants
MSAALDMTLEDIIKNNKKSSLANTRGRGRASGPGPARRLPNRAANRAAPYAAAKAPETAWKHDMYANQPVAAAYPGGRASSIETGTKLYISNLDYGVSNDDIKELFLEVGDVKRHTVHYDRSGRSKGTAEVVFSRRADAVAAVKRYNNVQLDGKPMKVEIVGTNIATHAAPPAVNGTFGNPTGVPRSGQGRSGSLGRPRGGSRGRGSIQRGRGRGRGGRDEKVSAEDLDADLEKYHAEAMQLN

SEQ ID NO: 387 - protein, 249 aa, Glycine max
  misc_feature (1)..(249): Public GI no. 51490663
  misc_feature: Utility: Useful for delaying flowering time
  misc_feature: Utility: Useful for making larger plants
  misc_feature: Utility: Useful for making ornamental plants with modified leaves
  misc_feature: Utility: Useful for making plants with increased biomass and foliage
  misc_feature: Utility: Useful for making smaller plants
  misc_feature: Utility: Useful for making stronger plants
MSNLDVSLDDLIKRNKSSSSRNPRPRTSGSGSGTGSGGPSPRRRFPSRAANRSAPYSSGPVHAPDSTWDHNMFAEHAPAYPAARGAGGISGIETGIKLLISNLDYGVSNEDIKELFSEAGDIKRYSIHYDKSGRSKGTAEVIFSRRRDAEAAIKKYNNVQLDGKPMKIEFAGPNIGAPTLPPLRNRLYRNPNPAPRSQQRGGGFRRPPRGGRGSMRKEGGRGRGRVENITAEDLDADLEKYHAEAMQTN

SEQ ID NO: 388 - protein, 277 aa, Triticum aestivum
  misc_feature (1)..(277): Ceres CLONE ID no. 568942
  misc_feature: Utility: Useful for delaying flowering time
  misc_feature: Utility: Useful for making larger plants
  misc_feature: Utility: Useful for making ornamental plants with modified leaves
  misc_feature: Utility: Useful for making plants with increased biomass and foliage
  misc_feature: Utility: Useful for making smaller plants
  misc_feature: Utility: Useful for making stronger plants
MADALDMSLDDLISKNKSSSQRGRGRRNPASGSGSGSASGGPAPAGRRFQARAATRAAAAPYHQFNFPPPAPAAFAYAAQQAHAHAHAQVMAMVAPPTGVETGTKLYISNLDYNVSNEDIKELFAEVGDLKRYSINYDKSGRSKGTAEVIFSRKSDALAALKRYNNVQLDGKPMKIEVIGTNIEAPPPPPAIFTLNTPTIGNFIPSYSGGRGRGGDGGRGWPRGRGGFGGRSAAGRGRGRGDVGRGRGRGGRGSQPVSANDLDADLDKYHSEAMQTS

SEQ ID NO: 389 - protein, 292 aa, Zea mays
  misc_feature (1)..(292): Ceres CLONE ID no. 218083
  misc_feature: Utility: Useful for delaying flowering time
  misc_feature: Utility: Useful for making larger plants
  misc_feature: Utility: Useful for making ornamental plants with modified leaves
  misc_feature: Utility: Useful for making plants with increased biomass and foliage
  misc_feature: Utility: Useful for making smaller plants
  misc_feature: Utility: Useful for making stronger plants
KKISNSPPQRATLTRFGRFLLCLPLTLVQHPEICSARAAMAETLDMTLDDIIKNNKKSNPSSGGARRSRGGSAPGGGSGGVGPTRRSFKRAGNRQAPYQPPKAPDAAWQHDMYPAVAAGGGGGGRVSALETGTKLYISNLDFGVSNDDIKELFSELGDLKRFSIIYDRSGRSKGTAEVVFARRSDAVAAVKKYNNVQLDGKPMKIEIVGTNTPTASAALPVSNGGHARNAVRSAPRGAAPAGVPQRRPHQRGGRRSGGSGGGRRGKERSKPKSAEELDADLEKYHADAMQTN

SEQ ID NO: 390 - protein, 292 aa, Zea mays; identical to SEQ ID NO: 389
  misc_feature (1)..(292): Ceres CLONE ID no. 240010
  misc_feature: Utility: Useful for delaying flowering time
  misc_feature: Utility: Useful for making larger plants
  misc_feature: Utility: Useful for making ornamental plants with modified leaves
  misc_feature: Utility: Useful for making plants with increased biomass and foliage
  misc_feature: Utility: Useful for making smaller plants
  misc_feature: Utility: Useful for making stronger plants

SEQ ID NO: 391 - protein, 293 aa, Zea mays
  misc_feature (1)..(293): Ceres CLONE ID no. 293151
  misc_feature: Utility: Useful for delaying flowering time
  misc_feature: Utility: Useful for making larger plants
  misc_feature: Utility: Useful for making ornamental plants with modified leaves
  misc_feature: Utility: Useful for making plants with increased biomass and foliage
  misc_feature: Utility: Useful for making smaller plants
  misc_feature: Utility: Useful for making stronger plants
  misc_feature (120)..(120): Xaa is any aa, unknown, or other
KEISNSSPYPPRCFLLPVDLDNLPPANPSPASEIYSARTAMAETLDMTLDDIIKNNKKSNPSSRGARRSRGGSAPGGGTGGVGPTRRPFKRAGNRQAPYQPPKAPDAAWQHDMYPAVAAXGGGGGRVSALETGAKLYISNLDFGVSNEDIKELFSELGDLKRFSINYDRSGRSKGTAEVVFARRSDAVAAVKKYDNVQLDGKPMKIEIVGTNTPAAASAHPVPNGGHARNAARSAPKDAAPAGMSQHRPHQRGGRRAAGSGGGRRGKERSKPKSTEELDADLEKYHADAMQTN

SEQ ID NO: 392 - protein, 262 aa, Zea mays
  misc_feature (1)..(262): Ceres CLONE ID no. 259439
  misc_feature: Utility: Useful for delaying flowering time
  misc_feature: Utility: Useful for making larger plants
  misc_feature: Utility: Useful for making ornamental plants with modified leaves
  misc_feature: Utility: Useful for making plants with increased biomass and foliage
  misc_feature: Utility: Useful for making smaller plants
  misc_feature: Utility: Useful for making stronger plants
YYMQFGKCKFQSACIFNHSKDILSSGWHPAECPFYMKTRTCQFGSACEFYHPKDRRSFKRAGNRQAPYQPPKAPDAAWQHDMYPAVAAGGGGGGRVSALETGTKLYISNLDFGVSNDDIKELFSELGDLKRFSIIYDRSGRSKGTAEVVFARRSDAVAAVKKYNNVQLDGKPMKIEIVGTNTPTASAALPVSNGGHARNAVRSAPRGAAPAGMPQRRPHQRGGRRSGGSGGGRRGKERSKPKSAEELDADLEKYHADAMQTN

SEQ ID NO: 393 - DNA, 1124 bp, Arabidopsis thaliana
  misc_feature (1)..(1124): Ceres CLONE ID no. 27460
  misc_feature (1)..(1124): Also known as  Ceres CDNA ID no. 23385757
aatttatattgttgagctgtgtgtgtggagatgatgatgatgatgatgataaacccaatagaattttaaaaggataagaatcgcaaagctcatatcacaaaactttgagatctcatttcatctttcttcgattctacctactccgattcaatcgatcttatcgagacatggatgctcgtaagagaggacgccctgaagctgctgcctctcacaactccaatggcggattcaagaggtctaagcaagagatggaatcaatttcaactggtttaggaagcaaatccaagccatgcactaaatttttcagcacttctggatgtccatttggtgacaattgccacttcttgcactatgtgcccggtgggtacaatgctgcagcgcagcatgaaaaatctccgaccaccggtttctcaagtttccagaaatatgcaaggatctggtggtcccggcggcagattctcagggagaggagatccaggatcaggccctgtttcaatctttggtgcttctacttccaagatcagtgtagatgcttctttagccggtgccatcattggaaaaggtggaatccattccaaacagatatgccgtgaaacaggagcaaaattatcgattaaagatcatgaaagagacccaaacttgaagattatcgagctggaaggaacatttgaacagatcaatgtagcgagtgggatggtgagagagcttatagggaggcttggatcagtgaagaaacctcaagggattggtggtcctgaagggaaaccacatcctgggagcaactacaaaaccaagatctgtgataggtactctaaagggaactgtacatatggagatagatgccattttgctcatggtgaatctgagctgcgcaggtcaggaatcgcttagttatgtctttagactcttgagaacagattatgcattgttagctccattatcattgtgactttttgctctctctttttgttttatcaatttgttttatgcgactccctttgaaaactttagcccattctgtattgagctctgaagattcgacgagttctgtaagttaccgatcacagttaaaagactttgatatgttaaaacccttatattacagctacatactttttttgtcc

SEQ ID NO: 394 - protein, 240 aa, Arabidopsis thaliana
  misc_feature (37)..(63): Pfam Name: zf-CCCH; Pfam Description: Zinc finger C-x8-C-x5-C-x3-H type (and similar)
  misc_feature (115)..(177): Pfam Name: KH_1; Pfam Description: KH domain
  misc_feature: Utility: Useful for delaying flowering time
  misc_feature: Utility: Useful for increasing chlorophyll and photosynthetic capacity
  misc_feature: Utility: Useful for making ornamental plants with modified flowers
  misc_feature: Utility: Useful for making plants that grow better in shade
  misc_feature: Utility: Useful for making smaller plants
MDARKRGRPEAAASHNSNGGFKRSKQEMESISTGLGSKSKPCTKFFSTSGCPFGDNCHFLHYVPGGYNAAAQMKNLRPPVSQVSRNMQGSGGPGGRFSGRGDPGSGPVSIFGASTSKISVDASLAGAIIGKGGIHSKQICRETGAKLSIKDHERDPNLKIIELEGTFEQINVASGMVRELIGRLGSVKKPQGIGGPEGKPHPGSNYKTKICDRYSKGNCTYGDRCHFAHGESELRRSGIA

SEQ ID NO: 395 - protein, 252 aa, Brassica napus
  misc_feature (1)..(252): Ceres CLONE ID no. 975540
  misc_feature: Utility: Useful for delaying flowering time
  misc_feature: Utility: Useful for increasing chlorophyll and photosynthetic capacity
  misc_feature: Utility: Useful for making ornamental plants with modified flowers
  misc_feature: Utility: Useful for making plants that grow better in shade
  misc_feature: Utility: Useful for making smaller plants
  misc_feature (195)..(195): Xaa is any aa, unknown, or other
MDTRKRAGSFNSNGGGGGGGSKKSKQEMESYSTGLGSKSKPCTKFFSTSGCPFGDNCHFLHYVPGGYNAVAQLTNMALPMPQASRNMQGPGGGGGGRFSGRGGESGPGHVSSFGASATAKISVDASLAGAIIGKGGVSSKQICRQTGAKLSIQDHERDPNLKNIELEGTFEQINEASVMVRELIGRLNSAASRRXPGGGGGIGGGVGSEGKPHPGSNFKTKMCERFAKGNCTFGDRCHFAHGEAELRRSGIA

SEQ ID NO: 396 - DNA, 1794 bp, Arabidopsis thaliana
  misc_feature (1)..(1794): Ceres CLONE ID no. 32348
  misc_feature (1)..(1794): Also known as  Ceres CDNA ID no. 24374562
ctcagcagcttcttctgctttcaattactctcgccgacgattttctcaccggaaaaaaacaatatcattgcggatacacaaactataatggacctcctcttgctggagaagtctttaatcgccgtcttcgtggcggtgattctcgccacggtgatttcaaagctccgcggcaagaaattgaagctacctccaggtcctataccaattccgatcttcggaaactggcttcaagtcggagatgatctcaaccaccgtaatctcgtcgattacgctaagaaattcggcgatctcttcctcctccgtatgggtcagcgaaacctagtcgtcgtctcctcaccggatctaacaaaggaagtgctcctcactcaaggcgttgagtttggatccagaacgagaaacgtcgtgttcgacattttcaccgggaaaggtcaagatatggtgttcactgtttacggcgagcattggaggaagatgagaagaatcatgacggttcctttcttcaccaacaaagttgttcaacagaatcgtgaaggttgggagtttgaagcagctagtgttgttgaagatgttaagaagaatccagattctgctacgaaaggaatcgtgttgaggaaacgtttgcaattgatgatgtataacaatatgttccgtatcatgttcgatagaagatttgagagtgaggatgatcctcttttccttaggcttaaggctttgaatggtgagagaagtcgattagctcagagctttgagtataactatggagatttcattcctatccttagaccattcctcagaggctatttgaagatttgtcaagatgtgaaagatcgaagaatcgctcttttcaagaagtactttgttgatgagaggaagcaaattgcgagttctaagcctacaggtagtgaaggattgaaatgtgccattgatcacatccttgaagctgagcagaagggagaaatcaacgaggacaatgttctttacatcgtcgagaacatcaatgtcgccgcgattgagacaacattgtggtctatcgagtggggaattgcagagctagtgaaccatcctgaaatccagagtaagctaaggaacgaactcgacacagttcttggaccgggtgtgcaagtcaccgagcctgatcttcacaaacttccataccttcaagctgtggttaaggagactcttcgtctgagaatggcgattcctctcctcgtgcctcacatgaacctccatgatgcgaagctcgctggctacgatatcccagcagaaagcaaaatccttgttaatgcttggtggctagcaaacaaccccaacagctggaagaagcctgaagagtttagaccagagaggttctttgaagaagaatcgcacgtggaagctaacggtaatgacttcaggtatgtgccatttggtgttggacgtcgaagctgtcccgggattatattggcattgcctattttggggatcaccattggtaggatggtccagaacttcgagcttcttcctcctccaggacagtctaaagtggatactagtgagaaaggtggacaattcagcttgcacatccttaaccactccataatcgttatgaaaccaaggaactgttaaactttctgcacaaaaaaaaggatgaagatgactttataaatgtttgtgaaatctgttgaaatattcccttgttttgcttttgtgagatgtttttgtgtaaaatgtctttaaatggttcgttctacgattgcaataataattagtggtgctcattgttttggatggatcaatgttatacttatatcattt

SEQ ID NO: 397 - protein, 505 aa, Arabidopsis thaliana
  misc_feature (34)..(499): Pfam Name: p450; Pfam Description: Cytochrome P450
  misc_feature: Utility: Useful for delaying flowering time
  misc_feature: Utility: Useful for increasing chlorophyll and photosynthetic capacity
  misc_feature: Utility: Useful for increasing increasing anthocyanin content
  misc_feature: Utility: Useful for making plants with altered leaf shape eg curled leaves
  misc_feature: Utility: Useful for making plants with increased biomass and foliage
  misc_feature: Utility: Useful for making smaller plants
MDLLLLEKSLIAVFVAVILATVISKLRGKKLKLPPGPIPIPIFGNWLQVGDDLNHRNLVDYAKKFGDLFLLRMGQRNLVVVSSPDLTKEVLLTQGVEFGSRTRNVVFDIFTGKGQDMVFTVYGEHWRKMRRIMTVPFFTNKVVQQNREGWEFEAASVVEDVKKNPDSATKGIVLRKRLQLMMYNNMFRIMFDRRFESEDDPLFLRLKALNGERSRLAQSFEYNYGDFIPILRPFLRGYLKICQDVKDRRIALFKKYFVDERKQIASSKPTGSEGLKCAIDHILEAEQKGEINEDNVLYIVENINVAAIETTLWSIEWGIAELVNHPEIQSKLRNELDTVLGPGVQVTEPDLHKLPYLQAVVKETLRLRMAIPLLVPHMNLHDAKLAGYDIPAESKILVNAWWLANNPNSWKKPEEFRPERFFEEESHVEANGNDFRYVPFGVGRRSCPGIILALPILGITIGRMVQNFELLPPPGQSKVDTSEKGGQFSLHILNHSIIVMKPRNC

SEQ ID NO: 398 - protein, 505 aa, Arabidopsis thaliana
  misc_feature (1)..(505): Public GI no. 12276037
  misc_feature: Utility: Useful for delaying flowering time
  misc_feature: Utility: Useful for increasing chlorophyll and photosynthetic capacity
  misc_feature: Utility: Useful for increasing increasing anthocyanin content
  misc_feature: Utility: Useful for making plants with altered leaf shape eg curled leaves
  misc_feature: Utility: Useful for making plants with increased biomass and foliage
  misc_feature: Utility: Useful for making smaller plants
MDLLLLEKTLLGSFVAILVAILVSKLRGKRFKLPPGPIPVPVFGNWLQVGDDLNHRNLTDLAKKFGDIFLLRMGQRNLVVVSSPDLSKEVLHTQGVEFGSRTRNVVFDIFTGKGQDMVFTVYGEHWRKMRRIMTVPFFTNKVVQQYRYGWEEEAAQVVEDVKKNPEAATNGIVLRRRLQLMMYNNMYRIMFDRRFESEDDPLFNKLKALNGERSRLAQSFDYNYGDFIPILRPFLRGYLKICQEVKERRLQLFKDYFVDERKKLASTKNMSNEGLKCAIDHILDAQKKGEINEDNVLYIVENINVAAIETTLWSIEWGIAELVNHPEIQKKLRHELDTLLGPGHQITEPDTYKLPYLNAVIKETLRLRMAIPLLVPHMNLHDAKLGGFDIPAESKILVNAWWLANNPAHWKNPEEFRPERFLEEEAKVEANGNDFRYLPFGVGRRSCPGIILALPILGITLGRLVQNFELLPPPGQSKIDTAEKGGQFSLHILKHSTIVAKPRSF

SEQ ID NO: 399 - protein, 505 aa, Arabidopsis thaliana
  misc_feature (1)..(505): Public GI no. 586082
  misc_feature: Utility: Useful for delaying flowering time
  misc_feature: Utility: Useful for increasing chlorophyll and photosynthetic capacity
  misc_feature: Utility: Useful for increasing increasing anthocyanin content
  misc_feature: Utility: Useful for making plants with altered leaf shape eg curled leaves
  misc_feature: Utility: Useful for making plants with increased biomass and foliage
  misc_feature: Utility: Useful for making smaller plants
MDLLLLEKTLLGLFLAAVVAIVVSKLRGKRFKLPPGPLPVPIFGNWLQVGDDLNHRNLTQLAKRFGDIFLLRMGQRNLVVVSSPDLAKEVLHTQGVEFGSRTRNVVFDIFTGEGQDMVFTVYGEHWRKMRRIMTVPFFTNKVVQQYRHGWEAEAAAVVDDVRKNPDAAVSGLVIRRRLQLMMYNNMYRIMFDRRFESEEDPLFQRLKALNGERSRLAQSFEYNYGDFIPILRPFLKGYLKICKEVKETRLKLFKDYFVDERKNIGSTKSTNNEGLKCAIDHILDAEKKGEINEDNVLYIVENINVAAIETTLWSIEWGIAELVNHPEIQQKVRDEIDRVLGVGHQVTEPDIQKLPYLQAVVKETLRLRMAIPLLVPHMNLHDAKLGGYDIPAESKILVNAWWLANNPAHWKKPEEFRPERFFEEESHVEANGNDFRYLPFGVGRRSCPGIILALPILGITLGRLVQNFELLPPPGQSQIDTSEKGGQFSLHILKHSTVVAKPRSF

SEQ ID NO: 400 - protein, 506 aa, Triticum aestivum
  misc_feature (1)..(506): Ceres CLONE ID no. 755965
  misc_feature: Utility: Useful for delaying flowering time
  misc_feature: Utility: Useful for increasing chlorophyll and photosynthetic capacity
  misc_feature: Utility: Useful for increasing increasing anthocyanin content
  misc_feature: Utility: Useful for making plants with altered leaf shape eg curled leaves
  misc_feature: Utility: Useful for making plants with increased biomass and foliage
  misc_feature: Utility: Useful for making smaller plants
MDFVFVEKLLAGLLAAVVGAIVVSKIRGRKLRLPPGPFPVPIFGNWLQVGDDLNHRNLAAMARKFGEVFLLRMGQRNLVVVSSPPLAREVLHTQGVEFGSRTRNVVFDIFTGEGQDMVFTVYGDHWRKMRRIMTVPFFTNKVVQQYRPGWEAEAAFVIDNVRADPRAATEGVVLRRHLQLMMYNNMYRIMFDRRFESMDDPLFLRLRALNGERSRLAQSFEYNYGDFIPILRPFLRGYLRLCKEVKETRLKLFKDYFLDERKKLVSTKAMDNNGGLKCAIDHILEAEQKGEINEDNVLYIIENINVAAIETTLWSIEWGLAELVNHPEIQQKLRDEMDAVLGAGHQITEPETHKLPYLQAVIKETLRLRMAIPLLVPHMNLHDAKLAGYNIPAESKILVNAWFLANNPEQWKRPDEFRPERFLEEEKHVEANGNDFRYLPFGVGRRSCPGIILALPILGITIGRLVQNFVLTPPPGQDKLDTTEKGGQFSLHILKHSTIVAKPRVF

SEQ ID NO: 401 - protein, 521 aa, Zea mays
  misc_feature (1)..(521): Ceres CLONE ID no. 241576
  misc_feature: Utility: Useful for delaying flowering time
  misc_feature: Utility: Useful for increasing chlorophyll and photosynthetic capacity
  misc_feature: Utility: Useful for increasing increasing anthocyanin content
  misc_feature: Utility: Useful for making plants with altered leaf shape eg curled leaves
  misc_feature: Utility: Useful for making plants with increased biomass and foliage
  misc_feature: Utility: Useful for making smaller plants
RLHEQTTHPTYPGRTGRQHNMDLALLEKALLGLFAAAVVAIAVAKLSGKRYRLPPGPPGAPVVGNWLQVGDDLNHRNLMAMAKRFGDIFLLRMGVRNLVVVSTPELAKEVLHTQGVEFGSRTRNVVFDIFTGKGQDMVFTVYGDHWRKMRRIMTVPFFTNKVVAQNRAGWEEEARLVVEDVRKDPEAAAGGVVLRRRLQLMMYNDMFRIMFDRRFDSEHDPLFNKLKALNAERSRLSQSFEYNYGDFIPVLRPFLRGYLNRCHDLKTRRMKFFEDNFVQERKKVMAQTGEIRCAMDHILEAERKGEINHDNVLYIVENINVAAIETTLWSIEWGIAELVNHPAIQHKLREELASVLGAGVPVTEPDLERLPYLQAIVKETLRLRMAIPLLVPHMNLNDGKLAGYDIPAESKILVNAWFLANDPKRWVRPDEFRPERFLEEEKSVEAHGNDFRFVPFGVGRRSCPGIILALPIIGITLGRLVQNFQLLPPPGLDKIDTTEKPGQFSNQIAKHATIVCKPLEA

SEQ ID NO: 402 - protein, 505 aa, Zea mays
  misc_feature (1)..(505): Public GI no. 44889626
  misc_feature: Utility: Useful for delaying flowering time
  misc_feature: Utility: Useful for increasing chlorophyll and photosynthetic capacity
  misc_feature: Utility: Useful for increasing increasing anthocyanin content
  misc_feature: Utility: Useful for making plants with altered leaf shape eg curled leaves
  misc_feature: Utility: Useful for making plants with increased biomass and foliage
  misc_feature: Utility: Useful for making smaller plants
MELLLLEKTLISLFFAITLAIVISKLRGKKFKLPPGPLPVPIFGNWLQVGDDLNHRNLANFAKKFGDVFLLRMGQRNLVVVSSPDLARDVLHTQGVEFGSRTRNVVFDIFTGKGQDMVFTVYGEHWRKMRRIMTVPFFTNKVVNQYRYGWEDEAGRVVEDVKKDAKAATEGIVLRKRLQLMMYNNMYRIMFDRRFESENDPLFLKLKALNGERSRLAQSFEYNYGDFIPILRPFLRGYLKICKEVKERRIQLFKDYFLEERKKLSSTKPTDNAGLKCAIDHILDAEKKGEINEDNVLYIVENINVAAIETTLWSIEWGIAELVNHPKIQRKLQHELDTVLGPGTQITEPDTHRLPYLQAVIKETLRLRMAIPLLVPHMNLHDAKLGGYDIPAESKILVNAWWLANNPAHWKDPEEFRPERFLEEEAKVEANGNDFRYIPFGVGRRSCPGIILALPILGITIGRLVQNFDLMPPPGMDKIDTTEKGGQFSLHILNHSTIVAKPRVF

SEQ ID NO: 403 - protein, 505 aa, Zea mays
  misc_feature (1)..(505): Public GI no. 9965897
  misc_feature: Utility: Useful for delaying flowering time
  misc_feature: Utility: Useful for increasing chlorophyll and photosynthetic capacity
  misc_feature: Utility: Useful for increasing increasing anthocyanin content
  misc_feature: Utility: Useful for making plants with altered leaf shape eg curled leaves
  misc_feature: Utility: Useful for making plants with increased biomass and foliage
  misc_feature: Utility: Useful for making smaller plants
MDLLFLEKALLGLFVAVVLAITISKLRGKRFKLPPGPLPVPVFGNWLQVGDDLNHRNLTDLAKKFGDIFLLRMGQRNLVVVSSPELAKEVLHTQGVEFGSRTRNVVFDIFTGKGQDMVFTVYGEHWRKMRRIMTVPFFTNKVVQQYRFGWEDEAARVVEDVRKNPEAATNGIVLRRRLQLMMYNNMYRIMFDTRFESEDDPLFVRLKALNGERSRLAQSFEYNYGDFIPILRPFLRGYLKICKEVKDRRLQLFKDHFVEERKKLGSTKSMNNDGLKCAIDHILDAQQKGEINEDNVLYIVENINVAAIETTLWSIEWGIAELVNHPEIQKKLRHELDTVLGPGNQITEPDTHKLPYLQAVIKETLRLRMAIPLLVPHMNLHDAKLGGYDIPAESKILVNAWWLANNPANWKNPEEFRPERFFEEEAKVEANGNDFRYLPFGVGRRSCPGIILALPILGITLGRLVQNFELLPPPGQSQIDTTEKGGQFSLHILKHSTIVAKPRQF

SEQ ID NO: 404 - protein, 505 aa, Zea mays
  misc_feature (1)..(505): Public GI no. 9965899
  misc_feature: Utility: Useful for delaying flowering time
  misc_feature: Utility: Useful for increasing chlorophyll and photosynthetic capacity
  misc_feature: Utility: Useful for increasing increasing anthocyanin content
  misc_feature: Utility: Useful for making plants with altered leaf shape eg curled leaves
  misc_feature: Utility: Useful for making plants with increased biomass and foliage
  misc_feature: Utility: Useful for making smaller plants
MDLLFLEKVLISLFFTIIFAILVSKLRGKRFKLPPGPLPIPVFGNWLQVGDDLNHRNLTDLAKKFGDIFLLRMGQRNLVVISSPELAKEVLHTQGVEFGSRTRNVVFDIFTGKGQDMVFTVYGEHWRKMRRIMTVPFFTNKVVQQYRHGWEDEAASVVEDVKKNPEAATNGIVLRRKLQLMMYNNMYRIMFDRRFESEDDPLFVKLKALNGERSRLAQSFEYNYGDFIPILRPFLRGYLKLCKEVKEIRLQLFRDQFLEERKKLATTKRIDNNALKCAIDHILDAQRKGEINEDNVLYIVENINVAAIETTLWSIEWGIAELVNHPEIQQKLRNEIDTVLGPGVQVTEPDTHKLPYLQAVIKETLRLRMAIPLLVPHMNLHDAKLGGYDIPAESKILVNAWWLANNPAHWKNPEEFRPERFFEEESKVEANGNDFRYLPFGVGRRSCPGIILALPILGITLGRLVQNFELLPPKGQSKLDTSEKGGQFSLHILKHSTIVAKPRVF

SEQ ID NO: 405 - protein, 505 aa, Zea mays
  misc_feature (1)..(505): Public GI no. 3915112
  misc_feature: Utility: Useful for delaying flowering time
  misc_feature: Utility: Useful for increasing chlorophyll and photosynthetic capacity
  misc_feature: Utility: Useful for increasing increasing anthocyanin content
  misc_feature: Utility: Useful for making plants with altered leaf shape eg curled leaves
  misc_feature: Utility: Useful for making plants with increased biomass and foliage
  misc_feature: Utility: Useful for making smaller plants
MDLLLVEKTLLALFAAIIASIFISKLRGKRFKLPPGPVPVPIFGNWLQVGDDLNHRNLTDLAKKFGEIFLLRMGQRNLVVVSSPNLAKEVLHTQGVEFGSRTRNVVFDIFTGKGQDMVFTVYGEHWRKMRRIMTVPFFTNKVVQQYRTGWEAEAAAVVDDVKKNPKAATEGVVIRKRLQLMMYNNMFRIMFDRRFESEDDPLFVKLKMLNGERSRLAQSFEYNYGDFIPILRPFLKGYLKLCKEVKEKRFQLFKDYFVDERKKLGSTKSMDNNQLKCAIDHILDAKDKGEINEDNVLYIVENINVAAIETTLWSIEWAIAELVNHPEIQAKLRHELVSQLGPGVQVTEPDLHKLPYLQAVIKETLRLRMAIPLLVPHMNLHDAKLGGYDIPAESKILVNAWWLANNPDQWKKPEEFRPERFLEEESKVEANGNDFRYLPFGVGRRSCPGIILALPILGITIGRLVQNFELLPPPGQDKVDTTEKGGQFSLHILKHSTIVAKPRVL

SEQ ID NO: 406 - protein, 506 aa, Zea mays
  misc_feature (1)..(506): Public GI no. 24571503
  misc_feature: Utility: Useful for delaying flowering time
  misc_feature: Utility: Useful for increasing chlorophyll and photosynthetic capacity
  misc_feature: Utility: Useful for increasing increasing anthocyanin content
  misc_feature: Utility: Useful for making plants with altered leaf shape eg curled leaves
  misc_feature: Utility: Useful for making plants with increased biomass and foliage
  misc_feature: Utility: Useful for making smaller plants
MDLLLLEKALLGLFAAAVVAIAVSKLRGKRFKLPPGPFGFPVFGNWLQVGDDLNQRKLANLSKKFGDVYLLRMGQRNLVVVSSPEMAKEVLHTQGVEFGSRTRNVVFDIFTGKGQDMVFTVYSEHWRKMRRIMTVPFFTNKVVQQQRFNWEDEAARVVEDVKKDPQAATTGIVLRRRLQLLMYNNMYRIMFDRRFESVDDPLFNKLKALNGERSRLAQSFEYNYGDFIPILRPFLRGYLKLVKEVKERRLKLFKDYFVEERKKLTSTKSMTEENFKCAIDHVLDAQQKGEINEDNVLYIVENINVAAIETTLWSIEWGIAELVNHPDIQKKLRAEIDRVLGPDHQITEPDTHKLPYLQAVIKETLRLRMAIPLLVPHMNLNDAKLAGYDIPAESKILVNAWWLANNPAHWKDPQVFRPERFLEEESGVEANGNDFRYIPFGVGRRSCPGIILALPILGITIGRMVQNFELLPPPGQSKIDTSEKGGQFSLFILNHSTIVLKPRSSV

SEQ ID NO: 407 - DNA, 756 bp, Arabidopsis thaliana
  misc_feature (1)..(756): Ceres CLONE ID no. 32548
  misc_feature (1)..(756): Also known as  Ceres CDNA ID no. 23551541
aaaatcacataagtctctctcttacattttgaaaccctaatttctcaaaataaatgtctgaagttgagtaccggtgctttgtcggcggccttgcctgggccaccaatgatgaagatcttcaaaggacgttctcacagttcggcgacgttatcgattctaagatcattaacgaccgcgagagtggaagatcaaggggattcggattcgtcaccttcaaggacgagaaagccatgagggatgcgattgaagagatgaacggtaaagagctcgatggacgtgtcatcaccgtgaacgaggctcagtcgagaggtagcggcggtggcggaggaggccgtggtggaagcggtggtggttaccgcagcggaggcggtggtggatactcaggaggcggtggcggcggatactcaggaggaggcggtggtggttacgagagacgtagcggaggttacggatctggtggaggcggtggtggccgaggatacggtggtggtggacgccgtgagggaggtggctacggaggcggtgatggtggaagttacggaggcggtggtggcggctggtaatcaaagatagagttgtttgcgtgctgctgctctgtttttggtttagatttggatttgtgtcaccacttctggtttggttatcgttcgtttggtttacttttttgatgaaacagtttcgtttaagtcttctttgtctggatcgaaatgttaattcgcgtgttgtttactaaatttataacgtttccttttaacc

SEQ ID NO: 408 - protein, 169 aa, Arabidopsis thaliana
  misc_feature (8)..(79): Pfam Name: RRM_1; Pfam Description: RNA recognition motif. (a.k.a. RRM, RBD, or RNP domain)
  misc_feature (8)..(79): Pfam Name: RRM_1; Pfam Description: RNA recognition motif. (a.k.a. RRM, RBD, or RNP domain)
  misc_feature: Utility: Useful for delaying flowering time
  misc_feature: Utility: Useful for increasing chlorophyll and photosynthetic capacity
  misc_feature: Utility: Useful for making ornamental plants with modified leaves
  misc_feature: Utility: Useful for making plants sterile and for genetic confinement
  misc_feature: Utility: Useful for making plants with altered leaf shape eg curled leaves
  misc_feature: Utility: Useful for making plants with increased biomass and foliage
  misc_feature: Utility: Useful for making smaller plants
MSEVEYRCFVGGLAWATNDEDLQRTFSQFGDVIDSKIINDRESGRSRGFGFVTFKDEKAMRDAIEEMNGKELDGRVITVNEAQSRGSGGGGGGRGGSGGGYRSGGGGGYSGGGGGGYSGGGGGGYERRSGGYGSGGGGGGRGYGGGGRREGGGYGGGDGGSYGGGGGGW

SEQ ID NO: 409 - protein, 169 aa, Arabidopsis thaliana
  misc_feature (1)..(169): Public GI no. 17819
  misc_feature: Utility: Useful for delaying flowering time
  misc_feature: Utility: Useful for increasing chlorophyll and photosynthetic capacity
  misc_feature: Utility: Useful for making ornamental plants with modified leaves
  misc_feature: Utility: Useful for making plants sterile and for genetic confinement
  misc_feature: Utility: Useful for making plants with altered leaf shape eg curled leaves
  misc_feature: Utility: Useful for making plants with increased biomass and foliage
  misc_feature: Utility: Useful for making smaller plants
MSEVEYRCFVGGLAWATGDAELERTFSQFGEVIDSKIINDRETGRSRGFGFVTFKDEKSMKDAIDEMNGKELDGRTITVNEAQSRGGGGGGGRGGGGYGGRGGGGYGGGGGGYGDRRGGGGYGSGGGGRGGGGYGSGGGGYGGGGGRRDGGGYGGGDGGYGGGSGGGGW

SEQ ID NO: 410 - protein, 157 aa, Arabidopsis thaliana
  misc_feature (1)..(157): Public GI no. 18347
  misc_feature: Utility: Useful for delaying flowering time
  misc_feature: Utility: Useful for increasing chlorophyll and photosynthetic capacity
  misc_feature: Utility: Useful for making ornamental plants with modified leaves
  misc_feature: Utility: Useful for making plants sterile and for genetic confinement
  misc_feature: Utility: Useful for making plants with altered leaf shape eg curled leaves
  misc_feature: Utility: Useful for making plants with increased biomass and foliage
  misc_feature: Utility: Useful for making smaller plants
MAEVEYRCFVGGLAWATNDESLEQAFSQFGDITDSKIINDRETGRSRGFGFVTFKDEKSMRDAIEGMNGQELDGRNITVNEAQSRGSGGGGGRREGGGGGYGGGGGYGGRREGGGGGGYGGRREGGGGGYGGGGGGYGGRREGGDGGYGGGGGGSRW

SEQ ID NO: 411 - protein, 166 aa, Arabidopsis thaliana
  misc_feature (1)..(166): Public GI no. 1346180
  misc_feature: Utility: Useful for delaying flowering time
  misc_feature: Utility: Useful for increasing chlorophyll and photosynthetic capacity
  misc_feature: Utility: Useful for making ornamental plants with modified leaves
  misc_feature: Utility: Useful for making plants sterile and for genetic confinement
  misc_feature: Utility: Useful for making plants with altered leaf shape eg curled leaves
  misc_feature: Utility: Useful for making plants with increased biomass and foliage
  misc_feature: Utility: Useful for making smaller plants
MASPDVEYRCFVGGLAWATDDRALETAFSQYGEVLDSKIINDRETGRSRGFGFVTFKDEKSMKDAIEGMNGQDLDGRSITVNEAQSRGSGGGGGGRGGGGGYRSGGGGGYGGGGGGYGGGGREGGYSGGGGGYSSRGGGGGGYGGGGRRDGGEGGGYGGSGGGGGW

SEQ ID NO: 412 - protein, 175 aa, Arabidopsis thaliana
  misc_feature (1)..(175): Ceres CLONE ID no. 7420
  misc_feature: Utility: Useful for delaying flowering time
  misc_feature: Utility: Useful for increasing chlorophyll and photosynthetic capacity
  misc_feature: Utility: Useful for making ornamental plants with modified leaves
  misc_feature: Utility: Useful for making plants sterile and for genetic confinement
  misc_feature: Utility: Useful for making plants with altered leaf shape eg curled leaves
  misc_feature: Utility: Useful for making plants with increased biomass and foliage
  misc_feature: Utility: Useful for making smaller plants
MASGDVEYRCFVGGLAWATDDRALETAFAQYGDVIDSKIINDRETGRSRGFGFVTFKDEKAMKDAIEGMNGQDLDGRSITVNEAQSRGSGGGGGHRGGGGGGYRSGGGGGYSGGGGSYGGGGGRREGGGGYSGGGGYSSRGGGGGSYGGGRREGGGGYGGGEGGGYGGSGGGGGW

SEQ ID NO: 413 - protein, 169 aa, Arabidopsis thaliana
  misc_feature (1)..(169): Public GI no. 1346181
  misc_feature: Utility: Useful for delaying flowering time
  misc_feature: Utility: Useful for increasing chlorophyll and photosynthetic capacity
  misc_feature: Utility: Useful for making ornamental plants with modified leaves
  misc_feature: Utility: Useful for making plants sterile and for genetic confinement
  misc_feature: Utility: Useful for making plants with altered leaf shape eg curled leaves
  misc_feature: Utility: Useful for making plants with increased biomass and foliage
  misc_feature: Utility: Useful for making smaller plants
MASPDVEYRCFVGGLAWATDERSLETAFSQFGELVDSKIINDRETGRSRGFGFVTFKDEKSMKDAIEGMNGQDLDGRSITVNEAQSRGSGAGGGGRGGGGGYRGGGGYGGGGGGYGGGRREGGGYSGGGGGYSSRGGGGGGYGGGGRRDGGGYGGGEGGGYGGGGGGGW

SEQ ID NO: 414 - protein, 176 aa, Arabidopsis thaliana
  misc_feature (1)..(176): Public GI no. 4567224
  misc_feature: Utility: Useful for delaying flowering time
  misc_feature: Utility: Useful for increasing chlorophyll and photosynthetic capacity
  misc_feature: Utility: Useful for making ornamental plants with modified leaves
  misc_feature: Utility: Useful for making plants sterile and for genetic confinement
  misc_feature: Utility: Useful for making plants with altered leaf shape eg curled leaves
  misc_feature: Utility: Useful for making plants with increased biomass and foliage
  misc_feature: Utility: Useful for making smaller plants
MASGDVEYRCFVGGLAWATDDRALETAFAQYGDVIDSKIINDRETGRSRGFGFVTFKDEKAMKDAIEGMNGQDLDGRSITVNEAQSRGSGGGGGHRGGGGGGYRSGGGGGYSGGGGSYGGGGGRREGGGGYSGGGGGYSSRGGGGGSYGGGRREGGGGYGGGEGGGYGGSGGGGGW

SEQ ID NO: 415 - protein, 175 aa, Arabidopsis thaliana
  misc_feature (1)..(175): Ceres CLONE ID no. 13879
  misc_feature: Utility: Useful for delaying flowering time
  misc_feature: Utility: Useful for increasing chlorophyll and photosynthetic capacity
  misc_feature: Utility: Useful for making ornamental plants with modified leaves
  misc_feature: Utility: Useful for making plants sterile and for genetic confinement
  misc_feature: Utility: Useful for making plants with altered leaf shape eg curled leaves
  misc_feature: Utility: Useful for making plants with increased biomass and foliage
  misc_feature: Utility: Useful for making smaller plants
  misc_feature (142)..(142): Xaa is any aa, unknown, or other
MASGDVEYRCFVGGLAWATDDRALETAFAQYGDVIDSKIINDRETGRSRGFGFVTFKDEKAMKDAIEGMNGQDLDGRSITVNEAQSRGSGGGGGHRGGGGGGYRSGGGGGYSGGGGSYGGGGGRREGGGGYSGGGGYSSRGXGGGSYGGGRREGGGGYGGGEGGGYGGSGGGGGW

SEQ ID NO: 416 - protein, 175 aa, Arabidopsis thaliana; identical to SEQ ID NO: 415
  misc_feature (1)..(175): Public GI no. 21553354
  misc_feature: Utility: Useful for delaying flowering time
  misc_feature: Utility: Useful for increasing chlorophyll and photosynthetic capacity
  misc_feature: Utility: Useful for making ornamental plants with modified leaves
  misc_feature: Utility: Useful for making plants sterile and for genetic confinement
  misc_feature: Utility: Useful for making plants with altered leaf shape eg curled leaves
  misc_feature: Utility: Useful for making plants with increased biomass and foliage
  misc_feature: Utility: Useful for making smaller plants
  misc_feature (142)..(142): Xaa is any aa, unknown, or other

SEQ ID NO: 417 - DNA, 1247 bp, Arabidopsis thaliana
  misc_feature (1)..(1247): Ceres CLONE ID no. 32753
  misc_feature (1)..(1247): Also known as  Ceres CDNA ID no. 23478258
ctcttgcttctcttcactcacaatctcacagcaaagcctctcgttgctagaggaatcaaacaatggtgtttgtgaagtccaccaagtcgaatgcttacttcaagaggtaccaagtgaagttcaggagaagaagagatggaaagactgactacagggcaaggatccgtcttatcaaccaagacaagaacaagtacaatacacctaagtatcgttttgttgtccggtttaccaacaaagacatagtggcacagattgtatctgcaagcattgctggtgacattgttaaagcttctgcttacgcacatgaactgcctcagtatggtctcactgttggtcttacaaactatgctgcagcttactgtactggccttcttttggctcgccgtgttttaaagatgttggaaatggatgacgagtatgagggaaacgttgaggccactggagaggacttttccgttgagccaactgattcaaggagacctttccgtgctcttcttgatgttggacttatcaggaccacaacaggaaaccgtgtgttcggtgctcttaagggtgctttggatggtggtcttgatatccctcacagtgacaagagatttgctgggttccacaaggagaacaagcaacttgatgctgaaatccacaggaactacatctatggtggccatgtctcaaactacatgaagctgttgggagaagatgagccagagaagttacaaactcacttcagtgcttacatcaagaaaggagttgaagctgagagcattgaggagttgtacaagaaggttcacgcagctattcgtgctgaccccaacccaaagaaaaccgtgaaacctgctcccaagcaacacaagaggtacaacttgaagaaacttacttacgaggagaggaagaacaagttgatcgagagagtcaggcattgaatggagcaggtggtgatgatgatgatgaggacgatgaagagtaaatcagtcaagccttctttatctcatgcctcttgtagttttttatcttttgagcttaatgcctcaaattttctgttttcagactaaaacactcagcttttgtgttcacattttaattgtgttcgaggattttgatattgaggatacattttctttgaagtatcattatcttattattacctccatcataattttcaagaatttgtatgacaatagtttgatgacttgattttatctgtagtttgctattgttaaatgtaagaactgttagacttcatctat

SEQ ID NO: 418 - protein, 286 aa, Arabidopsis thaliana
  misc_feature (26)..(172): Pfam Name: Ribosomal_L18p; Pfam Description: Ribosomal L18p/L5e family
  misc_feature (26)..(172): Pfam Name: Ribosomal_L18p; Pfam Description: Ribosomal L18p/L5e family
  misc_feature: Utility: Useful for delaying flowering time
  misc_feature: Utility: Useful for increasing chlorophyll and photosynthetic capacity
  misc_feature: Utility: Useful for making larger plants
  misc_feature: Utility: Useful for making plants sterile and for genetic confinement
  misc_feature: Utility: Useful for making smaller plants
  misc_feature (249)..(249): Xaa is any aa, unknown, or other
  misc_feature (252)..(252): Xaa is any aa, unknown, or other
MVFVKSTKSNAYFKRYQVKFRRRRDGKTDYRARIRLINQDKNKYNTPKYRFVVRFTNKDIVAQIVSASIAGDIVKASAYAHELPQYGLTVGLTNYAAAYCTGLLLARRVLKMLEMDDEYEGNVEATGEDFSVEPTDSRRPFRALLDVGLIRTTTGNRVFGALKGALDGGLDIPHSDKRFAGFHKENKQLDAEIHRNYIYGGHVSNYMKLLGEDEPEKLQTHFSAYIKKGVEAESIEELYKKVHAAIRAXPNXRKTVKPAPKQHKRYNLKKLTYEERKNKLIERVRH

SEQ ID NO: 419 - protein, 301 aa, Arabidopsis thaliana
  misc_feature (1)..(301): Ceres CLONE ID no. 21756
  misc_feature: Utility: Useful for delaying flowering time
  misc_feature: Utility: Useful for increasing chlorophyll and photosynthetic capacity
  misc_feature: Utility: Useful for making larger plants
  misc_feature: Utility: Useful for making plants sterile and for genetic confinement
  misc_feature: Utility: Useful for making smaller plants
MVFVKSSKSNAYFKRYQVKFRRRRDGKTDYRARIRLINQDKNKYNTPKYRFVVRFTNKDIVAQIVSASIAGDIVKASAYAHELPQYGLTVGLTNYAAAYCTGLLLARRVLKMLEMDDEYEGNVEATGEDFSVEPTDSRRPFRALLDVGLIRTTTGNRVFGALKGALDGGLDIPHSDKRFAGFHKENKQLDAEIHRNYIYGGHVSNYMKLLGEDEPEKLQTHFSAYIKKGVEAESIEEMYKKVHAAIRAEPNHKKTEKSAPKEHKRYNLKKLTYEERKNKLIERVKALNGAGGDDDDEDDEE

SEQ ID NO: 420 - protein, 302 aa, Zea mays
  misc_feature (1)..(302): Ceres CLONE ID no. 1538293
  misc_feature: Utility: Useful for delaying flowering time
  misc_feature: Utility: Useful for increasing chlorophyll and photosynthetic capacity
  misc_feature: Utility: Useful for making larger plants
  misc_feature: Utility: Useful for making plants sterile and for genetic confinement
  misc_feature: Utility: Useful for making smaller plants
MGGFVKTHKTNAYFKRFQVKFKRRRAGKTDYRARIRLINQDKNKYNTPKYRFVVRFTNKDITAQIISASIAGDMVLASAYSHELPRYGLEVGLTNYAAAYCTGLLLARRVLKIRGLDKEYEGNVEATGEDFSVEPADERRPFRALLDVGLIRTTTGNRVFGALKGALDGGLDIPHSEKRFAGFKKDDKQLDADTHRRYIYGGHVADYMKNLAEEEPEKYQSHFSAYIKKGVEADEIEALYKKVHAAIRADPSIVKSTKQPPKEHKRYNPKKLTYEQRKASLIERLNQLNSSGGADDDDEDDE

SEQ ID NO: 421 - protein, 302 aa, Triticum aestivum
  misc_feature (1)..(302): Ceres CLONE ID no. 933957
  misc_feature: Utility: Useful for delaying flowering time
  misc_feature: Utility: Useful for increasing chlorophyll and photosynthetic capacity
  misc_feature: Utility: Useful for making larger plants
  misc_feature: Utility: Useful for making plants sterile and for genetic confinement
  misc_feature: Utility: Useful for making smaller plants
  misc_feature (92)..(92): Xaa is any aa, unknown, or other
  misc_feature (94)..(94): Xaa is any aa, unknown, or other
  misc_feature (96)..(96): Xaa is any aa, unknown, or other
  misc_feature (107)..(107): Xaa is any aa, unknown, or other
  misc_feature (126)..(126): Xaa is any aa, unknown, or other
  misc_feature (134)..(134): Xaa is any aa, unknown, or other
  misc_feature (135)..(135): Xaa is any aa, unknown, or other
  misc_feature (139)..(139): Xaa is any aa, unknown, or other
  misc_feature (142)..(142): Xaa is any aa, unknown, or other
  misc_feature (196)..(196): Xaa is any aa, unknown, or other
  misc_feature (199)..(199): Xaa is any aa, unknown, or other
  misc_feature (201)..(201): Xaa is any aa, unknown, or other
  misc_feature (208)..(208): Xaa is any aa, unknown, or other
  misc_feature (210)..(210): Xaa is any aa, unknown, or other
  misc_feature (211)..(211): Xaa is any aa, unknown, or other
  misc_feature (215)..(215): Xaa is any aa, unknown, or other
  misc_feature (216)..(216): Xaa is any aa, unknown, or other
  misc_feature (218)..(218): Xaa is any aa, unknown, or other
  misc_feature (220)..(220): Xaa is any aa, unknown, or other
MVFVKNQKTRAYSKRFQVKFKRRRQGKTDYRARLRLTNQDKNKYNTPKYRFVVRFTNKDVTAQIVYATIAGDIVMAAAYSHELPRYGLEVGXTXYXAAYCTGLLLAXRVLKCRDLDQEYEGNVEAXGEDFSVEXXDERXPFXALLDVGLIRTTTGNRVFGALKGALDGGLDIPHSDKRFAGFKKDEKQLDAEIHRXYIXGXHVADYMXSXXDEEXXKXQXHFSEYIKRGISADDMEAVYKKVHAAIRADPTMAKSTKAPPKTHKRYNPKKLTYEQRKASLVERLNALNNSAGAADDDEDDDE

SEQ ID NO: 422 - DNA, 1145 bp, Arabidopsis thaliana
  misc_feature (1)..(1145): Ceres CLONE ID no. 34167
  misc_feature (1)..(1145): Also known as  Ceres CDNA ID no. 23385560
atttcacatctctctctctctctataagaaccctagaagaaggtttctcttgtcctccatacacttagcacaactgataaatcttttgaggtaaaatcagctttagatcaaggtttttctagtcatctctactcataaagatcaaagcttttgctattctcattttctaccaagagacaatatcatgatgatgggaaaagaggatttgggtttaagtcttagcttgggatttgcacaaaaccatcctctccagctaaatcttaaacccacttcttcaccaatgtccaatctccagatgtttccatggaaccaaacccttgtttcttcctcagatcaacaaaagcaacagtttcttaggaaaatcgacgtgaacagcttgccaacaacggtggatttggaagaggagataggagtttcgtctccaaacagtacgatctcgagcacagtgagtggaaagaggaggagtactgaaagagaaggtacctccggtggtggttgcggagatgaccttgacatcactctagatagatcttcctcacgtggaacctccgatgaagaggaagattacggaggtgagacttgtaggaagaagcttagactatccaaagatcaatccgcagttctcgaagacactttcaaagagcacaatactctcaatcccaaacagaagctggctttggctaagaagctaggtttaacagcaagacaagtggaagtgtggttccaaaacagaagagcaaggacaaagttaaagcagaccgaagtggattgcgagtatttgaaaagatgtgttgagaaattaacggaagagaatcggcggctcgagaaagaggcagcggaactaagagcattaaagctttcaccgcggttgtatggtcagatgagtccaccgaccacacttttgatgtgtccatcgtgtgaacgtgtggccggaccatcctcatctaaccacaaccagcgatctgtctcattgagtccatggctccaaatggcccatgggtcaacctttgatgtgatgcgtcctaggtcttaactttaatgctgcttctatgggttgtgtgtgggtcattgtactttttagattattgactctcagctaatgtatccttaaaagcctttttctacttttaaatttactttaatct

SEQ ID NO: 423 - protein, 282 aa, Arabidopsis thaliana
  misc_feature (1)..(98): Pfam Name: HD-ZIP_N; Pfam Description: HD-ZIP protein N terminus
  misc_feature (190)..(234): Pfam Name: HALZ; Pfam Description: Homeobox associated leucine zipper
  misc_feature (135)..(189): Pfam Name: Homeobox; Pfam Description: Homeobox domain
  misc_feature: Utility: Useful for delaying flowering time
  misc_feature: Utility: Useful for increasing chlorophyll and photosynthetic capacity
  misc_feature: Utility: Useful for making lethal plants for genetic confinement systems
  misc_feature: Utility: Useful for making ornamental plants with modified leaves
  misc_feature: Utility: Useful for making smaller plants
MMMGKEDLGLSLSLGFAQNHPLQLNLKPTSSPMSNLQMFPWNQTLVSSSDQQKQQFLRKIDVNSLPTTVDLEEEIGVSSPNSTISSTVSGKRRSTEREGTSGGGCGDDLDITLDRSSSRGTSDEEEDYGGETCRKKLRLSKDQSAVLEDTFKEHNTLNPKQKLALAKKLGLTARQVEVWFQNRRARTKLKQTEVDCEYLKRCVEKLTEENRRLEKEAAELRALKLSPRLYGQMSPPTTLLMCPSCERVAGPSSSNHNQRSVSLSPWLQMAHGSTFDVMRPRS

SEQ ID NO: 424 - protein, 283 aa, Arabidopsis thaliana
  misc_feature (1)..(283): Public GI no. 18857720
  misc_feature: Utility: Useful for delaying flowering time
  misc_feature: Utility: Useful for increasing chlorophyll and photosynthetic capacity
  misc_feature: Utility: Useful for making lethal plants for genetic confinement systems
  misc_feature: Utility: Useful for making ornamental plants with modified leaves
  misc_feature: Utility: Useful for making smaller plants
MMMGKEDLGLSLSLGFSQNHNPLQMNLNPNSSLSNNLQRLPWNQTFDPTSDLRKIDVNSFPSTVNCEEDTGVSSPNSTISSTISGKRSEREGISGTGVGSGDDHDEITPDRGYSRGTSDEEEDGGETSRKKLRLSKDQSAFLEETFKEHNTLNPKQKLALAKKLNLTARQVEVWFQNRRARTKLKQTEVDCEYLKRCVEKLTEENRRLQKEAMELRTLKLSPQFYGQMTPPTTLIMCPSCERVGGPSSSNHHHNHRPVSINPWVACAGQVAHGLNFEALRPRS

SEQ ID NO: 425 - protein, 282 aa, Arabidopsis thaliana
  misc_feature (1)..(282): Ceres CLONE ID no. 1014844
  misc_feature: Utility: Useful for delaying flowering time
  misc_feature: Utility: Useful for increasing chlorophyll and photosynthetic capacity
  misc_feature: Utility: Useful for making lethal plants for genetic confinement systems
  misc_feature: Utility: Useful for making ornamental plants with modified leaves
  misc_feature: Utility: Useful for making smaller plants
MMGKEDLGLSLSLGFSQNHNPLQMNLNPNSSLSNNLQRLPWNQTFDPTSDLRKIDVNSFPSTVNCEEDTGVSSPNSTISSTISGKRSEREGISGTGVGSGDDHDEITPDRGYSRGTSDEEEDGGETSRKKLRLSKDQSAFLEETFKEHNTLNPKQKLALAKKLNLTARQVEVWFQNRRARTKLKQTEVDCEYLKRCVEKLTEENRRLQKEAMELRTLKLSPQFYGQMTPPTTLIMCPSCERVGGPSSSNHHHNHRPVSINPWVACAGQVAHGLNFEALRPRS

SEQ ID NO: 426 - protein, 297 aa, Glycine max
  misc_feature (1)..(297): Ceres CLONE ID no. 527278
  misc_feature: Utility: Useful for delaying flowering time
  misc_feature: Utility: Useful for increasing chlorophyll and photosynthetic capacity
  misc_feature: Utility: Useful for making lethal plants for genetic confinement systems
  misc_feature: Utility: Useful for making ornamental plants with modified leaves
  misc_feature: Utility: Useful for making smaller plants
  misc_feature (253)..(253): Xaa is any aa, unknown, or other
  misc_feature (257)..(257): Xaa is any aa, unknown, or other
MVQKEDLGLSLSLNFPHHSTPNPQHLSLMSSSTHSSSPSGFNPQKPSWNEAFASSDPDRNSDTCRGETRSFLRGIDVNRLPSAVDAEEEAGVSSPNSTVSCVSGKRSEREPNGEEHDMDRACSRGISDEEDAETSRKKLRLSKDQSSILEESFKEHNTLNPKQKLALAKQLGLRPRQVEVWFQNRRARTKLKQTEVDCEVLKRCCENLTEENRRLQKEVQELRALKLSPQFYMQMSPPTTLTMCPSCERVAVXSSAXGSATRHHPMAHAHAHARPMPNGPWASAAPIPHRPFDAFHQ

SEQ ID NO: 427 - protein, 285 aa, Glycine max
  misc_feature (1)..(285): Ceres CLONE ID no. 514259
  misc_feature: Utility: Useful for delaying flowering time
  misc_feature: Utility: Useful for increasing chlorophyll and photosynthetic capacity
  misc_feature: Utility: Useful for making lethal plants for genetic confinement systems
  misc_feature: Utility: Useful for making ornamental plants with modified leaves
  misc_feature: Utility: Useful for making smaller plants
MTVEKEDLGLSLSLSFPQNPPTHLHLNLVSSSPSSHNPQKPSWNDPFTSSAGSSFLRGIDVNRLPSVVDCEEEAGVSSPNSTVSSVSGKRSEREEANGEENDTDRACSRGIISDEEDAETSRKKLRLSKDQSIILEESFKEHNTLNPKQKLALAKQLGLRARQVEVWFQNRRARTKLKQTEVDCEFLKRCCENLTVENRRLQKEVQELRALKLSPQFYMHMTPPTTLTMCPSCERVAVPPSSAVDPAMRHHHVPPTQPRAFPIGPWATAAATIPHRPFDALRRRS

SEQ ID NO: 428 - protein, 289 aa, Glycine max
  misc_feature (1)..(289): Public GI no. 8919876
  misc_feature: Utility: Useful for delaying flowering time
  misc_feature: Utility: Useful for increasing chlorophyll and photosynthetic capacity
  misc_feature: Utility: Useful for making lethal plants for genetic confinement systems
  misc_feature: Utility: Useful for making ornamental plants with modified leaves
  misc_feature: Utility: Useful for making smaller plants
MMLEKDDLGLSLGLNYPKKQMNLNSNPSVSVTPSSSSFGLLRRSSLNESFTSSVPNSDSSQKETRTFIRGIDVNRPPSTAEYGEEDAGVSSPNSTVSSSTGKRSEREEDTDPQGSRGGISDDEDGDNSRKKLRLSKDQSAILEETFKDHSTLNPKQKQALAKQLGLRARQVEVWFQNRRARTKLKQTEVDCEFLRRCCENLTEENRRLQKEVTELRALKLSPQFYMHMSPPTTLTMCPSCEHVSAPPPQQPPQAATSAQHHRGSLPVNAWAQGTRISHGLTFDALRPRS

SEQ ID NO: 429 - protein, 286 aa, Glycine max
  misc_feature (1)..(286): Public GI no. 992598
  misc_feature: Utility: Useful for delaying flowering time
  misc_feature: Utility: Useful for increasing chlorophyll and photosynthetic capacity
  misc_feature: Utility: Useful for making lethal plants for genetic confinement systems
  misc_feature: Utility: Useful for making ornamental plants with modified leaves
  misc_feature: Utility: Useful for making smaller plants
MSSEKEDGLGLSLSLGIMSCPQNNHKTTPSLPLNLLPFMHHHQVSSGRKDEGGERVRGGIDMNEPARMIIECDDEEDEEEDQVLMVSSPNSTVSSVSGKRSHDREENEGERATSSLEDDGGDAAARKKLRLSKEQAAVLEETFKEHNTLNPKQKLALSKQLNLRPRQVEVWFQNRRARTKLKQTEVDCEYLKRCCENLTDENRRLQKEVSELRALKLSPQFYMNMSPPTTLTMCPQCERVAVSSSSSSSSVVNATRAQNHQAPVPMNKPWAAMFASKTLDVQRSQM

SEQ ID NO: 430 - DNA, 1428 bp, Arabidopsis thaliana
  misc_feature (1)..(1428): Ceres CLONE ID no. 34385
  misc_feature (1)..(1428): Also known as  Ceres CDNA ID no. 23369491
gcaattttaactgcgaaacgctttttttttcctctctacacccaaattgaagggaaaaaaaaatctgcggatcctcgagaagccctatcaaacacataaagttctttctcttactcatctccgccgccggcagtaaaaatatcacatcgttagggtttcacggcggagattcaagttctttgacctaggaagctttcactatcaccggagactatttcaatggcaaccatggctaggtcgtttctgcaggcgatatcgaaggatgaggcggtggctcctccgcttagagttgttcagatcgaaggactggctgtactaaagataatcaaacactgcaaggagttttcaccgacccttgtcactggacagcttcttggacttgatgttggtagcgtcctcgaagttaccaattgttttcctttcccggtcagggatgatgatgaagaaattgaagctgatggtgctaattatcagcttgagatgatgagatgtctgagggaggttaatgttgacaacaacactgttggctggtatcaatctacagttcttggttcgtatcagactgtggaactgattgagaccttcatgaattaccaggagaatatcaagaggtgtgtgtgcatcatatatgatccctctaaagctgatctaggcgtcttagctttgaaggctttgaagctttcagattcctttatggagttgtaccgaggtggaaactttactggcgagaagttgagagagaaaaatttctcctggatggatatttttgaggaaatacctatcaaggtttcaaattctgcccttgtcagtgcctttatgaccgaactggagactgatacacctgtctcacagggcgattatgatcgtctacactcatcaaccactcctttccttgagaacaatatggagtttttgattaaatgcatggatgatttatctatggaacagcaaaagttccagtattactaccggaacctgtctcgtcagcaagcacaacagcaagcctggctccagaagagaagaacggagaacatggctcgtaaatcagctggagaggagcctttaccagaagaggatccttcaaacccaatctttaaggcgatccctgaaccatctaggctagagagtttcctcatcacaaaccaagtctcaaacttctgtggccaaatcaatggagtggctggccagaacttcagcaggctttacctgaccaaagcattgcacgacaactgattgcaaagactacccaagtttttgttttttgagtcagaaagtgaaagacttggtggtagaatggatcctatatttgtttttggtggatgtttttgtttttatttttgttgttgtgaagtaatttaatttacaagcttttcaaaaaaaatctttattcttatgcataatgaaaaattattgaagttttgaaagact

SEQ ID NO: 431 - protein, 337 aa, Arabidopsis thaliana
  misc_feature (20)..(128): Pfam Name: Mov34; Pfam Description: Mov34/MPN/PAD-1 family
  misc_feature (20)..(128): Pfam Name: Mov34; Pfam Description: Mov34/MPN/PAD-1 family
  misc_feature: Utility: Useful for delaying flowering time
  misc_feature: Utility: Useful for increasing chlorophyll and photosynthetic capacity
  misc_feature: Utility: Useful for increasing seed/fruit yield or modifying fruit content
  misc_feature: Utility: Useful for making plants sterile and for genetic confinement
  misc_feature: Utility: Useful for making plants with increased biomass and foliage
  misc_feature: Utility: Useful for making shorter plants and plants with modified flowers
  misc_feature: Utility: Useful for making smaller plants
MATMARSFLQAISKDEAVAPPLRVVQIEGLAVLKIIKHCKEFSPTLVTGQLLGLDVGSVLEVTNCFPFPVRDDDEEIEADGANYQLEMMRCLREVNVDNNTVGWYQSTVLGSYQTVELIETFMNYQENIKRCVCIIYDPSKADLGVLALKALKLSDSFMELYRGGNFTGEKLREKNFSWMDIFEEIPIKVSNSALVSAFMTELETDTPVSQGDYDRLHSSTTPFLENNMEFLIKCMDDLSMEQQKFQYYYRNLSRQQAQQQAWLQKRRTENMARKSAGEEPLPEEDPSNPIFKAIPEPSRLESFLITNQVSNFCGQINGVAGQNFSRLYLTKALHDN

SEQ ID NO: 432 - protein, 337 aa, Glycine max
  misc_feature (1)..(337): Ceres CLONE ID no. 463738
  misc_feature: Utility: Useful for delaying flowering time
  misc_feature: Utility: Useful for increasing chlorophyll and photosynthetic capacity
  misc_feature: Utility: Useful for increasing seed/fruit yield or modifying fruit content
  misc_feature: Utility: Useful for making plants sterile and for genetic confinement
  misc_feature: Utility: Useful for making plants with increased biomass and foliage
  misc_feature: Utility: Useful for making shorter plants and plants with modified flowers
  misc_feature: Utility: Useful for making smaller plants
MATTPARSFLQVAATEEAAPPLRVVQIEGLVILKIIKHCKDHSPSLVTGQLLGLDVGSVLEVTNCFPFPMREEDEEIEADGANYQLEMMRCLREVNVDNNTVGWYQSTLLGSFQTVELIETFMNYQENIRRCVCIIYDPSRSDQGVLALKALKLSDSFMELYRSNNFTGEKLREKNLSWVDIFEEIPIKVSNSALISAFMTELEPDTPVTQCDYDRLQLSTSSLMERNTEFLIECMDDLSLEQQKFQFYYRSLSRQQAQQQAWLQKRRTENMARKAAGEEPLPEEDPSNPIFKPLPEPSRLESFLITNQISNYCNQINGVSGQSFNRLYLMKALHED

SEQ ID NO: 433 - protein, 347 aa, Glycine max
  misc_feature (1)..(347): Public GI no. 50923675
  misc_feature: Utility: Useful for delaying flowering time
  misc_feature: Utility: Useful for increasing chlorophyll and photosynthetic capacity
  misc_feature: Utility: Useful for increasing seed/fruit yield or modifying fruit content
  misc_feature: Utility: Useful for making plants sterile and for genetic confinement
  misc_feature: Utility: Useful for making plants with increased biomass and foliage
  misc_feature: Utility: Useful for making shorter plants and plants with modified flowers
  misc_feature: Utility: Useful for making smaller plants
MANPAAAAGPSGGARSFLQAVSTVTEEAPSPLRVVQMEGLAVLKIIKHCEEFAPALVTGQLLGLDVGSVLEVTNCFPFPMREDDEEADADGANYQLEMMRCLREVNVDNNTVGWYQSCLLGSFQTVELIETFMNYQENIRRCVCIVYDPSRSNQGVLALKALKLTDSFMDLYRNNGLTGEKLREKKLSWVDIFEEIPIKVSNSALVSAFMTELEPESPVSQCDFDRLKLSTAPFMERNLEFLIGCMDDLSSEQNKFQYYYRNVSRQQSQQQAWLQKRRQENMARKAAGEEPLPEEDPSNPIFKPIPEPSRLEGYLVTNQISSYCNHINGVAGQNFNRLYLMKALQED

SEQ ID NO: 434 - protein, 397 aa, Zea mays
  misc_feature (1)..(397): Ceres CLONE ID no. 222358
  misc_feature: Utility: Useful for delaying flowering time
  misc_feature: Utility: Useful for increasing chlorophyll and photosynthetic capacity
  misc_feature: Utility: Useful for increasing seed/fruit yield or modifying fruit content
  misc_feature: Utility: Useful for making plants sterile and for genetic confinement
  misc_feature: Utility: Useful for making plants with increased biomass and foliage
  misc_feature: Utility: Useful for making shorter plants and plants with modified flowers
  misc_feature: Utility: Useful for making smaller plants
  misc_feature (4)..(4): Xaa is any aa, unknown, or other
NCTXPALCYSRSQPENPNFPAAAFLSLDPQLAPFLQVRTHRPAYALPPNDLRAAMANSAAPGGMRSFLQAVSTVTEEAPTPLRVVQMEGLAVLKIIKHCEEFAPALVTGQLLGLDVGSVLEVTNCFPFPIREEDDEADADGANYQLEMMRCLREVNVDNNTIGWYQSCLLGSFQTVELIETFMNYQESIRRCVCIVYDPSRSSQGVLALKALKLTDSFMDLYRNNGLTGEKLREKKLSWVDIFEEIPIKVSNSALVSAFMKELEPESPVTQCDLDRLKLSTAPFMERNLEFLIGCMDDLSSEQNKFQYYNRNLSRQQSQQQAWLQKRRQENMARKAAGEEPLPEEDPSNPIFKPIPEPSRLEGYLVTNQICSYCNHINGVAGQNFDRLYLMKALHED

SEQ ID NO: 435 - protein, 395 aa, Zea mays
  misc_feature (1)..(395): Ceres CLONE ID no. 246601
  misc_feature: Utility: Useful for delaying flowering time
  misc_feature: Utility: Useful for increasing chlorophyll and photosynthetic capacity
  misc_feature: Utility: Useful for increasing seed/fruit yield or modifying fruit content
  misc_feature: Utility: Useful for making plants sterile and for genetic confinement
  misc_feature: Utility: Useful for making plants with increased biomass and foliage
  misc_feature: Utility: Useful for making shorter plants and plants with modified flowers
  misc_feature: Utility: Useful for making smaller plants
INWTRTSCSLLSPADKKTLEFPAAALLSLDPFLQARTHPHASAPPPNDLRAAMANSAAPGGVRSFLQAVSTVTEETRTPLRVVQMEGLAVLKIIKHCEEFAPALVTGQLLGLDVGSVLEVTNCFPFPMREEDDEADADGANYQLEMMRCLREVNVDNNTIGWYQSCLLGSFQTVELIETFMNYQESIRRCVCIVYDPSRSSQGVLALKALKLTDSFMDLYRNNGLTGEKLREKKLSWVDIFEEIPIKVSNSALVSAFMKELEPESPVTQCDLDRLKLSTAPFMERNLEFLIGCMDDLSSEQNKFQYYNRNLSRQQSQQQAWLQKRRQENMARKAAGEEPLPEEDPSNPIFKPIPEPSRLEGYLVTNQISSYCNHINGVAGQNFDRLYLMKALHED

SEQ ID NO: 436 - protein, 343 aa, Zea mays
  misc_feature (1)..(343): Ceres CLONE ID no. 1213577
  misc_feature: Utility: Useful for delaying flowering time
  misc_feature: Utility: Useful for increasing chlorophyll and photosynthetic capacity
  misc_feature: Utility: Useful for increasing seed/fruit yield or modifying fruit content
  misc_feature: Utility: Useful for making plants sterile and for genetic confinement
  misc_feature: Utility: Useful for making plants with increased biomass and foliage
  misc_feature: Utility: Useful for making shorter plants and plants with modified flowers
  misc_feature: Utility: Useful for making smaller plants
MANSAAPGGMRSFLQAVSTVTEEAPTPLRVVQMEGLAVLKIIKHCEEFAPALVTGQLLGLDVGSVLEVTNCFPFPIREEDDEADADGANYQLEMMRCLREVNVDNNTIGWYQSCLLGSFQTVELIETFMNYQESIRRCVCIVYDPSRSSQGVLALKALKLTDSFMDLYRNNGLTGEKLREKKLSWVDIFEEIPIKVSNSALVSAFMKELEPESPVTQCDLDRLKLSTAPFMERNLEFLIGCMDDLSSEQNKFQYYNRNLSRQQSQQQAWLQKRRQENMARKAAGEEPLPEEDPSNPIFKPIPEPSRLEGYLVTNQICSYCNHINGVAGQNFDRLYLMKALHED

SEQ ID NO: 437 - DNA, 1839 bp, Arabidopsis thaliana
  misc_feature (1)..(1839): Ceres CLONE ID no. 34552
  misc_feature (1)..(1839): Also known as  Ceres CDNA ID no. 23361470
aggtaacgtctctctctctctgtgactctctcaattagtttgaaccagtcaactcgtaaagcccttgtttcctgtaattttccgaattgggtcttcccttaatttatcatttctcgccggaaaaactttgagaatttccttgtatttcacggcgatgctataatcctcctgaaagcgacttactgatatatattagtttattaggcaatgaatgtgaaatttaccgagtcaaacgtgtttaaacaatgtaaaagtgttgcaggcgattgttttgtttatcttgttttgggtttggttgtcttggatgggaggaagtagctctaaagagtcacctagaggaggtggaagtggtcgtaggtatgaacgtagtgtgtctgggagctcatcttattcgtctgcttgggaccagagcagctattatcagacaccaaaccatccatctgcgtctcctgtttcatcctataattctgggagacaaacaccgaagaatcttgagaggaagtattcacggattgctgataactaccgttccattgatgaggttaccgctgctctttcacatgccggtttggagtcctcgaatctcattgttggtatagatgtcaccaagagcaacgagtggacaggggcgagatcatttggtaggaagagtctgcatttcattggaactactccaaacccttatcaacaagctatttccatcattggaaagactttatcggtttttgatgaggataatttgatcccctgttatggatttggagatgctacaactcatgatcaggatgtcttcagtttcaatcccaatgatacatattgtaacgggtttgaagaagttctcatgtgttacagagagattgttccccagcttcgtctctcaggtccgacatcttttgcacctatcatcgaaagggccatgacaattgtggaagaaagtggtggccagtaccatgttcttctcattatcgctgatggacaggtgacaagaagtgttgatacagataacggtggattcagtccacaagagcagcagactattgatgccattgttagagcaagtgaatatcctttgtctatagttcttgttggtgttggagatggtccctgggacaccatgagacagtttgatgacaacatccccgctcgtgcctttgacaatttccagtttgtgaatttcacggatataatgtcaaagaacattgatccagcaagaaaagaggcagaattcgcgctttctgccttgatggagatcccgtctcagtataaagccaccctcgaactaggcttacttggacaaagaaccggacattgtccagacaggattgcgcttccaccaccaacttatgctactcaatctatgcgcaacagcccaagaacttcccgatcaaccagttttcaaaacaaaccatatgataatggtgtttcctctacaccaccttcaactactcataacgagagccagcaacagttttgccccgtatgtctagtgagtgcaaagaacatggctttcaattgtggtcatcagacttgcgctggatgtggggaagacctccatgtgtgtcccatttgccggagctcaatctcggttcgtatcaagctttattaagataagtctctcaagaactgaaggaacccgaggtggtctgagatctttcacagccaacaccatcccaacttagatctcatttaccagtgtcctaacatttgtttttactttgaggggaataaccggttcctctcaaaggttttgtagataatctgttgtcaattttgcattctcattgcacatgaaaaaaccacagcagactctctcgtgaataaaggatcctttctctgcgg

SEQ ID NO: 438 - protein, 433 aa, Arabidopsis thaliana
  misc_feature (116)..(264): Pfam Name: Copine; Pfam Description: Copine
  misc_feature (116)..(264): Pfam Name: Copine; Pfam Description: Copine
  misc_feature: Utility: Useful for delaying flowering time
  misc_feature: Utility: Useful for making plants with altered leaf shape eg curled leaves
  misc_feature: Utility: Useful for making plants with increased biomass
  misc_feature: Utility: Useful for making plants with increased biomass and foliage
  misc_feature: Utility: Useful for making smaller plants
MGGSSSKESPRGGGSGRRYERSVSGSSSYSSAWDQSSYYQTPNHPSASPVSSYNSGRQTPKNLERKYSRIADNYRSIDEVTAALSHAGLESSNLIVGIDVTKSNEWTGARSFGRKSLHFIGTTPNPYQQAISIIGKTLSVFDEDNLIPCYGFGDATTHDQDVFSFNPNDTYCNGFEEVLMCYREIVPQLRLSGPTSFAPIIERAMTIVEESGGQYHVLLIIADGQVTRSVDTDNGGFSPQEQQTIDAIVRASEYPLSIVLVGVGDGPWDTMRQFDDNIPARAFDNFQFVNFTDIMSKNIDPARKEAEFALSALMEIPSQYKATLELGLLGQRTGHCPDRIALPPPTYATQSMRNSPRTSRSTSFQNKPYDNGVSSTPPSTTHNESQQQFCPVCLVSAKNMAFNCGHQTCAGCGEDLHVCPICRSSISVRIKLY

SEQ ID NO: 439 - DNA, 1856 bp, Arabidopsis thaliana
  misc_feature (1)..(1856): Ceres CLONE ID no. 35776
  misc_feature (1)..(1856): Also known as  Ceres CDNA ID no. 23458256
aacaaattcctacaccaatatctttagctagagagaaaaaaagagtgaggaaactagagagagagaccacccaataatggtgaggttcgagaaggttcatttagtgttagggttagctctggttctaactctggtcggagctccgaccaaagcccaaggacctgtttgcggtgcaggcctgcctgacaaatttagcagattaaacttccctgaaggcttcatttggggaaccgcaacagcagcatttcaggttgaaggagctgttaatgaaggttgcagaggtccaagcatgtgggatactttcactaagaagttcccacatagatgtgaaaatcataacgctgatgttgctgtggatttctatcatcgttacaaggaagatatccagttgatgaaagaccttaacactgatgcttttagactttctattgcgtggcccagaatattcccccatggaaggatgtctaagggaataagcaaagtgggagtccaattctaccacgacctcatcgatgagcttctcaaaaacaatataataccattagttacagtctttcattgggatactccccaagacttggaagatgaatatggtggtttcttaagtggtcgcatcgtgcaagattttaccgaatatgcgaatttcactttccacgaatatggacacaaagtgaaacattggatcacattcaatgagccatgggtgtttagtcgtgccggttacgacaacggaaagaaagctccgggacgttgttcaccgtacatccccggttatggacagcattgtcaagatgggcggtctggatacgaagcttatcaagtcagtcacaacttactcttgtcgcatgcttacgccgttgacgcattcagaaaatgcaaacagtgtgctggaggtaaaataggaattgcacacagtccagcttggttcgaaccacaagaccttgagcatgttggaggttccattgaacgtgtgcttgatttcatcctasgatggcatttggctccaacaacttatggagattatccacaatcgatgaaggatcgtgtcggtcatagattgccaaaattcacagaagctgagaagaagttgctgaagggttctacagattactaggaatgaattactatacttcagtgtttgcaaaagaaattagccctgatcctaagaatccgagttggacgactgattctcttgttgattgggatagcaagagtgtggatggatacaaaattggtagcaagccgtttaatggtaaactggatgtgtattcaaaaggtttgagataccttttgaagtatattaaggataactatggcgacccagaagttatcattgccgagaatggatacggagaagaccttggagagaagcacaatgacgtaaactttgggacacaagatcacaacaggaaatattatatccaaaggcatctcttgagtatgcacgacgccatttgcaaggacaaagtgaacgttacgggatactttgtgtggtcgttgatggacaactttgagtggcaagatgggtacaaggcgaggttcggactttactacatcgatttccagaacaacttgacccgtcaccaaaaagtttcgggcaaatggtattccgaattcctcaaaccacagtttccaacctccaagctgagggaagaactctagatgatcaagaatcctatcgggacaaaataattgagtacaagagtcttgaagatgttgttgaggataatatcagtttgtgtgttctatggatcgttttcatctaccggtccttcctatgttagaaggacttgtgagttgttcaagttttaataatatcaataaatgtcttcttttttaatatatgttgagttaat

SEQ ID NO: 440 - protein, 345 aa, Arabidopsis thaliana
  misc_feature (40)..(344): Pfam Name: Glyco_hydro_1; Pfam Description: Glycosyl hydrolase family 1
  misc_feature: Utility: Useful for delaying flowering time
  misc_feature: Utility: Useful for increasing chlorophyll and photosynthetic capacity
  misc_feature: Utility: Useful for increasing increasing anthocyanin content
  misc_feature: Utility: Useful for making larger plants
  misc_feature: Utility: Useful for making ornamental plants with modified leaves
  misc_feature: Utility: Useful for making plants with altered leaf shape eg curled leaves
  misc_feature: Utility: Useful for making plants with increased biomass and foliage
  misc_feature: Utility: Useful for making smaller plants
MVRFEKVHLVLGLALVLTLVGAPTKAQGPVCGAGLPDKFSRLNFPEGFIWGTATAAFQVEGAVNEGCRGPSMWDTFTKKFPHRCENHNADVAVDFYHRYKEDIQLMKDLNTDAFRLSIAWPRIFPHGRMSKGISKVGVQFYHDLIDELLKNNIIPLVTVFHWDTPQDLEDEYGGFLSGRIVQDFTEYANFTFHEYGHKVKHWITFNEPWVFSRAGYDNGKKAPGRCSPYIPGYGQHCQDGRSGYEAYQVSHNLLLSHAYAVDAFRKCKQCAGGKIGIAHSPAWFEPQDLEHVGGSIERVLDFILGWHLAPTTYGDYPQSMKDRVGHRLPKFTEAEKKLLKGSTDY

SEQ ID NO: 441 - protein, 501 aa, Arabidopsis thaliana
  misc_feature (1)..(501): Public GI no. 18377977
  misc_feature: Utility: Useful for delaying flowering time
  misc_feature: Utility: Useful for increasing chlorophyll and photosynthetic capacity
  misc_feature: Utility: Useful for increasing increasing anthocyanin content
  misc_feature: Utility: Useful for making larger plants
  misc_feature: Utility: Useful for making ornamental plants with modified leaves
  misc_feature: Utility: Useful for making plants with altered leaf shape eg curled leaves
  misc_feature: Utility: Useful for making plants with increased biomass and foliage
  misc_feature: Utility: Useful for making smaller plants
IHFTRANFPKGFIFGTATAAFQVEGAVNEGCRGPSMWDVYTKKFPHKCNYHNADVAVDFYHRYKEDIKLMKNLNTDGFRFSIAWPRIFPHGRMEKGISKAGVQYYHDLIDELLANGITPLVTVFHWDTPQDLEDEYGGFLSDRIIKDFTEYANFTFQEYGDKVKHWITFNEPWVFSRAGYDIGNKAPGRCSKYIKEHGEMCHDGRSGHEAYIVSHNMLLAHADAVDAFRKCDKCKGGKIGIAHSPAWFEAHELSDEEHETPVTGLIDFILGWHLHPTTYGDYPQSMKDHIGHRLPKFTEAQKEKLKNSADFVGINYYTSVFALHDEEPDPSQPSWQSDSLVDWEPRYVDKFNAFANKPDVAKVEVYAKGLRSLLKYIKDKYGNPEIMITENGYGEDLGEQDTSLVVALSDQHRTYYIQKHLLSLHEAICDDKVNVTGYFHWSLMDNFEWQDGYKARFGLYYVDYKNNLTRHEKLSAQWYSSFLHDGSKEFEIEHEFEHDEL

SEQ ID NO: 442 - protein, 514 aa, Brassica napus
  misc_feature (1)..(514): Ceres CLONE ID no. 1119202
  misc_feature: Utility: Useful for delaying flowering time
  misc_feature: Utility: Useful for increasing chlorophyll and photosynthetic capacity
  misc_feature: Utility: Useful for increasing increasing anthocyanin content
  misc_feature: Utility: Useful for making larger plants
  misc_feature: Utility: Useful for making ornamental plants with modified leaves
  misc_feature: Utility: Useful for making plants with altered leaf shape eg curled leaves
  misc_feature: Utility: Useful for making plants with increased biomass and foliage
  misc_feature: Utility: Useful for making smaller plants
MKFPLLGLLLLVTLVGSPTRAEEGPVCPKTETLSRASFPEGFMFGTATASYQVEGAVNEGCRGPSLWDIYTKKFPHRVKNHNADVAVDFYHRFREDIKLMKKLNTDALRLSIAWPRIFPHGRMEKGNSKEGVQFYHDLIDELLKNDLTPLVTIFHWDMPADLEDEYGGFLSERVVPDFVEYANFTFHEYGDKVKNWITFNEPWVFSRSAYDVGKKAPGRCSPYIKDFGHLCQDGRSGFEAYVVSHNLLVSHAEAVDAFRKCEKCKGDKIGIAHSPAWFEPEDVEGGQRTVDRVLDFIMGWHLDPTTYGDYPQSMKDAVGARLPKFTKAQKAKLKGSADFVGINYYSSFYAKASEKPDYRQPSWATDSLVEFEPKTVDGSVKIGSQPSTAKMAVYAAGLRKLVKYIKDRYGNPEIIITENGYGEDLGEKDTDHSVALNDHNRKYYHQRHLLSLHQAICEDKVNVTSYFVWSLMDNFEWLDGYTARFGLYYIDFQNNLTRMEKESATCSLNSSNRA

SEQ ID NO: 443 - protein, 514 aa, Brassica napus; identical to SEQ ID NO: 442
  misc_feature (1)..(514): Public GI no. 757740
  misc_feature: Utility: Useful for delaying flowering time
  misc_feature: Utility: Useful for increasing chlorophyll and photosynthetic capacity
  misc_feature: Utility: Useful for increasing increasing anthocyanin content
  misc_feature: Utility: Useful for making larger plants
  misc_feature: Utility: Useful for making ornamental plants with modified leaves
  misc_feature: Utility: Useful for making plants with altered leaf shape eg curled leaves
  misc_feature: Utility: Useful for making plants with increased biomass and foliage
  misc_feature: Utility: Useful for making smaller plants

SEQ ID NO: 444 - protein, 499 aa, Brassica napus
  misc_feature (1)..(499): Public GI no. 50947507
  misc_feature: Utility: Useful for delaying flowering time
  misc_feature: Utility: Useful for increasing chlorophyll and photosynthetic capacity
  misc_feature: Utility: Useful for increasing increasing anthocyanin content
  misc_feature: Utility: Useful for making larger plants
  misc_feature: Utility: Useful for making ornamental plants with modified leaves
  misc_feature: Utility: Useful for making plants with altered leaf shape eg curled leaves
  misc_feature: Utility: Useful for making plants with increased biomass and foliage
  misc_feature: Utility: Useful for making smaller plants
MRWLLLALFLVALVSNGAAVHGAFNRFSFPEDFIFGTGSAAYQYEGAVNEGGRGPSIWDTYAHIPGKVEDGSNGDVAVDFYHRYKEDLNFVTDMNMDAFRFSIAWSRILPNGTISGGINKEGIAFYNSLINEVISRGLKPFVTIFHFDTPQALEDKYRSFLSENIVKDFVDYADVCFREFGDRVKSWNTFNEPMIFCAGGYGSGTKAPGRCSPYVSKKCAPGDSGNEPYVAGHNLLLAHAEAVRLYRQKYQATQKGQIGITQVSHWFVPYSDAAADKHAVRRSLDFMYGWFMDPIVFGDYPGTMRKLVGDRLPKFTAEQSELVKGSYDFIGLNYYTTNYAKSVLRRPSKLKPAYATDNWVNQTAYRNGVPIGPPAFTKIFFTYAPGLRELLLYTKRKYNDPDIYIAENGTDEANNSTIPIAEALKDDNRISFHYQHLRFTQLAIKEGVKVKGYFTWTFMDDFEWGDGYTGRFGLIYVDRETLKRYRKKSSYWFADFLKR

SEQ ID NO: 445 - protein, 445 aa, Brassica napus
  misc_feature (1)..(445): Public GI no. 51965008
  misc_feature: Utility: Useful for delaying flowering time
  misc_feature: Utility: Useful for increasing chlorophyll and photosynthetic capacity
  misc_feature: Utility: Useful for increasing increasing anthocyanin content
  misc_feature: Utility: Useful for making larger plants
  misc_feature: Utility: Useful for making ornamental plants with modified leaves
  misc_feature: Utility: Useful for making plants with altered leaf shape eg curled leaves
  misc_feature: Utility: Useful for making plants with increased biomass and foliage
  misc_feature: Utility: Useful for making smaller plants
MRWLLLALFLVALVSNGAAVHGAFNRFSFPEDFIFGTGSAAYQYEGAVNEGGRGPSIWDTYAHIPGKVEDGSNGDVAVDFYHRYKEDLNFVTDMNMDAFRFSIAWSRILPNGTISGGINKEGIAFYNSLINEVISRGLKPFVTIFHFDTPQALEDKYRSFLSENIVKDFVDYADVCFREFGDRVKSWNTFNEPMIFCAGGYGSGTKAPGRCSPYVSKKCAPGDSGNEPYVAGHNLLLAHAEAVRLYRQKYQATQKGQIGITQVSHWFVPYSDAAADKHAVRRSLDFMYGWFMDPIVFGDYPGTMRKLVGDRLPKFTAEQSELVKGSYDFIGLNYYTTNYAKSVLRRPSKLKPAYATDNWVNQTAYRNGVPIGPPAFTKIFFTYAPGLRELLLYTKRKYNDPDIYIAENGTDEANNSTIPIAEALKDDNRISFHYQHLRFTQLAIK

SEQ ID NO: 446 - protein, 531 aa, Brassica napus
  misc_feature (1)..(531): Public GI no. 1155255
  misc_feature: Utility: Useful for delaying flowering time
  misc_feature: Utility: Useful for increasing chlorophyll and photosynthetic capacity
  misc_feature: Utility: Useful for increasing increasing anthocyanin content
  misc_feature: Utility: Useful for making larger plants
  misc_feature: Utility: Useful for making ornamental plants with modified leaves
  misc_feature: Utility: Useful for making plants with altered leaf shape eg curled leaves
  misc_feature: Utility: Useful for making plants with increased biomass and foliage
  misc_feature: Utility: Useful for making smaller plants
LLLLGFALANTNAARTDPPVVCATLNRTNFDTLFPGFTFGTATASYQLEGAANIDGRGPSIWDAFTHNHPEKITDGSNGDVAIDQYHRYKEDVAIMKDMGLDAYRFSISWSRLLPNGTLSGGINKKGIEYYNNLTNELIRNGIEPLVTLFHWDVPQALEEEYGGVLSPRIVYDFKAYAELCYKEFGDRVKHWTTLNEPYTISNHGYTIGIHAPGRCSSWYDPTCLGGDSGTEPYLVTHNLLLAHAAAVKLYREKYQASQEGVIGITVVSHWFEPASESQKDINASVRALDFMYGWFMDPLTRGDYPQSMRSLVKERLPNFTEEQSKSLIGSYDYIGVNYYSARYASAYPEDYSIPTPPSYLTDAYVNVTTELNGVPIGPQAASDWLYVYPKGLYDLVLYTKNKYNDPIMYITENGMDEFNNPKISLEQALNDSNRIDYCYRHLCYLQEAIIEGANVQGYFAWSLLDNFEWSEGYTVRFGINYVDYDNGLKRHSKLSTHWFKNFLKRSSISKEKIRRCGNNNARARKFVYRI

SEQ ID NO: 447 - protein, 527 aa, Brassica napus
  misc_feature (1)..(527): Public GI no. 28628597
  misc_feature: Utility: Useful for delaying flowering time
  misc_feature: Utility: Useful for increasing chlorophyll and photosynthetic capacity
  misc_feature: Utility: Useful for increasing increasing anthocyanin content
  misc_feature: Utility: Useful for making larger plants
  misc_feature: Utility: Useful for making ornamental plants with modified leaves
  misc_feature: Utility: Useful for making plants with altered leaf shape eg curled leaves
  misc_feature: Utility: Useful for making plants with increased biomass and foliage
  misc_feature: Utility: Useful for making smaller plants
MLVLLISFLALTKPAMADYDGIPADFNRSYFPDDFIFGTATSAYQIEGAANILGRGPSVWDTFTHESPKRIKDQSNGDVAVDFYNRFEEDIKNVKDMGFDAFRFSISWSRVIPSGRRHEGVNEGGIEFYNTVINETIKQGLRPFVTIFHWDTPQALEDKYGGFLSRDIVKDFREYADLLFERFGDRVKHWMTFNEPWALSGFAYDYGVFAPGRCSSWVNRRCRAGNSATEPYIVAHHLLLSHAAVVQIYRENYQTTQNGKIGITLFTFWFEPLSNRTIDIEASRTALDFMFGLWMDPLTYGRYPRTVRDLIGDRLLKFTDEETQMLRGSYDFVGIQYYTSYFAKPNAAIDPNHRRYKTDSQIIETPYDYDGNLIGPQAYSPWFYIFPQGIRHLLNYTKDTYNNPVIYITENGVDNLNNETESIDEALQDEFRVNYYRKHMWNALGSLKEYNVNIKGYFAWSYLDNFEWNIGYTSRFGLFYVDYKKNLTRIPKSSAFWFAAFLNPESSKKITQTTSRNSRKVGKFYIM

SEQ ID NO: 448 - protein, 507 aa, Brassica napus
  misc_feature (1)..(507): Public GI no. 32400332
  misc_feature: Utility: Useful for delaying flowering time
  misc_feature: Utility: Useful for increasing chlorophyll and photosynthetic capacity
  misc_feature: Utility: Useful for increasing increasing anthocyanin content
  misc_feature: Utility: Useful for making larger plants
  misc_feature: Utility: Useful for making ornamental plants with modified leaves
  misc_feature: Utility: Useful for making plants with altered leaf shape eg curled leaves
  misc_feature: Utility: Useful for making plants with increased biomass and foliage
  misc_feature: Utility: Useful for making smaller plants
MMAAKGSVVVGVLAIVAYALVVSEVAIAAQISSFNRTSFPDGFVFGAASSAYQFEGAAKEGGKGPNIWDTFTHEFPGKISNGSTGDVADDFYHRYKEDVKVLKFIGLDGFRMSISWARVLPRGKLSGGVNKEGIAFYNNVINDLLSKGIQPFITIFHWDLPQALEDEYGGFLSPHIVNDFRDFAELCFKEFGDRVKHWITMNEPWSYSYGGYDAGLLAPGRCSAFMAFCPKGNSGTEPYIVTHNLLLSHAAAVKLYKEKYQAYQKGQIGITLVTYWMIPYSNSKADKDAAQRALDFMYGWFIEPLSFGEYPKSMRRLVGKRLPRFTKEQAMLVKGSFDFLGLNYYIANYVLNVPTSNSVNLSYTTDSLSNQTAFRNGVAIGRPTGVPAFFMYPKGLKDLLVYTKEKYNDPVIYITENGMGDNNNVTTEEGIKDPQRVYFYNQHLLSLKNAIAAGVKVKGYFTWAFLDNFEWLSGYTQRFGIVYVDFKDGLKRYPKHSALWFKKFLLK

SEQ ID NO: 449 - DNA, 1395 bp, Arabidopsis thaliana
  misc_feature (1)..(1395): Ceres CLONE ID no. 36518
  misc_feature (1)..(1395): Also known as  Ceres CDNA ID no. 23471732
aaatcgtccccgtctcgtttccttcttcgctcgctgttcagattttgctttgaggctttaggctccccagatctctaatcgccgcagctttaagaaatggagactttcctattcacatctgagtctgtgaacgaaggacaccctgacaagctttgcgaccagatctctgatgcagtccttgatgcctgccttgagcaagaccctgatagcaaagttgcttgtgagacatgcaccaagaccaacatggtcatggttttcggtgagatcaccaccaaggctacgattgactacgagaagattgtccgtgacacttgccgttccattggattcatctctgacgatgttggtcttgatgcacaaatgcaaagtccttgttaacattgaacaacagagcccagacattgctcaaggtgttcacggtcacttcaccaaacgtccagaagacattggagctggtgaccaaggacacatgtttggttatgccactgatgaaacccctgagctcatgcctttgagtcatgtccttgcaaccaagattggtgctcgtctcactgaagtcaggaagaatggaacttgccgttggttaagaccagatggcaagacccaagtcactgttgagtactacaatgacaatggcgctatggttccagtccgtgtccacaccgtcctgatctcaacccagcacgatgaaaccgttaccaacgacgagattgcgcgtgacctcaaggagcatgtgatcaaaccaatcatcccagagaaataccttgacgacaaaaccatcttccacctcaacccatcaggccggtttgtgatcgggggaccacacggtgatgctggtttaactggacgtaagatcatcattgacacatacggaggatggggagctcatggaggtggtgctttctcaggcaaagacccaaccaaagtcgacagaagtggagcttacatcgtgaggcaagcagcaaagagtgtggtggctaatggcatggctcgcagggctcttgtccaggtctcatacgccattggagtacccgagccattgtctgtcttcgttgacacttacggaacagggttgattccagacaaggagatcctgaagatcgtgaaagagacattcgatttcagaccaggaatgatgacaatcaacttggacttgaagagaggaggaaatggaaggtttcagaaaacggcagcgtatggacatttcggaagagacgaccctgacttcacctgggaggtcgtgaagccactcaagtgggacaaacctcaagcttaaacttgattttatgtttcttctgtctttttactttaaacatctaccatggaccaataatcaaatccctctgtttcttttttcttgtattattgatatgaaagtttctggtttgtttaacc

SEQ ID NO: 450 - protein, 368 aa, Arabidopsis thaliana
  misc_feature (62)..(77): Pfam Name: S-AdoMet_synt_N; Pfam Description: S-adenosylmethionine synthetase, N-terminal domain
  misc_feature (91)..(213): Pfam Name: S-AdoMet_synt_M; Pfam Description: S-adenosylmethionine synthetase, central domain
  misc_feature (215)..(357): Pfam Name: S-AdoMet_synt_C; Pfam Description: S-adenosylmethionine synthetase, C-terminal domain
  misc_feature (62)..(77): Pfam Name: S-AdoMet_synt_N; Pfam Description: S-adenosylmethionine synthetase, N-terminal domain
  misc_feature (91)..(213): Pfam Name: S-AdoMet_synt_M; Pfam Description: S-adenosylmethionine synthetase, central domain
  misc_feature (215)..(357): Pfam Name: S-AdoMet_synt_C; Pfam Description: S-adenosylmethionine synthetase, C-terminal domain
  misc_feature: Utility: Useful for delaying flowering time
  misc_feature: Utility: Useful for making larger plants
  misc_feature: Utility: Useful for making plants with increased biomass and foliage
  misc_feature: Utility: Useful for making smaller plants
  misc_feature (294)..(294): Xaa is any aa, unknown, or other
MQSLMPALSKTLIAKLLVRHAPRPTWSWFSVRSPPRLRLTTRRLSVTLAVPLDSSLTMLVLMHKCKVLVNIEQQSPDIAQGVHGHFTKRPEDIGAGDQGHMFGYATDETPELMPLSHVLATKIGARLTEVRKNGTCRWLRPDGKTQVTVEYYNDNGAMVPVRVHTVLISTQHDETVTNDEIARDLKEHVIKPIIPEKYLDDKTIFHLNPSGRFVIGGPHGDAGLTGRKIIIDTYGGWGAHGGGAFSGKDPTKVDRSGAYIVRQAAKSVVANGMARRALVQVSYAIGVPEPLSVXVDTYGTGLIPDKEILKIVKETFDFRPGMMTINLDLKRGGNGRFQKTAAYGHFGRDDPDFTWEVVKPLKWDKPQA

SEQ ID NO: 451 - protein, 344 aa, Arabidopsis thaliana
  misc_feature (1)..(344): Ceres CLONE ID no. 37800
  misc_feature: Utility: Useful for delaying flowering time
  misc_feature: Utility: Useful for making larger plants
  misc_feature: Utility: Useful for making plants with increased biomass and foliage
  misc_feature: Utility: Useful for making smaller plants
MVMVFGEITTKATVDYEKIVRDTCRAIGFVSDDVGLDADKCKVLVNIEQQSPDIAQGVHGHFTKCPEEIGAGDQGHMFGYATDETPELMPLSHVLATKLGARLTEVRKNGTCAWLRPDGKTQVTVEYYNDKGAMVPIRVHTVLISTQHDETVTNDEIARDLKEHVIKPVIPEKYLDEKTIFHLNPSGRFVIGGPHGDAGLTGRKIIIDTYGGWGAHGGGAFSGKDPTKVDRSGAYIVRQAAKSVVANGMARRALVQVSYAIGVPEPLSVFVDTYETGLIPDKEILKIVKESFDFRPGMMTINLDLKRGGNGRFLKTAAYGHFGRDDPDFTWEVVKPLKWDKPQA

SEQ ID NO: 452 - protein, 341 aa, Glycine max
  misc_feature (1)..(341): Ceres CLONE ID no. 564011
  misc_feature: Utility: Useful for delaying flowering time
  misc_feature: Utility: Useful for making larger plants
  misc_feature: Utility: Useful for making plants with increased biomass and foliage
  misc_feature: Utility: Useful for making smaller plants
MVFGEITTKANVDYEKIVRDTCRNIGFVSNDVGLDADNCKVLVNIEQQSPDIAQGVHGHLTKKPEEIGAGDQGHMFGYATDETPELMPLSHVLATKLGARLTEVRKNGTCPWLRPDGKTQVTVEYYNDNGAMVPVRVHTVLISTQHDETVSNDQIAADLKEHVIKPVIPEKYLDEKTIFHLNPSGRFVIGGPHGDAGLTGRKIIIDTYGGWGAHGGGAFSGKDPTKVDRSGAYIVRQAAKSVVANGLARRCIVQVSYAIGVPEPLSVFVDTYGTGKIPDKEILQIVKENFDFRPGMITINLDLKRGGHRFLKTAAYGHFGRDDPDFTWEVVKPLKSEKPQA

SEQ ID NO: 453 - protein, 341 aa, Zea mays
  misc_feature (1)..(341): Ceres CLONE ID no. 225429
  misc_feature: Utility: Useful for delaying flowering time
  misc_feature: Utility: Useful for making larger plants
  misc_feature: Utility: Useful for making plants with increased biomass and foliage
  misc_feature: Utility: Useful for making smaller plants
MVMVFGEITTKASVDYEKIVRDTCREIGFTSDDVGLDADRCKVLVNIEQQSPDIAQGVHGHFTKRPEEIGAGDQGHMFGYATDETPELMPLSHVLATKLGARLTEVRKDGTCAWLRPDSKTQVTVEYVNEGGAMVPVRVHTVLISTQHDETVTNDEIAADLKEHVIKPVIPERYLDEKTIFHLNPSGRFVIGGPHGDAGLTGRKIIIDTYGGWGAHGGGAFSGKDPTKVDRSGAYVARQAAKSIVASGLARRCLVQVSYAIGVPEPLSVFVDSYGTGTIPDKEILKIVKENFDFRPGMVTINLDLKKGGNRFIKTAAYGHFGRDDADFTWEVVKPLKKASA

SEQ ID NO: 454 - protein, 396 aa, Zea mays
  misc_feature (1)..(396): Ceres CLONE ID no. 450648
  misc_feature: Utility: Useful for delaying flowering time
  misc_feature: Utility: Useful for making larger plants
  misc_feature: Utility: Useful for making plants with increased biomass and foliage
  misc_feature: Utility: Useful for making smaller plants
MAAVDTFLFTSESVNEGHPDKLCDQVSDAVLDACLAEDPDSKVACETCTKTNMVMVFGEITTKANVDYEKIVRETCRNIGFVSNDVGLDADHCKVLVNIEQQSPDIAQGVHGHFTKRPEEIGAGDQGHMFGYATDETPELMPLSHVLATKLGARLTEVRKNGTCPWLRPDGKTQVTVEYRNEGGAMVPIRVHTVLISTQHDETVTNDEIAADLKEHVIKPVIPEQYLDEKTIFHLNPSGRFVIGGPHGDAGLTGRKIIIDTYGGWGAHGGGAFSGKDPTKVDRSGAYVARQAAKSIVASGLARRAIVQVSYAIGVPEPLSVFVDTYGTGAIPDKEILKIVKENFDFRPGMIIINLDLKKGGNGRYLKTAAYGHFGRDDPDFTWEVVKPLKSEKPSA

SEQ ID NO: 455 - protein, 344 aa, Arabidopsis thaliana
  misc_feature (1)..(344): Ceres CLONE ID no. 326
  misc_feature: Utility: Useful for delaying flowering time
  misc_feature: Utility: Useful for making larger plants
  misc_feature: Utility: Useful for making plants with increased biomass and foliage
  misc_feature: Utility: Useful for making smaller plants
MVMVFGEITTKANVDYEQIVRKTCREIGFVSADVGLDADNCKVLVNIEQQSPDIAQGVHGHLTKKPEEVGAGDQGHMFGYATDETPELMPLTHVLATKLGAKLTEVRKNGTCPWLRPDGKTQVTIEYINESGAMVPVRVHTVLISTQHDETVTNDEIAADLKEHVIKPVIPEKYLDEKTIFHLNPSGRFVIGGPHGDAGLTGRKIIIDTYGGWGAHGGGAFSGKDPTKVDRSGAYIVRQAAKSIVASGLARRVIVQVSYAIGVPEPLSVFVDSYGTGKIPDKEILEIVKESFDFRPGMISINLDLKRGGNGRFLKTAAYGHFGRDDADFTWEVVKPLKSNKVQA

SEQ ID NO: 456 - DNA, 1636 bp, Arabidopsis thaliana
  misc_feature (1)..(1636): Ceres CLONE ID no. 36891
  misc_feature (1)..(1636): Also known as  Ceres CDNA ID no. 23363031
atatacccctcaatcataaacaataaacagagggagtcgccaaattttctcatcattttctcgagaaaatagactaaaagcgattcccgagagaaagaaagaacaaaaaaaaaacatccgagtgaaaatgagagaaattcttcatattcaaggaggtcagtgcggaaaccagatcggagctaagttctgggaagttatttgcggcgagcacggtattgatcaaaccggtcagtcatgtggcgatacagatctacagcttgaaaggatcaatgtctattttaacgaagctagcggaggcaaatacgttcctcgtgctgttcttatggatctggagcctggaactatggattctctcagatctgggccgtttggtcagattttccggcctgataacttcgtttttggtcagtctggtgctgggaataactgggcgaaaggtcattacacggagggagctgagttgattgattctgtgcttgatgttgtgaggaaggaagctgagaactgtgattgtcttcaaggttttcaagtttgtcattctttgggaggaggaactggttctggcatgggaacacttcttatttctaagattagagaggaatatccagatcgtatgatgatgaccttttcggttttcccatctcctaaggtctctgatacagttgttgagccatacaatgctactctttccgttcaccagctcgttgagaatgctgatgaatgtatggttttggataacgaagctctttacgatatctgtttccgtaccttgaagcttgctaatcctacatttggtgaccttaaccatctcatctcagctacaatgagtggtgttacatgctgtcttcggttccctggtcaactaaactctgaccttagaaaacttgcagtgaaccttattcctttcccacgactccacttcttcatggttggttttgcacctttgacatcaagaggatctcaacaatacagtgccttgagtgtccctgagctaactcaacagatgtgggatgccaaaaacatgatgtgtgcagctgatcctcgtcatggtcgttacttgacagcttctgctgtcttccgtggaaagatgagtaccaaagaggttgatgaacagatgatgaacgtccagaacaaaaactcctcatactttgttgaatggattccaaataacgtgaaatcaagcgtctgcgatatagctcccactggtttgaaaatggcatcaactttcattggaaactcaacttcaatccaggaaatgttcaggcgtgtgagtgaacagttcactgccatgttcaggagaaaggctttccttcattggtacacaggagaaggaatggacgagatggagttcactgaagcagagagtaacatgaatgatcttgttgcagagtatcagcaatatcaagatgctacagtcggtgaagaggagtacgaggaggacgaagaagaagaagaagcctaaagaaaagatgattgattattacttttgtaaggctgtaagttcgtcgcactcatttccttttacctctttttctgaattgggattctctctttttgtgctttgtgtgttttgttattgaatttctttcccaaacctaagatttgttccagagtgtaatcacatttgcctatgctc

SEQ ID NO: 457 - protein, 444 aa, Arabidopsis thaliana
  misc_feature (45)..(244): Pfam Name: Tubulin; Pfam Description: Tubulin/FtsZ family, GTPase domain
  misc_feature (246)..(383): Pfam Name: Tubulin_C; Pfam Description: Tubulin/FtsZ family, C-terminal domain
  misc_feature (45)..(244): Pfam Name: Tubulin; Pfam Description: Tubulin/FtsZ family, GTPase domain
  misc_feature (246)..(383): Pfam Name: Tubulin_C; Pfam Description: Tubulin/FtsZ family, C-terminal domain
  misc_feature: Utility: Useful for delaying flowering time
MREILHIQGGQCGNQIGAKFWEVICGEHGIDQTGQSCGDTDLQLERINVYFNEASGGKYVPRAVLMDLEPGTMDSLRSGPFGQIFRPDNFVFGQSGAGNNWAKGHYTEGAELIDSVLDVVRKEAENCDCLQGFQVCHSLGGGTGSGMGTLLISKIREEYPDRMMMTFSVFPSPKVSDTVVEPYNATLSVHQLVENADECMVLDNEALYDICFRTLKLANPTFGDLNHLISATMSGVTCCLRFPGQLNSDLRKLAVNLIPFPRLHFFMVGFAPLTSRGSQQYSALSVPELTQQMWDAKNMMCAADPRHGRYLTASAVFRGKMSTKEVDEQMMNVQNKNSSYFVEWIPNNVKSSVCDIAPTGLKMASTFIGNSTSIQEMFRRVSEQFTAMFRRKAFLHWYTGEGMDEMEFTEAESNMNDLVAEYQQYQDATVGEEEYEEDEEEEEA

SEQ ID NO: 458 - protein, 445 aa, Triticum aestivum
  misc_feature (1)..(445): Ceres CLONE ID no. 861902
  misc_feature: Utility: Useful for delaying flowering time
MREILHIQGGQCGNQIGAKFWEVICDEHGIDQTGKYAGDSDLQLERINVYYNEASGGRFVPRAVLMDLEPGTMDSLRSGPYGQIFRPDNFVFGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLATPTFGDLNHLISATMSGVTCCLRFPGQLNSDLRKLAVNLIPFPRLHFFMVGFAPLTSRGSQQYRALTVPELTQQMWDSKNMMCAADPRHGRYLTASAMFRGKMSTKEVDEQMLNVQNKNSSYFVEWIPNNVKSSVCDIPPTGLSMSSTFVGNSTSIQEMFRRVSEQFTAMFRRKAFLHWYTGEGMDEMEFTEAESNMNDLVAEYQQYQDATADEEEEYDEEEEEEAA

SEQ ID NO: 459 - protein, 442 aa, Glycine max
  misc_feature (1)..(442): Ceres CLONE ID no. 471579
  misc_feature: Utility: Useful for delaying flowering time
MREILHIQGGQCGNQIGAKFWEVICDEHGIDHTGKYSGDSELQLERINVYYNEASGGRYVPRAVLMDLEPGTMDSVRSGPFGQIFRPDNFVFGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLATPTFGDLNHLISATMSGVTCCLRFPGQLNSDLRKLAVNLIPFPRLHFFMVGFAPLTSRGSQQYRNLTVPELTQQMWDSKNMMCAADPRHGRYLTASAMFRGKMSTKEVDEQMINVQNKNSSYFVEWIPNNVKSSVCDIPPKGLKMSSTFIGNSTSIQEMFRRVSEQFTAMFRRKAFLHWYTGEGMDEMEFTEAESNMNDLVAEYQQYQDATADEEEYEDEEEEA

SEQ ID NO: 460 - protein, 445 aa, Zea mays
  misc_feature (1)..(445): Ceres CLONE ID no. 422618
  misc_feature: Utility: Useful for delaying flowering time
MREILHIQGGQCGNQIGAKFWEVICDEHGIDHTGKYAGDSDLQLERINVYYNEASGGRFVPRAVLMDLEPGTMDSVRSGPFGQIFRPDNFVFGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLSTPTFGDLNHLISATMSGVTCCLRFPGQLNSDLRKLAVNLIPFPRLHFFMVGFAPLTSRGSQQYRALTVPELTQQMWDSKNMMCAADPRHGRYLTASAMFRGKMSTKEVDEQMLNVQNKNSSYFVEWIPNNVKSSVCDIPPIGLKMSSTFVGNSTSIQEMFRRVSEQFTAMFRRKAFLHWYTGEGMDEMEFTEAESNMNDLVAEYQQYQDATAEDEEYEEEEEEEEET

SEQ ID NO: 461 - protein, 444 aa, Triticum aestivum
  misc_feature (1)..(444): Ceres CLONE ID no. 686137
  misc_feature: Utility: Useful for delaying flowering time
MREILHIQGGQCGNQIGAKFWEVICDEHGIDGTGRYAGDSDLQLERINVYYNEASGGRFVPRAVLMDLEPGTMDSVRSGPFGQIFRPDNFVFGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLATPSFGDLNHLISATMSGVTCCLRFPGQLNSDLRKLAVNLIPFPRLHFFMVGFAPLTSRGSQMYRALTVPELTQQMWDAKNMMCAADPRHGRYLTASACFRGKMSTKEVDEQMLNVQNKNSSYFVEWIPNNVKSSVCDMPPRGLKMAGTFVGNSTSIQEMFRRVSEQFTAMFRRKAFLHWYTGEGMDEMEFTEAESNMNDLVAEYQQYQDATAEEEYDEEEEEERDA

SEQ ID NO: 462 - protein, 445 aa, Triticum aestivum
  misc_feature (1)..(445): Ceres CLONE ID no. 1315179
  misc_feature: Utility: Useful for delaying flowering time
MREILHIQGGQCGNQIGAKFWEVICDEHGIDGTGRYAGDSDLQLERINVYYNEASGGRFVPRAVLMDLEPGTMDSVRSGPFGQIFRPDNFVFGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLATPSFGELNHLISATMSGVTCCLRFPGQLNSDLRKLAVNLIPFPRLHFFMVGFAPLTSRGSQMYRALTVPELTQQMWDAKNMMCAADPRHGRYLTASACFRGKMSTKEVDEQMLNVQNKNSSYFVEWIPNNVKSSVCDMPPRGLKMAGTFVGNSTSIQEMFRRVSEQFTAMFRRKAFLHWYTGEGMDEMEFTEAESNMNDLVAEYQQYQDATADEEYDEEEEEERDAE

SEQ ID NO: 463 - protein, 447 aa, Triticum aestivum
  misc_feature (1)..(447): Ceres CLONE ID no. 725504
  misc_feature: Utility: Useful for delaying flowering time
MREILHIQGGQCGNQIGAKFWEVVCDEHGIDPTGRYTGTSDLQLERVNVYYNEASCGRFVPRAVLMDLEPGTMDSVRTGPYGQIFRPDNFVFGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLTTPSFGDLNHLISATMSGVTCCLRFPGQLNSDLRKLAVNLIPFPRLHFFMVGFAPLTSRGSQQYRALTVPELTQQMWDAKNMMCAADPRHGRYLTASAMFRGKMSTKEVDEQMINVQNKNSSYFVEWIPNNVKSSVCDIPPTGLSMASTFVGNSTSIQEMFRRVSEQFTSMFRRKAFLHWYTGEGMDEMEFTEAESNMNDLVSEYQQYQDATSDEEGEYEDEDQEPEEDM

SEQ ID NO: 464 - protein, 445 aa, Zea mays
  misc_feature (1)..(445): Ceres CLONE ID no. 705622
  misc_feature: Utility: Useful for delaying flowering time
MREILHIQGGQCGNQIGSKFWEVVCDEHGIDPTGRYVGTSDLQLERVNVYYNEASCGRFVPRAVLMDLEPGTMDSVRTGPYGQIFRPDNFVFGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLTTPSFGDLNHLISATMSGVTCCLRFPGQLNSDLRKLAVNLIPFPRLHFFMVGFAPLTSRGSQQYRALTVPELTQQMWDAKNMMCAADPRHGRYLTASAMFRGKMSTKEVDEQMINVQNKNSSYFVEWIPNNVKSSVCDIPPRGLSMASTFIGNSTSIQEMFRRVSEQFTAMFRRKAFLHWYTGEGMDEMEFTEAESNMNDLVSEYQQYQDATADEEAEYEDEEAIQDE

SEQ ID NO: 465 - protein, 445 aa, Triticum aestivum
  misc_feature (1)..(445): Ceres CLONE ID no. 726433
  misc_feature: Utility: Useful for delaying flowering time
MREILHIQGGQCGNQIGAKFWEVICGEHGVDPTGQYTGSAPEQLERMDVYFNEAGGNRYVPRAVLMDLEPGTMDSLRSGPIGAIFRPDNFVYGQSGAGNNWAKGHYTEGAELIDSVLDVVRKEAENSDCLQGFQVCHSLGGGTGSGMDTLLISKIREEYPDRMMLTFSVFPSPKVSDTVVEPYNATLSVHQLVENADECMVLDNEALYDICFRTLKLTNPSFGDLNHLISATMSGVTCCLRFPGQLNSDLRKLAVNLIPFPRLHFFMVGFAPLTSRGSQQYRALTVPELTQQMWDAKNMMCAADPRHGRYLTASAMFRGKMSTKEVDEQMMNVQNKNSSYFVEWIPNNVKSSVCDIPPVGLAMSSTFVGNSTSIQEMFRRVSEQFTAMFRRKAFLHWYTSEGMDEMEFTEAESNMNDLVAEYQQYQDATAEEDYEEEEEPAADQP

SEQ ID NO: 466 - protein, 447 aa, Arabidopsis thaliana
  misc_feature (1)..(447): Ceres CLONE ID no. 256068
  misc_feature: Utility: Useful for delaying flowering time
MREILHVQGGQCGNQIGSKFWEVICDEHGVDPTGRYNGDSADLQLERINVYYNEASGGRYVPRAVLMDLEPGTMDSIRSGPYGQIFRPDNFVFGQSGAGNNWAKGHYTEGAELIDAVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLSTPSFGDLNHLISATMSGVTCSLRFPGQLNSDLRKLAVNLIPFPRLHFFMVGFAPLTSRGSQQYISLTVPELTQQMWDAKNMMCAADPRHGRYLTASAMFRGKMSTKEVDEQILNVQNKNSSYFVEWIPNNVKSSVCDIPPTGIKMASTFVGNSTSIQEMFRRVSEQFTAMFRRKAFLHWYTGEGMDEMEFTEAESNMNDLVSEYQQYQDATADEEDEYDEEEEQVYES

SEQ ID NO: 467 - protein, 445 aa, Zea mays
  misc_feature (1)..(445): Ceres CLONE ID no. 264576
  misc_feature: Utility: Useful for delaying flowering time
MREILHIQGGQCGNQIGAKFWEVICGEHGVDSTGCYSGVSPQQLERINVYYNEAGGGRYVPRAVLMDLEPGTMESIRAGPFGGIFRPDNFVYGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLTNPSFGDLNHLISATMSGVTCCLRFPGQLNSDLRKLAVNLIPFPRLHFFMVGFAPLTSRGSQQYRALTVPELTQQMWDAKNMMCAADPRHGRYLTASAMFRGKMSTKEVDEQMINVQNKNSSYFVEWIPNNVKSSVCDIPPVGLSMSSTFVGNSTSIQEMFRRVSEQFTAMFRRKAFLHWYTSEGMDEMEFTEAESNMNDLVAEYQQYQDATAEEYDEEEQDGEEEHA

SEQ ID NO: 468 - protein, 447 aa, Zea mays
  misc_feature (1)..(447): Ceres CLONE ID no. 1412402
  misc_feature: Utility: Useful for delaying flowering time
MREILHIQGGQCGNQIGAKFWEVICGEHCVDSTGRYSGTSSQQLELERINVYYNEAGGGRYVPRAVLMDLEPGTMESIRAGPFGGIFRPDNFVYGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLTNPSFGDLNHLISATMSGVTCCLRFPGQLNSDLRKLAVNLIPFPRLHFFMVGFAPLTSRGSQQYRALTVPELTQQMWDAKNMMCSADPRHGRYLTASAMFRGKMSTKEVDEQMINVQNKNSSYFVEWIPNNVKSSVCDIPPVGLPMASTFVGNSTSIQEMFRRVSEQFTAMFRRKAFLHWYTSEGMDEMEFTEAESNMNDLVAEYQQYQDATAEEYEEEEHDGEEEHA

SEQ ID NO: 469 - protein, 445 aa, Triticum aestivum
  misc_feature (1)..(445): Ceres CLONE ID no. 914491
  misc_feature: Utility: Useful for delaying flowering time
MREILHIQGGQCGNQIGSKFWEVVCDEHGIDPTGRYVGTSDLQLERVNVYYNEASCGRFVPRAVLMDLEPGTMDSVRTGPYGQIFRPDNFVFGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLTTPSFGDLNHLISATMSGVTCCLRFPGQLNSDLRKLAVNLIPFPRLHFFMVGFAPLTSRGSQMYRPLTVPELTQQMWDSKNMMCAADPRHGRYLTASAMFRGKMSTKEVDEQMINVQNKNSSYFVEWIPNNVKSSVCDIPPRGLSMASTFIGNSTSIQEMFRRVSEQFTAMFRRKAFLHWYTGEGMDEMEFTEAESNMNDLVSEYQQYQDATADEEGEYEEEEELEQE

SEQ ID NO: 470 - protein, 447 aa, Triticum aestivum
  misc_feature (1)..(447): Ceres CLONE ID no. 773962
  misc_feature: Utility: Useful for delaying flowering time
MREILHIQGGQCGNQIGSKFWEVVCDEHGIDPTGRYVGTSDLQLERVNVYYNEASCGRFVPRAVLMDLEPGTMDSVRTGPYGQIFRPDNFVFGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLTTPSFGDLNHLISATMSGVTCCLRFPGQLNSDLRKLAVNLIPFPRLHFFMVGFAPLTSRGSQMYRSLTVPELTQQMWDSKNMMCAADPRHGRYLTASAMFRGKMSTKEVDEQMINVQNKNSSYFVEWIPNNVKSSVCDIAPRGLSMASTFIGNSTSIQEMFRRVSEQFTAMFRRKAFLHWYTGEGMDEMEFTEAESNMNDLVAEYQQYQDATADEEEELYEDEDDADLQE

SEQ ID NO: 471 - DNA, 1511 bp, Arabidopsis thaliana
  misc_feature (1)..(1511): Ceres CLONE ID no. 36904
  misc_feature (1)..(1511): Also known as  Ceres CDNA ID no. 23376069
ataaagtaggaaaaaattagggttagactcgatcattcatagctgcgactattctctgctctttctacattttctcattttctcttgggctacttttcgactactaacaaatccaacgatgaggggattggtgaacaagctcgtgtccagatctctctccatctccgggaaatggcagaaccaacagcttcgtcgtctcaacatccacgagtatcagggagctgaattgatggggaaatatggagttaatgtgccgaaaggagtagctgcttcttcgttggaagaagttaaaaaggctattcaagatgttttccctaatgaaagcgagttggttgttaagagccagattttggctggtggaagaggtcttggaacattcaagagtggtcttaagggtggtgttcacattgttaaacgtgatgaggctgaagagattgctggaaagatgctaggacaagtacttgtcaccaagcaaactggtcctcaaggcaaagtagttagcaaggtttacttgtgtgagaaattgtcactcgtcaatgagatgtacttttccattattctggaccgtaaatctgctggaccgttgatcattgcctgtaaaaagggtggtaccagtattgaagatcttgctgagaagttccctgacatgatcatcaaggtaccaattgatgtatttgcaggaatcactgatgaagatgctgctaaggttgtggatggtctggctcccaaagctgctgacagaaaagattcgattgaacaagtgaagaagctatacgaactcttccgcaagactgactgcacaatgttggaaatcaatccccttgcggagacatcaactaatcaattggtagctgctgatgccaaattgaacttcgatgataatgctgcgttccgacaaaaagaggttttcgccatgcgtgatccaacacaggaggatccacgagaggtggctgctgctaaagttgacctgaactacatcggtttagatggagagattggttgcatggtgaatggtgctggattggccatggcaaccatggacatcattaaattacacggtggaacacccgccaatttccttgacgttggtggaaatgcttctgagcaccaggtggtggaagcgtttaagatactgacatcggacgataaagtgaaagcaatcttggtgaacatatttggtgggataatgaaatgtgatgtgattgctagtggaatcgtgaacgctgcaaaagaggtcgcattgaaagtgccagtggtggttagtctagaaggaacgaatgttgagcagggaaagagaatcctcaaggaaagtggaatgaaactcataacagctgatgatttggatgatgcagctgagaaagcggttaaagctttagctcactaatctctctatatataccaaaagccggtttgttaattgttttgtggttgacgcccaatttacactttcttgcggatatcatttcctcaaacagatcaataatgaactggtctcctttttttgtgtgatc

SEQ ID NO: 472 - protein, 421 aa, Arabidopsis thaliana
  misc_feature (69)..(232): Pfam Name: ATP-grasp; Pfam Description: ATP-grasp domain
  misc_feature (280)..(416): Pfam Name: Ligase_CoA; Pfam Description: CoA-ligase
  misc_feature (69)..(232): Pfam Name: ATP-grasp; Pfam Description: ATP-grasp domain
  misc_feature (280)..(416): Pfam Name: Ligase_CoA; Pfam Description: CoA-ligase
  misc_feature: Utility: Useful for delaying flowering time
  misc_feature: Utility: Useful for increasing chlorophyll and photosynthetic capacity
  misc_feature: Utility: Useful for making plants with increased biomass and foliage
  misc_feature: Utility: Useful for making smaller plants
MRGLVNKLVSRSLSISGKWQNQQLRRLNIHEYQGAELMGKYGVNVPKGVAASSLEEVKKAIQDVFPNESELVVKSQILAGGRGLGTFKSGLKGGVHIVKRDEAEEIAGKMLGQVLVTKQTGPQGKVVSKVYLCEKLSLVNEMYFSIILDRKSAGPLIIACKKGGTSIEDLAEKFPDMIIKVPIDVFAGITDEDAAKVVDGLAPKAADRKDSIEQVKKLYELFRKTDCTMLEINPLAETSTNQLVAADAKLNFDDNAAFRQKEVFAMRDPTQEDPREVAAAKVDLNYIGLDGEIGCMVNGAGLAMATMDIIKLHGGTPANFLDVGGNASEHQVVEAFKILTSDDKVKAILVNIFGGIMKCDVIASGIVNAAKEVALKVPVVVSLEGTNVEQGKRILKESGMKLITADDLDDAAEKAVKALAH

SEQ ID NO: 473 - protein, 417 aa, Arabidopsis thaliana
  misc_feature (1)..(417): Public GI no. 27803873
  misc_feature: Utility: Useful for delaying flowering time
  misc_feature: Utility: Useful for increasing chlorophyll and photosynthetic capacity
  misc_feature: Utility: Useful for making plants with increased biomass and foliage
  misc_feature: Utility: Useful for making smaller plants
MLRKLANQSLSVAGKWQQQQLRRLNIHEYQGAELMSKYGINVPKGVAVASLDEVKKAIQDVFPNQSEVVVKSQVLAGGRGLGTFKNGFQGGVHIVKADQAEDIASKMLGQILVTKQTGAQGKVVSKVYLCEKMSLVNEMYFSIILDRATAGPLIIACRKGGTSIEDLAEKFPDMIIKVPIDVFKGISDADAAKVVDGLAPKVADRNDSIEQVKKLYKLFCETDCTMLEINPLAETSDNKLVAADAKLNFDDNAAYRQKEIFSLRDSSQEDPREVAAAKADLNYIGLDGEIGCMVNGAGLAMATMDIIKLHGGTPANFLDVGGNATEGQVVEAFKILTADEKVKAILVNIFGGIMKCDVIASGIVNAAKQVQLKVPVIVRLEGTNVEQGKRILKESGMKLITAEDLDDAAEKAVKALA

SEQ ID NO: 474 - protein, 384 aa, Glycine max
  misc_feature (1)..(384): Ceres CLONE ID no. 476815
  misc_feature: Utility: Useful for delaying flowering time
  misc_feature: Utility: Useful for increasing chlorophyll and photosynthetic capacity
  misc_feature: Utility: Useful for making plants with increased biomass and foliage
  misc_feature: Utility: Useful for making smaller plants
MSKHGVNVPRGVAVSSVEEARKVIKDLFPNENELVVKSQILAGGRGLGTFKSGLKGGVHIVKTDQVEDIAGKMLGQILVTKQTGPQGKIVSKVYLCEKLSLVNEMYFAITLDRTSAGPIIIACSKGGTSIEDLAEKFPDMIIKVPVDVFEGITDEGAAKVVDGLALKVADRNKSIEQVKNLYKLFVDCDCTLLEINPIAETADNQLVAADAKLNFDDNAAYRQKEIFSLRDTTQEDPREVTAAKADLNYIGLDGEIGCMVNGAGLAMATMDIIKLHGGTPANFLDVGGNASENQVVEAFKILTADDKVKAILVNIFGGIMKCDVIASGIVNAAKEVALKVPVVVRLEGTNVDQGKRILKESGMALITAEDLDDAAQKAVKAAYK

SEQ ID NO: 475 - protein, 384 aa, Zea mays
  misc_feature (1)..(384): Ceres CLONE ID no. 336060
  misc_feature: Utility: Useful for delaying flowering time
  misc_feature: Utility: Useful for increasing chlorophyll and photosynthetic capacity
  misc_feature: Utility: Useful for making plants with increased biomass and foliage
  misc_feature: Utility: Useful for making smaller plants
MGKYGINVPRGAAAGSVHEVKDALKNMFPSEKEIVVKSQILAGGRGLGTFKSGLQGGVHIVKAEEAELIASKMLGQILITKQTGPEGKIVSKVYLCEKLSLTNEMYFAITLDRKTAGPLIIACSKGGTSIEDLAEKYPDMIIKVPIDVFKGITDEDAAKVVDGLALKAADRQSSIEQIKKLYELFCKCDCTLLEINPLAETADNKLVAADAKLNFDDNAAFRQKEIFALRDTTQEDPREVAAAKADLNYIGLDGEIGCMVNGAGLAMATMDIIKLHGGTPANFLDVGGSASEGQVVEAFKILTSDDRVKAILVNIFGGIMKCDVIASGIVNAAKQVDLKVPVVVRLEGTNVDQGKRILKESGMTLITAEDLDDAAEKAVKASVK

SEQ ID NO: 476 - protein, 422 aa, Zea mays
  misc_feature (1)..(422): Public GI no. 50910635
  misc_feature: Utility: Useful for delaying flowering time
  misc_feature: Utility: Useful for increasing chlorophyll and photosynthetic capacity
  misc_feature: Utility: Useful for making plants with increased biomass and foliage
  misc_feature: Utility: Useful for making smaller plants
MVRGSLGKLASRALSVAGKWQHQQLRRLNIHEYQGAELMGKYGINVPRGAAAGSVEEVKNTLKNVFPSEKEIVVKSQILAGGRGLGTFKSGLQGGVHIVKAEEAESLAAKMLGQILVTKQTGPQGKIVSKVYLCEKLSLVNEMYFAITLDRNTAGPLIIACSKGGTSIEDLAEKYPDMIIKVPIDVFKGITDDDAAKVVDGLAPKTADRQSSIEQIKKLYELFCKSDCTLLEINPLAETADNKLVAADAKLNFDDNAAFRQKEIFAMRDTTQEDPREVAAAKADLNYIGLDGEIGCMVNGAGLAMATMDIIKLHGGTPANFLDVGGSASEGQVVEAFKILTSDDRVKAILVNIFGGIMKCDVIASGIVNAAKQVDLKVPVVVRLEGTNVDQGKRILKESGMTLITAEDLDDAAEKAVKASVK

SEQ ID NO: 477 - protein, 384 aa, Zea mays
  misc_feature (1)..(384): Ceres CLONE ID no. 306053
  misc_feature: Utility: Useful for delaying flowering time
  misc_feature: Utility: Useful for increasing chlorophyll and photosynthetic capacity
  misc_feature: Utility: Useful for making plants with increased biomass and foliage
  misc_feature: Utility: Useful for making smaller plants
MGKYGINVPRGAAAGSVQEVNDALKNMFPSEKEIVVKSQILAGGRGLGTFKSGLQGGVHIVKAEEAESIARKMLGQILVTKQTGPEGKIVSKVYLCEKLSLTNEMYFAITLDRKTAGPLIIACSKGGTSIEDLAEKYPDMIIKVPVDVFKGITDEDAAKVVDGLALKSADRQSSIEQIKKLYELFCKSDCTLLEINPLAETADNKLVAADAKLNFDDNAAFRQKEIFALRDTTQEDPREVAAAKADLNYIGLDGEIGCMVNGAGLAMATMDIIKLHGGTPANFLDVGGSASEGQVVEAFKILTSDDRVKAILVNIFGGIMKCDVIASGIVNAAKQVDLKVPVVVRLEGTNVDQGKRILKESGMTLITAEDLDDAAEKAVKASVK

SEQ ID NO: 478 - DNA, 1151 bp, Arabidopsis thaliana
  misc_feature (1)..(1151): Ceres CLONE ID no. 37288
  misc_feature (1)..(1151): Also known as  Ceres CDNA ID no. 23380533
agcccctttcccaatatttgatcaatttctaaagaaaaccccttcctctactagtcctcctcctatatatacaaaatcttaagaaatctctctacttgtttcctctgttatcataatctcttctctctatatctcttctcttcttcttttaccctgtttttttttttcattccacagagcccaggttgattgattttgttattcagagatatggggagaggaaggattgagattaagaagattgagaatatcaacagtcgtcaagtcactttctctaagagacgaaacggtttgatcaagaaggctaaagagctttcgattctctgtgacgccgaggttgctcttatcatcttctccagcaccggcaagatttacgatttctccagcgtctgtatggagcaaattctttctagatatggatacactactgcgtccactgagcataaacaacaaagagaacaccaacttctaatttgtgcttcacatggaaatgaagctgtgttgcgaaatgatgattctatgaaggtggaacttgaaagattacagcttgcaattgagagacttaagggtaaggagcttgaaggtatgagtttcccggatcttatttcttttgaaaaccagttgaacgagagcttgcatagtgtcaaggatcaaaagacacaaatcctgctcaaccagattgagagatccaggatacaggagaaaaaagcattggaagaaaaccaaatcttgcgcaaacaggttgagatgttggggagaggttcaggaccaaaagtgttgaatgaaaggcctcaagattctagcccagaagccgatcccgagagctcttcatcagaagaggatgagaatgacaacgaggagcaccattccgacacttccttgcagttggggttgtcgtcgacggggtattgcacaaagagaaagaagccgaagatcgaactggtctgcgataactctgggagtcaagtggcttctgattgatggaatcgattatttttctaattctggttgtttaggggtctctatgtgtcttcttgtttctggctgttcttttgctttatttcatctcaagtagagttttcttaatgtttaggtggaacatttttccataatcaagaagggatttgatcaatcaataacattagattttc

SEQ ID NO: 479 - protein, 256 aa, Arabidopsis thaliana
  misc_feature (9)..(59): Pfam Name: SRF-TF; Pfam Description: SRF-type transcription factor (DNA- binding and dimerisation domain)
  misc_feature (102)..(180): Pfam Name: K-box; Pfam Description: K-box region
  misc_feature (9)..(59): Pfam Name: SRF-TF; Pfam Description: SRF-type transcription factor (DNA- binding and dimerisation domain)
  misc_feature (102)..(180): Pfam Name: K-box; Pfam Description: K-box region
  misc_feature: Utility: Useful for delaying flowering time
  misc_feature: Utility: Useful for increasing chlorophyll and photosynthetic capacity
  misc_feature: Utility: Useful for making larger plants
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with increased biomass and foliage
  misc_feature: Utility: Useful for making plants with increased size and biomass
  misc_feature: Utility: Useful for making smaller plants
  misc_feature: Utility: Useful for making stronger plants
MGRGRIEIKKIENINSRQVTFSKRRNGLIKKAKELSILCDAEVALIIFSSTGKIYDFSSVCMEQILSRYGYTTASTEHKQQREHQLLICASHGNEAVLRNDDSMKVELERLQLAIERLKGKELEGMSFPDLISFENQLNESLHSVKDQKTQILLNQIERSRIQEKKALEENQILRKQVEMLGRGSGPKVLNERPQDSSPEADPESSSSEEDENDNEEHHSDTSLQLGLSSTGYCTKRKKPKIELVCDNSGSQVASD

SEQ ID NO: 480 - protein, 254 aa, Arabidopsis thaliana
  misc_feature (1)..(254): Public GI no. 52789958
  misc_feature: Utility: Useful for delaying flowering time
  misc_feature: Utility: Useful for increasing chlorophyll and photosynthetic capacity
  misc_feature: Utility: Useful for making larger plants
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with increased biomass and foliage
  misc_feature: Utility: Useful for making plants with increased size and biomass
  misc_feature: Utility: Useful for making smaller plants
  misc_feature: Utility: Useful for making stronger plants
MGRGKIEIKRIENANSRQVTFSKRRAGLLKKAKELAILCDAEVAVIIFSNTGKLFEFSSSGMNKTISRYKSAQGSPEIAQVEHKAEKQDSKEADHLKDEIAKLQMKQLQLLGKNLTSMSLKELQLLEQQLNEGLLSVKEKKEQLLMQQLEQSRLQEQRAMLENETLRRQVEELRGFFPTTDHPIQPYLECYPVERKNSLMSHSIPSPDLTCNCTVEKGDSDTTLYLGLPSDYHKRKKPEIESHSNESESQLGLL

SEQ ID NO: 481 - protein, 247 aa, Glycine max
  misc_feature (1)..(247): Ceres CLONE ID no. 523628
  misc_feature: Utility: Useful for delaying flowering time
  misc_feature: Utility: Useful for increasing chlorophyll and photosynthetic capacity
  misc_feature: Utility: Useful for making larger plants
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with increased biomass and foliage
  misc_feature: Utility: Useful for making plants with increased size and biomass
  misc_feature: Utility: Useful for making smaller plants
  misc_feature: Utility: Useful for making stronger plants
MGRGKIEIKKIENLNSRQVTFSKRRNGLLKKAKELSVLCDAEVAVIIFSSTGKLYEFSNTSMEHTLSRYSKGAESDSAEQPIDVPPTDVMAVEPDTNLLMEEITKLRSAYLRMMGKELDGLSLKELQQLENQLSEGMQSVKDKKEQVLVEQLRKSRIQEQKAMLENEVLRKQLEEIQNKTKSQFLEFSSLDRTFSKNGSKSLFNCASEENDLSDTSLQLGLSTDYGRQRKALKMEPCNDSGSQVASH

SEQ ID NO: 482 - protein, 235 aa, Glycine max
  misc_feature (1)..(235): Public GI no. 38326712
  misc_feature: Utility: Useful for delaying flowering time
  misc_feature: Utility: Useful for increasing chlorophyll and photosynthetic capacity
  misc_feature: Utility: Useful for making larger plants
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with increased biomass and foliage
  misc_feature: Utility: Useful for making plants with increased size and biomass
  misc_feature: Utility: Useful for making smaller plants
  misc_feature: Utility: Useful for making stronger plants
MGRGKIEIKRIDNASSRQVTFSKRRTGLFKKAQELSILCDAEVAVIVFSNTGKLFEFSSSGMKRTLSRYNKCLGSTDAAVAEIKTQKEDSKMVEILREEIAKLETKQLQLVGKDLTGLGLKELQNLEQQLNEGLLSVKARKLEQSRVQEQRVMLENETLRRQIEELRCLFPQSESMVPFQYQHTEGKNTFVDTGARYLNLANNCGNEKGSSDTSFHLGLPAGVQEEGPQERNLFK

SEQ ID NO: 483 - protein, 269 aa, Glycine max
  misc_feature (1)..(269): Public GI no. 34452081
  misc_feature: Utility: Useful for delaying flowering time
  misc_feature: Utility: Useful for increasing chlorophyll and photosynthetic capacity
  misc_feature: Utility: Useful for making larger plants
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with increased biomass and foliage
  misc_feature: Utility: Useful for making plants with increased size and biomass
  misc_feature: Utility: Useful for making smaller plants
  misc_feature: Utility: Useful for making stronger plants
MGRGKIDIKLIENVNNRQVTFSKRRAGLLKKANELSVLCDAEVAVIIFSSTGKLFEFSSTSMKQTLSRYNRCLASTETSAIEKKLEDNEQPQPLQTYVPKQEQKEMDILKDELSKLKMDQLRLLGKDLSGMGLNELRLLEHQLNEGLLAIKDRKEELLIQQLEQSRRQEERAALESETLRRQLEELRGLFPLSTSLPPPYLEYHPLEQKYPILKEGEESLDSDTACEDGVDDEDSNTTLQLGLPIVGRKRKKPEQDSPSSNSENQVGSK

SEQ ID NO: 484 - DNA, 1155 bp, Arabidopsis thaliana
  misc_feature (1)..(1155): Ceres CLONE ID no. 37298
  misc_feature (1)..(1155): Also known as  Ceres CDNA ID no. 23372860
ctctctcgtcgtctcaaatctcttcttccttcttcttctctctcgattcaagctaatccacacgcaaaaatgggaagccaacaagcggctgtttcgttcctttccaatttggcgaaggctgctttcggtcttggaacggcggcgacggtgctgaatacatcgcttttcaccgttgacggcggagaaagagctgttatcttcgatcgattcaggggagtgatggatcagactgtgggtgaagggactcatttcttgatcccgattcttcagaggcctcacatcttcgatatccgcacgaagcctcacacgttctcttcaatctctggtactaaggatctccagatggttaatctcactcttcgtgttctctctcgtcctgaggtgtcgcgtctcccgtacatcttccaaactttgggtctagagtatgacgagaaggttcttccttcgattggaaatgaggttttgaaagctgtggttgcacagttcaacgctgaccagcttctcactgagcgtcctcacgtctcagcacttgttcgggagtcactaatcacccgtgcgaaggacttcaacattgtgcttgatgatgtagctatcacgcatttgtcctatggtgtggagttttcaagggctgttgagcagaaacaagtggctcagcaagaggcagagaggtctaagtttgttgtgatgaaggctgatcaagagaggagagctgcggttataagagctgaaggtgagagtgaagctgctcagttgatttctgatgctacggctaaagctggtatgggacttatcgagcttaggaggattgaagcttcaagggagattgcgtctacacttgctaggtctcctaatgtggcctacttacccggtggccagagcatgctctttgccctgaaccgttgatcttgatcagatatgatggttgtttgggagcattttgcgatattttaatgatcaagttgtgaatctgattgaatcaaaaaggtgaaatgctcttttgttttgatgaactctgaagaagaaaaagaaactagttgtttgagttgtcattattgtgttctgaatctcggcaaaatttactctacctgaagaatctttgttttcagcatcatgtttatctaattctcaacaaataaatgattttggctgaactgc

SEQ ID NO: 485 - protein, 277 aa, Arabidopsis thaliana
  misc_feature (32)..(223): Pfam Name: Band_7; Pfam Description: SPFH domain / Band 7 family
  misc_feature (32)..(223): Pfam Name: Band_7; Pfam Description: SPFH domain / Band 7 family
  misc_feature: Utility: Useful for delaying flowering time
  misc_feature: Utility: Useful for increasing chlorophyll and photosynthetic capacity
  misc_feature: Utility: Useful for making larger plants
  misc_feature: Utility: Useful for making ornamental plants with modified flowers
  misc_feature: Utility: Useful for making ornamental plants with modified leaves
  misc_feature: Utility: Useful for making plants with increased biomass
  misc_feature: Utility: Useful for making smaller plants
  misc_feature: Utility: Useful for modifying plant structure, ie increased branching
MGSQQAAVSFLSNLAKAAFGLGTAATVLNTSLFTVDGGERAVIFDRFRGVMDQTVGEGTHFLIPILQRPHIFDIRTKPHTFSSISGTKDLQMVNLTLRVLSRPEVSRLPYIFQTLGLEYDEKVLPSIGNEVLKAVVAQFNADQLLTERPHVSALVRESLITRAKDFNIVLDDVAITHLSYGVEFSRAVEQKQVAQQEAERSKFVVMKADQERRAAVIRAEGESEAAQLISDATAKAGMGLIELRRIEASREIASTLARSPNVAYLPGGQSMLFALNR

SEQ ID NO: 486 - protein, 279 aa, Arabidopsis thaliana
  misc_feature (1)..(279): Ceres CLONE ID no. 33731
  misc_feature: Utility: Useful for delaying flowering time
  misc_feature: Utility: Useful for increasing chlorophyll and photosynthetic capacity
  misc_feature: Utility: Useful for making larger plants
  misc_feature: Utility: Useful for making ornamental plants with modified flowers
  misc_feature: Utility: Useful for making ornamental plants with modified leaves
  misc_feature: Utility: Useful for making plants with increased biomass
  misc_feature: Utility: Useful for making smaller plants
  misc_feature: Utility: Useful for modifying plant structure, ie increased branching
MGSQQAAISFLTNLAKAAFGLGVAATALNSSLYTVDGGERAVLFDRFRGVLDQTVGEGTHFLIPYLQTPHIYDIRTKPHTFSSKSGTKDLQMVNLTLRVLFRPEVSRLPYIFQTLGLEYDEKVLPSIGNEVLKAVVANFNADQLLTERPQVSALVREALIKRAREFNIELDDIAITHLSYGAEFSRAVEAKQVAQQEAERSKFVVMKADQERRAAVIRAEGESEAAQLISDATAKAGMGLIELRRIEASREVAATLARSPNVAYLPGGQSMLFNLNPGR

SEQ ID NO: 487 - protein, 279 aa, Arabidopsis thaliana; identical to SEQ ID NO: 486
  misc_feature (1)..(279): Public GI no. 21592895
  misc_feature: Utility: Useful for delaying flowering time
  misc_feature: Utility: Useful for increasing chlorophyll and photosynthetic capacity
  misc_feature: Utility: Useful for making larger plants
  misc_feature: Utility: Useful for making ornamental plants with modified flowers
  misc_feature: Utility: Useful for making ornamental plants with modified leaves
  misc_feature: Utility: Useful for making plants with increased biomass
  misc_feature: Utility: Useful for making smaller plants
  misc_feature: Utility: Useful for modifying plant structure, ie increased branching

SEQ ID NO: 488 - protein, 279 aa, Arabidopsis thaliana
  misc_feature (1)..(279): Public GI no. 9294221
  misc_feature: Utility: Useful for delaying flowering time
  misc_feature: Utility: Useful for increasing chlorophyll and photosynthetic capacity
  misc_feature: Utility: Useful for making larger plants
  misc_feature: Utility: Useful for making ornamental plants with modified flowers
  misc_feature: Utility: Useful for making ornamental plants with modified leaves
  misc_feature: Utility: Useful for making plants with increased biomass
  misc_feature: Utility: Useful for making smaller plants
  misc_feature: Utility: Useful for modifying plant structure, ie increased branching
MGSQQVAISFLTNLAKAAFGLGVAATALNSSLYTVDGGERAVLFDRFRGVLDQTVGEGTHFLIPYLQTPHIYDIRTKPHTFSSKSGTKDLQMVNLTLRVLFRPEVSRLPYIFQTLGLEYDEKVLPSIGNEVLKAVVANFNADQLLTERPQVSALVRDALIKRAREFNIELDDIAITHLSYGAEFSRAVEAKQVAQQEAERSKFVVMKADQERRAAVIRAEGESEAAQLISDATAKAGMGLIELRRIEASREVAATLARSPNVAYLPGGQSMLFNLNPGR

SEQ ID NO: 489 - protein, 279 aa, Arabidopsis thaliana
  misc_feature (1)..(279): Public GI no. 27765032
  misc_feature: Utility: Useful for delaying flowering time
  misc_feature: Utility: Useful for increasing chlorophyll and photosynthetic capacity
  misc_feature: Utility: Useful for making larger plants
  misc_feature: Utility: Useful for making ornamental plants with modified flowers
  misc_feature: Utility: Useful for making ornamental plants with modified leaves
  misc_feature: Utility: Useful for making plants with increased biomass
  misc_feature: Utility: Useful for making smaller plants
  misc_feature: Utility: Useful for modifying plant structure, ie increased branching
MGSQQVAISFLTNLAKAAFGLGVAATALNSSLYTVDGGERAVLFDRFRGVLDQTVGEGTHFLIPYLQTPHIYDIRTKPHTFSSKSGTKDLQMVNLTLRVLFRPEVSRLPYIFQTLGLEYDEKVLPSIGNEVLEAVVANFNADQLLTERPQVSALVRDALIKRAREFNIELDDIAITHLSYGAEFSRAVEAKQVAQQEAERSKFVVMKADQERRAAVIRAEGESEAAQLISDATAKAGMGLIELRRIEASREVAATLARSPNVAYLPGGQSMLFNLNPGR

SEQ ID NO: 490 - protein, 279 aa, Arabidopsis thaliana
  misc_feature (1)..(279): Public GI no. 58979188
  misc_feature: Utility: Useful for delaying flowering time
  misc_feature: Utility: Useful for increasing chlorophyll and photosynthetic capacity
  misc_feature: Utility: Useful for making larger plants
  misc_feature: Utility: Useful for making ornamental plants with modified flowers
  misc_feature: Utility: Useful for making ornamental plants with modified leaves
  misc_feature: Utility: Useful for making plants with increased biomass
  misc_feature: Utility: Useful for making smaller plants
  misc_feature: Utility: Useful for modifying plant structure, ie increased branching
MGSNQAAVSFLTNLARAAFGLGISATVVNSSLYTVDGGQRAVLFDRFRGVIDDTVGEGTHFLIPWLQKPFIFDIRTRPHTFSSTSGTKDLQMVNLTLRVLSRPEVARLPDIFKTLGLEYDEKVLPSIGNEVLKAVVAQFNADQLLTERPQVSALVRESLIRRAKDFNIVLDDVAITHLSYGAEFSKAVEQKQVAQQEAERSKFVVMKAEQERRAAIIRAEGESESAKLISDATAAAGMGLIELRRIEASREVAATLAKTPNVAYLPKQGNMLLGLNASR

SEQ ID NO: 491 - protein, 279 aa, Arabidopsis thaliana
  misc_feature (1)..(279): Public GI no. 1946329
  misc_feature: Utility: Useful for delaying flowering time
  misc_feature: Utility: Useful for increasing chlorophyll and photosynthetic capacity
  misc_feature: Utility: Useful for making larger plants
  misc_feature: Utility: Useful for making ornamental plants with modified flowers
  misc_feature: Utility: Useful for making ornamental plants with modified leaves
  misc_feature: Utility: Useful for making plants with increased biomass
  misc_feature: Utility: Useful for making smaller plants
  misc_feature: Utility: Useful for modifying plant structure, ie increased branching
MGSSQAAVSFLTNVARAAFGLGISATVLNSSLYTVDGGQRAVLFDRFRGVIDDTVGEGTHFLVPWLQKPFIFDIRTRPHTFSSVSGTKDLQMVHLTLRVLSRPEVARLPAIFKTLGLEYDEKVLPSIGNEVLKAVVAQFNADQLLTERPQVSALVRESLIRRAKDFNIVLDDVAITHLSYGAEFSKAVEQKQVAQQEAERSKFVVMKAEQERRAAIIRAEGESESAKLISDATAAAGMGLIELRRIEASREVAATMAKTPNVAYLPKQGNMLLGLNASR

SEQ ID NO: 492 - protein, 279 aa, Glycine max
  misc_feature (1)..(279): Ceres CLONE ID no. 523811
  misc_feature: Utility: Useful for delaying flowering time
  misc_feature: Utility: Useful for increasing chlorophyll and photosynthetic capacity
  misc_feature: Utility: Useful for making larger plants
  misc_feature: Utility: Useful for making ornamental plants with modified flowers
  misc_feature: Utility: Useful for making ornamental plants with modified leaves
  misc_feature: Utility: Useful for making plants with increased biomass
  misc_feature: Utility: Useful for making smaller plants
  misc_feature: Utility: Useful for modifying plant structure, ie increased branching
MGSNQAAISFLTNVARAAFGLGAAATALSSSLYTVDGGQRAVLFDRFRGILDSTVGEGTHFLVPWVQKPYIFDIRTRPHTFSSVSGTKDLQMVNLTLRVLSRPDTEKLPTIVQNLGLEYDEKVLPSIGNEVLKAVVAQFNADQLLTDRSQVSALVRESLIRRARDFNIVLDDVAITHLSYGGEFSRAVEQKQVAQQEAERSKFVVMKAEQERRAAIIRAEGESDAAKLISDATASAGMGLIELRRIEASREVAATLAKSPNVSYLPGGQNLLMALGPSR

SEQ ID NO: 493 - protein, 284 aa, Zea mays
  misc_feature (1)..(284): Ceres CLONE ID no. 296971
  misc_feature: Utility: Useful for delaying flowering time
  misc_feature: Utility: Useful for increasing chlorophyll and photosynthetic capacity
  misc_feature: Utility: Useful for making larger plants
  misc_feature: Utility: Useful for making ornamental plants with modified flowers
  misc_feature: Utility: Useful for making ornamental plants with modified leaves
  misc_feature: Utility: Useful for making plants with increased biomass
  misc_feature: Utility: Useful for making smaller plants
  misc_feature: Utility: Useful for modifying plant structure, ie increased branching
MAGGPAAVSFLTNIAKVAAGLGAAASLASASLYTVDGGERAVIFDRFRGVLPETVGEGTHFLVPWLQKPFIFDIRTRPHNFSSNSGTKDLQMVNLTLRLLSRPDVQHLPTIFTSLGLEYDDKVLPSIGNEVLKAVVAQFNADQLLTDRPHVSALVRDALIRRAREFNIILDDVAITHLSYGIEFSLAVEKKQVAQQEAERSKFLVAKAEQERRAAIVRAEGESESARLISEATAMAGTGLIELRRIEAAKEIAAELARSPNVAYIPSGENGKMLLGLNATGFVR

SEQ ID NO: 494 - protein, 271 aa, Zea mays
  misc_feature (1)..(271): Ceres CLONE ID no. 238897
  misc_feature: Utility: Useful for delaying flowering time
  misc_feature: Utility: Useful for increasing chlorophyll and photosynthetic capacity
  misc_feature: Utility: Useful for making larger plants
  misc_feature: Utility: Useful for making ornamental plants with modified flowers
  misc_feature: Utility: Useful for making ornamental plants with modified leaves
  misc_feature: Utility: Useful for making plants with increased biomass
  misc_feature: Utility: Useful for making smaller plants
  misc_feature: Utility: Useful for modifying plant structure, ie increased branching
MTRMAKVAAGLGVAASAASTSFYTVDGGERAVIFDRVRGVLPRTMSEGTHLLVPILQKPFIFDIRTRPHSFSSTSGTKDLQMVSLTLRVLSRPDVEHLPDIFTSLGLEYDEKVLPSIGNEVLKAVVAQFNADQLLTERPHVSALVRESLTKRAREFNIVLDDVAITHLAYGQEFAQAVEKKQVAQQEAERSRFLVARAEQERRAAIVRAEGESESARLISEATTTAGNGLIELRRIEAAKEIASVLSRTPNVSYIPAGDNGQMLLGLNAAR

SEQ ID NO: 495 - DNA, 1276 bp, Arabidopsis thaliana
  misc_feature (1)..(1276): Ceres CLONE ID no. 37663
  misc_feature (1)..(1276): Also known as  Ceres CDNA ID no. 23384271
aaagaagttcctcattcaaaaaagatttctcagccatcaaaattctctttctcttcatccaacaaaaaaaaagcatacctctttttcttccatatagataagttaattaagaaaacgaattatcaggttttgtttcggctgatctgaggaagttcatctatggatacggctcagtggccacaggagattgtagtgaagcccttggaagaaatagtaacaaacacatgcccaaagccacaaccgcaaccgcttcaaacgcagcagccaccgtcggtgggwtggagagaggaaggcaagaccagaaaaggatcaagctgtaaactgtccgagatgtaactcaaccaacacaaagttttgttactacaacaattatagtttgacgcagccaagatacttctgcaaaggttgtagaaggtattggaccgaaggcggttcgcttaggaacattcctgttggcggtggctcaagaaagaacaagagatctcactctttttcttctgatattagtaacaatcactcggattctacacaaccagctacaaagaagcatctctctgatcatcaccaccacctcatgagcatgtctcaacaaggtttgaccggtcaaaaccctaaattccttgagacgacccaacaagatctcaatttaggtttttcaccacatgggatgattaggaccaacttcactgacctcatccacaacattggcaacaacaccaacaagagcaacaacaataacaatccattgattgtttcttcatgttctaccatggctacttcttctctggatctcataagaaacaatagtaacaatgggaattcttcaaattcttccttcatgggatttccagttcataatgaagatccagcatcaggagggttttcaatgcaagatcattacaagccttgcaacacaaacaccacactgctagggttttcattagatcatcatcataataatggatttcatggagggtttcaaggaggagaagaaggtggagaaggtggtgatgatgtgaatggaaggcacttgtttccttttgaggatttgaaattgccagtttcttcttcatcagcaacaattaatgtcgacattaatgaacatcagaagcgaggaagcggtagtgatgcagctgctacgtctggtgggtattggactgggatgttgagtggaggatcatggtgctaattaatttctcggtttggttgatgaagatagtactattagtggttaattattgctatttatttaattaatcaatatgttcttaatttc

SEQ ID NO: 496 - protein, 342 aa, Arabidopsis thaliana
  misc_feature (48)..(110): Pfam Name: zf-Dof; Pfam Description: Dof domain, zinc finger
  misc_feature: Utility: Useful for delaying flowering time
  misc_feature: Utility: Useful for increasing chlorophyll and photosynthetic capacity
  misc_feature: Utility: Useful for making ornamental plants with modified leaves
  misc_feature: Utility: Useful for making plants with altered leaf shape eg curled leaves
  misc_feature: Utility: Useful for making plants with increased biomass
  misc_feature: Utility: Useful for making smaller plants
MDTAQWPQEIVVKPLEEIVTNTCPKPQPQPLQTQQPPSVGGERKARPEKDQAVNCPRCNSTNTKFCYYNNYSLTQPRYFCKGCRRYWTEGGSLRNIPVGGGSRKNKRSHSFSSDISNNHSDSTQPATKKHLSDHHHHLMSMSQQGLTGQNPKFLETTQQDLNLGFSPHGMIRTNFTDLIHNIGNNTNKSNNNNNPLIVSSCSTMATSSLDLIRNNSNNGNSSNSSFMGFPVHNEDPASGGFSMQDHYKPCNTNTTLLGFSLDHHHNNGFHGGFQGGEEGGEGGDDVNGRHLFPFEDLKLPVSSSSATINVDINEHQKRGSGSDAAATSGGYWTGMLSGGSWC

SEQ ID NO: 497 - protein, 293 aa, Glycine max
  misc_feature (1)..(293): Ceres CLONE ID no. 476994
  misc_feature: Utility: Useful for delaying flowering time
  misc_feature: Utility: Useful for increasing chlorophyll and photosynthetic capacity
  misc_feature: Utility: Useful for making ornamental plants with modified leaves
  misc_feature: Utility: Useful for making plants with altered leaf shape eg curled leaves
  misc_feature: Utility: Useful for making plants with increased biomass
  misc_feature: Utility: Useful for making smaller plants
MVVKPIEDIVVTNTCPKAVESKPRPQKEQAINCPRCHSINTKFCYYNNYSLTQPRYFCKTCRRYWTEGGTLRNIPVGGGSRKNKRSSASCSTPNNSHNNNNSTNKKLLSDLVITPPTLSHTQNPNSNNTIHQGQDLNLAFPSSTPDFRKISELVQQNNNNNNSSNNSMSASASSSSTTTTTSTSHLSALELLTGITSSSSAGLTSFMPVPVPSDPNSIYTCGFPLQDFKPTLNFSLDGIGNGYTSLQNVQSGRLLFPSDDLRQVSSSTITTMDQKQQGDSTGYWTGMLGGGSW

SEQ ID NO: 498 - DNA, 1417 bp, Arabidopsis thaliana
  misc_feature (1)..(1417): Ceres CLONE ID no. 38101
  misc_feature (1)..(1417): Also known as  Ceres CDNA ID no. 23377274
attcgctccgtttctctctcaaaaactacacacacgtaccacaccaccaccctcctcgtttcctcagagatcccctctctaacttctaaggatatagaaaatggcagatggtgaagacattcagcctctcgtctgtgacaatggaaccggaatggttaaggctggatttgctggagatgatgcaccaagagctgtattccctagcatcgttggtcgtcctcgacacactggtgtcatggttggtatgggacaaaaagatgcttacgttggtgatgaggctcagtctaagagaggtattttgacattgaaatatcctattgagcatggtattgttagcaactgggatgatatggagaagatttggcatcacactttctacaatgagctccgtgttgcacctgaagaacaccctgttcttctcactgaggctcctctcaaccccaaggccaatcgtgagaaaatgactcagattatgtttgaaactttcaacactcctgccatgtatgtcgctatccaagctgttctttccctctacgctagtggtcgtactactggtattgtgttggactctggagatggtgtgagtcacactgttccaatttatgaaggatatgctcttccacatgctattctgcgtttggaccttgcaggccgtgaccttactgattacctcatgaagatcttaaccgagcgtggttactcattcactacctcagcagagcgtgaaatcgtaagggatgtgaaagagaaacttgcttacatagcacttgactacgagcaagagatggaaacagcaaacacaagctcatccgttgagaagagctatgagttgcctgatggacaggtgatcaccattggaggagagagattccgctgcccggaggttctgttccaaccgtctttggtgggaatggaagctgctggtattcacgagaccacttacaattccatcatgaagtgtgatgtggatatcaggaaggatctgtatggaaacattgtgctcagtggtggaaccaccatgttccctggaattgctgataggatgagcaaagagatcactgctttggctccaagcagcatgaagattaaggtggttgctccaccagagaggaagtacagtgtctggattggaggctccattctagcatcactcagtaccttccaacagatgtggatagcaaaggctgagtatgatgagtcagggccatcaatagtccacaggaagtgcttctaagattaagctcaaatcaaagtgatgaatgattgttctgtattggtaaagccttttgttcatcgactttgttgcaaaatattcttttgttttctatgtttcttcaccactacattacatttctttcttgttgttatcctcttttggtgtttctgctattaatcgaaaaagaaattttcttttctc

SEQ ID NO: 499 - protein, 377 aa, Arabidopsis thaliana
  misc_feature (8)..(377): Pfam Name: Actin; Pfam Description: Actin
  misc_feature (8)..(377): Pfam Name: Actin; Pfam Description: Actin
  misc_feature: Utility: Useful for delaying flowering time
  misc_feature: Utility: Useful for increasing chlorophyll and photosynthetic capacity
  misc_feature: Utility: Useful for making plants with altered leaf shape eg curled leaves
  misc_feature: Utility: Useful for making plants with increased biomass
  misc_feature: Utility: Useful for making smaller plants
MADGEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNTPAMYVAIQAVLSLYASGRTTGIVLDSGDGVSHTVPIYEGYALPHAILRLDLAGRDLTDYLMKILTERGYSFTTSAEREIVRDVKEKLAYIALDYEQEMETANTSSSVEKSYELPDGQVITIGGERFRCPEVLFQPSLVGMEAAGIHETTYNSIMKCDVDIRKDLYGNIVLSGGTTMFPGIADRMSKEITALAPSSMKIKVVAPPERKYSVWIGGSILASLSTFQQMWIAKAEYDESGPSIVHRKCF

SEQ ID NO: 500 - protein, 360 aa, Zea mays
  misc_feature (1)..(360): Ceres CLONE ID no. 338602
  misc_feature: Utility: Useful for delaying flowering time
  misc_feature: Utility: Useful for increasing chlorophyll and photosynthetic capacity
  misc_feature: Utility: Useful for making plants with altered leaf shape eg curled leaves
  misc_feature: Utility: Useful for making plants with increased biomass
  misc_feature: Utility: Useful for making smaller plants
MVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNTPAMYVAIQAVLSLYASGRTTGIVLDSGDGVSHTVPIYEGYALPHAILRLDLAGRDLTDYLMKILTERGYSFTTTAEREIVRDMKEKLAYIALDYDQEMETAKTSSSVEKSYELPDGQVITIGAERFRCPEVLFQPSFIGMEAAGIHETTYNSIMKCDVDIRKDLYGNIVLSGGTTMFPGIADRMSKEITALAPSSMKIKVVAPPERKYSVWIGGSILASLSTFQQMWIAKAEYDESGPSIVHRKCF

SEQ ID NO: 501 - protein, 360 aa, Zea mays
  misc_feature (1)..(360): Ceres CLONE ID no. 331439
  misc_feature: Utility: Useful for delaying flowering time
  misc_feature: Utility: Useful for increasing chlorophyll and photosynthetic capacity
  misc_feature: Utility: Useful for making plants with altered leaf shape eg curled leaves
  misc_feature: Utility: Useful for making plants with increased biomass
  misc_feature: Utility: Useful for making smaller plants
MVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDSLMKILTERGYSFTTSAEREIVRDIKEKLAYIALDYEQELETAKNSSSVEKSYELPDGQVITIGAERFRCPEVLFQPSMIGMEAAGIHETTYNSIMKCDVDIRKDLYGNIVLSGGSTMFPGIADRMSKEITSLAPSSMKIKVVAPPERKYSVWIGGSILASLSTFQQMWISKEEYDESGPAIVHRKCF

SEQ ID NO: 502 - protein, 377 aa, Zea mays
  misc_feature (1)..(377): Ceres CLONE ID no. 294922
  misc_feature: Utility: Useful for delaying flowering time
  misc_feature: Utility: Useful for increasing chlorophyll and photosynthetic capacity
  misc_feature: Utility: Useful for making plants with altered leaf shape eg curled leaves
  misc_feature: Utility: Useful for making plants with increased biomass
  misc_feature: Utility: Useful for making smaller plants
MADSEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDSLMKILTERGYSFTTSAEREIVRDIKEKLAYIALDYEQELETAKNSSSVEKSYELPDGQVITIGAERFRCPEVLFQPSMIGMEAAGIHETTYNSIMKCDVDIRKDLYGNIVLSGGSTMFPGIADRMSKEITSLAPSSMKIKVVAPPERKYSVWIGGSILASLSTFQQMWISKEEYDESGPAIVHRKCF

SEQ ID NO: 503 - protein, 360 aa, Arabidopsis thaliana
  misc_feature (1)..(360): Ceres CLONE ID no. 116045
  misc_feature: Utility: Useful for delaying flowering time
  misc_feature: Utility: Useful for increasing chlorophyll and photosynthetic capacity
  misc_feature: Utility: Useful for making plants with altered leaf shape eg curled leaves
  misc_feature: Utility: Useful for making plants with increased biomass
  misc_feature: Utility: Useful for making smaller plants
MVKAGFAGDDAPRAVFPSIVGRPRHTGVMVGMGQKDAYVGDEAQSKRGILTLKYPIEHGIVNNWDDMEKIWHHTFYNELRVAPEEHPILLTEAPLNPKANREKMTQIMFETFNAPAMYVAIQAVLSLYASGRTTGIVLDSGDGVSHTVPIYEGYALPHAILRLDLAGRDLTDALMKILTERGYSFTTTAEREIVRDIKEKLCYIALDYEQELETAKTSSSVEKNYELPDGQVITIGSERFRCPEVLYQPSMIGMENAGIHETTYNSIMKCDVDIRKDLYGNIVLSGGTTMFPGIADRMSKEITALAPSSMKIKVVAPPERKYSVWIGGSILASLSTFQQMWIAKAEYDESGPSIVHRKCF

SEQ ID NO: 504 - protein, 360 aa, Zea mays
  misc_feature (1)..(360): Ceres CLONE ID no. 292789
  misc_feature: Utility: Useful for delaying flowering time
  misc_feature: Utility: Useful for increasing chlorophyll and photosynthetic capacity
  misc_feature: Utility: Useful for making plants with altered leaf shape eg curled leaves
  misc_feature: Utility: Useful for making plants with increased biomass
  misc_feature: Utility: Useful for making smaller plants
MVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDSLMKILTERGYSFTTTAEREIVRDIKEKLAYVALDYDQELENAKSSSSVEKSYELPDGQVITIGAERFRCPEVLFQPSFIGMEAPGIHETTYNSIMKCDVDIRKDLYGNIVLSGGTTMFPGIADRMSKEITALAPSSMKIKVVAPPERKYSVWIGGSILASLSTFQQMWISKAEYDESGPAIVHRKCF

SEQ ID NO: 505 - protein, 360 aa, Zea mays
  misc_feature (1)..(360): Ceres CLONE ID no. 996136
  misc_feature: Utility: Useful for delaying flowering time
  misc_feature: Utility: Useful for increasing chlorophyll and photosynthetic capacity
  misc_feature: Utility: Useful for making plants with altered leaf shape eg curled leaves
  misc_feature: Utility: Useful for making plants with increased biomass
  misc_feature: Utility: Useful for making smaller plants
MVKAGFAGDDAPRAVFPSIVGRPRHTGVMVGMGQKDAYVGDEAQSKRGILTLKYPIEHGIVNNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDSLMKILTERGYSFTTSAEREIVRDIKEKLAYVALEYDQELENAKSSSSVEKSYELPDGQVITIGAERFRCPEVLFQPSFIGMEAPGIHETTYNSIMKCDVDIRKDLYGNIVLSGGTTMFPGIADRMSKEITALAPSSMKIKVVAPPERKYSVWIGGSILASLSTFQQMWISKAEYDESGPGIVHRKCF

SEQ ID NO: 506 - protein, 360 aa, Brassica napus
  misc_feature (1)..(360): Ceres CLONE ID no. 1073372
  misc_feature: Utility: Useful for delaying flowering time
  misc_feature: Utility: Useful for increasing chlorophyll and photosynthetic capacity
  misc_feature: Utility: Useful for making plants with altered leaf shape eg curled leaves
  misc_feature: Utility: Useful for making plants with increased biomass
  misc_feature: Utility: Useful for making smaller plants
MVKAGFAGDDAPRAVFPSIVGRPRHTGVMVGMGQKDAYVGDEAQSKRGILTLKYPIEHGIVSNWDDMENIWHHTFYNELRVAPEEHPVLLTEAPLNPKANREKMTHIMFETFNVPAMYVAIQAVLSLYASGRTTGIVLDSGDGVSHTVPIYEGYALPHAILRLDLAGRDLTDSLMKILTERGYMFTTTAEREIVRDIKEKLAYVALDYEQELETAKSSSSVEKNYELPDGQVITIGAERFRCPEVLFQPSLVGMEAPGIHETTYNSIMKCDVDIRKDLYGNIVLSGGSTMFPGIADRMSKEITALAPSSMKIKVVAPPERKYSVWIGGSILASLSTFQQMWISKGEYDESGPSIVHRKCF

SEQ ID NO: 507 - protein, 360 aa, Arabidopsis thaliana
  misc_feature (1)..(360): Ceres CLONE ID no. 41421
  misc_feature: Utility: Useful for delaying flowering time
  misc_feature: Utility: Useful for increasing chlorophyll and photosynthetic capacity
  misc_feature: Utility: Useful for making plants with altered leaf shape eg curled leaves
  misc_feature: Utility: Useful for making plants with increased biomass
  misc_feature: Utility: Useful for making smaller plants
MVKAGFAGDDAPRAVFPSIVGRPRHTGVMVGMGQKDAYVGDEAQSKRGILTLKYPIEHGIVNNWDDMEKIWHHTFYNELRVAPEEHPVLLTEAPLNPKANREKMTQIMFETFNTPAMYVAIQAVLSLYASGRTTGIFLDSGDGVSHTVPIYEGYALPHAILRLDLAGRDLTDHLMKILTERGYSFTTTAEREIVRDMKEKLSYIALDFEQELETSKTSSSVEKSFELPDGQVITIGAERFRCPEVLFQPSMIGMENPGIHETTYNSIMKCDVDIRKDLYGNIVLSGGTTMFGGIGDRMSKEITALAPSSMKIKVVAPPERKYSVWIGGSILASLSTFQQMWIAKAEYDESGPSIVHRKCF

SEQ ID NO: 508 - protein, 360 aa, Zea mays
  misc_feature (1)..(360): Ceres CLONE ID no. 1549130
  misc_feature: Utility: Useful for delaying flowering time
  misc_feature: Utility: Useful for increasing chlorophyll and photosynthetic capacity
  misc_feature: Utility: Useful for making plants with altered leaf shape eg curled leaves
  misc_feature: Utility: Useful for making plants with increased biomass
  misc_feature: Utility: Useful for making smaller plants
MVKAGFAGDDAPRAVFPSIVGRPRHTGVMVGMGQKDAYVGDEAQSKRGILTLKYPIEHGIVGNWDDMEKIWHHTFYNELRVAPEEHPILLTEAPLNPKANREKMTQIMFETFNCPAMYVAIQAVLSLYASGRTTGIVLDSGDGVSHTVPIYEGYTLPHAILRLDLAGRDLTDNLMKILTERGYSFTTTAEREIVRDIKEKLAYVALDYEQELETARTSSSVEKSYELPDGQVITIGAERFRCPEVLFQPSFIGMESAGIHEATYNSIMKCDVDIRKDLYGNVVLSGGSTMFPGIGDRMSKEITALAPSSMKVKVVAPPERKYSVWIGGSILASLSTFQQMWISKEEYDESGPGIVHMKCF

SEQ ID NO: 509 - protein, 360 aa, Arabidopsis thaliana
  misc_feature (1)..(360): Ceres CLONE ID no. 34479
  misc_feature: Utility: Useful for delaying flowering time
  misc_feature: Utility: Useful for increasing chlorophyll and photosynthetic capacity
  misc_feature: Utility: Useful for making plants with altered leaf shape eg curled leaves
  misc_feature: Utility: Useful for making plants with increased biomass
  misc_feature: Utility: Useful for making smaller plants
MVKAGFAGDDAPRAVFPSVVGRPRHHGVMVGMNQKDAYVGDEAQSKRGILTLKYPIEHGVVSNWDDMEKIWHHTFYNELRIAPEEHPVLLTEAPLNPKANREKMTQIMFETFNSPAMYVAIQAVLSLYASGRTTGIVLDSGDGVSHTVPIYEGFSLPHAILRLDLAGRDLTDYLMKILTERGYMFTTTAEREIVRDIKEKLSFVSVDYEQEMETSKTSSSIEKNYELPDGQVITIGAERFRCPEVLFQPSFVGMEAAGIHETTYNSIMKCDVDIRKDLYGNIVLSGGTTMFSGIADRMSKEITALAPSSMKIKVVAPPERKYSVWIGGSILASLSTFQQMWISKAEYDEAGPGIVHRKCF

SEQ ID NO: 510 - protein, 360 aa, Zea mays
  misc_feature (1)..(360): Ceres CLONE ID no. 223048
  misc_feature: Utility: Useful for delaying flowering time
  misc_feature: Utility: Useful for increasing chlorophyll and photosynthetic capacity
  misc_feature: Utility: Useful for making plants with altered leaf shape eg curled leaves
  misc_feature: Utility: Useful for making plants with increased biomass
  misc_feature: Utility: Useful for making smaller plants
MVKAGFAGDDAPRAVFPSIVGRPRHTGVMVGMGQKDAYVGDEAQAKRGILTLKYPIEHGIVNNWDDMEKIWHHTFYNELRVSPEDHPVLLTEAPLNPKANREKMTQIMFETFECPAIYVAIQAVLSLYASGRTTGIVMDSGDGVSHTVPIYEGYTLPHAILRLDLAGRDLTDHLMKILTERGYSLTTSAEREIVRDIKEKLAYVALDYEQELETARSSSSVEKSYEMPDGQVITIGSERFRCPEVLFQPSLVGMESPGVHEATYNSIMKCDVDIRKDLYGNVVLSGGSTMFPGIADRMSKEITSLAPSSMKVKVIAPPERKYSVWIGGSILASLSTFQQMWISKGEYDETGPGIVHMKCF

SEQ ID NO: 511 - DNA, 1623 bp, Arabidopsis thaliana
  misc_feature (1)..(1623): Ceres CLONE ID no. 38419
  misc_feature (1)..(1623): Also known as  Ceres CDNA ID no. 23358368
ccgagattacagagaaccccgtcccgtgtttaaaccctccggcgacaaagctcagatagagaaccgctccacccttgtcgttctctgcagccatgtacggcggagatgaagtgtcagctattgtggttgacttgggttcgcacacttgcaaggctggttacgccggtgaagatgctcccaaggccgttttcccttccgttattggggcagtagatggtgtagaggcaatggatgtggatgttgattctacaaagactaattcgaactctgaggattcgaagaccgagtctgaaaaggaaaagggcaaacgcaagctctatgtaggatctcaagccatgagctaccgcagagatcatatggaggttttgtcacctataaaagatggcatcgtttctgactgggatttggtggacaatatatgggaacatgctttcaagagttgtctgatgattgatcctacggagcatccaatgctgctagctgagcctcctttaaacactcaacagcagagagagaaggcggcagagctaatgtttgaaaagtacaaagttccggcactgtttatggctaagaaccctgttctcacgtcttttgctactgggcgtgctacttctttggttgttgactgcggtggaggatccacaaccatttcaccggtgcatgatggttatgttcttcagaaggctgttgtatcgtctccacttggaggggaatttctcactgactgcctactgaaaagcttggagagtaaaggaattaaaataagacctagatactctttcaagaggaaggaagtacgagcaggggaattccaggttgaagatgtggatattcctgacaccacggaaagctacaaactcttctgccagaggatgatagtgggtgatatcaaggattctatttgtcgagttcctgatactccctatgacgataaatcatattcaaacatccctactacgtcgtacgagcttcctgatggccagacgctcgagattggtgctgataggttcaaagttcctgatgtgatgttcaacccgtccatagtccagacgattcctggaatggagaagtatgctgatatgattccttccgttcgtgggttaccacacatggtcatggagagcatcaacaaatgtgatgtagacatccggagagagttgtatagtagcatactgcttgctggtggcacatcgtcaatgcaacagctgaaagaacgtctcgaaaaggacttgatcgaagagtctcctcactcagctagagttaaagtgttggcaagcggtaacacaacagaaagaagattcagtgtatggataggagggagtatattggcatcactaggctcatttcaacagatgtggttctccaagtctgagtatgaggaacatggagcttcctacattcagagaaaatgcccttaaagcaggcagtttcagattatgtggagtctgacaagacgaaacttggaaactaatgtgttattttcattgtgcatcgttgttccttgaagattattagtattccgcctgaaccttttagaatgagtgtcattaacaagcattatagtgctatttttaaaacataaaaacatgtggaagaagtttcgttgctttattagattttcgc

SEQ ID NO: 512 - protein, 441 aa, Arabidopsis thaliana
  misc_feature (8)..(223): Pfam Name: Actin; Pfam Description: Actin
  misc_feature (8)..(223): Pfam Name: Actin; Pfam Description: Actin
  misc_feature: Utility: Useful for delaying flowering time
  misc_feature: Utility: Useful for increasing chlorophyll and photosynthetic capacity
  misc_feature: Utility: Useful for making ornamental plants with modified leaves
  misc_feature: Utility: Useful for making plants that grow better in shade
  misc_feature: Utility: Useful for making plants with altered leaf shape eg curled leaves
  misc_feature: Utility: Useful for making plants with increased biomass
  misc_feature: Utility: Useful for making plants with increased biomass and foliage
  misc_feature: Utility: Useful for making smaller plants
MYGGDEVSAIVVDLGSHTCKAGYAGEDAPKAVFPSVIGAVDGVEAMDVDVDSTKTNSNSEDSKTESEKEKGKRKLYVGSQAMSYRRDHMEVLSPIKDGIVSDWDLVDNIWEHAFKSCLMIDPTEHPMLLAEPPLNTQQQREKAAELMFEKYKVPALFMAKNPVLTSFATGRATSLVVDCGGGSTTISPVHDGYVLQKAVVSSPLGGEFLTDCLLKSLESKGIKIRPRYSFKRKEVRAGEFQVEDVDIPDTTESYKLFCQRMIVGDIKDSICRVPDTPYDDKSYSNIPTTSYELPDGQTLEIGADRFKVPDVMFNPSIVQTIPGMEKYADMIPSVRGLPHMVMESINKCDVDIRRELYSSILLAGGTSSMQQLKERLEKDLIEESPHSARVKVLASGNTTERRFSVWIGGSILASLGSFQQMWFSKSEYEEHGASYIQRKCP

SEQ ID NO: 513 - protein, 102 aa, Brassica napus
  misc_feature (1)..(102): Ceres CLONE ID no. 1125315
  misc_feature: Utility: Useful for delaying flowering time
  misc_feature: Utility: Useful for increasing chlorophyll and photosynthetic capacity
  misc_feature: Utility: Useful for making ornamental plants with modified leaves
  misc_feature: Utility: Useful for making plants that grow better in shade
  misc_feature: Utility: Useful for making plants with altered leaf shape eg curled leaves
  misc_feature: Utility: Useful for making plants with increased biomass
  misc_feature: Utility: Useful for making plants with increased biomass and foliage
  misc_feature: Utility: Useful for making smaller plants
MYGGDEVSAIVVDLGSHTCKAGYAGEDAPKAVFPSVVGAVDGVEAMEVDVDSAKTNSNSEDKSEKDKGKRKLCVGSQALNYRRDHMEILSPIKDGIVSDWDL

SEQ ID NO: 514 - protein, 443 aa, Zea mays
  misc_feature (1)..(443): Ceres CLONE ID no. 319835
  misc_feature: Utility: Useful for delaying flowering time
  misc_feature: Utility: Useful for increasing chlorophyll and photosynthetic capacity
  misc_feature: Utility: Useful for making ornamental plants with modified leaves
  misc_feature: Utility: Useful for making plants that grow better in shade
  misc_feature: Utility: Useful for making plants with altered leaf shape eg curled leaves
  misc_feature: Utility: Useful for making plants with increased biomass
  misc_feature: Utility: Useful for making plants with increased biomass and foliage
  misc_feature: Utility: Useful for making smaller plants
MYGGDEVSAIVIDVGSYSCKAGYAGDDTPKAVFPSVVGSIEQTEDTDDPKPEKEADSASDSKNGAKPMDVDKAKTKRRLYVGQELEFRRDHMEVISSMKDGTVTDWDIVDNIWNHAFRRRLLINPEEHPMLIAEPSTNTAQQREKAAELIFENYKVPALFLAKNAVLTSFASGRATSLVVDSGGGSTVVSAVHDGFVLQKSVSTSPVGGEFLTDCMMKSLESKGIVIRPRYSFKKKEISPGEYKIVDLDLPNTTESYRLYCMRAIASDVKESVCRVPDTAFDEVAYANVPTTSYELPDGQTIEVGADRFKVPDILFNPSLSQTIPGIDGFADSIPVRGLQRMVIDSVNKCDVDIRKELFSNILLSGGSSSILQLKERLEKEVLEESPQAARVKVMASGNSVERRFSVWIGGSILASLGSFQQMWFSKAEYEEHGVSYIQRKCP

SEQ ID NO: 515 - protein, 128 aa, Brassica napus
  misc_feature (1)..(128): Ceres CLONE ID no. 944775
  misc_feature: Utility: Useful for delaying flowering time
  misc_feature: Utility: Useful for increasing chlorophyll and photosynthetic capacity
  misc_feature: Utility: Useful for making ornamental plants with modified leaves
  misc_feature: Utility: Useful for making plants that grow better in shade
  misc_feature: Utility: Useful for making plants with altered leaf shape eg curled leaves
  misc_feature: Utility: Useful for making plants with increased biomass
  misc_feature: Utility: Useful for making plants with increased biomass and foliage
  misc_feature: Utility: Useful for making smaller plants
  misc_feature (119)..(119): Xaa is any aa, unknown, or other
MADGEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANRXEDDPDYVRD

SEQ ID NO: 516 - protein, 142 aa, Brassica napus
  misc_feature (1)..(142): Ceres CLONE ID no. 1078589
  misc_feature: Utility: Useful for delaying flowering time
  misc_feature: Utility: Useful for increasing chlorophyll and photosynthetic capacity
  misc_feature: Utility: Useful for making ornamental plants with modified leaves
  misc_feature: Utility: Useful for making plants that grow better in shade
  misc_feature: Utility: Useful for making plants with altered leaf shape eg curled leaves
  misc_feature: Utility: Useful for making plants with increased biomass
  misc_feature: Utility: Useful for making plants with increased biomass and foliage
  misc_feature: Utility: Useful for making smaller plants
MADGEDIQPLVCDNGTGMVKAGFAGDDAPRAVFPSIVGRPRHTGVMVGMGQKDAYVGDEAQSKRGILTLKYPIEHGIVNNWDDMEKIWHHTFYNELRVAPEEHPVLLTEAPLNPKANREKMTQIMFETFNAPAMYVAIQAVL

SEQ ID NO: 517 - protein, 136 aa, Brassica napus
  misc_feature (1)..(136): Ceres CLONE ID no. 1067464
  misc_feature: Utility: Useful for delaying flowering time
  misc_feature: Utility: Useful for increasing chlorophyll and photosynthetic capacity
  misc_feature: Utility: Useful for making ornamental plants with modified leaves
  misc_feature: Utility: Useful for making plants that grow better in shade
  misc_feature: Utility: Useful for making plants with altered leaf shape eg curled leaves
  misc_feature: Utility: Useful for making plants with increased biomass
  misc_feature: Utility: Useful for making plants with increased biomass and foliage
  misc_feature: Utility: Useful for making smaller plants
MADGEDIQPLVCDNGTGMVKAGFAGDDAPRAVFPSIVGRPRHTGVMVGMGQKDAYVGDEAQSKRGILTLKYPIEHGIVNNWDDMEKIWHHTFYNELRVAPEEHPVLLTEAPLNPKANREKMTQIMFETFNTPAMYV

SEQ ID NO: 518 - DNA, 468 bp, Arabidopsis thaliana
  misc_feature (1)..(468): Ceres CLONE ID no. 38470
  misc_feature (1)..(468): Also known as  Ceres CDNA ID no. 23371695
atagaatataaccatattccggacatgaagatcgtgacattggtactcgtcgtcttcgtcatactttcgacatcattcccggctgccatcaaagccgaagacacgggagatacaggaaatgtgggagtgacatgtgacgcaaggcagcttcagccttgccttgccgcgattacgggaggaggacaaccctcgggtgcatgttgtgcaaagcttacagagcaacagtcatgcctatgtggtttcgctaagaaccctgcgttcgcacagtacattagctctccaaacgctcgcaaagtgctccttgcttgcaatgttgcttatcccacttgttgaaacttatctagattttataaataaataaacgaaaggaaataaattacattatatcaaacgttatgatacaattcaaccgtttgtgttaatgtactggcttacatggttaaataaagtttaatttcttggttgctc

SEQ ID NO: 519 - protein, 102 aa, Arabidopsis thaliana
  misc_feature (37)..(102): Pfam Name: Tryp_alpha_amyl; Pfam Description: Protease inhibitor/seed storage/LTP family
  misc_feature (37)..(102): Pfam Name: Tryp_alpha_amyl; Pfam Description: Protease inhibitor/seed storage/LTP family
  misc_feature: Utility: Useful for delaying flowering time
  misc_feature: Utility: Useful for making smaller plants
MKIVTLVLVVFVILSTSFPAAIKAEDTGDTGNVGVTCDARQLQPCLAAITGGGQPSGACCAKLTEQQSCLCGFAKNPAFAQYISSPNARKVLLACNVAYPTC

SEQ ID NO: 520 - protein, 95 aa, Brassica napus
  misc_feature (1)..(95): Ceres CLONE ID no. 1087891
  misc_feature: Utility: Useful for delaying flowering time
  misc_feature: Utility: Useful for making smaller plants
MVLTLMVFVILLTSFPVPNKAADTNVEAACDPKQLQPCLAAITGGGQPSGDCCAKLKEQQPCLCGFAKNPAFAQYISSPNSRKVLTACGIPYPSC

SEQ ID NO: 521 - protein, 95 aa, Brassica napus
  misc_feature (1)..(95): Ceres CLONE ID no. 946439
  misc_feature: Utility: Useful for delaying flowering time
  misc_feature: Utility: Useful for making smaller plants
MKILALTLTVFVILSPSFASPTKVALGAACDAKQLQPCLAAITGGGQPSGDCCAKLKEQQPCLCGFSKNPAFAQYVSSPNSRKVVSACGVPYPSC

SEQ ID NO: 522 - protein, 89 aa, Parthenium argentatum
  misc_feature (1)..(89): Ceres CLONE ID no. 1610064
  misc_feature: Utility: Useful for delaying flowering time
  misc_feature: Utility: Useful for making smaller plants
MAAAYALLVMILAGYAETTNAATCSVTELSPCISSFTTSAPPSAQCCAKLKQQQPCLCGYIKNPSLKQYVNSPNAKKVSSTCGVPFPKC

SEQ ID NO: 523 - protein, 102 aa, Parthenium argentatum
  misc_feature (1)..(102): Public GI no. 45593274
  misc_feature: Utility: Useful for delaying flowering time
  misc_feature: Utility: Useful for making smaller plants
MKFTTLMLITFVIIAMSSPVPIRATRVESFGEVAQSCVVTELAPCLPAMTLTGDPTTECCDKLVEQKPCLCGYIRNPAYSMYVTSPNARKVLDFCKVPFPSC

SEQ ID NO: 524 - protein, 103 aa, Parthenium argentatum
  misc_feature (1)..(103): Public GI no. 28973415
  misc_feature: Utility: Useful for delaying flowering time
  misc_feature: Utility: Useful for making smaller plants
MKFTGVVFILFVLGTMLSPVPVKARVVKGSGEEVNVTCDATQLSSCVTAVSTGAPPSTDCCGKLKEHETCLCTYIQNPLYSSYVTSPNARKTLAACDVAYPTC

SEQ ID NO: 525 - protein, 91 aa, Zea mays
  misc_feature (1)..(91): Ceres CLONE ID no. 1061228
  misc_feature: Utility: Useful for delaying flowering time
  misc_feature: Utility: Useful for making smaller plants
MFVAALALVVVMATTSTGGGRAAAACDPKPLVVCDPAFMDGAKPAAACCSTLRAQEACLCVYAKDPKFAKYINNPNTAKTFTSCGIAIPKC

SEQ ID NO: 526 - DNA, 1641 bp, Arabidopsis thaliana
  misc_feature (1)..(1641): Ceres CLONE ID no. 38690
  misc_feature (1)..(1641): Also known as  Ceres CDNA ID no. 23358357
acattccacaactctctctctctctcatttcttcgtataaaaggaaatctatatcatctctctctctctcattgtcaaaactcaaaagtatatacttttagtagttttagacttaataaatgcgatcgccctttttttagtatgttgaacctcattgctttcctccgccgtcgtctccgccgtccccggaaagccagaatctccgtcaaccaccaccacctctcagttgattcttctcctgagactcatcatcatcaaaatggcttttcatcggcagccgccatccacccaaacccggacaaaaccatcacagtggccacctttaacgctgctatgttctccatggctcccgccgtccctagcaacaagggcttgccattccggtccaagtctacggttgaccgccccaagagcattctcaagcccatgaacgccgssgcatctcctactcacgactctagaaagcaacagaggtttgccaaatccaggcctaggagagtctccatcaatctccccgacaacgagatcagccgccagctcagcttccgggaggatccacagcactctcccctcaggcccggcgagatcggtctccggagcaccagaacggctctggaagttctgagtgagctagacgcagacgtgctggctcttcaagacgtcaaggcggacgaggctgaccaaatgagaccgctctccgatctcgctgcggcgctggggatgaattacgtcttcgccgagagctgggcgccggagtacggcaacgccattctctctaagtggcccatcaaaagctccaatgttctaagaatcttcgaccacactgatttcaggaacgtgttgaaggcgagcatagaggttcccgggagcggggaagtggagtttcactgcactcatctggatcacttggacgagaagtggagaatgaagcaagtcgatgccattatccaatccaccaacgtaccgcacatactcgctggtgctctcaattctctcgacgaatccgattattctcctgagagatggaccgacatcgtcaagtattacgaagagatgggtaagccaataccaaaagcacaagtgatgagattcttaaagagcaaagaatacactgacgctaaggactttgctggagaatgcgaatctgtggttgttgtcgccaaaggccaaagtgtgcaggggacatgcaagtacgggacacgcgtggactacatacttgcttcctccgattcaccgtaccggttcgtgccagggtcgtattccgtgttgtcttccaaaggaacctcggaccatcacatagtcaaagtcgatgttgtaaaagctacatcgatcaacgtcaacgagcaggagcagcgaccgataagatcacataagctgcagagaattacagcgactacgtataataataactcgtctctcacaaaggcctcgtggaggacacactactataaagcatgaacaatcaacatatatattacaaaatgttacaggttttttttcgactgttggttgattaacacaatttgagatctgtgtatagttaataatcgtgctagtctctgtgttgaacgtgaagtctgatatacttttgcctagatttccattttttctacatcctaattttggtctgcttttaatgtc

SEQ ID NO: 527 - protein, 438 aa, Arabidopsis thaliana
  misc_feature (56)..(391): Pfam Name: Exo_endo_phos; Pfam Description: Endonuclease/Exonuclease/phosphatase family
  misc_feature (56)..(391): Pfam Name: Exo_endo_phos; Pfam Description: Endonuclease/Exonuclease/phosphatase family
  misc_feature: Utility: Useful for delaying flowering time
  misc_feature: Utility: Useful for increasing chlorophyll and photosynthetic capacity
  misc_feature: Utility: Useful for making ornamental plants with modified flowers
  misc_feature: Utility: Useful for making ornamental plants with modified leaves
  misc_feature: Utility: Useful for making plants that grow better in shade
  misc_feature: Utility: Useful for making plants with altered leaf shape eg curled leaves
  misc_feature: Utility: Useful for making plants with increased biomass and foliage
MLNLIAFLRRRLRRPRKARISVNHHHLSVDSSPETHHHQNGFSSAAAIHPNPDKTITVATFNAAMFSMAPAVPSNKGLPFRSKSTVDRPKSILKPMNAAASPTHDSRKQQRFAKSRPRRVSINLPDNEISRQLSFREDPQHSPLRPGEIGLRSTRTALEVLSELDADVLALQDVKADEADQMRPLSDLAAALGMNYVFAESWAPEYGNAILSKWPIKSSNVLRIFDHTDFRNVLKASIEVPGSGEVEFHCTHLDHLDEKWRMKQVDAIIQSTNVPHILAGALNSLDESDYSPERWTDIVKYYEEMGKPIPKAQVMRFLKSKEYTDAKDFAGECESVVVVAKGQSVQGTCKYGTRVDYILASSDSPYRFVPGSYSVLSSKGTSDHHIVKVDVVKATSINVNEQEQRPIRSHKLQRITATTYNNNSSLTKASWRTHYYKA

SEQ ID NO: 528 - protein, 443 aa, Arabidopsis thaliana
  misc_feature (1)..(443): Public GI no. 34898868
  misc_feature: Utility: Useful for delaying flowering time
  misc_feature: Utility: Useful for increasing chlorophyll and photosynthetic capacity
  misc_feature: Utility: Useful for making ornamental plants with modified flowers
  misc_feature: Utility: Useful for making ornamental plants with modified leaves
  misc_feature: Utility: Useful for making plants that grow better in shade
  misc_feature: Utility: Useful for making plants with altered leaf shape eg curled leaves
  misc_feature: Utility: Useful for making plants with increased biomass and foliage
MLRRVLAGFRALHPRPRRRRHGGAEGKARVTVRRLGSNGRKEAAAAAAGARRDNRGDGATGEAVTIRVATFNAAMFSMAPAVAAASSAETATETARRVTTPAAGGGRRPKGILKAQASLARTASKARVSINLQDNEISRERSKLGSTAARSTTTATTTPAATQQLNGGAEGRRRSVEEVLREVGADIIGLQNVRAEEERGMSPLSELAEGLGMRYVFAESWAPEYGNAVLSRWPIKRWKSQRVADQSDFNVLRATIEVPRAGEVNFHCTHLDHLDESWRMKQMNAILRSSDGPHILTGGLNALDGTDYSDERWADIVKYYEEIGKPTPKAEVMKYLKGKQYVDAKDFAGECEAVVVVAKGQVQGTCKYGTRVDYILASPNSPYKFVPGSYTVISSKGTSDHHIVKVDVTIQDKKETDEESGNQRQRVVKINKKCSKKGLWAAK

SEQ ID NO: 529 - protein, 458 aa, Arabidopsis thaliana
  misc_feature (1)..(458): Public GI no. 11994389
  misc_feature: Utility: Useful for delaying flowering time
  misc_feature: Utility: Useful for increasing chlorophyll and photosynthetic capacity
  misc_feature: Utility: Useful for making ornamental plants with modified flowers
  misc_feature: Utility: Useful for making ornamental plants with modified leaves
  misc_feature: Utility: Useful for making plants that grow better in shade
  misc_feature: Utility: Useful for making plants with altered leaf shape eg curled leaves
  misc_feature: Utility: Useful for making plants with increased biomass and foliage
MLCVFRRKLGCLFSRLRWVIKKRVRARVIVRRFRKARWRARRKESPESEVSSIHLSSNSGRHIRVATFNVAMFSLAPVVQTMEETAFLGHLDSSNITCPSPKGILKQSPLHSSAVRKPKVCINLPDNEISLAQSYSFLSMVENDNDGKENRGSLSMRSPVCLPSCWWDQESFNGYSSRRSIAELLRELDADILALQDVKAEEETLMKPLSDLASALGMKYVFAESWAPEYGNAILSKWPIKKWRVQRIADVDDFRNVLKVTVEIPWAGDVNVYCTQLDHLDENWRMKQIDAITRGDESPHILLGGLNSLDGSDYSIARWNHIVKYYEDSGKPTPRVEVMRFLKGKGYLDSKEFAGECEPVVIIAKGQNVQGTCKYGTRVDYILASPESPYEFVPGSYSVVSSKGTSDHHIVKVDLVITKERSRGNFKHSRKKAKQKIFQIKANLMSKDTWKLGNLMSS

SEQ ID NO: 530 - DNA, 840 bp, Arabidopsis thaliana
  misc_feature (1)..(840): Ceres CLONE ID no. 39286
  misc_feature (1)..(840): Also known as  Ceres CDNA ID no. 23428165
ttttttcgttcgactcatctccaaagagaagcttcaaaaaatggcttgcaaaacgattttgcgttccgttttcgtatcggaatcacgacggacttccggcgcacgtagatgcttctttctccctccttctccagcatcagttccagtccatggtttgttcccggcgccaaagagtctatgtttcaatggttttgcatctgttcccgagcgggctactcggcttaattgcagccataacgatcaatccgatcaaggtccgcctcaagaagctgttctcaaggcaatctcagaagtgtcaaagactgatgggagggttgggaaaactactaacatgattattggaggcactgtggctgatgattctgctaaagattggctcgaacttgaccaaaaggtcaatacatacccaacagaaagagggtttactgcaattgggactggtggcaatgactttgtgcatgctatggttgttgctgttgaatctgttattgaccgacaaattccagaggactgtgtaaagcagactttatcaagcaaaggaaaatatgtgtcggtgaatattggccctatccaagtcgtctctagtgagcaggttcaagctgtgtataatgcaatgaggagagacgaaagaatgaaatacttcttgtaggtttgaagtgtgtagaatcacgggtcttctcttttctatcttctccattgcgactatgtaaattatgcagtgtaaggccaccattaattattatttatacttatctacactaacttctgttagacactccttagacagtgtcttatgcatctgaaggaattagtggatatatcaaaaaatgacttataccc

SEQ ID NO: 531 - protein, 202 aa, Arabidopsis thaliana
  misc_feature (111)..(202): Pfam Name: DUF493; Pfam Description: Protein of unknown function (DUF493)
  misc_feature: Utility: Useful for delaying flowering time
  misc_feature: Utility: Useful for increasing chlorophyll and photosynthetic capacity
  misc_feature: Utility: Useful for making ornamental plants with modified leaves
  misc_feature: Utility: Useful for making plants sterile and for genetic confinement
  misc_feature: Utility: Useful for making plants with increased biomass and foliage
  misc_feature: Utility: Useful for making smaller plants
MACKTILRSVFVSESRRTSGARRCFFLPPSPASVPVHGLFPAPKSLCFNGFASVPERATRLNCSHNDQSDQGPPQEAVLKAISEVSKTDGRVGKTTNMIIGGTVADDSAKDWLELDQKVNTYPTERGFTAIGTGGNDFVHAMVVAVESVIDRQIPEDCVKQTLSSKGKYVSVNIGPIQVVSSEQVQAVYNAMRRDERMKYFL

SEQ ID NO: 532 - protein, 204 aa, Brassica napus
  misc_feature (1)..(204): Ceres CLONE ID no. 967750
  misc_feature: Utility: Useful for delaying flowering time
  misc_feature: Utility: Useful for increasing chlorophyll and photosynthetic capacity
  misc_feature: Utility: Useful for making ornamental plants with modified leaves
  misc_feature: Utility: Useful for making plants sterile and for genetic confinement
  misc_feature: Utility: Useful for making plants with increased biomass and foliage
  misc_feature: Utility: Useful for making smaller plants
  misc_feature (182)..(182): Xaa is any aa, unknown, or other
  misc_feature (203)..(203): Xaa is any aa, unknown, or other
MACKTILRSVFISESRRASAASRCFFIPPSLSASGPVPGLFPAPKGLSFNNFASLPDRRLPRLNCTLSNDQSEQGPPQEAVLKAISVSKTDGRVGKTTNMIIGGTVADDSAQDWLELDQKVNTYPTDRGFTAIGTGGDDFVHAMVVAVESVIERQIPEDCVKQTLSSKGKYVSVNIGPIRVXSSEQVQAVYNAMRRDERMKYXL

SEQ ID NO: 533 - protein, 180 aa, Glycine max
  misc_feature (1)..(180): Ceres CLONE ID no. 675195
  misc_feature: Utility: Useful for delaying flowering time
  misc_feature: Utility: Useful for increasing chlorophyll and photosynthetic capacity
  misc_feature: Utility: Useful for making ornamental plants with modified leaves
  misc_feature: Utility: Useful for making plants sterile and for genetic confinement
  misc_feature: Utility: Useful for making plants with increased biomass and foliage
  misc_feature: Utility: Useful for making smaller plants
MLRSTILIEPSLLRSLNFNSNKHHIASLNQWSCRFHSPKPPYSSSQNETPLSQDPVLKAISEISKGEGRVGQTTNVIIGSTAADDSNNEWLALDQKVNSYPTDRGFTAIGTGGEDFVQAMVVAVESVIQQPIPQGYVKQKLSSGGKYVSVNIGPIQVVSSEQVQAVYNAMRTDNRVKYFL

SEQ ID NO: 534 - protein, 182 aa, Zea mays
  misc_feature (1)..(182): Ceres CLONE ID no. 460412
  misc_feature: Utility: Useful for delaying flowering time
  misc_feature: Utility: Useful for increasing chlorophyll and photosynthetic capacity
  misc_feature: Utility: Useful for making ornamental plants with modified leaves
  misc_feature: Utility: Useful for making plants sterile and for genetic confinement
  misc_feature: Utility: Useful for making plants with increased biomass and foliage
  misc_feature: Utility: Useful for making smaller plants
MACRALALRSLLLPDPLHRLPAAAPPVWRASRGGRRPHLRCCSGGGGGEPGQPPQEAVLEAISKIARSKGRVALTTNMVMGGTVTDDASDEWLVLDQKVNSYPTDRGFTAIGTGGDDFVQSMVVAVESVLQESIPKGRVSQKLSSRGKYVSVNIGPIRVVSSEQVQAVYRAMRRDNRMKYFL

SEQ ID NO: 535 - protein, 186 aa, Zea mays
  misc_feature (1)..(186): Public GI no. 50908821
  misc_feature: Utility: Useful for delaying flowering time
  misc_feature: Utility: Useful for increasing chlorophyll and photosynthetic capacity
  misc_feature: Utility: Useful for making ornamental plants with modified leaves
  misc_feature: Utility: Useful for making plants sterile and for genetic confinement
  misc_feature: Utility: Useful for making plants with increased biomass and foliage
  misc_feature: Utility: Useful for making smaller plants
MMACRALALLPLPAPSRLPRPRAASLARLDAARRRASASLLVRCCANPAGPGGQEDPPQDAVLKAISQVANSKGRVAQTTNVVMGGTVTDDATDEWLVLDKQVNTYPTVRGFTAIGTGGDDFVQAMVVAVESVLEEQIPKAQISHKVSSKGKYVSVKIGPIPVVSSEQVQAVYNAMKKDERMKFFL

SEQ ID NO: 536 - DNA, 1139 bp, Arabidopsis thaliana
  misc_feature (1)..(1139): Ceres CLONE ID no. 40508
  misc_feature (1)..(1139): Also known as  Ceres CDNA ID no. 23356656
agaaaccgatagacctctctcattcgatcatttcttcttcttcttcgtcttcgctgcagcctgcatctgttgtttcttctagactttgcagtcacagagatagtgagtgagatagagagagtgataatggcgagtggactaagcgagatcgggagcacgaagatgttcgatggctacaacaaaagatacaaacacttcagtgagacacttggatgttccatgaccttttccatctacttccctccttctgcttctgcttcttcttcccataaatctcctgtgctttactggctttctggcctcacctgcacggacgagaacttcattatcaaatcaggagctcaacgtgctgcttctactcacggcattgctcttgttgctccagacacttctccaagaggactaaatgttgaaggggaggcagacagttacgactttggtgtaggagccggattctacctcaatgctactcaggaaaagtggaagaactggcgtatgtatgactatgttgtcaaagagttgccaaaactcctgagtgaaaacttttcccagcttgacacaacaaaagcatctatatctggacactccatgggtggacatggagctcttactatatacctgaggaacctcgataaatacaagtctgtatctgcgtttgcaccaatcacgaatcccataaattgtgcatggggacagaaggcattcaccaattatctaggtgacaacaaagctgcttgggaggaatacgatgccacttgtcttatttcaaagtacaacaatctttctgcaacaattctaattgatcagggagaaaacgaccagttctaccctgatcagttattgcccagcaagtttgaggaggcgtgcaagaaagtgaatgcaccgctcttattgcgcctccatccaggatacgaccactcctactatttcattgccaccttcatcgaagaccacattagtcaccatgctcaagcccttgagctatagctcacttcatctgcttggaaaccggctttgggtttgtccaagtattagtatctcaataaagcaagtggacttgtaatgttttatgttcaataactcccctgtgtgctcttttgtctacgataataataagaaaatcatctttgcttcatacc

SEQ ID NO: 537 - protein, 286 aa, Arabidopsis thaliana
  misc_feature (19)..(279): Pfam Name: Esterase; Pfam Description: Putative esterase
  misc_feature (74)..(280): Pfam Name: Peptidase_S9; Pfam Description: Prolyl oligopeptidase family
  misc_feature: Utility: Useful for delaying flowering time
  misc_feature: Utility: Useful for increasing chlorophyll and photosynthetic capacity
  misc_feature: Utility: Useful for making ornamental plants with modified leaves
  misc_feature: Utility: Useful for making plants with altered leaf shape eg curled leaves
  misc_feature: Utility: Useful for making plants with increased biomass
  misc_feature: Utility: Useful for making plants with increased biomass and foliage
  misc_feature: Utility: Useful for making shorter plants and plants with modified flowers
  misc_feature: Utility: Useful for making smaller plants
MASGLSEIGSTKMFDGYNKRYKHFSETLGCSMTFSIYFPPSASASSSHKSPVLYWLSGLTCTDENFIIKSGAQRAASTHGIALVAPDTSPRGLNVEGEADSYDFGVGAGFYLNATQEKWKNWRMYDYVVKELPKLLSENFSQLDTTKASISGHSMGGHGALTIYLRNLDKYKSVSAFAPITNPINCAWGQKAFTNYLGDNKAAWEEYDATCLISKYNNLSATILIDQGENDQFYPDQLLPSKFEEACKKVNAPLLLRLHPGYDHSYYFIATFIEDHISHHAQALEL

SEQ ID NO: 538 - protein, 281 aa, Glycine max
  misc_feature (1)..(281): Ceres CLONE ID no. 1063112
  misc_feature: Utility: Useful for delaying flowering time
  misc_feature: Utility: Useful for increasing chlorophyll and photosynthetic capacity
  misc_feature: Utility: Useful for making ornamental plants with modified leaves
  misc_feature: Utility: Useful for making plants with altered leaf shape eg curled leaves
  misc_feature: Utility: Useful for making plants with increased biomass
  misc_feature: Utility: Useful for making plants with increased biomass and foliage
  misc_feature: Utility: Useful for making shorter plants and plants with modified flowers
  misc_feature: Utility: Useful for making smaller plants
MENGLSEIGSTKMFDGYNKRYKHNSETLGCSMTFSIYFPPSSHRSPVLYWLSGLTCTDENFIIKSGAQRAASTHGIALVVPDTSPRGLNIEGEADSYDFGVGAGFYLNATQEKWKNWRMYDYVVKELPKLLSENFPQLDTTRASISGHSMGGHGALTIYLKNLDKYKSVSAFAPIANPINCPWGQKAFTNYLGDNKAAWEEYDATCLISKFNNLSATILIDQGENDQFYPDQLLPNKFEEACKKVNAPLLVRLQPGYDHSYYFIATFIEDHISHHVQALEL

SEQ ID NO: 539 - protein, 273 aa, Glycine max
  misc_feature (1)..(273): Ceres CLONE ID no. 521881
  misc_feature: Utility: Useful for delaying flowering time
  misc_feature: Utility: Useful for increasing chlorophyll and photosynthetic capacity
  misc_feature: Utility: Useful for making ornamental plants with modified leaves
  misc_feature: Utility: Useful for making plants with altered leaf shape eg curled leaves
  misc_feature: Utility: Useful for making plants with increased biomass
  misc_feature: Utility: Useful for making plants with increased biomass and foliage
  misc_feature: Utility: Useful for making shorter plants and plants with modified flowers
  misc_feature: Utility: Useful for making smaller plants
MFGGYNKRFKHFSLTLGCSMNFHIYFPPSPSPSHKFPVLYFLSGLTCTDENFIFKSGAQRAASAEGVALVAPDTSPRGLNVEGEADSWDLGVGAGFYLNATQEKWKNWRMYDYVVKELPKLLSDNFPQLEISKASIFGHSMGGHGALTIFLKNQDKYKSVSAFAPIANPINCPWGQKAFSNYLGDNKSEWEDYDATRLVTKFPNVSSTILIDQGEDDKFLPDQLLPHKFEEACKKANVPLLLRFQPGYDHLYYFIATFIDDHIRHHAQALRLN

SEQ ID NO: 540 - protein, 272 aa, Zea mays
  misc_feature (1)..(272): Ceres CLONE ID no. 217396
  misc_feature: Utility: Useful for delaying flowering time
  misc_feature: Utility: Useful for increasing chlorophyll and photosynthetic capacity
  misc_feature: Utility: Useful for making ornamental plants with modified leaves
  misc_feature: Utility: Useful for making plants with altered leaf shape eg curled leaves
  misc_feature: Utility: Useful for making plants with increased biomass
  misc_feature: Utility: Useful for making plants with increased biomass and foliage
  misc_feature: Utility: Useful for making shorter plants and plants with modified flowers
  misc_feature: Utility: Useful for making smaller plants
MFDGFNLRFRHQSATLGCAMTFSIYLPPSPASNLPVLYWLSGLTCTDENFIIKSGAQRAAAAHGIALVAPDTSPRGLNIEGESDSYDFGVGAGFYLNATNEKWKNWRMYDYIVKELPKVLSDNFEQLNTSQASIFGHSMGGHGALTIYLKNTDKYKSVSAFAPIANPINCPWGQKAFSNYLGSTKSDWEEYDATCLIKKNSKVPTTILIDQGEADKFLAEQQLLPHKFEEACKAAGAALTLRMQPGYDHSYYFIATFVDDHIAHHAQFLKSA

SEQ ID NO: 541 - protein, 290 aa, Triticum aestivum
  misc_feature (1)..(290): Ceres CLONE ID no. 699913
  misc_feature: Utility: Useful for delaying flowering time
  misc_feature: Utility: Useful for increasing chlorophyll and photosynthetic capacity
  misc_feature: Utility: Useful for making ornamental plants with modified leaves
  misc_feature: Utility: Useful for making plants with altered leaf shape eg curled leaves
  misc_feature: Utility: Useful for making plants with increased biomass
  misc_feature: Utility: Useful for making plants with increased biomass and foliage
  misc_feature: Utility: Useful for making shorter plants and plants with modified flowers
  misc_feature: Utility: Useful for making smaller plants
MAAAASPPAAALEQLSKTKMFGGHNLRFRHQSAALGCPMTFSLFLPASPASKLPVLYWLSGLTCTDENFIIKSGAQRAAAAHGVALVAPDTSPRGLNVEGEADSWDFGVGAGFYLNATNEKWKNWRMYDYVVKELPKVLSDNFEQLNTSCASIFGHSMGGHGALTIYLKNTDKYKSVSAFAPIANPINCPWGQKAFSNYLGTTKSEWEEYDATLLVKKCNTLSTPILVDQGEDDKFLAEQLLAGNFEEACKAAGAPLTLRMQPGYDHSFFFIATFIDDHIAHHAQFLKSG

SEQ ID NO: 542 - protein, 292 aa, Triticum aestivum
  misc_feature (1)..(292): Public GI no. 57900400
  misc_feature: Utility: Useful for delaying flowering time
  misc_feature: Utility: Useful for increasing chlorophyll and photosynthetic capacity
  misc_feature: Utility: Useful for making ornamental plants with modified leaves
  misc_feature: Utility: Useful for making plants with altered leaf shape eg curled leaves
  misc_feature: Utility: Useful for making plants with increased biomass
  misc_feature: Utility: Useful for making plants with increased biomass and foliage
  misc_feature: Utility: Useful for making shorter plants and plants with modified flowers
  misc_feature: Utility: Useful for making smaller plants
MAAAAPSPPPVAALEQMSRTKMFGGHNLRFRHHSATLGCPMTFSVFLPPSPASDLPVLYWLSGLTCNDENFVTKAGAQRAAAAHGIALVAPDTSPRGLNIEGEADSWDFGVGAGFYLNATNEKWKNWRMYDYVVKELPKVLSDNFEQLNTSRASIFGHSMGGHGALTIYLKNTDKYKSVSAFSPVVNPINCPWGQKAFSNYLGPAKSDWKEYDATCLIKKCNKISTPILIDQGEDDKFLAKQLLPRNFEEACKAVGAPLTLRMQPGYDHSYFFIATFIDDHIAHHSQFLKSA

SEQ ID NO: 543 - DNA, 1098 bp, Arabidopsis thaliana
  misc_feature (1)..(1098): Ceres CLONE ID no. 40729
  misc_feature (1)..(1098): Also known as  Ceres CDNA ID no. 23360311
agagagctttctttagtgatggcggcgcttatccggtgttgctcctccttctctcatacttccggtggccaaccaccgccgcgtgacaagtctcgagctccagagattggaaaatttgctacatctattggctactcagtagtcagaaaacctggggatcatcctcctttctccaaaattatacattcgtcttcacagcctaaggagcgacaaggaaagggaatcttacaaacgccatttgccagtgtgggatctcttgacaagttttcagcttttgagggaattgggaggctcaaattaccggtgatggcagtgttgttgacaaactcccttcagatggctacacctcttgaagctttggctgctgagatatgtgagcctgagagctccatgttcagcatgcctattttgttgcttgttgctcttattggagccaccgttggagggttgcttgctcggcagaggaaaggggagttacagaggttgaatgaacaactacgacagattaacgcagctcttaggagacaagccaaaatcgagtcttatgcaccaagcttgagttatgctccagtgggagcaagaatcccagatagtgaaatcattgtggaaccaaagaaacaagagttgatttccaagttgaaaacaggaaaaacctttcttaggaaccaagaaccagagaaagcttatacagagttcaagatagctttggaacttgcccagagtctcaaagaccccaccgaagaaaagaaggctgcaagaggcctaggcgcctcgctgcagcgccaagggaagtatagggaagccatacagtatcactccatggttctagccatctcaaagagggaaagtgaagattctggaatcactgaagcatatggagctattgcagactgttataccgagctgggagatctcgagaaagctggaaagttctatgatacgtacattgctcggttagagactgactgatccttccgcaatgtttttttctttgttgtctgtttatgatcatgtaaaatcacatagaatggatatccaaatcccttttattgaatgtaattcgcttgtcttacaatccatgggaatacataactaatc

SEQ ID NO: 544 - protein, 316 aa, Arabidopsis thaliana
  misc_feature (243)..(276): Pfam Name: TPR_1; Pfam Description: Tetratricopeptide repeat
  misc_feature (283)..(316): Pfam Name: TPR_2; Pfam Description: Tetratricopeptide repeat
  misc_feature (243)..(276): Pfam Name: TPR_1; Pfam Description: Tetratricopeptide repeat
  misc_feature (283)..(316): Pfam Name: TPR_2; Pfam Description: Tetratricopeptide repeat
  misc_feature: Utility: Useful for delaying flowering time
  misc_feature: Utility: Useful for delaying senescence
  misc_feature: Utility: Useful for increasing chlorophyll and photosynthetic capacity
  misc_feature: Utility: Useful for increasing seed/fruit yield or modifying fruit content
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with increased biomass and foliage
  misc_feature: Utility: Useful for making shorter plants and plants with modified flowers
  misc_feature: Utility: Useful for making smaller plants
  misc_feature: Utility: Useful for making stronger plants
  misc_feature: Utility: Useful for modifying plant structure, ie increased branching
MAALIRCCSSFSHTSGGQPPPRDKSRAPEIGKFATSIGYSVVRKPGDHPPFSKIIHSSSQPKERQGKGILQTPFASVGSLDKFSAFEGIGRLKLPVMAVLLTNSLQMATPLEALAAEICEPESSMFSMPILLLVALIGATVGGLLARQRKGELQRLNEQLRQINAALRRQAKIESYAPSLSYAPVGARIPDSEIIVEPKKQELISKLKTGKTFLRNQEPEKAYTEFKIALELAQSLKDPTEEKKAARGLGASLQRQGKYREAIQYHSMVLAISKRESEDSGITEAYGAIADCYTELGDLEKAGKFYDTYIARLETD

SEQ ID NO: 545 - protein, 126 aa, Parthenium argentatum
  misc_feature (1)..(126): Ceres CLONE ID no. 1604687
  misc_feature: Utility: Useful for delaying flowering time
  misc_feature: Utility: Useful for delaying senescence
  misc_feature: Utility: Useful for increasing chlorophyll and photosynthetic capacity
  misc_feature: Utility: Useful for increasing seed/fruit yield or modifying fruit content
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with increased biomass and foliage
  misc_feature: Utility: Useful for making shorter plants and plants with modified flowers
  misc_feature: Utility: Useful for making smaller plants
  misc_feature: Utility: Useful for making stronger plants
  misc_feature: Utility: Useful for modifying plant structure, ie increased branching
MGFVRALPVGSIIANALLLATPLEALAEACEAEQSIFNMNMPLLLLVALIGATVGGLLARQRKAELQRLNEQLRQINVALKRQAKIESYAPALSYAPAAARVPDSEVIVDPKKQELISRLKKWGKL

SEQ ID NO: 546 - protein, 297 aa, n/a
  misc_feature (1)..(297): Ceres CLONE ID no. 627169
  misc_feature: Utility: Useful for delaying flowering time
  misc_feature: Utility: Useful for delaying senescence
  misc_feature: Utility: Useful for increasing chlorophyll and photosynthetic capacity
  misc_feature: Utility: Useful for increasing seed/fruit yield or modifying fruit content
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with increased biomass and foliage
  misc_feature: Utility: Useful for making shorter plants and plants with modified flowers
  misc_feature: Utility: Useful for making smaller plants
  misc_feature: Utility: Useful for making stronger plants
  misc_feature: Utility: Useful for modifying plant structure, ie increased branching
MVMLIRCSCFFARPRFSQPQFYGNNTKPLLPGKLAFLSLKPDKGVPHFEDTLDGSSKISCLLHCSKCKEDIHQRFPSLIFVASNVLMFSMPNTALAETCEADNSVFNMPILLAVALIGATVGGLLARQRRNELQRVNEQLIQINAALRKQAKIESYAPSLSYAPIGGGRILDNEIIVDPKKQELISKLKNGKNFLRNQQPDKAFTEFKNALELAQNLKDPIEEKKAARGLGASLQRQGKYRDAIKYHSMVLGISEREEEDSGSTEAFGAIADCYTELGELEKAGQFYDKYIARLEKD

SEQ ID NO: 547 - protein, 324 aa, n/a
  misc_feature (1)..(324): Public GI no. 34914598
  misc_feature: Utility: Useful for delaying flowering time
  misc_feature: Utility: Useful for delaying senescence
  misc_feature: Utility: Useful for increasing chlorophyll and photosynthetic capacity
  misc_feature: Utility: Useful for increasing seed/fruit yield or modifying fruit content
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with increased biomass and foliage
  misc_feature: Utility: Useful for making shorter plants and plants with modified flowers
  misc_feature: Utility: Useful for making smaller plants
  misc_feature: Utility: Useful for making stronger plants
  misc_feature: Utility: Useful for modifying plant structure, ie increased branching
MELLLRPSPPPPWAIPRRSSGERTKPCRSRSRSRTGTSKQTFPVPLLVGKVGRRPFPVQCSIVRCCLSSTDAIHSTSDDIHEDNGHGHFLMKSTSDLQKVISSCFGKACLLSSVMLVLPPSCFAEPCEPEYSLPNMPLLFAIAMIGATVGGLLARQRRGELKRLNDQLRQINAALRRQAKIESYAPSLSYAPVGSKIPESEVIVDPQKDRLISYLRAGKNYLRNQAPDKAFPEFKAAFDLAQSLGDHVEEKKAARGLGASLQRQGKYKEAIKYHSMVLNISKLTGEDAGVTEAYGAIADCYTELGELEKAGKFYDKYIARLEND

SEQ ID NO: 548 - protein, 319 aa, Zea mays
  misc_feature (1)..(319): Ceres CLONE ID no. 1397168
  misc_feature: Utility: Useful for delaying flowering time
  misc_feature: Utility: Useful for delaying senescence
  misc_feature: Utility: Useful for increasing chlorophyll and photosynthetic capacity
  misc_feature: Utility: Useful for increasing seed/fruit yield or modifying fruit content
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with increased biomass and foliage
  misc_feature: Utility: Useful for making shorter plants and plants with modified flowers
  misc_feature: Utility: Useful for making smaller plants
  misc_feature: Utility: Useful for making stronger plants
  misc_feature: Utility: Useful for modifying plant structure, ie increased branching
MALLLRLAAPSVPPRRSSGLRALPRVVLPEVVSKQSFLRLLVDSTASMPCPIKCSAARCAPSLTEHNDSRNNGIHASSVYGHDLMKSMSDLQEVVFSSFSKACLLSSCIIYGLPPSCIAEPCEQEYFLPNMPLLFAIAMVGATVGGLLARQRRGELARLNDQLRQINAALRRQAKIESYAPALSYAPVGSKIPESEVIVDPQKQRLIAYLRTGKNYLRNQAPDKAFPEFKAALDLARSLGDHVEEKKAARGLGASLQRQGKYKEAINYHSMVLNISKVTGEDAGVTEAYGAIADCYTELGELEKAGKFYDKYIARLENE

SEQ ID NO: 549 - protein, 319 aa, Zea mays
  misc_feature (1)..(319): Public GI no. 50909895
  misc_feature: Utility: Useful for delaying flowering time
  misc_feature: Utility: Useful for delaying senescence
  misc_feature: Utility: Useful for increasing chlorophyll and photosynthetic capacity
  misc_feature: Utility: Useful for increasing seed/fruit yield or modifying fruit content
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with increased biomass and foliage
  misc_feature: Utility: Useful for making shorter plants and plants with modified flowers
  misc_feature: Utility: Useful for making smaller plants
  misc_feature: Utility: Useful for making stronger plants
  misc_feature: Utility: Useful for modifying plant structure, ie increased branching
MPARAAALSCRGVSPHPRAHSLLPGRRRRPVLPFADEAAAAPLRVSSVPHSRAYGCGGGGYFVHLEDRDDGEASRLLRALRRVLPDHQKWAQPDLLKAAVISTMSILAVPLEASASAETCQPANSMANMPIFIAVALIGAAVGGLLARQRKEELKRLNTQLRQINTALRRQAQIESFAPGLTYAPVGRATETEVIVDPRKQQLTVNLRNGKTFMRNQDLDMAVKEFRAALELAKSVGDRFEEKKAARGLGASLQRLGKYREAMNCYYKVLELSKETGEDSGCTEAYGAIADCYTELGDLERAAKLYDKYISRLQPGGGE

SEQ ID NO: 550 - protein, 202 aa, Zea mays
  misc_feature (1)..(202): Ceres CLONE ID no. 304724
  misc_feature: Utility: Useful for delaying flowering time
  misc_feature: Utility: Useful for delaying senescence
  misc_feature: Utility: Useful for increasing chlorophyll and photosynthetic capacity
  misc_feature: Utility: Useful for increasing seed/fruit yield or modifying fruit content
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with increased biomass and foliage
  misc_feature: Utility: Useful for making shorter plants and plants with modified flowers
  misc_feature: Utility: Useful for making smaller plants
  misc_feature: Utility: Useful for making stronger plants
  misc_feature: Utility: Useful for modifying plant structure, ie increased branching
MDGEAPRLPHALRRMLIDHQKMACPNLLKAAVLSTMTLLAVPLEASAEMCQPPSSFANMPIFIVVALIGAAVGGLLARQRKAELKRLNNQLRQINAALRRQAQIESFAPGLTYAPVGRTNETDVIVDPRKQQLVTNLRNGKNYMRNQDLDKAIVEFRTALELAESIGDRFEEKKAARGLEAREVPRSNETVQQGSGAVQGDR

SEQ ID NO: 551 - DNA, 1473 bp, Arabidopsis thaliana
  misc_feature (1)..(1473): Ceres CLONE ID no. 41306
  misc_feature (1)..(1473): Also known as  Ceres CDNA ID no. 23359586
agagattacaagagtgttgtttgagagcgaatcaaggttcctccaaagaaagaagatgactttaattcttatttaatttccctttctccttttgcttcaccaaaatccacacattcatcaattaaaaaacaaaccctagattcttgaaaactggaactcattcacgaatcctaaaaagagagctcctttggttttcttgaaacccagattcttcaagctcagctatggcggtcttcaaaaccctagctttcctattcgttttaagcatcgtgatttaccaatcagtggctgttacagatgtaaattcatcgttttcctttaatgggtttgtcaaagctccaagctttgacaataatgttgctctgtttggagattcgaagctcgttcatggcggtccatcgattcaattgactgactcagtgagtcgcagtgaagggcgagttatttacaagaaacccatcagactgttccaaggtaaagagagaaacttttccggatcattctcaactagtttctcgttttcgatgtctgatgagattggtagtgtcttggcttttataatggttccaagaggtttggatcttaggttgtttggtagaaagggtaataatagttcctctggtttagggttcttattgaaacacaaagttgttgctgttgagtttggtatctccaagagagggaatcatgtagggatcttagttggtcgtcctgaatctggtaaagttagaaagttatcatcttttggtcaccatttcaatgaagagaagagattgaattgttggattgattatgaggcaagctcaaagagaatagaggttcgtttgagtctatctgctgccttaaagccggtggatccattcgtgtcttactctgtagacttggctaagctatggaaagatgggaagtttatggtgggtttaacctctgcaaatggaaacacttcaaagccggtttatctccattcgtggagctttaaactgatacatccttcgatgaggattcactcgcagccgcttgatccaaacgacgtttccaagactgttaaggaaggggagaagacggtggaagttaaggggaaaggaaaatgtatatggagaatccttggtgcattggtcttgggggcggtttgtggaacattgggagccatgttcgcgttatacctttggacaatatgcggtaataggcagtcaatggcgatagttcccgaggaatgtgctgacgaaaaagcggatatccttgtaacgaaagctgatgttgttgttgaagaagaagtcaagaagtagtagaaaaagaaaagtttggtgtgtgtgttttagaatgttgtatttgttgtttgtaatgtaaattcttgtgtccttctttattcttcttctgtttgtttttttgttagttgcagatttggtgagatgagttttcacatgtagaagaaccatacaatatgtattaagttaagatcctgaaatcttgatc

SEQ ID NO: 552 - protein, 353 aa, Arabidopsis thaliana
  misc_feature (23)..(204): Pfam Name: Lectin_legB; Pfam Description: Legume lectins beta domain
  misc_feature: Utility: Useful for delaying flowering time
  misc_feature: Utility: Useful for making smaller plants
  misc_feature: Utility: Useful for making stronger plants
MAVFKTLAFLFVLSIVIYQSVAVTDVNSSFSFNGFVKAPSFDNNVALFGDSKLVHGGPSIQLTDSVSRSEGRVIYKKPIRLFQGKERNFSGSFSTSFSFSMSDEIGSVLAFIMVPRGLDLRLFGRKGNNSSSGLGFLLKHKVVAVEFGISKRGNHVGILVGRPESGKVRKLSSFGHHFNEEKRLNCWIDYEASSKRIEVRLSLSAALKPVDPFVSYSVDLAKLWKDGKFMVGLTSANGNTSKPVYLHSWSFKLIHPSMRIHSQPLDPNDVSKTVKEGEKTVEVKGKGKCIWRILGALVLGAVCGTLGAMFALYLWTICGNRQSMAIVPEECADEKADILVTKADVVVEEEVKK

SEQ ID NO: 553 - protein, 353 aa, Glycine max
  misc_feature (1)..(353): Ceres CLONE ID no. 578942
  misc_feature: Utility: Useful for delaying flowering time
  misc_feature: Utility: Useful for making smaller plants
  misc_feature: Utility: Useful for making stronger plants
MAPFSTSPHFTAFTFLILFLKTQAFDPLSFFSFTDFEKDPNFKSSVGLYGNAKVVNNGSEVLLSGNGGRVIYKKPVKLVHGGARELVSFSTYFGFSMSLDSEKSGLAFVMVPSGVEGEVFGNSSYGLSFGLKEREFKVVGVQFSAYGRNGGSGSCIVSINVGSSVPVKTINASSVIMGLKSEGKLHAWIDYEASSKRLEVRLNQYGQSRPVDPLLWHSMDLSNVWGTEEMFAGFSTVKENNTSQTCFLYSWSFIVRHFPHWMHSEPLNPKVLAKKTETPAVKSRSDCLLRVLAAMIFGAGCGALTAFIVLYLWTIFGNKRPVVPEEYAMQPVDFEYKKVSIVVDKTTIIDAKE

SEQ ID NO: 554 - DNA, 1142 bp, Arabidopsis thaliana
  misc_feature (1)..(1142): Ceres CLONE ID no. 41439
  misc_feature (1)..(1142): Also known as  Ceres CDNA ID no. 23374774
aagcacttcactctctaatttccttctctctatctctcaccatattcgcgattaaaaactctcaacttttctctcaaatttctgatcctttaatccaacagttagaagaagattcatctgatcatggccctcgaagcgatgaacactccaacttcttctttcaccagaatcgaaacgaaagaagatttgatgaacgacgccgttttcattgagccgtggcttaaacgcaaacgctccaaacgtcagcgttctcacagcccttcttcgtcttcttcctcaccgcctcgatctcgacccaaatcccagaatcaagatcttacggaagaagagtatctcgctctttgtctcctcatgctcgctaaagatcaaccgtcgcaaacgcgatttcatcaacagtcgcaatcgttaacgccgccgccagaatcaaagaaccttccgtacaagtgtaacgtctgtgaaaaagcgtttccttcctatcaggctttaggcggtcacaaagcaagtsrccgaatcaaaccaccaaccgtaatctcaacaactgccgatgattcaacagctccgaccatctccatcgtcgccggagaaaaacatccgattgctgcctccggaaagatccacgagtgttcaatctgtcataaagtgtttccgacgggtcaagctttaggcggtcacaaacgttgtcactacgaaggcaacctcggcggcggaggaggaggaggaagcaaatcaatcagtcacagtggaagcgtgtcgagcacggtatcggaagaaaggagccaccgtggattcatcgatctaaacctaccggcgttacctgaactcagccttcatcacaatccaatcgtcgacgaagagatcttgagtccgttgaccggtaaaaaaccgcttttgttgaccgatcacgaccaagtcatcaagaaagaagatttatctttaaaaatctaatactcgactattaattcttgtgttttcattttcatttttttagttacaaatttttaattgttctgatttggattgaatattggtatattgttagggattgatacaaaaatttgatgattgattaagtcagaatttctttttaattatggtaactaatctcttgatcagtccactctgtataaatattgcgtggcatt

SEQ ID NO: 555 - protein, 273 aa, Arabidopsis thaliana
  misc_feature (106)..(128): Pfam Name: zf-C2H2; Pfam Description: Zinc finger, C2H2 type
  misc_feature (106)..(128): Pfam Name: zf-C2H2; Pfam Description: Zinc finger, C2H2 type
  misc_feature: Utility: Useful for delaying flowering time
  misc_feature: Utility: Useful for increasing chlorophyll and photosynthetic capacity
  misc_feature: Utility: Useful for making larger plants
  misc_feature: Utility: Useful for making plants with altered leaf shape eg curled leaves
  misc_feature: Utility: Useful for making plants with increased biomass and foliage
  misc_feature: Utility: Useful for making smaller plants
MALEAMNTPTSSFTRIETKEDLMNDAVFIEPWLKRKRSKRQRSHSPSSSSSSPPRSRPKSQNQDLTEEEYLALCLLMLAKDQPSQTRFHQQSQSLTPPPESKNLPYKCNVCEKAFPSYQALGGHKASHRIKPPTVISTTADDSTAPTISIVAGEKHPIAASGKIHECSICHKVFPTGQALGGHKRCHYEGNLGGGGGGGSKSISHSGSVSSTVSEERSHRGFIDLNLPALPELSLHHNPIVDEEILSPLTGKKPLLLTDHDQVIKKEDLSLKI

SEQ ID NO: 556 - protein, 235 aa, Arabidopsis thaliana
  misc_feature (1)..(235): Public GI no. 7228329
  misc_feature: Utility: Useful for delaying flowering time
  misc_feature: Utility: Useful for increasing chlorophyll and photosynthetic capacity
  misc_feature: Utility: Useful for making larger plants
  misc_feature: Utility: Useful for making plants with altered leaf shape eg curled leaves
  misc_feature: Utility: Useful for making plants with increased biomass and foliage
  misc_feature: Utility: Useful for making smaller plants
MAMEALNSPTTATPFTPFEEPNLSYLETPWTKGKRSKRSRMDQSSCTEEEYLALCLIMLARSGNNNDKKSDSVATPLTTVKLSHKCSVCNKAFSSYQALGGHKASHRKAVMSATTAEDQITTTSSAVTTSSASNGKNKTHECSICHKSFPTGQALGGHKRCHYEGSVGAGAGAGSNAVTASEGVGLSHSHHRDFDLNLPAFPDFSKKFFVDDEVFSPLPAAKKPCLFKLEIPSHY

SEQ ID NO: 557 - protein, 273 aa, Arabidopsis thaliana
  misc_feature (1)..(273): Public GI no. 2981169
  misc_feature: Utility: Useful for delaying flowering time
  misc_feature: Utility: Useful for increasing chlorophyll and photosynthetic capacity
  misc_feature: Utility: Useful for making larger plants
  misc_feature: Utility: Useful for making plants with altered leaf shape eg curled leaves
  misc_feature: Utility: Useful for making plants with increased biomass and foliage
  misc_feature: Utility: Useful for making smaller plants
MTLEALKSPTAATPTLPPRYEDDDEIHNLDSWAKGKRSKRPRIDAPPTEEEYLALCLIMLARSGTGTRTGLTDATTSQQPADKKTAELPPVHKKEVATEQAEQSYKCSVCDKAFSSYQALGGHKASHRKTTTTATAASDDNNPSTSTSTGAVNISALNPTGRSHVCSICHKAFPTGQALGGHKRRHYEGKLGGNSRDLGGGGGGGHSGSVLTTSDGGASTHTLRDFDLNMPASPELQLGLSIDCGRKSQLLPMVQEVESPMPAKKPRLLFSLG

SEQ ID NO: 558 - protein, 259 aa, Arabidopsis thaliana
  misc_feature (1)..(259): Public GI no. 55734108
  misc_feature: Utility: Useful for delaying flowering time
  misc_feature: Utility: Useful for increasing chlorophyll and photosynthetic capacity
  misc_feature: Utility: Useful for making larger plants
  misc_feature: Utility: Useful for making plants with altered leaf shape eg curled leaves
  misc_feature: Utility: Useful for making plants with increased biomass and foliage
  misc_feature: Utility: Useful for making smaller plants
MALEALNSPTTPTPVFQYENAATLRYLDQPWAKGKRSKRPRSVEPPPPQHQQQQQPTEEEYLALCLIMLARGGAPSTTTLPLPPPPQQHNIPSSSSSDPPKLLYKCSVCDKAFSSYQALGGHKASHRKLSTASAGGGDDQSTTSTSTTTAAAATGRTHECSICHKCFPSGQALGGHKRCHYEGGAGAVGSTGNAASGVTSSEGMGSTNTHSNRDFDLNLPALPEFWLAAAAGDDEVSSPHPAKRSRFALPIKVENHQIN

SEQ ID NO: 559 - protein, 253 aa, Arabidopsis thaliana
  misc_feature (1)..(253): Public GI no. 439493
  misc_feature: Utility: Useful for delaying flowering time
  misc_feature: Utility: Useful for increasing chlorophyll and photosynthetic capacity
  misc_feature: Utility: Useful for making larger plants
  misc_feature: Utility: Useful for making plants with altered leaf shape eg curled leaves
  misc_feature: Utility: Useful for making plants with increased biomass and foliage
  misc_feature: Utility: Useful for making smaller plants
MALEALNSPTTTTPPSFQFENNGLKYLESWTKGKRSKRQRSMERQCTEEEYLALCLIMLARSDGSVNNSRSLPPPPLPPSVPVTSQINATLLEQKNLYKCSVCGKGFGSYQALGGHKASHRKLVSMGGDEQSTTSTTTNVTGTSSANVNGNGRTHECSICHKCFPTGQALGGHKRCHYDGGNGNGNGSVSVGVTSSEGVGSTISHHRDFDLNIPALPEFWPGFGSGEDEVESPHPAKKSRLSLPPKLELFKGL

SEQ ID NO: 560 - protein, 240 aa, Arabidopsis thaliana
  misc_feature (1)..(240): Public GI no. 7488707
  misc_feature: Utility: Useful for delaying flowering time
  misc_feature: Utility: Useful for increasing chlorophyll and photosynthetic capacity
  misc_feature: Utility: Useful for making larger plants
  misc_feature: Utility: Useful for making plants with altered leaf shape eg curled leaves
  misc_feature: Utility: Useful for making plants with increased biomass and foliage
  misc_feature: Utility: Useful for making smaller plants
MALEALNSPTTTAPSFPFDDPTIPWAKRKRSKRSRDHPSEEEYLALCLIMLARGGTTTVNNRHVSPPPLQPQPQPTPDPSTKLSYKCSVCDKSFPSYQALGGHKASHRKLAGAAEDQPPSTTTSSAAATSSASGGKAHECSICHKSFPTGQALGGHKRCHYEGNGNGNNNNSNSVVTVASEGVGSTHTVSHGHHRDFDLNIPAFPDFSTKVGEDEVESPHPVMKKPRLFVIPKIEIPQFQ

SEQ ID NO: 561 - protein, 253 aa, Arabidopsis thaliana
  misc_feature (1)..(253): Public GI no. 33771374
  misc_feature: Utility: Useful for delaying flowering time
  misc_feature: Utility: Useful for increasing chlorophyll and photosynthetic capacity
  misc_feature: Utility: Useful for making larger plants
  misc_feature: Utility: Useful for making plants with altered leaf shape eg curled leaves
  misc_feature: Utility: Useful for making plants with increased biomass and foliage
  misc_feature: Utility: Useful for making smaller plants
MALEALNSPTTTTPPTFQFENNGPLRYLENWTKGKRSKRPRSMERQPTEEEYLALCLIMLARSDGSANREQSLPPPPVPVMKIHAPPEEKMVYKCSVCGKGFGSYQALGGHKASHRKLVAGGGGGDDQSTTSTTTNATGTTSSANGNGNGSGKTHECSICHKRFPTGQALGGHKRCHYDGGNSNGGVSVSASVGLTSSEGVGSTVSHRDFDLNIPALPEFWPGFGSGEDEVESPHPTKKSRLSLPPKFELFRE

SEQ ID NO: 562 - protein, 239 aa, Triticum aestivum
  misc_feature (1)..(239): Ceres CLONE ID no. 701379
  misc_feature: Utility: Useful for delaying flowering time
  misc_feature: Utility: Useful for increasing chlorophyll and photosynthetic capacity
  misc_feature: Utility: Useful for making larger plants
  misc_feature: Utility: Useful for making plants with altered leaf shape eg curled leaves
  misc_feature: Utility: Useful for making plants with increased biomass and foliage
  misc_feature: Utility: Useful for making smaller plants
MAVEAVLEAATMIPSPPSKEMEASSSTSEEASALLGQAEGWSKRKRSRRQRALDPSEEEYLALCLLMLAHGHRDSAPAAAPEQQHGCSVCGKVFASYQALGGHKASHRKPTAAPAGAEDQKPLAAVAAASSSGSGEAAVSAGGGKVHECNVCRKTFPTGQALGGHKRCHYDGTIGSAAAGPTQKLAAKAAAASATAASQGFDLNLPALPDIPERCAVTEDGEEVLSPASFKKPRLMLAA

SEQ ID NO: 563 - protein, 235 aa, Triticum aestivum
  misc_feature (1)..(235): Public GI no. 2058504
  misc_feature: Utility: Useful for delaying flowering time
  misc_feature: Utility: Useful for increasing chlorophyll and photosynthetic capacity
  misc_feature: Utility: Useful for making larger plants
  misc_feature: Utility: Useful for making plants with altered leaf shape eg curled leaves
  misc_feature: Utility: Useful for making plants with increased biomass and foliage
  misc_feature: Utility: Useful for making smaller plants
MALETLNSPTSATASARPLLRYREEMEPENLEQWAKRKRTKRQRFDQSRLNQETAPSEEEYLALCLLMLARGSAVQSPLPPSSSSDHRGYKCTVCGKSFSSYQALGGHKTSHRKPASNVNVPINQEQSNNSHSNSNGGSVVINGNGVSQSGKIHTCSICFKSFSSGQALGGHKRCHYDAGNNGNGNGSSSNSVEVVGGSDGSYVDDERSSEQSATGDNRGFDLNLPADQVAVVIS

SEQ ID NO: 564 - protein, 233 aa, Glycine max
  misc_feature (1)..(233): Ceres CLONE ID no. 638614
  misc_feature: Utility: Useful for delaying flowering time
  misc_feature: Utility: Useful for increasing chlorophyll and photosynthetic capacity
  misc_feature: Utility: Useful for making larger plants
  misc_feature: Utility: Useful for making plants with altered leaf shape eg curled leaves
  misc_feature: Utility: Useful for making plants with increased biomass and foliage
  misc_feature: Utility: Useful for making smaller plants
MALETLNSPTTTAPSFPFDDPTIPWAKRKRSKRCSRDHPSEEEYLALCLIMLARGGTTRRVSTPPPQPTPDPSTKLSYKCSVCNKSFPSYQALGGHKASHRKLAASGGEDQPTTTSSAASSANTASGGRTHECSICHKSFPTGQALGGHKRCHYEGNSNGNNNNSNSSVTAASEGVGSTHTVSHGHHRDFDLNIPAFPDFSTKVGEDEVESPHPVMKKPRPFVIPKIEIPQYQ

SEQ ID NO: 565 - protein, 261 aa, Glycine max
  misc_feature (1)..(261): Public GI no. 33331578
  misc_feature: Utility: Useful for delaying flowering time
  misc_feature: Utility: Useful for increasing chlorophyll and photosynthetic capacity
  misc_feature: Utility: Useful for making larger plants
  misc_feature: Utility: Useful for making plants with altered leaf shape eg curled leaves
  misc_feature: Utility: Useful for making plants with increased biomass and foliage
  misc_feature: Utility: Useful for making smaller plants
MALEALNSPTGTPTPPPFQFESDGQQLRYIENWRKGKRSKRSRSMEHQPTEEEYLALCLIMLARSGGSVNHQRSLPPPAPVMKLHAPSSSSAAEEEKEKMVYKCSVCGKGFGSYQALGGHKASHRKLVPGGDDQSTTSTTTNATGTTTSVNGNGNRSGRTHECSICHKCFPTGQALGGHKRCHYDGGIGNGNANSGVSASVGVTSSEGVGSTVSHRDFDLNIPALPEFWLGFGSGEDEVESPHPAKKSRLCLPPKYELFQH

SEQ ID NO: 566 - protein, 247 aa, Glycine max
  misc_feature (1)..(247): Public GI no. 4666360
  misc_feature: Utility: Useful for delaying flowering time
  misc_feature: Utility: Useful for increasing chlorophyll and photosynthetic capacity
  misc_feature: Utility: Useful for making larger plants
  misc_feature: Utility: Useful for making plants with altered leaf shape eg curled leaves
  misc_feature: Utility: Useful for making plants with increased biomass and foliage
  misc_feature: Utility: Useful for making smaller plants
MALEALNSPTTATPVFHYDDPSLNYLEPWTKRKRSKRTRLDSPHTEEEYLAFCLIMLARGRVASANRRDSQSSIQIQPEATTSATKVSYKCSVCDKAFSSYQALGGHKASHRKLAGGEDQSTSFATTNSATVTTTTASGGGGRSHECSICHKSFPTGQALGGHKRCHYEGSIGGNSIHHHNNTTNSGSNGGMSMTSEVGSTHTVSHSHRDFDLNIPALPEFRSNFFISGDDEVESPHPAKKPRILMK

SEQ ID NO: 567 - protein, 250 aa, Glycine max
  misc_feature (1)..(250): Public GI no. 28849865
  misc_feature: Utility: Useful for delaying flowering time
  misc_feature: Utility: Useful for increasing chlorophyll and photosynthetic capacity
  misc_feature: Utility: Useful for making larger plants
  misc_feature: Utility: Useful for making plants with altered leaf shape eg curled leaves
  misc_feature: Utility: Useful for making plants with increased biomass and foliage
  misc_feature: Utility: Useful for making smaller plants
MAVEAVLEASRSSSEEEAEVIVTHGGGGGGGGGGGQVEGWGKRKRSRRRRPQLPPSEEEYLALCLLMLARGRRDGDDVAASASAAAAAVEHRCSVCGKAFASYQALGGHKASHRKPPPPPPPAMVDDDEVVVETKPAAIATPSSSASGVSGGGGGRAHECNVCGKAFPTGQALGGHKRCHYDGTIGSAAGAGASKPAAKTTVAVAASRGFDLNLPALPDVAAAADQRCAAEDDEVLSPLAFKKPRLMIPA

SEQ ID NO: 568 - protein, 237 aa, Glycine max
  misc_feature (1)..(237): Public GI no. 2058506
  misc_feature: Utility: Useful for delaying flowering time
  misc_feature: Utility: Useful for increasing chlorophyll and photosynthetic capacity
  misc_feature: Utility: Useful for making larger plants
  misc_feature: Utility: Useful for making plants with altered leaf shape eg curled leaves
  misc_feature: Utility: Useful for making plants with increased biomass and foliage
  misc_feature: Utility: Useful for making smaller plants
MALETLNSPTSATASARPLLRYREEMEPENLEQWAKRKRTKRQRFDQSRLNQETAPSEEEYLALCLLMLARGSAVQSPLPPSSSSDHRGYKCTVCGKSFSSYQALGGHKTSHRKPASNVNVPINQEQSNNSHSNSNGGSVAINGNGVSQSGKIHTCSICFKSFSSGQALGGHKRCHYDAGINGNGNGSSSNSVEVVGGSDGNYVDDERSSEQSATGDNRGFDLNLPADQVAVVISKR

SEQ ID NO: 569 - DNA, 1809 bp, Arabidopsis thaliana
  misc_feature (1)..(1809): Ceres CLONE ID no. 42141
  misc_feature (1)..(1809): Also known as  Ceres CDNA ID no. 23375607
acgaaaaacaagtgatggaggaagtagtagtagtagttgcagacccaccaccgaagattactaccgttgtggaatacgaagaagagcttgaagatgatgacgatgatctctcgctttcgtcagattccgatatcgctgaagctcttgattggctagacggtaaagacgatgacgagctaattggtggtggcttctctcttcatgctcgtcgtcctaatgctcacggtggacatggttcacgccctaactctagtgctctacagcctatttccaataaggcccagaagcttactagtcacgttcgtgcttctcctttagagggatgggaaggaagagttaaagttgggatgtcgaattctgtgacaactgcgattcgtggaagtcttagagatacagaaattgggagaagtaggaatactgataaagcggaccgggcaactgttgaacaggctcttgatccaaggacgcgtatggtattgtttagaatgcttaataggggtgtgtttaacgatgttaatggctgtatttcgacaggcaaagaagcaaatgtttatcatgccacaaaatctgacggttcggaacttgcaataaaagtgtacaagacatctgttctggttttcaaggatcgagatcgatatgtacaaggagattaccgttttagatatggctactgtcgtcacaatcctcgaaagatggtgaagacatgggctgaaaaagaacagagaaatctcaagaggcttcatgcagcaggaattaggtgtccagctgttatacttctacgccttcatgttctagtcatggagtttataggragggatggttgggctgcaccgcgtctcaaggatgccgcattgtctctggacaagttgcgcgagtgttacttagagttgataattcaaatgcgagtattatatcagaagtgcaaattagtgcatggggatctcagtgagtataacatactttattttgaagggcacctttatataattgatgtttctcaatctgtggatctggaccatcctcttgcactcaactttctacgggaagattgtgaccatgtctcggattttttcaaaaaacatggtgtggctgttatgacaatacgagagctatttgacttcatagttgacccgacaatttcagacgaaaatgttgatagctatttggaagaggtccaacggaaagttatagagcgaggagagatatccgtagaggatgaaatcgcggattctgtattcatgaagtcatacataccgaaatctctggatgctgtgaacaacccagaggctgatgtagcgaagataacaagcgggcaggacacaggagacatgctgtaccaaacgataacggggcttaaggatgctcttcctaaagtagacgagcagcaaatagaggtgaatgctgaagaggaagaagaagaagaggaagagggaagtggagaagaaagcgaagaagagagtgaagaagaattgggtcctgaagacaagaaagctgcaaggaaagagcacaagaagaaagtgaaagaggagaaacgagagtctaggaagacgaaaacacccaaatctgtcaagaagcgaaaaaagaaagtctctaaaccccacaagactcgttagcatcttttgacacccatacttgtatcttttactatggacccgaaggctcttttgggtctctttatccaaaacagtaagttcttgtaatattcacagtacgattatgatagatcacatgataggtttgctggtgttttgagaggactaaaataatttttgttacttgacaattcgactaatggtagtctctaaattt

SEQ ID NO: 570 - protein, 532 aa, Arabidopsis thaliana
  misc_feature (178)..(366): Pfam Name: RIO1; Pfam Description: RIO1 family
  misc_feature (178)..(366): Pfam Name: RIO1; Pfam Description: RIO1 family
  misc_feature: Utility: Useful for delaying flowering time
  misc_feature: Utility: Useful for making ornamental plants with modified leaves
  misc_feature: Utility: Useful for making plants with increased biomass and foliage
  misc_feature: Utility: Useful for making smaller plants
MEEVVVVVADPPPKITTVVEYEEELEDDDDDLSLSSDSDIAEALDWLDGKDDDELIGGGFSLHARRPNAHGGHGSRPNSSALQPISNKAQKLTSHVRASPLEGWEGRVKVGMSNSVTTAIRGSLRDTEIGRSRNTDKADRATVEQALDPRTRMVLFRMLNRGVFNDVNGCISTGKEANVYHATKSDGSELAIKVYKTSVLVFKDRDRYVQGDYRFRYGYCRHNPRKMVKTWAEKEQRNLKRLHAAGIRCPAVILLRLHVLVMEFIGRDGWAAPRLKDAALSLDKLRECYLELIIQMRVLYQKCKLVHGDLSEYNILYFEGHLYIIDVSQSVDLDHPLALNFLREDCDHVSDFFKKHGVAVMTIRELFDFIVDPTISDENVDSYLEEVQRKVIERGEISVEDEIADSVFMKSYIPKSLDAVNNPEADVAKITSGQDTGDMLYQTITGLKDALPKVDEQQIEVNAEEEEEEEEEGSGEESEEESEEELGPEDKKAARKEHKKKVKEEKRESRKTKTPKSVKKRKKKVSKPHKTR

SEQ ID NO: 571 - protein, 531 aa, Arabidopsis thaliana
  misc_feature (1)..(531): Public GI no. 51970844
  misc_feature: Utility: Useful for delaying flowering time
  misc_feature: Utility: Useful for making ornamental plants with modified leaves
  misc_feature: Utility: Useful for making plants with increased biomass and foliage
  misc_feature: Utility: Useful for making smaller plants
MEEVVVVAEPPPKITPFVEYEEELEDDDDDLSLSSDSDIAEALDWLDGKDDDELIGGGFSLHARRPNAHGGHGSRPNSSALQPISNKAQKLTSHVRASPLEGWEGRVKVGMSNSVTTAIRGSLRDTEIGRSRNTDKADRATVEQALDPRTRMVLFRMLNRGVFNDVNGCISTGKEANVYHATKSDGSELAIKVYKTSVLVFKDRDRYVQGDYRFRYGYCRHNPRKMVKTWAEKEQRNLKRLHAAGIRCPAVILLRLHVLVMEFIGRDGWAAPRLKDAALSLDKLRECYLKLIIQMRVLYQKCKLVHGDLSEYNILYFEGHLYIIDVSQSVDLDHPLALNFLREDCDHVSDFFKKHGVAVMTIRELFDFIVDPTISDENVDSYLEEVQRKVIERGEISVEDEIADSVFMKSYIPKSLDAVNNPEADVAKITSGQDTGDMLYQTITGLKDALPKVGEQQIEVNAEEEEEEEEEGSGEESEEESEKELGPEDKKAARKEHKKKVKEEKRESRKTKTPKSVKKRKKKVSKPHKTR

SEQ ID NO: 572 - protein, 537 aa, Arabidopsis thaliana
  misc_feature (1)..(537): Ceres CLONE ID no. 1197765
  misc_feature: Utility: Useful for delaying flowering time
  misc_feature: Utility: Useful for making ornamental plants with modified leaves
  misc_feature: Utility: Useful for making plants with increased biomass and foliage
  misc_feature: Utility: Useful for making smaller plants
MEEVVLVTEPPPTIPPVVEYEEEHDDDDDDDLSLSSDSDIAEALDWLDGKDDDELIGGGFSLHARRPNAHGGHGSRPNSSSLQPISNKAQKLTSHVRASPLEGWEGRVKVGMSNSVTTAIRGSLRDTEIGRSRNTDKADRATVEQALDPRTRMVLFRMLNRGVFNDVNGCISTGKEANVYHATKSDGSELAIKVYKTSVLVFKDRDRYVQGDYRFRYGYCRHNPRKMVKTWAEKEQRNLKRLHAAGIRCPAVILLRLHVLVMEFIGRDGWAAPRLKDAALSLDKLRECYLELIIQMRVLYQKCKLVHGDLSEYNILYFEGHLYIIDVSQSVDLDHPLALNFLREDCDHVSDFFKKHGVAVMTIRELFDFIVDPAITDENVDSYLEEVQRKVIERGEISVEDEIADSVFMKSYIPKSLDAVNNPEADVAKITSGQDTGDMLYQTITGLKDALPKIEEQKIEVNDEEKEEEGEEEEDGESEEGSEEEESEEELGHEDKKAARKEHKKKVKEEKRESRKTKTPKSVKKRKKKVSKPHKTR

SEQ ID NO: 573 - protein, 537 aa, Arabidopsis thaliana; identical to SEQ ID NO: 572
  misc_feature (1)..(537): Public GI no. 4559353
  misc_feature: Utility: Useful for delaying flowering time
  misc_feature: Utility: Useful for making ornamental plants with modified leaves
  misc_feature: Utility: Useful for making plants with increased biomass and foliage
  misc_feature: Utility: Useful for making smaller plants

SEQ ID NO: 574 - protein, 562 aa, Arabidopsis thaliana
  misc_feature (1)..(562): Public GI no. 45476407
  misc_feature: Utility: Useful for delaying flowering time
  misc_feature: Utility: Useful for making ornamental plants with modified leaves
  misc_feature: Utility: Useful for making plants with increased biomass and foliage
  misc_feature: Utility: Useful for making smaller plants
MAEPADKLEKPQNAENEKEAAVVDEELEEEEEEEDEEGELSWSSDSEIGEALDYLDTKDDSESINGAFSLQTRRPNAHGGLHSRPNSSALQPLSNRTQKFSNHIRASPLEEWEGRIKVGMSNSVTTAIRGSVRDMAIGKTKTTEKADRATVEQAIDPRTRMVLFKMLNRGVFHDINGCISTGKEANVYHATKADGQELAIKVYKTSVLVFKDRDRYVQGDYRFRYGYCKHNPRKMVKTWAEKEMRNLMRLRAAGIRCPAPLLLRLHVLVMEFIGKGGWAAPRLKDAALSLDKLRECYVEIIMAMRTLYQKCKLVHGDLSEYNILYYEGHLYVIDVSQSVDLDHPHALDFLREDCVHVSDFFKKHGVAVMTIRELFDFIVDPTIDDDSVDSYLEKVQEKIMARGEMTAEEEIADSVFIQSFIPKTLDHVKDAEADVQRIISGEDTGDMYYKTITGLKQALSGTNPSAENQQHEQNGERGPEAAAEIDKESDGELETESDDDDESDSSEGFSSDGEKQTAAEKKTARKENKKKVKEEKREARKHKVPKAVKKKKKKLAKAKKYR

SEQ ID NO: 575 - protein, 420 aa, Glycine max
  misc_feature (1)..(420): Ceres CLONE ID no. 512325
  misc_feature: Utility: Useful for delaying flowering time
  misc_feature: Utility: Useful for making ornamental plants with modified leaves
  misc_feature: Utility: Useful for making plants with increased biomass and foliage
  misc_feature: Utility: Useful for making smaller plants
  misc_feature (80)..(80): Xaa is any aa, unknown, or other
  misc_feature (95)..(95): Xaa is any aa, unknown, or other
  misc_feature (107)..(107): Xaa is any aa, unknown, or other
  misc_feature (125)..(125): Xaa is any aa, unknown, or other
  misc_feature (393)..(393): Xaa is any aa, unknown, or other
MNVGMSNSVTTAIRGSVRDMAIGKTKTTEKADRATVEQAIDPRTRMVLFKMLNRGVFHDINGCISTGKEANVYHATKSDXQELAIKVYKTSVLVXKDRDRYVQGDFXFRNGYCKHNPRKMVKTWXEKEMRNLMRLKAAGIRCPTPYLLRLHVLVMEFIGKSGWAAPRLKDAALSLDKLREGYVEIIIAMRTLYQKCKLVHGDLSEYNILYFEGHLYIIDVSQAVDPEHPHALDFLREDCVHVSDFFKKHGVAVMTIRELFEFIVDASITDDAVDSYLEEMQQKILTRGDISAEDEIADSVFVQSYIPKTLEDVKNAEEDVQRITSGKDTKDLYYQTITGLKHALSLTQPSQQKTQQKSSPTKDSPAVSDDKSKLLEDDAEGQSDEDEDDESNXEEDSPSESEVDDPADKKAARKEVRKEN

SEQ ID NO: 576 - protein, 496 aa, Glycine max
  misc_feature (1)..(496): Public GI no. 50934355
  misc_feature: Utility: Useful for delaying flowering time
  misc_feature: Utility: Useful for making ornamental plants with modified leaves
  misc_feature: Utility: Useful for making plants with increased biomass and foliage
  misc_feature: Utility: Useful for making smaller plants
MKRSGRTPTWPMRSTGSTPRRPNAHGGVLSRPFQPISNRTQKLASHIRATPLEEWEGRMNVGMSNSVTTAIRDSIRETAIGKTRNTEKADRATVEQAIDPRTRMVLFKMLNRGVFNTINGCISTGKEANVYHASKADGQELAIKVYKTSVLVFKDRDRYVHGDYRFRHGYCKHNPRKMVKTWAEKEMRNLLRVGAAGIRCPKPLLLRLHVLVMEFIGKGGWAAPRLKDAALSDDKLRESYFELITTMRTLYQKCKLVHGDLSEYNILYFEGHLYIIDVSQSVDLDHPSALEFLKEDCLHVTDFFKKRGVAVMSVTELFNFVIDQNIADEDVDHYLEKIQQKMLENGDMVANDDEITPTVLVQTLDYVKQCEADIVNMSLMQRPSFANEPTADKLYNQPLLGFVRNKNEPTKNQQVQSEEPLDLQNKCSSEHSESCTSSDEDGSWHEILKVGPEERKAARKENKKKVKAEKREARKDKIPKAEKKKRKKMAKAKCKR

SEQ ID NO: 577 - protein, 532 aa, Zea mays
  misc_feature (1)..(532): Ceres CLONE ID no. 297520
  misc_feature: Utility: Useful for delaying flowering time
  misc_feature: Utility: Useful for making ornamental plants with modified leaves
  misc_feature: Utility: Useful for making plants with increased biomass and foliage
  misc_feature: Utility: Useful for making smaller plants
MALVKSDAEEEWSDSDFDDASDSEVAEALDWLDAVEGPDGSARPHVAFSASGGGAAARRPNAHGGVLSRPLQPLSNRTQKLASHISATPLEEWEGRMNVAMSNSVTTAIRDSIRDTAIGKIRNTEKADRATVEQAIDPRTRMVLFKMLNRGVFNNINGCISTGKEANVYHATKTDGQELAIKVYKTSVLVFKDRDRYVQGDYRFRHGYCKHNPRKMVKTWAEKEMRNLLRVRAAGIRCPAPLLLRLHVLVMEFIGKGGWAAPRLKDAALSDDKLHESYFEIITTMRTLYQTCKLVHGDLSEYNILYFEGHLYIIDVSQSVDLDHPSALDFLKEDCLHVSDFFKKRGVPVMTVTDLFNFVIDQSISDEDVDDYLEKAQQKILENGGAVPNDDEITPTVMVQTLDYVKQCEADIVNMSIMQRSSSGYEPTADKLYDQPLLGFVRTKNTNTEKEQGQPARNLVEVEEDESESCLSSDEDDSWHEDDPKVGPEERKAARKENKKKVKEEKREARKTKIPKAEKKKRKKMAKAKCKR

SEQ ID NO: 578 - DNA, 884 bp, Arabidopsis thaliana
  misc_feature (1)..(884): Ceres CLONE ID no. 92459
  misc_feature (1)..(884): Also known as  Ceres CDNA ID no. 23361912
aggattaaattagggcataacccttatcggagatttgaagccatgggaagaagaaaaatcgagatcaagcgaatcgagaacaaaagcagtcgacaagtcactttctccaaacgacgcaatggtctcatcgacaaagctcgacaactttcgattctctgtgaatcctccgtcgctgttgtcgtcgtatctgcctccggaaaactctatgactcttcctccggtgacgacatttccaagatcattgatcgttatgaaatacaacatgctgatgaacttagagccttagatcttgaagaaaaaattcagaattatcttccacacaaggagttactagaaacagtccaaagcaagcttgaagaaccaaatgtcgataatgtaagtgtagattctctaatttctctggaggaacaacttgagactgctctgtccgtaagtagagctaggaaggcagaactgatgatggagtatatcgagtcccttaaagaaaaggagaaattgctgagagaagagaaccaggttctggctagccagatgggaaagaatacgttgctggcaacagatgatgagagaggaatgtttccgggaagtagctccggcaacaaaataccggagactctcccgctgctcaattagccaccatcatcaacggctgagttttcaccttaaactcaaagcctgattcataattaagagaataaatttgtatattataaaaagctgtgtaatctcaaaccttttatcttcctctagtgtggaatttaaggtcaaaaagaaaacgagaaagtatggatcagtgttgtacctccttcggagacaagatcagagtttgtgtgtttgtgtctgaatgtacggattggatttttaaagttgtgctttctttcttc

SEQ ID NO: 579 - protein, 196 aa, Arabidopsis thaliana
  misc_feature (117)..(166): Pfam Name: K-box; Pfam Description: K-box region
  misc_feature (9)..(59): Pfam Name: SRF-TF; Pfam Description: SRF-type transcription factor (DNA- binding and dimerisation domain)
  misc_feature: Utility: Useful for delaying flowering time
  misc_feature: Utility: Useful for increasing chlorophyll and photosynthetic capacity
  misc_feature: Utility: Useful for making larger plants
  misc_feature: Utility: Useful for making ornamental plants with modified flowers
  misc_feature: Utility: Useful for making ornamental plants with modified leaves
  misc_feature: Utility: Useful for making plants with increased biomass
  misc_feature: Utility: Useful for making plants with increased biomass and foliage
  misc_feature: Utility: Useful for making plants with increased size and biomass
  misc_feature: Utility: Useful for making smaller plants
  misc_feature: Utility: Useful for making stronger plants
  misc_feature: Utility: Useful for making taller plants and plants with longer inflorescences
  misc_feature: Utility: Useful for modifying plant architecture, ie amount of  branching
MGRRKIEIKRIENKSSRQVTFSKRRNGLIDKARQLSILCESSVAVVVVSASGKLYDSSSGDDISKIIDRYEIQHADELRALDLEEKIQNYLPHKELLETVQSKLEEPNVDNVSVDSLISLEEQLETALSVSRARKAELMMEYIESLKEKEKLLREENQVLASQMGKNTLLATDDERGMFPGSSSGNKIPETLPLLN

SEQ ID NO: 580 - protein, 192 aa, Arabidopsis thaliana
  misc_feature (1)..(192): Ceres CLONE ID no. 98850
  misc_feature: Utility: Useful for delaying flowering time
  misc_feature: Utility: Useful for increasing chlorophyll and photosynthetic capacity
  misc_feature: Utility: Useful for making larger plants
  misc_feature: Utility: Useful for making ornamental plants with modified flowers
  misc_feature: Utility: Useful for making ornamental plants with modified leaves
  misc_feature: Utility: Useful for making plants with increased biomass
  misc_feature: Utility: Useful for making plants with increased biomass and foliage
  misc_feature: Utility: Useful for making plants with increased size and biomass
  misc_feature: Utility: Useful for making smaller plants
  misc_feature: Utility: Useful for making stronger plants
  misc_feature: Utility: Useful for making taller plants and plants with longer inflorescences
  misc_feature: Utility: Useful for modifying plant architecture, ie amount of  branching
MGRRKIEIKRIENKSSRQVTFSKRRNGLIDKARQLSILCESSVAVVVVSASGKLYDSSSGDEIEALFKPEKPQCFELDLEEKIQNYLPHKELLETVQSKLEEPNVDNVSVDSLISLEEQLETALSVSRARKAELMMEYIESLKEKEKLLREENQVLASQMGKNTLLATDDERGMFPGSSSGNKIPETLPLLN

SEQ ID NO: 581 - protein, 192 aa, Arabidopsis thaliana; identical to SEQ ID NO: 580
  misc_feature (1)..(192): Public GI no. 11545547
  misc_feature: Utility: Useful for delaying flowering time
  misc_feature: Utility: Useful for increasing chlorophyll and photosynthetic capacity
  misc_feature: Utility: Useful for making larger plants
  misc_feature: Utility: Useful for making ornamental plants with modified flowers
  misc_feature: Utility: Useful for making ornamental plants with modified leaves
  misc_feature: Utility: Useful for making plants with increased biomass
  misc_feature: Utility: Useful for making plants with increased biomass and foliage
  misc_feature: Utility: Useful for making plants with increased size and biomass
  misc_feature: Utility: Useful for making smaller plants
  misc_feature: Utility: Useful for making stronger plants
  misc_feature: Utility: Useful for making taller plants and plants with longer inflorescences
  misc_feature: Utility: Useful for modifying plant architecture, ie amount of  branching

SEQ ID NO: 582 - protein, 197 aa, Arabidopsis thaliana
  misc_feature (1)..(197): Public GI no. 2829920
  misc_feature: Utility: Useful for delaying flowering time
  misc_feature: Utility: Useful for increasing chlorophyll and photosynthetic capacity
  misc_feature: Utility: Useful for making larger plants
  misc_feature: Utility: Useful for making ornamental plants with modified flowers
  misc_feature: Utility: Useful for making ornamental plants with modified leaves
  misc_feature: Utility: Useful for making plants with increased biomass
  misc_feature: Utility: Useful for making plants with increased biomass and foliage
  misc_feature: Utility: Useful for making plants with increased size and biomass
  misc_feature: Utility: Useful for making smaller plants
  misc_feature: Utility: Useful for making stronger plants
  misc_feature: Utility: Useful for making taller plants and plants with longer inflorescences
  misc_feature: Utility: Useful for modifying plant architecture, ie amount of  branching
MGRRKIEIKRIENKSSRQVTFSKRRNGLIDKARQLSILCESSVAVVVVSASGKLYDSSSVIVSTGKYKNFTIFLTIPFLHVQDLEEKIQNYLPHKELLETVQSKLEEPNVDNVSVDSLISLEEQLETALSVSRARKAELMMEYIESLKEKEKLLREENQVLASQMGKNTLLATDDERGMFPGSSSGNKIPETLPLLN

SEQ ID NO: 583 - protein, 205 aa, Arabidopsis thaliana
  misc_feature (1)..(205): Public GI no. 51968502
  misc_feature: Utility: Useful for delaying flowering time
  misc_feature: Utility: Useful for increasing chlorophyll and photosynthetic capacity
  misc_feature: Utility: Useful for making larger plants
  misc_feature: Utility: Useful for making ornamental plants with modified flowers
  misc_feature: Utility: Useful for making ornamental plants with modified leaves
  misc_feature: Utility: Useful for making plants with increased biomass
  misc_feature: Utility: Useful for making plants with increased biomass and foliage
  misc_feature: Utility: Useful for making plants with increased size and biomass
  misc_feature: Utility: Useful for making smaller plants
  misc_feature: Utility: Useful for making stronger plants
  misc_feature: Utility: Useful for making taller plants and plants with longer inflorescences
  misc_feature: Utility: Useful for modifying plant architecture, ie amount of  branching
MCRKSEAMGRRRVEIKRIENKSSRQVTFCKRRNGLMEKARQLSILCGSSVALFIVSSTGKLYNSSSGDSMAKIISRFKIQQADDPETLDLEDKTQDYLSHKELLEIVQRKIEEAKGDNVSIESLISMEEQLKSALSVIRARKTELLMELVKNLQDKEKLLKEKNKVLASEVGKLKKILETGDERAVMSPENSSGHSPPETLPLLK

SEQ ID NO: 584 - protein, 197 aa, Brassica napus
  misc_feature (1)..(197): Ceres CLONE ID no. 963001
  misc_feature: Utility: Useful for delaying flowering time
  misc_feature: Utility: Useful for increasing chlorophyll and photosynthetic capacity
  misc_feature: Utility: Useful for making larger plants
  misc_feature: Utility: Useful for making ornamental plants with modified flowers
  misc_feature: Utility: Useful for making ornamental plants with modified leaves
  misc_feature: Utility: Useful for making plants with increased biomass
  misc_feature: Utility: Useful for making plants with increased biomass and foliage
  misc_feature: Utility: Useful for making plants with increased size and biomass
  misc_feature: Utility: Useful for making smaller plants
  misc_feature: Utility: Useful for making stronger plants
  misc_feature: Utility: Useful for making taller plants and plants with longer inflorescences
  misc_feature: Utility: Useful for modifying plant architecture, ie amount of  branching
MGRKKLEIKRIENKSSRQVTFSKRRSGLIEKARQLSVLCDASVALLVVSSSGKLYSFSAGDNLVRILDRYGKQHADDLKALNLQSKALSYGSHNELLELVDSKLVESNVGGVSVDTLVQLEGVLENALSLTRARKTELMLKLVDSLKEKEKLLKEENQALAGQKEKKNLAGAEADNMEMSPGQISDINLPVTLPLLN

SEQ ID NO: 585 - DNA, 641 bp, Arabidopsis thaliana
  misc_feature (1)..(641): Ceres CLONE ID no. 92670
  misc_feature (1)..(641): Also known as  Ceres CDNA ID no. 23383902
aaaaccctaaggtaaacctgagagaacaagccagagctaatctcttgtcggaaggaagaaggatcaaaaatgccgctctacgactgtatgcttctgttcaagcctataatcaggaaggagggcctcatcgacctcgttgcgcgcattggtaaacacgtttacagcagaaatggcgtcctcaccgagatcaaatcctttggcaaggtcgaattgggttacggtattagaaagctcgacggaagacactatcagggacaattgatgcagataacaatgatgacaactccaaacatgaacaaggagcttcactacctgaacaaggaagacaaactgctacgctggctcttagttaaacaccgtgacatcaagattggacagtcggaaaaggaagatagtctgactgtgcctaacagactcactagtgggagcttatatgatggatcctcctcggacgaagatgacaacaacattttagggttatcacgatgaggaaatcaatttctttgaaatgtttactcagacaatttcttcatgggagtccccttcaatggttatgaatgtttttggttacataaagtggtggtatgcgttttgcgtagacaatgaaataaattaattttatgtaataataatttttaggc

SEQ ID NO: 586 - protein, 139 aa, Arabidopsis thaliana
  misc_feature: Utility: Useful for delaying flowering time
  misc_feature: Utility: Useful for increasing increasing anthocyanin content
  misc_feature: Utility: Useful for making lethal plants for genetic confinement systems
  misc_feature: Utility: Useful for making ornamental plants with modified leaves
  misc_feature: Utility: Useful for making plants with increased biomass and foliage
  misc_feature: Utility: Useful for making smaller plants
  misc_feature: Utility: Useful for making stronger plants
MPLYDCMLLFKPIIRKEGLIDLVARIGKHVYSRNGVLTEIKSFGKVELGYGIRKLDGRHYQGQLMQITMMTTPNMNKELHYLNKEDKLLRWLLVKHRDIKIGQSEKEDSLTVPNRLTSGSLYDGSSSDEDDNNILGLSR

SEQ ID NO: 587 - protein, 126 aa, Brassica napus
  misc_feature (1)..(126): Ceres CLONE ID no. 1067750
  misc_feature: Utility: Useful for delaying flowering time
  misc_feature: Utility: Useful for increasing increasing anthocyanin content
  misc_feature: Utility: Useful for making lethal plants for genetic confinement systems
  misc_feature: Utility: Useful for making ornamental plants with modified leaves
  misc_feature: Utility: Useful for making plants with increased biomass and foliage
  misc_feature: Utility: Useful for making smaller plants
  misc_feature: Utility: Useful for making stronger plants
MPLYDCMLLFKPIIRKEGLIDLVARIGKHVYSKNGVLTEVKSFGKVELGYGIKKLDGRHYQGQLMQITMMATPNINKELHYLNKEDKLLRWLLVKHRDIKIGSSEMEDRLDESNRVTNRSLYDESS

SEQ ID NO: 588 - protein, 116 aa, Brassica napus
  misc_feature (1)..(116): Ceres CLONE ID no. 1259129
  misc_feature: Utility: Useful for delaying flowering time
  misc_feature: Utility: Useful for increasing increasing anthocyanin content
  misc_feature: Utility: Useful for making lethal plants for genetic confinement systems
  misc_feature: Utility: Useful for making ornamental plants with modified leaves
  misc_feature: Utility: Useful for making plants with increased biomass and foliage
  misc_feature: Utility: Useful for making smaller plants
  misc_feature: Utility: Useful for making stronger plants
MLLFKPVIRKEGLIELVARIGKHVYSRNGVLTEVKSFGKVELGYGIRKLDGRHYQGQLMQITMMATPNMNKELHYLNKEDKLLRWLLVKHRHIKIGASEMEDRQDESSRVTNNRSL

SEQ ID NO: 589 - protein, 132 aa, Brassica napus
  misc_feature (1)..(132): Ceres CLONE ID no. 981652
  misc_feature: Utility: Useful for delaying flowering time
  misc_feature: Utility: Useful for increasing increasing anthocyanin content
  misc_feature: Utility: Useful for making lethal plants for genetic confinement systems
  misc_feature: Utility: Useful for making ornamental plants with modified leaves
  misc_feature: Utility: Useful for making plants with increased biomass and foliage
  misc_feature: Utility: Useful for making smaller plants
  misc_feature: Utility: Useful for making stronger plants
MLLFKPVIRKEGLIDLVARIGKHVYSKNGVLTEVKSFGKVELGYGIKKLDGRHYQGQLMQITMMATPNINKELHYLNKEDKLLRWLLVKHRDIKIGSSEMEDRLDESNRVTNRSLYDESSTDEDDDVLGLSR

SEQ ID NO: 590 - protein, 103 aa, Triticum aestivum
  misc_feature (1)..(103): Ceres CLONE ID no. 937515
  misc_feature: Utility: Useful for delaying flowering time
  misc_feature: Utility: Useful for increasing increasing anthocyanin content
  misc_feature: Utility: Useful for making lethal plants for genetic confinement systems
  misc_feature: Utility: Useful for making ornamental plants with modified leaves
  misc_feature: Utility: Useful for making plants with increased biomass and foliage
  misc_feature: Utility: Useful for making smaller plants
  misc_feature: Utility: Useful for making stronger plants
  misc_feature (12)..(12): Xaa is any aa, unknown, or other
  misc_feature (22)..(22): Xaa is any aa, unknown, or other
  misc_feature (97)..(97): Xaa is any aa, unknown, or other
MPLYDCMLMVKXLVTKEAIAEXVARVAARAYQRNGVVTELKSFGKVQLGYGIRKLDGRHFQGQLLQMTMMVPPSFTQELHYLNKEDRLLRWLVVKHXDAVYGL

SEQ ID NO: 591 - protein, 163 aa, Zea mays
  misc_feature (1)..(163): Ceres CLONE ID no. 260168
  misc_feature: Utility: Useful for delaying flowering time
  misc_feature: Utility: Useful for increasing increasing anthocyanin content
  misc_feature: Utility: Useful for making lethal plants for genetic confinement systems
  misc_feature: Utility: Useful for making ornamental plants with modified leaves
  misc_feature: Utility: Useful for making plants with increased biomass and foliage
  misc_feature: Utility: Useful for making smaller plants
  misc_feature: Utility: Useful for making stronger plants
MPLYDCMLLLKTTVTREVLAELVTRVARRACQRNGVVTDVKSFGKVSLAYGIRKLDGRHFQGHLMQMTMMVPPSFPQELHYLNKEDRLLRWLVVKHRDTVYGLEFLNADGGRDELRSFSHGHTKGDYDIEIDSDDEDSDDSDDEEYAIEEEEEEEAANDEEKK

SEQ ID NO: 592 - protein, 138 aa, Glycine max
  misc_feature (1)..(138): Ceres CLONE ID no. 599515
  misc_feature: Utility: Useful for delaying flowering time
  misc_feature: Utility: Useful for increasing increasing anthocyanin content
  misc_feature: Utility: Useful for making lethal plants for genetic confinement systems
  misc_feature: Utility: Useful for making ornamental plants with modified leaves
  misc_feature: Utility: Useful for making plants with increased biomass and foliage
  misc_feature: Utility: Useful for making smaller plants
  misc_feature: Utility: Useful for making stronger plants
MFLFKPHIRKEAVMDLVVRVGKHVCRRNGVVTDIKSLGKVQLGYGVKKLDGRYYQGLLMQMSMMATPEINKELHYLNKEDRLLRWLLVKQRNTKFGLDSYGDEGRYELSKLSQIGKHGDEDEDEDDEEYEVNEEETVN

SEQ ID NO: 593 - protein, 152 aa, Triticum aestivum
  misc_feature (1)..(152): Ceres CLONE ID no. 685681
  misc_feature: Utility: Useful for delaying flowering time
  misc_feature: Utility: Useful for increasing increasing anthocyanin content
  misc_feature: Utility: Useful for making lethal plants for genetic confinement systems
  misc_feature: Utility: Useful for making ornamental plants with modified leaves
  misc_feature: Utility: Useful for making plants with increased biomass and foliage
  misc_feature: Utility: Useful for making smaller plants
  misc_feature: Utility: Useful for making stronger plants
MPLYDCMLMVKPMVTKEAIAELVARVAARAYQRNGVVTELKSFGKVHLGYGIRKLDGRHFQGQLLQMTMMVPPSFTQELHYLNKEDRLLRWLVVKHRDAVYGLEFINEDDGRYEMDSFRRKSTTTQDDEDVDEYDDDDDDDDDDDEYDVQEE

SEQ ID NO: 594 - protein, 144 aa, Glycine max
  misc_feature (1)..(144): Ceres CLONE ID no. 1074266
  misc_feature: Utility: Useful for delaying flowering time
  misc_feature: Utility: Useful for increasing increasing anthocyanin content
  misc_feature: Utility: Useful for making lethal plants for genetic confinement systems
  misc_feature: Utility: Useful for making ornamental plants with modified leaves
  misc_feature: Utility: Useful for making plants with increased biomass and foliage
  misc_feature: Utility: Useful for making smaller plants
  misc_feature: Utility: Useful for making stronger plants
MPPYDCMFLFKPHIRKEAVMDLVVRVGKHVCRRNGVVIDIKSLGRVQLGYGVKKLDGRYYQGLLMQMSMMATPEINKELHYLNKEDRLLRWLLVKQRNTKFGLDSYGDEGRYELSKFSQIGKHGDEDEDEDDEEYEVNEEETVN

SEQ ID NO: 595 - protein, 146 aa, Glycine max
  misc_feature (1)..(146): Public GI no. 34904072
  misc_feature: Utility: Useful for delaying flowering time
  misc_feature: Utility: Useful for increasing increasing anthocyanin content
  misc_feature: Utility: Useful for making lethal plants for genetic confinement systems
  misc_feature: Utility: Useful for making ornamental plants with modified leaves
  misc_feature: Utility: Useful for making plants with increased biomass and foliage
  misc_feature: Utility: Useful for making smaller plants
  misc_feature: Utility: Useful for making stronger plants
MPLYDCMLLVKPLVTREAMAELVGRVARRAYQRNGVVTDVKSFGTICLGYGIKKLDGRHFKGQLMQMTMMVPPSFTQELHYLNKEDRLLRWLVVKHRDAVYGVEFINEDDGRREMTDFRYRTKDEASDVDEYDDDDDDYEYEIDEE

SEQ ID NO: 596 - protein, 108 aa, Zea mays
  misc_feature (1)..(108): Ceres CLONE ID no. 894996
  misc_feature: Utility: Useful for delaying flowering time
  misc_feature: Utility: Useful for increasing increasing anthocyanin content
  misc_feature: Utility: Useful for making lethal plants for genetic confinement systems
  misc_feature: Utility: Useful for making ornamental plants with modified leaves
  misc_feature: Utility: Useful for making plants with increased biomass and foliage
  misc_feature: Utility: Useful for making smaller plants
  misc_feature: Utility: Useful for making stronger plants
  misc_feature (103)..(103): Xaa is any aa, unknown, or other
MQMTMMVPPSLPREHSLNKEDRLLRFCWLVVKHRDAVYGLEFVNEDGGRNELSGFSLAHRKDDYDTELASDDEDSDSDSDTTSMRSRRRSRTAWLGFCSLICXGRCFS

SEQ ID NO: 597 - protein, 126 aa, Zea mays
  misc_feature (1)..(126): Ceres CLONE ID no. 1466424
  misc_feature: Utility: Useful for delaying flowering time
  misc_feature: Utility: Useful for increasing increasing anthocyanin content
  misc_feature: Utility: Useful for making lethal plants for genetic confinement systems
  misc_feature: Utility: Useful for making ornamental plants with modified leaves
  misc_feature: Utility: Useful for making plants with increased biomass and foliage
  misc_feature: Utility: Useful for making smaller plants
  misc_feature: Utility: Useful for making stronger plants
  misc_feature (107)..(107): Xaa is any aa, unknown, or other
MQMTMMVPPSLPREHSLNKEDRLLRFCWLVVKHRDAVYGLEFVNEDGGRNELSGFSLAHRKDDYDTELASDDEDSDSDSDTTSMRSRRRSRTAWPGFCSFICVGRCXFWGLIEYVDFFYYYNLVVA

SEQ ID NO: 598 - DNA, 943 bp, Arabidopsis thaliana
  misc_feature (1)..(943): Ceres CLONE ID no. 94231
  misc_feature (1)..(943): Also known as  Ceres CDNA ID no. 23471133
attttttttcataattgtatcaaattgtgagaggaaaaaaagaagttcaagaaatggagaaggaaggactcgggcttgagataacggagctgagattggggcttccggggagagatgtggcagagaagatgatgaagaagagagctttcacggagatgaatatgacgtcgtcgggtagtaatagtgatcaatgtgaaagcggcgtcgtttcatctggtggtgacgctgagaaggttaatgattcgccggcggcgaaaagccaggtggtggggtggccaccggtttgttcttaccggaagaaaaacagctgtaaggaagcttcgaccacgaaagtgggttagggtatgtgaaagtgagcatggatggtgtgccttatttgaggaagatggatcttggttcgagccaaggctatgatgatctagccttttctcttgataagctcttcggtttccgtggcatcggtgtggccttgaaagatggtgacaactgcgaatacgttaccatatacgaagacaaagatggagactggatgctcgccggtgatrmwycttgggggatgtgwtytagagwcatgchwkaggttgagaataatgaaaagatcggatgctaccgggkttgggctgsrgcctagaggagtagacsagtgatgatgacttgaacaagaagcaaggagctggttcattaatttaatcttaaatttgatcatcaagatcctttasaacatttttcctattcatgttatataaatatatatgttatagtatattatttgcaacaaaatttcaagttatggtttgcataattatcttcagaaagacagctatatatatatacactacttgtttcttgagtgttgagttaaaacattaatctgtttcaaaatttattgttatttcggatctatatatgtgtgtagaaacatatgtaataagtatccattatt

SEQ ID NO: 599 - protein, 95 aa, Arabidopsis thaliana
  misc_feature (6)..(90): Pfam Name: AUX_IAA; Pfam Description: AUX/IAA family
  misc_feature: Utility: Useful for delaying flowering time
  misc_feature: Utility: Useful for increasing chlorophyll and photosynthetic capacity
  misc_feature: Utility: Useful for making ornamental plants with modified flowers
  misc_feature: Utility: Useful for making ornamental plants with modified leaves
  misc_feature: Utility: Useful for making plants with altered leaf shape eg curled leaves
  misc_feature: Utility: Useful for making smaller plants
  misc_feature: Utility: Useful for making stronger plants
MEKEGLGLEITELRLGLPGRDVAEKMMKKRAFTEMNMTSSGSNSDQCESGVVSSGGDAEKVNDSPAAKSQVVGWPPVCSYRKKNSCKEASTTKVG

SEQ ID NO: 600 - protein, 42 aa, Arabidopsis thaliana
  misc_feature (1)..(42): Ceres CLONE ID no. 121353
  misc_feature: Utility: Useful for delaying flowering time
  misc_feature: Utility: Useful for increasing chlorophyll and photosynthetic capacity
  misc_feature: Utility: Useful for making ornamental plants with modified flowers
  misc_feature: Utility: Useful for making ornamental plants with modified leaves
  misc_feature: Utility: Useful for making plants with altered leaf shape eg curled leaves
  misc_feature: Utility: Useful for making smaller plants
  misc_feature: Utility: Useful for making stronger plants
MEKEGLGLEITELRLGLPGRDVAEKMMKKMFFVQASTVTEHH

SEQ ID NO: 601 - protein, 172 aa, Brassica napus
  misc_feature (1)..(172): Ceres CLONE ID no. 981738
  misc_feature: Utility: Useful for delaying flowering time
  misc_feature: Utility: Useful for increasing chlorophyll and photosynthetic capacity
  misc_feature: Utility: Useful for making ornamental plants with modified flowers
  misc_feature: Utility: Useful for making ornamental plants with modified leaves
  misc_feature: Utility: Useful for making plants with altered leaf shape eg curled leaves
  misc_feature: Utility: Useful for making smaller plants
  misc_feature: Utility: Useful for making stronger plants
  misc_feature (160)..(160): Xaa is any aa, unknown, or other
  misc_feature (166)..(166): Xaa is any aa, unknown, or other
  misc_feature (168)..(168): Xaa is any aa, unknown, or other
MMKKRGFTEMIMTSSGSHSEQCESSVVSSGVDVEKVNETPAVKTQVVGWPPVCSYRRKNSCKEVSTTKVGLGYVKVSMDGVPYLRKMDLGSSQGYDDLAFALDKLFGFHGIGVALKDGDNCEYVTIYEDKDGDWMLAGDVPWGMFIESCRRVRIMKRSEXTGFGLXPXGLDE

SEQ ID NO: 602 - protein, 133 aa, Glycine max
  misc_feature (1)..(133): Ceres CLONE ID no. 707989
  misc_feature: Utility: Useful for delaying flowering time
  misc_feature: Utility: Useful for increasing chlorophyll and photosynthetic capacity
  misc_feature: Utility: Useful for making ornamental plants with modified flowers
  misc_feature: Utility: Useful for making ornamental plants with modified leaves
  misc_feature: Utility: Useful for making plants with altered leaf shape eg curled leaves
  misc_feature: Utility: Useful for making smaller plants
  misc_feature: Utility: Useful for making stronger plants
MAKEGLGLEITELRLGLPDAEHVTVVNKNEKKRAFSQIDDENSSSGGDRKIKTNKSQVVGWPPVCSYRKKNSMNEGSKMYVKVSMDGAPFLRKIDLGLHKGYSDLALALDKLFGSYGMVEALKNADNSEHVPF

SEQ ID NO: 603 - protein, 194 aa, Glycine max
  misc_feature (1)..(194): Public GI no. 416640
  misc_feature: Utility: Useful for delaying flowering time
  misc_feature: Utility: Useful for increasing chlorophyll and photosynthetic capacity
  misc_feature: Utility: Useful for making ornamental plants with modified flowers
  misc_feature: Utility: Useful for making ornamental plants with modified leaves
  misc_feature: Utility: Useful for making plants with altered leaf shape eg curled leaves
  misc_feature: Utility: Useful for making smaller plants
  misc_feature: Utility: Useful for making stronger plants
MAKEGLGLEITELRLGLPDAEHVAVANKNGEKKNKRVFSEIDDVGDENSSSGGGGDRKMENKNQVVGWPPVCSYRKKNSVNEASKMYVKVSMDGAPFLRKMDLGMHKGYSDLAFALEKLFGCYGMVEALKNVENGEHVPIYEDKDGDWMLVGDVPWEMFMESCKRLRIMKRADAKGFGLQPKGSLKGFIESVGK

SEQ ID NO: 604 - protein, 195 aa, Glycine max
  misc_feature (1)..(195): Ceres CLONE ID no. 471171
  misc_feature: Utility: Useful for delaying flowering time
  misc_feature: Utility: Useful for increasing chlorophyll and photosynthetic capacity
  misc_feature: Utility: Useful for making ornamental plants with modified flowers
  misc_feature: Utility: Useful for making ornamental plants with modified leaves
  misc_feature: Utility: Useful for making plants with altered leaf shape eg curled leaves
  misc_feature: Utility: Useful for making smaller plants
  misc_feature: Utility: Useful for making stronger plants
MAKEGLGLEITELRLGLPDAEHQVSVVNKKNEKKRAFSEIDDGVGDENSSSGGGDRKMETNKSQVVGWPPVCSYRKKNSMNEGASKMYVKVSMDGAPFLRKIDLGLHKGYSDLALALDKLFGCYGMVEALKNADNSEHVPIYEDKDGDWMLVGDVPWEMFMESCKRLRIMKKSDAKGFGLQPKGSLKGFIESAAK

SEQ ID NO: 605 - protein, 195 aa, Glycine max; identical to SEQ ID NO: 604
  misc_feature (1)..(195): Public GI no. 114733
  misc_feature: Utility: Useful for delaying flowering time
  misc_feature: Utility: Useful for increasing chlorophyll and photosynthetic capacity
  misc_feature: Utility: Useful for making ornamental plants with modified flowers
  misc_feature: Utility: Useful for making ornamental plants with modified leaves
  misc_feature: Utility: Useful for making plants with altered leaf shape eg curled leaves
  misc_feature: Utility: Useful for making smaller plants
  misc_feature: Utility: Useful for making stronger plants

SEQ ID NO: 606 - protein, 189 aa, Glycine max
  misc_feature (1)..(189): Ceres CLONE ID no. 612705
  misc_feature: Utility: Useful for delaying flowering time
  misc_feature: Utility: Useful for increasing chlorophyll and photosynthetic capacity
  misc_feature: Utility: Useful for making ornamental plants with modified flowers
  misc_feature: Utility: Useful for making ornamental plants with modified leaves
  misc_feature: Utility: Useful for making plants with altered leaf shape eg curled leaves
  misc_feature: Utility: Useful for making smaller plants
  misc_feature: Utility: Useful for making stronger plants
MEKEAVGLEITTELRLGLPGGELPDKNEKIKKRVFSEIQAHDDDENSSSEQDRKIQTKNQVVGWPPVCSYRKKNTVNETKMYVKVSMDGAPFLRKIDLAMHKGYSELVLALEKFFGCYGIREALKDAENAEHVPIYEDKDGDWMLVGDVPWEMFIESCKRLRIMKRSDAKGFDLQPKGSLKGFIEGVTK

SEQ ID NO: 607 - protein, 179 aa, Glycine max
  misc_feature (1)..(179): Public GI no. 414178
  misc_feature: Utility: Useful for delaying flowering time
  misc_feature: Utility: Useful for increasing chlorophyll and photosynthetic capacity
  misc_feature: Utility: Useful for making ornamental plants with modified flowers
  misc_feature: Utility: Useful for making ornamental plants with modified leaves
  misc_feature: Utility: Useful for making plants with altered leaf shape eg curled leaves
  misc_feature: Utility: Useful for making smaller plants
  misc_feature: Utility: Useful for making stronger plants
MAREGLGLEITELRLGLSCGEPKKNEKKRMFSEIDGGVEENGGSGDRKSVDKKNQVVGWPPVCSYRKKNMNEGSKMYMKVSMDGAPYLRKIDLCLHKGYLELALALEKLFDCCGIEEALKDAENCEHVPIYEDKDGDWMLVGDVPWEMFIESCKRLRIMKRSDAKGFDLQPKGSLKRFI

SEQ ID NO: 608 - protein, 195 aa, Glycine max
  misc_feature (1)..(195): Public GI no. 4887018
  misc_feature: Utility: Useful for delaying flowering time
  misc_feature: Utility: Useful for increasing chlorophyll and photosynthetic capacity
  misc_feature: Utility: Useful for making ornamental plants with modified flowers
  misc_feature: Utility: Useful for making ornamental plants with modified leaves
  misc_feature: Utility: Useful for making plants with altered leaf shape eg curled leaves
  misc_feature: Utility: Useful for making smaller plants
  misc_feature: Utility: Useful for making stronger plants
MERTATYEKDLNLKATELRLGLPGIDEPEKQSSSASTSAKYSKKRTSSEMDNSSSGKENEQDSAPAPKAQVVGWPPVRSYRKNVLQIKKSESDNSSGMYLKVSMDGGTYLRKIDLKVYNSYPELLKALQNMFKCTIGVYTEREGYNGSDYAPTYEDKDGDWMLVGDVPWDMFLNSCRRLRIMKGSEAKGLHAYRL

SEQ ID NO: 609 - protein, 202 aa, Glycine max
  misc_feature (1)..(202): Public GI no. 4887016
  misc_feature: Utility: Useful for delaying flowering time
  misc_feature: Utility: Useful for increasing chlorophyll and photosynthetic capacity
  misc_feature: Utility: Useful for making ornamental plants with modified flowers
  misc_feature: Utility: Useful for making ornamental plants with modified leaves
  misc_feature: Utility: Useful for making plants with altered leaf shape eg curled leaves
  misc_feature: Utility: Useful for making smaller plants
  misc_feature: Utility: Useful for making stronger plants
MERTATYEKDLNLEATELRLGLPGINEPEKQSSSASTSAKYSKKRTSSEMDNSSSGKENEQDSAPAPKAQVVGWPPVRSYRKNVLQVKKSESDNSSGMYLKVSMDGGTYLRKIDLKVYKSYPELLKALQNMFKCTIGVYTEREGYNGSEYAPTYEDKDRDWMLVGDVPWDMFINSCRRLRIMKGSEAKGLHAYRLWTYRPSN

SEQ ID NO: 610 - protein, 208 aa, Glycine max
  misc_feature (1)..(208): Public GI no. 22531416
  misc_feature: Utility: Useful for delaying flowering time
  misc_feature: Utility: Useful for increasing chlorophyll and photosynthetic capacity
  misc_feature: Utility: Useful for making ornamental plants with modified flowers
  misc_feature: Utility: Useful for making ornamental plants with modified leaves
  misc_feature: Utility: Useful for making plants with altered leaf shape eg curled leaves
  misc_feature: Utility: Useful for making smaller plants
  misc_feature: Utility: Useful for making stronger plants
MSSENGKRLLETDAGGLNFEATELTLGLPGEPRVTSDGGAKLGSKRGFSETVDLKLGDNNQEVKLGHSLQEAAKSPVSKTQVVGWPPVRGFAKRGKKSCKYVKVAVDGAPYLRKVDLEIYNSYQQLLTSLEDMFSCFTIRNYLNEKKIDQVNGIEYMPTYEDKDGDWMLVGDVPWQMFVESCKRLRLMKSSEAVGLGLKTAPKYSSTN

SEQ ID NO: 611 - DNA, 815 bp, Arabidopsis thaliana
  misc_feature (1)..(815): Ceres CLONE ID no. 95135
  misc_feature (1)..(815): Also known as  Ceres CDNA ID no. 23386334
agaatcagccgacgtttcctcttcaccactttcctctgtttctctgtttcgctctctctacaaaatttctccatgaacatacttaacaagctaggtataggatcaagtagacaaaccaacatggatccttctccaatcgcacaagtaatcgacgacgaagctccggcgccgggaaaccagtttgctcaattcggcgccggttgtttctggagcgtggaattagcgtaccagagagttccaggagtgactcaaacagaggttggttattctcaagggatcactcacgatccttcttacaaagatgtttgttcaggtaccacgaatcatgccgagattgttcgtgttcaatatgatccaaaagagtgtagttaccagtcgctgcttgatttgttctggtctaagcatgatcccaccactttgaatcggcagggaaatgatgtgggaacccaataccgttcagggatatatttctacaacccggagcaagagaaactagcacgcgagtcactggagcggcaccagcaacaagttgacaggaaggttgtgacagagatcttaccggctaagaaattttatagagctgaggaacatcaccagcaatacttgtctaaatgagggaggtttggtcttaagcaatcaacggaaaaaggctgcaacgacccaatccgctgctacgggtaaaagccttgcttctaaccgaaagcagaggatgcttccacttatctatgatagattatagcaattatcgttgaaaaataaagaagccgaggctacttatgtaacttgttcttgttcataaaactttttaagtgttc

SEQ ID NO: 612 - protein, 180 aa, Arabidopsis thaliana
  misc_feature (36)..(180): Pfam Name: PMSR; Pfam Description: Peptide methionine sulfoxide reductase
  misc_feature: Utility: Useful for delaying flowering time
  misc_feature: Utility: Useful for increasing chlorophyll and photosynthetic capacity
  misc_feature: Utility: Useful for making larger plants
  misc_feature: Utility: Useful for making ornamental plants with modified leaves
  misc_feature: Utility: Useful for making plants with increased biomass
  misc_feature: Utility: Useful for making plants with increased biomass and foliage
  misc_feature: Utility: Useful for making smaller plants
MNILNKLGIGSSRQTNMDPSPIAQVIDDEAPAPGNQFAQFGAGCFWSVELAYQRVPGVTQTEVGYSQGITHDPSYKDVCSGTTNHAEIVRVQYDPKECSYQSLLDLFWSKHDPTTLNRQGNDVGTQYRSGIYFYNPEQEKLARESLERHQQQVDRKVVTEILPAKKFYRAEEHHQQYLSK

SEQ ID NO: 613 - protein, 202 aa, Arabidopsis thaliana
  misc_feature (1)..(202): Public GI no. 38260672
  misc_feature: Utility: Useful for delaying flowering time
  misc_feature: Utility: Useful for increasing chlorophyll and photosynthetic capacity
  misc_feature: Utility: Useful for making larger plants
  misc_feature: Utility: Useful for making ornamental plants with modified leaves
  misc_feature: Utility: Useful for making plants with increased biomass
  misc_feature: Utility: Useful for making plants with increased biomass and foliage
  misc_feature: Utility: Useful for making smaller plants
MNILNRLGLGSSGQTNMNPSPIAQGNDGDAPSPGNQFAQFGAGCFWGVELAFQRVPGVTQTEVGYTQGIVDKPSYEDVCSGTTGHAEVVRVQYDLNDCSYESLLDLFWSRHDPTTLNRQGNDVGTQYRSGIYFYTPEQEKLARESLERHQQQMERKIMTEILPAKKFYRAEEHHQQYLSKGGRFGLGQSTAKGCNDPIRCYG

SEQ ID NO: 614 - protein, 202 aa, Arabidopsis thaliana
  misc_feature (1)..(202): Ceres CLONE ID no. 31014
  misc_feature: Utility: Useful for delaying flowering time
  misc_feature: Utility: Useful for increasing chlorophyll and photosynthetic capacity
  misc_feature: Utility: Useful for making larger plants
  misc_feature: Utility: Useful for making ornamental plants with modified leaves
  misc_feature: Utility: Useful for making plants with increased biomass
  misc_feature: Utility: Useful for making plants with increased biomass and foliage
  misc_feature: Utility: Useful for making smaller plants
MNILNRLGLGSSGQTNMDPSPIAQGNDDDTPAPGNQFAQFGAGCFWGVELAFQRVPGVTQTEAGYTQGTVHNPSYGDVCSGTTGHSEVVRVQYDLNDCTYESLLDLFWSRHDPTTLNRQGNDVGTQYRSGIYFYTPEQEKLARESLERHQQQMERKIMTEILPAKKFYRAEEHHQQYLSKGGRFGQGQSTAKGCNDPIRCYG

SEQ ID NO: 615 - protein, 202 aa, Arabidopsis thaliana
  misc_feature (1)..(202): Public GI no. 38260657
  misc_feature: Utility: Useful for delaying flowering time
  misc_feature: Utility: Useful for increasing chlorophyll and photosynthetic capacity
  misc_feature: Utility: Useful for making larger plants
  misc_feature: Utility: Useful for making ornamental plants with modified leaves
  misc_feature: Utility: Useful for making plants with increased biomass
  misc_feature: Utility: Useful for making plants with increased biomass and foliage
  misc_feature: Utility: Useful for making smaller plants
MNILNRLGLGSSGQSNMDPSPIAQGNDDDAPSPGNQFAQFGAGCFWGVELAFQRVPGVTQTEVGYTQGIIDNPSYEDVCSGTTNHSEVVRVQYDPNDCSYETLLDMFWSRHDPTTLNRQGNDVGTQYRSGIYFYTPEQEKLAHESLERHQQQMERKIMTEILPAKKFYRAEEHHQQYLSKGGRFGLGQSTAKGCNDPIRCYG

SEQ ID NO: 616 - protein, 202 aa, Arabidopsis thaliana; identical to SEQ ID NO: 614
  misc_feature (1)..(202): Public GI no. 21592658
  misc_feature: Utility: Useful for delaying flowering time
  misc_feature: Utility: Useful for increasing chlorophyll and photosynthetic capacity
  misc_feature: Utility: Useful for making larger plants
  misc_feature: Utility: Useful for making ornamental plants with modified leaves
  misc_feature: Utility: Useful for making plants with increased biomass
  misc_feature: Utility: Useful for making plants with increased biomass and foliage
  misc_feature: Utility: Useful for making smaller plants

SEQ ID NO: 617 - protein, 202 aa, Arabidopsis thaliana
  misc_feature (1)..(202): Public GI no. 38260639
  misc_feature: Utility: Useful for delaying flowering time
  misc_feature: Utility: Useful for increasing chlorophyll and photosynthetic capacity
  misc_feature: Utility: Useful for making larger plants
  misc_feature: Utility: Useful for making ornamental plants with modified leaves
  misc_feature: Utility: Useful for making plants with increased biomass
  misc_feature: Utility: Useful for making plants with increased biomass and foliage
  misc_feature: Utility: Useful for making smaller plants
MNILNRLGLGSSGQSNMDPSPIAQGKDDDAPSPGNQFAQFGAGCFWGVELAYQRVPGVTQTEVGYTQGIVHNPSYEDICKGTTNHTEVVRVQYDPNDCSYESLLDLFWSRHDPTTLNRQGNDVGTQYRSGIYFYTPEQEKLARASLERHQEQLDRKIMSEILPAKKFYRAEDHQQQYLSKGGRFGLGQSTAKGCNDPIRCYG

SEQ ID NO: 618 - protein, 202 aa, Arabidopsis thaliana
  misc_feature (1)..(202): Public GI no. 7576185
  misc_feature: Utility: Useful for delaying flowering time
  misc_feature: Utility: Useful for increasing chlorophyll and photosynthetic capacity
  misc_feature: Utility: Useful for making larger plants
  misc_feature: Utility: Useful for making ornamental plants with modified leaves
  misc_feature: Utility: Useful for making plants with increased biomass
  misc_feature: Utility: Useful for making plants with increased biomass and foliage
  misc_feature: Utility: Useful for making smaller plants
MNILNRLGLGSSGQTNMDPSPIAQGNDDDTPAPGNQFAQFGAGCFWGVELAFQRVPGVTQTEAGYTQGTVDNPSYGDVCSGTTGHSEVVRVQYDLNDCTYESLLDLFWSRHDPTTLNRQGNDVGTQYRSGIYFYTPEQEKLARESLERHQQQMERKIMTEILPAKKFYRAEEHHQQYLSKGGRFGQGQSTAKGCNDPIRCYG

SEQ ID NO: 619 - protein, 204 aa, Arabidopsis thaliana
  misc_feature (1)..(204): Public GI no. 4884035
  misc_feature: Utility: Useful for delaying flowering time
  misc_feature: Utility: Useful for increasing chlorophyll and photosynthetic capacity
  misc_feature: Utility: Useful for making larger plants
  misc_feature: Utility: Useful for making ornamental plants with modified leaves
  misc_feature: Utility: Useful for making plants with increased biomass
  misc_feature: Utility: Useful for making plants with increased biomass and foliage
  misc_feature: Utility: Useful for making smaller plants
MNILNRLGLGSSGQTNMDPSPIAQGNDDDTPAPGNQFAQFGAGCFWGVELAFQRVPGVTQTEAGYTQGTVDNPSYGDVCSGTTGHSEVVRVQYDLNDCTYESLLDLFWSRHDPTTLNRQVNDVGTHYRSGIYFYTPEQEKLARESLERHQHQQQMERKIMTEILPAKKFYRAEEHHQQYLSKGGRFGQGQSTAKGCNDPIRCYG

SEQ ID NO: 620 - protein, 202 aa, Arabidopsis thaliana
  misc_feature (1)..(202): Public GI no. 38196010
  misc_feature: Utility: Useful for delaying flowering time
  misc_feature: Utility: Useful for increasing chlorophyll and photosynthetic capacity
  misc_feature: Utility: Useful for making larger plants
  misc_feature: Utility: Useful for making ornamental plants with modified leaves
  misc_feature: Utility: Useful for making plants with increased biomass
  misc_feature: Utility: Useful for making plants with increased biomass and foliage
  misc_feature: Utility: Useful for making smaller plants
MNILNRFGLGSGGQTSTDPSPIAQGPDDDSPAPGNHFAQFAAGCFWGVELAFQRLPGVTQTEVGYAQGITHNPSYEDVCSETTGHAEVVRVQYDPKGCTFESLLDLFWSRHDPTTLNRQGNDVGTRYRSGIYFYTPEQEKLARESLERHQQRMERKIMTQILPAKKFYRAEEQQQQYLSKGGRYGMGQSCAKGCTDPIRCYG

SEQ ID NO: 621 - protein, 202 aa, Brassica napus
  misc_feature (1)..(202): Ceres CLONE ID no. 958836
  misc_feature: Utility: Useful for delaying flowering time
  misc_feature: Utility: Useful for increasing chlorophyll and photosynthetic capacity
  misc_feature: Utility: Useful for making larger plants
  misc_feature: Utility: Useful for making ornamental plants with modified leaves
  misc_feature: Utility: Useful for making plants with increased biomass
  misc_feature: Utility: Useful for making plants with increased biomass and foliage
  misc_feature: Utility: Useful for making smaller plants
  misc_feature (133)..(133): Xaa is any aa, unknown, or other
  misc_feature (135)..(135): Xaa is any aa, unknown, or other
  misc_feature (161)..(161): Xaa is any aa, unknown, or other
  misc_feature (166)..(166): Xaa is any aa, unknown, or other
  misc_feature (167)..(167): Xaa is any aa, unknown, or other
  misc_feature (178)..(178): Xaa is any aa, unknown, or other
  misc_feature (202)..(202): Xaa is any aa, unknown, or other
MNILNRFGLGSGGQTSTDPSPIAQGSDDDSPAPGNHFAQFAAGCFWGVELAFQRLPGVTQTEVGYTQGITHNPSYEDVCSETTRHAEVVRVQYDPKGCTFESLLDLFWSRHDPTTLNRQGNDVGTRYRSGIYXYXPEQEKLARESLERHQQRMERKIMTEXLPAKXXYRAEEQQQQYXSKGGRYGMGQSCAKGCTDPIRCYX

SEQ ID NO: 622 - protein, 202 aa, Glycine max
  misc_feature (1)..(202): Ceres CLONE ID no. 463936
  misc_feature: Utility: Useful for delaying flowering time
  misc_feature: Utility: Useful for increasing chlorophyll and photosynthetic capacity
  misc_feature: Utility: Useful for making larger plants
  misc_feature: Utility: Useful for making ornamental plants with modified leaves
  misc_feature: Utility: Useful for making plants with increased biomass
  misc_feature: Utility: Useful for making plants with increased biomass and foliage
  misc_feature: Utility: Useful for making smaller plants
MNLLNRLGFGSARAPENMDSSIPQGPDDDIPAPGQQFAEFGAGCFWGVELAFQRVPGVTKTEVGYTQGLVHNPTYEDVCTGTTNHSEVVRVQYDPKICSYETLLDVFWARHDPTTLNRQGNDVGTQYRSGIYYYTPEQEKAAKESLEQQQKQLNRKIVTEILPAKKFYRAEEYHQQYLEKGGRSGFKQSASKGCNDPIRCYG

SEQ ID NO: 623 - DNA, 515 bp, Arabidopsis thaliana
  misc_feature (1)..(515): Ceres CLONE ID no. 97434
  misc_feature (1)..(515): Also known as  Ceres CDNA ID no. 23462257
attttcgttttcactttctccgaacatccaaaagcttgtagcttgctcctcaaatcttcttgaaaaatgaaggttgccgctgctttcctcctcgccgttttgggcggaaacgctaatccttcagccgagaatatcaaagatatcatcggagctgttggtgctgatgttgatggagagagcattgagcttctattgaaagaagtgagtggtaaggacattgctgagctgattgcttctggtagggagaaattagcgtctgtgccatctggtggtggtgtggctgtttcagctgctccatcaagcggtggtggtggtgctgctgctgctgcccctgcggagaagaaagaagccaagaaggaagagaaagaagagtctgatgatgacatgggattcagtctcttcgagtaaggtttttgtccccacggaaaggagtcgagatttgattttttgttctcttagtggttctggtttttgctcctctttgtaaccttggtctagttagcgggttttttatt

SEQ ID NO: 624 - protein, 113 aa, Arabidopsis thaliana
  misc_feature (17)..(112): Pfam Name: Ribosomal_60s; Pfam Description: 60s Acidic ribosomal protein
  misc_feature: Utility: Useful for delaying flowering time
  misc_feature: Utility: Useful for making larger plants
  misc_feature: Utility: Useful for making ornamental plants with modified flowers
  misc_feature: Utility: Useful for making ornamental plants with modified leaves
  misc_feature: Utility: Useful for making plants with increased biomass and foliage
  misc_feature: Utility: Useful for making smaller plants
MKVAAAFLLAVLGGNANPSAENIKDIIGAVGADVDGESIELLLKEVSGKDIAELIASGREKLASVPSGGGVAVSAAPSSGGGGAAAAAPAEKKEAKKEEKEESDDDMGFSLFE

SEQ ID NO: 625 - protein, 139 aa, Brassica napus
  misc_feature (1)..(139): Ceres CLONE ID no. 953928
  misc_feature: Utility: Useful for delaying flowering time
  misc_feature: Utility: Useful for making larger plants
  misc_feature: Utility: Useful for making ornamental plants with modified flowers
  misc_feature: Utility: Useful for making ornamental plants with modified leaves
  misc_feature: Utility: Useful for making plants with increased biomass and foliage
  misc_feature: Utility: Useful for making smaller plants
FFHCLSSETLFSFPPPPARSPSTSAKMKVVAAFLLAVLSGKACPTSADIKVILNSVGCETEDSQIELLLKEVNGKDVAELIAVGREKLASVPSGGGGVAMASAPSAGGGGGAAPAEDKKEEKKEEKEESDDDMGFSLFE

SEQ ID NO: 626 - protein, 114 aa, Glycine max
  misc_feature (1)..(114): Ceres CLONE ID no. 524682
  misc_feature: Utility: Useful for delaying flowering time
  misc_feature: Utility: Useful for making larger plants
  misc_feature: Utility: Useful for making ornamental plants with modified flowers
  misc_feature: Utility: Useful for making ornamental plants with modified leaves
  misc_feature: Utility: Useful for making plants with increased biomass and foliage
  misc_feature: Utility: Useful for making smaller plants
MKVVAAYLLAVLGGNNSPSADVIKEILGSVGVEADEDRIESFLSEVKGKDIVELIAAGREKLATVPSGCGGAVAVAAAPGGGAAAAAPAAEAKKEEKVEEKEESDDDMGFSLFD

SEQ ID NO: 627 - protein, 114 aa, Brassica napus
  misc_feature (1)..(114): Ceres CLONE ID no. 949174
  misc_feature: Utility: Useful for delaying flowering time
  misc_feature: Utility: Useful for making larger plants
  misc_feature: Utility: Useful for making ornamental plants with modified flowers
  misc_feature: Utility: Useful for making ornamental plants with modified leaves
  misc_feature: Utility: Useful for making plants with increased biomass and foliage
  misc_feature: Utility: Useful for making smaller plants
MKVVAAFLLAVLSGKASPTSADIKDILGSVGAETEDAQIELLLKEVKGKDCAELIALGREKLASVPCGGGGVAMASAPSAGGGGGAAPAEEAKKEEKKEEKEESDDDMGFSLFE

SEQ ID NO: 628 - protein, 114 aa, Brassica napus
  misc_feature (1)..(114): Ceres CLONE ID no. 1299820
  misc_feature: Utility: Useful for delaying flowering time
  misc_feature: Utility: Useful for making larger plants
  misc_feature: Utility: Useful for making ornamental plants with modified flowers
  misc_feature: Utility: Useful for making ornamental plants with modified leaves
  misc_feature: Utility: Useful for making plants with increased biomass and foliage
  misc_feature: Utility: Useful for making smaller plants
MKVVAAFLLAVLSGKASPTSADIKDILGSVGAETEDAQIEILLKEVKGKDCAELIAVGREKLASVPCGGGGVAMASAPSAGGGGGAAPAAEAKKEEKKEEKEESDDDMGFSLFE

SEQ ID NO: 629 - protein, 114 aa, Brassica napus
  misc_feature (1)..(114): Public GI no. 42565379
  misc_feature: Utility: Useful for delaying flowering time
  misc_feature: Utility: Useful for making larger plants
  misc_feature: Utility: Useful for making ornamental plants with modified flowers
  misc_feature: Utility: Useful for making ornamental plants with modified leaves
  misc_feature: Utility: Useful for making plants with increased biomass and foliage
  misc_feature: Utility: Useful for making smaller plants
MKVVAAYLLAVLGGNTTPSAEVIKDILGSVGADAEDDRIELLLSEVKGKDITELIASGREKFASVPSGGAAIAVSAPAAGGGAAPAAAAAETKKEEKVEEKEESDEDMGFSLFD

SEQ ID NO: 630 - protein, 138 aa, Brassica napus
  misc_feature (1)..(138): Ceres CLONE ID no. 1098019
  misc_feature: Utility: Useful for delaying flowering time
  misc_feature: Utility: Useful for making larger plants
  misc_feature: Utility: Useful for making ornamental plants with modified flowers
  misc_feature: Utility: Useful for making ornamental plants with modified leaves
  misc_feature: Utility: Useful for making plants with increased biomass and foliage
  misc_feature: Utility: Useful for making smaller plants
  misc_feature (4)..(4): Xaa is any aa, unknown, or other
  misc_feature (10)..(10): Xaa is any aa, unknown, or other
  misc_feature (28)..(28): Xaa is any aa, unknown, or other
  misc_feature (29)..(29): Xaa is any aa, unknown, or other
  misc_feature (72)..(72): Xaa is any aa, unknown, or other
  misc_feature (81)..(81): Xaa is any aa, unknown, or other
SFHXRLHKHXSFPPPPARSPSTSAKMKXXAAFLLAVLSGKACPTSADIKVILNSVGCETEDSQIELLLKEVXGKDVAELIXVGREKLASVPSGGGGVAMASAPSAGGGGGAAPAEAKKEEKKEEKEESDDDMGFSLFE

SEQ ID NO: 631 - protein, 135 aa, Glycine max
  misc_feature (1)..(135): Ceres CLONE ID no. 691062
  misc_feature: Utility: Useful for delaying flowering time
  misc_feature: Utility: Useful for making larger plants
  misc_feature: Utility: Useful for making ornamental plants with modified flowers
  misc_feature: Utility: Useful for making ornamental plants with modified leaves
  misc_feature: Utility: Useful for making plants with increased biomass and foliage
  misc_feature: Utility: Useful for making smaller plants
TRPSKSPFVFFSFASSLSLRKMKVVAAYLLAVLGGNNSPSADVIKEILGSVGVEADEDRIESFLSEVKGKDIVELIAAGREKLASVPSGGGGAVAVAAAPGGGAAAAAPAAEAKKEEKVEEKEESDDDMGFSLSD

SEQ ID NO: 632 - protein, 114 aa, Glycine max
  misc_feature (1)..(114): Public GI no. 47026878
  misc_feature: Utility: Useful for delaying flowering time
  misc_feature: Utility: Useful for making larger plants
  misc_feature: Utility: Useful for making ornamental plants with modified flowers
  misc_feature: Utility: Useful for making ornamental plants with modified leaves
  misc_feature: Utility: Useful for making plants with increased biomass and foliage
  misc_feature: Utility: Useful for making smaller plants
MKVVAAYLLAVLGGNTTPSAEVIKDILGSVGAEAEDDRILLLLSEVKGKDITELIASGREKFASVPSGGAAIAVSAPAAGGGAAPAAAAAETKKEEKVEEKEESDEDMGFSLFD

SEQ ID NO: 633 - protein, 134 aa, Glycine max
  misc_feature (1)..(134): Ceres CLONE ID no. 1120463
  misc_feature: Utility: Useful for delaying flowering time
  misc_feature: Utility: Useful for making larger plants
  misc_feature: Utility: Useful for making ornamental plants with modified flowers
  misc_feature: Utility: Useful for making ornamental plants with modified leaves
  misc_feature: Utility: Useful for making plants with increased biomass and foliage
  misc_feature: Utility: Useful for making smaller plants
  misc_feature (134)..(134): Xaa is any aa, unknown, or other
LPSPSPSLHSQFCHILTFRRKMKVIAAYLLAVLGGNAAPSADDLRDILGSVGADANDDNISNFLSEVKGKDIVELIASGREKLASVPSGGGAAVAVAAAPGGGPAAPAAAESKKEEKVEEKEESDDDMGFSLFX

SEQ ID NO: 634 - protein, 113 aa, Glycine max
  misc_feature (1)..(113): Public GI no. 24473796
  misc_feature: Utility: Useful for delaying flowering time
  misc_feature: Utility: Useful for making larger plants
  misc_feature: Utility: Useful for making ornamental plants with modified flowers
  misc_feature: Utility: Useful for making ornamental plants with modified leaves
  misc_feature: Utility: Useful for making plants with increased biomass and foliage
  misc_feature: Utility: Useful for making smaller plants
MKVVAAYLLAVLGGNTTPSAEDLKDILGSVGAETDDDRIQLLLSEVKGKDITELIASGREKLASVPSGGGAVAVAAPGAGAGAAAPAAAEPKKEEKVEEKEDTDDDMGFSLFD

SEQ ID NO: 635 - protein, 132 aa, Glycine max
  misc_feature (1)..(132): Ceres CLONE ID no. 708265
  misc_feature: Utility: Useful for delaying flowering time
  misc_feature: Utility: Useful for making larger plants
  misc_feature: Utility: Useful for making ornamental plants with modified flowers
  misc_feature: Utility: Useful for making ornamental plants with modified leaves
  misc_feature: Utility: Useful for making plants with increased biomass and foliage
  misc_feature: Utility: Useful for making smaller plants
TFTSLSDRSFCHTLTFRCKMKVIAAYLLAVLGGNAAPSADDLRTILGSVGADANDDNISNFLSEVKGKDIAELIAAGREKLASVPSGGGAAVSVAAAPGGGAAAPAAAESKKEEKVEEKEESDDDMGFSLFD

SEQ ID NO: 636 - protein, 134 aa, Glycine max
  misc_feature (1)..(134): Ceres CLONE ID no. 475895
  misc_feature: Utility: Useful for delaying flowering time
  misc_feature: Utility: Useful for making larger plants
  misc_feature: Utility: Useful for making ornamental plants with modified flowers
  misc_feature: Utility: Useful for making ornamental plants with modified leaves
  misc_feature: Utility: Useful for making plants with increased biomass and foliage
  misc_feature: Utility: Useful for making smaller plants
SFTFTSLSDRSFCHTLTFRCKMKVIAAYLLAVLGGNAAPSADDLRTILGSVGADANDDNISNFLSEVKGKDIAELIAAGREKLASVPSGGGAAVSVAAAPGGGAAAPAAAESKKEEKVEEKEESDDDMGFSLFD

SEQ ID NO: 637 - protein, 113 aa, Zea mays
  misc_feature (1)..(113): Ceres CLONE ID no. 415601
  misc_feature: Utility: Useful for delaying flowering time
  misc_feature: Utility: Useful for making larger plants
  misc_feature: Utility: Useful for making ornamental plants with modified flowers
  misc_feature: Utility: Useful for making ornamental plants with modified leaves
  misc_feature: Utility: Useful for making plants with increased biomass and foliage
  misc_feature: Utility: Useful for making smaller plants
MKFVAAYLLAVLAGNSSPSAEDLTSILESVGCEVDNEKMELLLSQLSGKDITELIAAGREKFASVPCGGGGVAVAAAAPAAGGGGAPAAEAKKEEKVEEKEESDDDMGFSLFD

SEQ ID NO: 638 - protein, 114 aa, Zea mays
  misc_feature (1)..(114): Public GI no. 551267
  misc_feature: Utility: Useful for delaying flowering time
  misc_feature: Utility: Useful for making larger plants
  misc_feature: Utility: Useful for making ornamental plants with modified flowers
  misc_feature: Utility: Useful for making ornamental plants with modified leaves
  misc_feature: Utility: Useful for making plants with increased biomass and foliage
  misc_feature: Utility: Useful for making smaller plants
MKVIAAFLLALLGGNTSPTDEDLKSILASVGADADDDKIELLLSQVKGKDITELIASGRERLASVPSGGGVAVAAAAGGGGGDAPAAAAEEPKKEEKSEEESDEELGFSLFDDN

SEQ ID NO: 639 - protein, 144 aa, Brassica napus
  misc_feature (1)..(144): Ceres CLONE ID no. 1117460
  misc_feature: Utility: Useful for delaying flowering time
  misc_feature: Utility: Useful for making larger plants
  misc_feature: Utility: Useful for making ornamental plants with modified flowers
  misc_feature: Utility: Useful for making ornamental plants with modified leaves
  misc_feature: Utility: Useful for making plants with increased biomass and foliage
  misc_feature: Utility: Useful for making smaller plants
  misc_feature (6)..(6): Xaa is any aa, unknown, or other
  misc_feature (32)..(32): Xaa is any aa, unknown, or other
  misc_feature (143)..(143): Xaa is any aa, unknown, or other
INQIPXFACSSPSSQKTISFTPPSRSPPTKMXVVAAYLLAALSGKASPTSADIKQILGSVGCESEDSQIELLLKEVSGKDLCDLIATGREKLASVPSGGGGVAMASAPSAGGGGGGSPAAEAKKEEKKEEKEESDDDMGLSLXE

SEQ ID NO: 640 - DNA, 512 bp, Arabidopsis thaliana
  misc_feature (1)..(512): Ceres CLONE ID no. 97480
  misc_feature (1)..(512): Also known as  Ceres CDNA ID no. 23380395
atcaactctattctgaaccaatttgatttccgttttttgcagatctttagggtttttgtttagggatttatcgaagactctgctctatcatgtctggaagaaaagaaacggttttagatttggccaagtttgtagataagggtgtgcaagttaagctcactggtggtagacaagtgactggaactcttaaaggctatgaccaattgcttaatcttgttcttgatgaagcagtcgagtttgttcgagatcatgatgatcctttgaagactacggatcagacaagacgccttggtttgattgtttgccgtggaaccggtgatgcttgtctcaccaaccgatggcaccgaagaaatcgctaacccgttcgttacagcagaggctgtctaaaagactttcttctcaaacaatatgtctctctattagtttaacttggcgatttagagagtattttatctaactctctggtgtgatgttggaaacatatatgttcaatttaaactatttggaacatc

SEQ ID NO: 641 - protein, 89 aa, Arabidopsis thaliana
  misc_feature (9)..(75): Pfam Name: LSM; Pfam Description: LSM domain
  misc_feature (9)..(75): Pfam Name: LSM; Pfam Description: LSM domain
  misc_feature: Utility: Useful for delaying flowering time
  misc_feature: Utility: Useful for delaying senescence
MSGRKETVLDLAKFVDKGVQVKLTGGRQVTGTLKGYDQLLNLVLDEAVEFVRDHDDPLKTTDQTRRLGLIVCRGTGDACLTNRWHRRNR

SEQ ID NO: 642 - protein, 99 aa, Brassica napus
  misc_feature (1)..(99): Ceres CLONE ID no. 1073419
  misc_feature: Utility: Useful for delaying flowering time
  misc_feature: Utility: Useful for delaying senescence
MSGRKETVLDLAKFVDKGVQVKLTGGRQVTGTLKGYDQLLNLVLDGALESVRDHDDPLKTTDQTRRLGLIVCRGTAVMLVSPTDGTEEIANPFNQPEAL

SEQ ID NO: 643 - protein, 99 aa, Brassica napus
  misc_feature (1)..(99): Ceres CLONE ID no. 1064362
  misc_feature: Utility: Useful for delaying flowering time
  misc_feature: Utility: Useful for delaying senescence
MSGRKETVLDLAKFVDKGVQVKLTGGRQVTGTLKGYDQLLNLVLDGALESVRDHDDPLKTTDQTRRLGLIVCRGTAVMLVSPTDGTEEIANPFNQPEAV

SEQ ID NO: 644 - protein, 86 aa, Brassica napus
  misc_feature (1)..(86): Ceres CLONE ID no. 1067161
  misc_feature: Utility: Useful for delaying flowering time
  misc_feature: Utility: Useful for delaying senescence
  misc_feature (21)..(21): Xaa is any aa, unknown, or other
  misc_feature (43)..(43): Xaa is any aa, unknown, or other
  misc_feature (75)..(75): Xaa is any aa, unknown, or other
MSGRKETVLDLAKFVDKGVQXKLTGGRQVTGTLKGYDQLLNLXLDAAVESVRDHDDPLKTTDQTRRLGLIVCRGXAVMLVSPTDGT

SEQ ID NO: 645 - protein, 98 aa, Brassica napus
  misc_feature (1)..(98): Public GI no. 50941651
  misc_feature: Utility: Useful for delaying flowering time
  misc_feature: Utility: Useful for delaying senescence
MSGRKETVLDLAKFVDKGVQVKLTGGRQVTGTLKGYDQLLNLVLDEAVEFEREQDDPLKLSGKTRQLGLIVCRGTAVMLVSPTDGTDEIANPFQSDGA

SEQ ID NO: 646 - protein, 104 aa, Triticum aestivum
  misc_feature (1)..(104): Ceres CLONE ID no. 685838
  misc_feature: Utility: Useful for delaying flowering time
  misc_feature: Utility: Useful for delaying senescence
MSGRKETVLDLAKFVDKGIQVKLTGGRQVTGTLKGYDQLLNLVLDEAIEFEREQDDPLKLSTKTRQLGLIVCRGTAVMLVSPTEGTEEIKNPFQEADGEQTAHS

SEQ ID NO: 647 - protein, 98 aa, Zea mays
  misc_feature (1)..(98): Ceres CLONE ID no. 462970
  misc_feature: Utility: Useful for delaying flowering time
  misc_feature: Utility: Useful for delaying senescence
MAGRKETALDLAKFVDKGVQVKLTGGRQVTGTLKGYDQLLNLVLDEAVEYEREQDDPLKLSGKTRQLGLIVCRGTAVMLVSPTDGTDEIANPFLAEGA

SEQ ID NO: 648 - protein, 98 aa, Zea mays; identical to SEQ ID NO: 647
  misc_feature (1)..(98): Ceres CLONE ID no. 393073
  misc_feature: Utility: Useful for delaying flowering time
  misc_feature: Utility: Useful for delaying senescence

SEQ ID NO: 649 - protein, 100 aa, Triticum aestivum
  misc_feature (1)..(100): Ceres CLONE ID no. 606064
  misc_feature: Utility: Useful for delaying flowering time
  misc_feature: Utility: Useful for delaying senescence
MAGRKETALDLAKFVDKGVQVKLTGGRQVTGTLKGYDQLLNLVLDEAVESEREQDDPLKLSTKTRQLGLIVCRGTAVMLVSPTDGTDEIANPFLAAEGAS

SEQ ID NO: 650 - protein, 100 aa, Triticum aestivum; identical to SEQ ID NO: 649
  misc_feature (1)..(100): Ceres CLONE ID no. 1018838
  misc_feature: Utility: Useful for delaying flowering time
  misc_feature: Utility: Useful for delaying senescence

SEQ ID NO: 651 - protein, 100 aa, Triticum aestivum
  misc_feature (1)..(100): Ceres CLONE ID no. 1031827
  misc_feature: Utility: Useful for delaying flowering time
  misc_feature: Utility: Useful for delaying senescence
  misc_feature (97)..(97): Xaa is any aa, unknown, or other
MAGRKETALDLAKFVDKGVQVKLTGGRQVTGTLKGYDQLLNLVLDEAVESEREQDDPLKLSTKTRQLGLIVCRGTAVMLCLRLMEPTRLPTPSSQRXGAS

SEQ ID NO: 652 - protein, 100 aa, Zea mays; identical to SEQ ID NO: 649
  misc_feature (1)..(100): Ceres CLONE ID no. 1502051
  misc_feature: Utility: Useful for delaying flowering time
  misc_feature: Utility: Useful for delaying senescence

SEQ ID NO: 653 - protein, 73 aa, Triticum aestivum
  misc_feature (1)..(73): Ceres CLONE ID no. 1054195
  misc_feature: Utility: Useful for delaying flowering time
  misc_feature: Utility: Useful for delaying senescence
  misc_feature (70)..(70): Xaa is any aa, unknown, or other
MAGRKETALDLAKFVDKGVQVKLTGGRQVTGTLKGYDQLLNLVLDEAVESEREQDDPLKLSTKTRQLGLXCVQ

SEQ ID NO: 654 - DNA, 1359 bp, Arabidopsis thaliana
  misc_feature (1)..(1359): Ceres CLONE ID no. 97958
  misc_feature (1)..(1359): Also known as  Ceres CDNA ID no. 23363449
atactaaatcatcaccccaacactacaaagaagaaacacactctatctctctgtctcaatacatatttcctcacttctgatcagtgtgatcacgtagagtgccttgaaggagaagaaggaaacaaaaagaaataaaaatgggataccttatagaagaaactttaagctctaactctaaaaccccaattgttatcgatgatgataacgagttgggtttgatggccgtgagactagccaatgctgctgcctttccgatggttctcaaagccgccctcgagctcggtgtctttgacactctctatgctgaagcctctcgcagcgactcgttcctttcaccatcagaaatagcgagtaagctaccaactacacctcgtaaccctgaggctccggttttattggaccgtatgcttcgtctactcgctagctattctgtggtcaagtgtggtaaggtctcataaggaaagggtgagagggtctacagagccgagccaatttgcaggtttttcttgaaggataacattcaagatattggatcccttgcttctcaagtcattgtcaatttcgatagcgtcttcctcaatacttgggcacaattgaaagacgtggttctagaaggaggagatgcatttggccgcgcacatggtggtatgaagctctttgactatatgggtacagatgagagattcagcaaactatttaaccagaccggttttaccattgcggtggtgaagaaggctcttgaagtttaccaaggcttcaaagatgtggatgtgttggttgatgtgggaggtggagttggtaacactcttggtgttgtaacatctaagtatcccaatattaagggtatcaattttgatctaacttgcgccttggcacaagcaccctcttatcccggtgtggaacatgttgctggagatatgtttgtggatattccaaccggagatgctatgatcttgaaacgtatacttcatgattggaccgacgaagactgtgtgaagattcttaagaattgttggaaatcacttccagaaaacggtaaagtggttgtcatagaattagtcactcctgatgaggcagagaatggagacatcaacgcaaacattgcctttgacatggacatgttaatgttcacacaatgttccggaggaaaagagagatcaagagctgagtttgaagctttggctgcagcttctggctttacccattgcaagttcgtttgccaagcttatcactgctggattattgagttctgtaaataaaatgtgtgaaatgtaaaacaaaatcgtcgttaattatttattttcatctttgttgtcattctttcttgatatctttctcgtcgagtaataaaagtgtttt

SEQ ID NO: 655 - protein, 203 aa, Arabidopsis thaliana
  misc_feature (2)..(180): Pfam Name: Methyltransf_2; Pfam Description: O-methyltransferase
  misc_feature: Utility: Useful for delaying flowering time
  misc_feature: Utility: Useful for delaying senescence
  misc_feature: Utility: Useful for increasing seed/fruit yield or modifying fruit content
  misc_feature: Utility: Useful for making plants sterile and for genetic confinement
  misc_feature: Utility: Useful for making smaller plants
  misc_feature: Utility: Useful for making taller plants and plants with longer inflorescences
MKLFDYMGTDERFSKLFNQTGFTIAVVKKALEVYQGFKDVDVLVDVGGGVGNTLGVVTSKYPNIKGINFDLTCALAQAPSYPGVEHVAGDMFVDIPTGDAMILKRILHDWTDEDCVKILKNCWKSLPENGKVVVIELVTPDEAENGDINANIAFDMDMLMFTQCSGGKERSRAEFEALAAASGFTHCKFVCQAYHCWIIEFCK

SEQ ID NO: 656 - protein, 197 aa, Arabidopsis thaliana
  misc_feature (1)..(197): Ceres CLONE ID no. 101583
  misc_feature: Utility: Useful for delaying flowering time
  misc_feature: Utility: Useful for delaying senescence
  misc_feature: Utility: Useful for increasing seed/fruit yield or modifying fruit content
  misc_feature: Utility: Useful for making plants sterile and for genetic confinement
  misc_feature: Utility: Useful for making smaller plants
  misc_feature: Utility: Useful for making taller plants and plants with longer inflorescences
MGTDERFSKLFNQTGFTIAVVKKALEVYQGFKDVNVLVDVGGGVGNTLGVVTSKYPNIKGINFDLTCALAQAPSYPGVEHVAGDMFVDIPTGDAMILKRILHDWTDEDCVKILNNCWKSLPENGKVVVIELVTPDEAENGDINANIAFDMDMLMFTQCSGGKERSRAEFEALAAASGFTHCKFVCQAYHCWIIEFCK

SEQ ID NO: 657 - protein, 346 aa, Arabidopsis thaliana
  misc_feature (1)..(346): Ceres CLONE ID no. 1347792
  misc_feature: Utility: Useful for delaying flowering time
  misc_feature: Utility: Useful for delaying senescence
  misc_feature: Utility: Useful for increasing seed/fruit yield or modifying fruit content
  misc_feature: Utility: Useful for making plants sterile and for genetic confinement
  misc_feature: Utility: Useful for making smaller plants
  misc_feature: Utility: Useful for making taller plants and plants with longer inflorescences
MAVRLANAAAFPMVLKAALELGVFDTLYAAASRTDSFLSPYEIASKLPTTPRNPEAPVLLDRMLRLLASYSMVKCGKALSGKGERVYRAEPICRFFLKDNIQDIGSLASQVIVNFDSVFLNTWAQLKDVVLEGGDAFGRAHGGMKLFDYMGTDERFSKLFNQTGFTIAVVKKALEVYEGFKGVKVLVDVGGGVGNTLGVVTSKYPNIKGINFDLTCALAQAPSYPGVEHVAGDMFVDVPTGDAMILKRILHDWTDEDCVKILKNCWKSLPENGKVVVIELVTPDEAENGDINANIAFDMDMLMFTQCSGGKERSRAEFEALAAASGFTHCKFVCQAYHCWIIEFCK

SEQ ID NO: 658 - protein, 373 aa, Arabidopsis thaliana
  misc_feature (1)..(373): Public GI no. 23506107
  misc_feature: Utility: Useful for delaying flowering time
  misc_feature: Utility: Useful for delaying senescence
  misc_feature: Utility: Useful for increasing seed/fruit yield or modifying fruit content
  misc_feature: Utility: Useful for making plants sterile and for genetic confinement
  misc_feature: Utility: Useful for making smaller plants
  misc_feature: Utility: Useful for making taller plants and plants with longer inflorescences
MGYLFQETLSSNPKTPIVVDDDNELGLMAVRLANAAAFPMVLKAALELGVFDTLYAAASRTDSFLSPYEIASKLPTTPRNPEAPVLLDRMLRLLASYSMVKCGKALSGKGERVYRAEPICRFFLKDNIQDIGSLASQVIVNFDSVFLNTWAQLKDVVLEGGDAFGRAHGGMKLFDYMGTDERFSKLFNQTGFTIAVVKKALEVYEGFKGVKVLVDVGGGVGNTLGVVTSKYPNIKGINFDLTCALAQAPSYPGVEHVAGDMFVDVPTGDAMILKRILHDWTDEDCVKILKNCWKSLPENGKVVVIELVTPDEAENGDINANIAFDMDMLMFTQCSGGKERSRAEFEALAAASGFTHCKFVCQAYHCWIIEFCK

SEQ ID NO: 659 - protein, 373 aa, Arabidopsis thaliana
  misc_feature (1)..(373): Public GI no. 12744973
  misc_feature: Utility: Useful for delaying flowering time
  misc_feature: Utility: Useful for delaying senescence
  misc_feature: Utility: Useful for increasing seed/fruit yield or modifying fruit content
  misc_feature: Utility: Useful for making plants sterile and for genetic confinement
  misc_feature: Utility: Useful for making smaller plants
  misc_feature: Utility: Useful for making taller plants and plants with longer inflorescences
MGYLFEETLSSNPKTPIVVDDDNELGLMAVRLANAAAFPMVLKASLELGVFDTLYAEASRTDSFLSPSEIASKLPTTPRNPGAPVLLDRMLRLLASYSMVKCEKVSVGKGERVYRAEPICRFFLKNNIQDIGSLASQVIVNFDSVFLNTWAQLKDVVLEGGDAFGRAHGGMKLFDYMGTDERFSKLFNQTGFTIAVVKKALEVYQGFKGVNVLVDVGGGVGNTLGVVTSKYPNIKGINFDLTCALAQAPSYPGVEHVAGDMFVDVPTGDAMILKRILHDWTDEDCVKILKNCWKSLPENGKVVVIELVTPDEAENGDINANIAFDMDMLMFTQCSGGKERSRAEFEALAAASCFTHCKFVCQAYHCWIIEFCK

SEQ ID NO: 660 - protein, 373 aa, Arabidopsis thaliana
  misc_feature (1)..(373): Ceres CLONE ID no. 12023
  misc_feature: Utility: Useful for delaying flowering time
  misc_feature: Utility: Useful for delaying senescence
  misc_feature: Utility: Useful for increasing seed/fruit yield or modifying fruit content
  misc_feature: Utility: Useful for making plants sterile and for genetic confinement
  misc_feature: Utility: Useful for making smaller plants
  misc_feature: Utility: Useful for making taller plants and plants with longer inflorescences
MGYLFEETLSSNPKTPIVVDDDNELGLMAVRLANAAAFPMVLKASLELGVFDTLYAEASRTDSFLSPSEIASKLPTTPRNPGAPVLLDRMLRLLASYSMVKCEKVSVGKGERVYRAEPICRFFLKNNIQDIGSLASQVIVNFDTVFLNTWAQLKDVVLEGGDAFGRAHGGMKLFDYMGTDERFSKLFNQTGFTIAVVKKALEVYEGFKGVNVLVDVGGGVGNTLGVVTSKYPNIKGINFDLTCALAQAPSYPGVEHVAGDMFVDVPTGDAMILKRILHDWTDEDCVKILKNCWKSLPKNGKVVVIELVTPDEAENGDINANIAFDMDMLMFTQCSGGKERSRAEFEALAAASGFTHCKFVCQAYHCWIIEFCK

SEQ ID NO: 661 - protein, 373 aa, Arabidopsis thaliana
  misc_feature (1)..(373): Public GI no. 62320460
  misc_feature: Utility: Useful for delaying flowering time
  misc_feature: Utility: Useful for delaying senescence
  misc_feature: Utility: Useful for increasing seed/fruit yield or modifying fruit content
  misc_feature: Utility: Useful for making plants sterile and for genetic confinement
  misc_feature: Utility: Useful for making smaller plants
  misc_feature: Utility: Useful for making taller plants and plants with longer inflorescences
MGYLFEETLSSNPKTPIVVDDDNELGLMAVRLANAAAFPMVLKASLELGVFDTLYAEASRTDSFLSPSEIASKLPTTPRNPGAPVLLDRMLRLLASYSMVKCEKVSVGKGERVYRAEPICRFFLKNNIQDIGSLASQVIVNFDSVFLNTWAQLKDVVLEGGDAFGRAHGGMKLFDYMGTDERFSKLFNQTGFTIAVVKKALEVYQGFKGVNVLVDVGGGVGNTLGVVTSKYPNIKGINFDLTCALAQAPSYPGVEHVAGDMFVDVPTGDAMILKRILHDWTDEDCVKILKNCWKSLPENGKVVVIELVIPDEAENGDINANIAFDMDMLMFTQCSGGKERSRAEFEALAAASCFTHCKFVCQAYHCWIIEFCK

SEQ ID NO: 662 - protein, 373 aa, Arabidopsis thaliana
  misc_feature (1)..(373): Public GI no. 15218138
  misc_feature: Utility: Useful for delaying flowering time
  misc_feature: Utility: Useful for delaying senescence
  misc_feature: Utility: Useful for increasing seed/fruit yield or modifying fruit content
  misc_feature: Utility: Useful for making plants sterile and for genetic confinement
  misc_feature: Utility: Useful for making smaller plants
  misc_feature: Utility: Useful for making taller plants and plants with longer inflorescences
MGYLLEETLSSNSKTPIVIDDDNELGLMAVRLANAAAFPMVLKAALELGVFDTLYAEASRSDSFLSPSEIASKLPTTPRNPEAPVLLDRMLRLLASYSVVKCGKVSEGKGERVYRAEPICRFFLKDNIQDIGSLASQVIVNFDSVFLNTWAQLKDVVLEGGDAFGRAHGGMKLFDYMGTDERFSKLFNQTGFTIAVVKKALEVYQGFKGVNVLVDVGGGVGNTLGVVASKYPNIKGINFDLTCALAQAPSYPGVEHVAGDMFVDVPTGDAMILKRILHDWTDEDCVKILKNCWKSLPESGKVVVIELVTPDEAENGDINANIAFDMDMLMFTQCSGGKERSRAEFEALAAASGFTHCKFVCQAYHCWIIEFCK

SEQ ID NO: 663 - protein, 373 aa, Arabidopsis thaliana
  misc_feature (1)..(373): Public GI no. 28973283
  misc_feature: Utility: Useful for delaying flowering time
  misc_feature: Utility: Useful for delaying senescence
  misc_feature: Utility: Useful for increasing seed/fruit yield or modifying fruit content
  misc_feature: Utility: Useful for making plants sterile and for genetic confinement
  misc_feature: Utility: Useful for making smaller plants
  misc_feature: Utility: Useful for making taller plants and plants with longer inflorescences
MGYLFEETLSSNPKTPIVVDDDNELGLMAVRLANAAAFPMVLKASLELGVFDTLYAEASRTDSFLSPSEIASKLPTTPRNPGAPVLLDRMLRLLASYSMVKCEKVSVGKEQRVYRAEPICRFFLKNNIQDIGSLASQVIVNFDSVFLNTWAQLKDVVLEGGDAFGRAHGGMKLFDYMGTDERFSKLFNQTGFTIAVVKKALEVYQGFKGVNVLVDVGGGVGNTLGVVTSKYPNIKGINFDLTCALAQAPTYPGVEHVAGDMFVDVPTGNAMILKRILHDWTDEDCVKILKNCWKSLPQNGKVVVIELVTPDEAENGDINANIAFDMDMLMFTQCSGGKERSRAEFEALAAASGFSHCQFVCQAYHCWIIEFCK

SEQ ID NO: 664 - protein, 371 aa, Arabidopsis thaliana
  misc_feature (1)..(371): Public GI no. 47232556
  misc_feature: Utility: Useful for delaying flowering time
  misc_feature: Utility: Useful for delaying senescence
  misc_feature: Utility: Useful for increasing seed/fruit yield or modifying fruit content
  misc_feature: Utility: Useful for making plants sterile and for genetic confinement
  misc_feature: Utility: Useful for making smaller plants
  misc_feature: Utility: Useful for making taller plants and plants with longer inflorescences
MRSTSPQTIDSTPMSHPQQEEEEELGKQAIRLANVVILPMVLKSALELNVIDIIWGAGDGESLSPSDIAAQLPTKNSNAPAVLDRMLRLLASHSILKCSARTGSDGQVERLYSAGPICKFLVKDQNGGTRSVGPLFLLHHDKVFMEGWFHLNDAILEGGIPFNRAYGMTAFEYPETDERFNRVFNQAMSNHTTLILKKILDVYRGFEGINVLVDVGGGIGVTLNLITNKYPHIKGINFDLPHVLADAPSYPGVEHVGGDMFKSVPQGDAIFMKWILHDWSDEHCLTLLKNCCKSLPSSGKVIFVESILPEVPDSTVTSNIVCEQDLLMFTQNPGGKERTKKEYEALALKSGFSRLEVVCSAYNSWVMEFHK

SEQ ID NO: 665 - protein, 375 aa, Triticum aestivum
  misc_feature (1)..(375): Ceres CLONE ID no. 632026
  misc_feature: Utility: Useful for delaying flowering time
  misc_feature: Utility: Useful for delaying senescence
  misc_feature: Utility: Useful for increasing seed/fruit yield or modifying fruit content
  misc_feature: Utility: Useful for making plants sterile and for genetic confinement
  misc_feature: Utility: Useful for making smaller plants
  misc_feature: Utility: Useful for making taller plants and plants with longer inflorescences
  misc_feature (113)..(113): Xaa is any aa, unknown, or other
  misc_feature (114)..(114): Xaa is any aa, unknown, or other
  misc_feature (115)..(115): Xaa is any aa, unknown, or other
  misc_feature (120)..(120): Xaa is any aa, unknown, or other
  misc_feature (121)..(121): Xaa is any aa, unknown, or other
  misc_feature (226)..(226): Xaa is any aa, unknown, or other
QNKRVLVHQPQQTRWRQRQLMGSMAAEMTAVEEEACIYAMQLSSTAVLPLTLKNAIELGMLEVLMGAGGKMLSPSEVAARLPPTTTNPDAPAMVDRMLHLLASLQGGVVAKVXXXTHAPXXTGPTPVCKWFTPNQDGISMAPLLLLTNDKVPMESLYHLKDAVLDGGLPFHKAHGMTMYEYTKTDARLNHVFNEAMKSYTTIVTGKLVELYTGFHDVATLVDVGGXVGATIRAVTSKYPHIKGINFDLPHVIAEAPQSPGVEHVAGDMFKNVPSGDAIVLKWILHNWTDEHCTTLLRNCYNALPAHGKVVVVEGILPVEPEATSRGQQASLSDMIMLTHTAGGKERNQREFEQLAKAAGFTGVKTAYIYSNTLGH

SEQ ID NO: 666 - protein, 146 aa, Brassica napus
  misc_feature (1)..(146): Ceres CLONE ID no. 974547
  misc_feature: Utility: Useful for delaying flowering time
  misc_feature: Utility: Useful for delaying senescence
  misc_feature: Utility: Useful for increasing seed/fruit yield or modifying fruit content
  misc_feature: Utility: Useful for making plants sterile and for genetic confinement
  misc_feature: Utility: Useful for making smaller plants
  misc_feature: Utility: Useful for making taller plants and plants with longer inflorescences
MSNHSTITMKKILETYNGFEGLVSLVDVGGGIGATLKMIVSKYPNLKGINFDLPHVIEDAPSHPGVEHVGGDMFVSVPKGDAIFMKWICHDWSDEHCLKFLKNCYEALPENGKVILAECILPETLDSSLSTKQVVNVDCIMLALNP

SEQ ID NO: 667 - protein, 361 aa, Brassica napus
  misc_feature (1)..(361): Public GI no. 5031494
  misc_feature: Utility: Useful for delaying flowering time
  misc_feature: Utility: Useful for delaying senescence
  misc_feature: Utility: Useful for increasing seed/fruit yield or modifying fruit content
  misc_feature: Utility: Useful for making plants sterile and for genetic confinement
  misc_feature: Utility: Useful for making smaller plants
  misc_feature: Utility: Useful for making taller plants and plants with longer inflorescences
MSSTANNPQINSDEEENFLFAMQLASASVLPMVLKSAIELDLLELIKKAGAGAFVSPAELAAQLLTTNAEAHVMLDRILRLLTSYAILECRLKTLPDGGVQRLYGLAPVCKFLTKNEDGVSMAPLALMNQDKVLMESWYHLKDAVLDGGIPFNKAYGMTAFEYHGTDPRFNKVFNQGMSNHSTITMKKILETYTGFDGLKTVVDVGGGTGATLNMIISKYPSIKGINFDLPHVVEDAPSYPGVEHVGGDMFVSVPKGDAIFMKWICHDWSDAHCVKFLKKCYEALPENGKVILAECVLPEAPDTGLATKNVVHIDVIMLAHNPGGKERTEKEFQVLAKASGFKQFNKVCCAYNSWIMELLK

SEQ ID NO: 668 - protein, 361 aa, Brassica napus
  misc_feature (1)..(361): Public GI no. 5031492
  misc_feature: Utility: Useful for delaying flowering time
  misc_feature: Utility: Useful for delaying senescence
  misc_feature: Utility: Useful for increasing seed/fruit yield or modifying fruit content
  misc_feature: Utility: Useful for making plants sterile and for genetic confinement
  misc_feature: Utility: Useful for making smaller plants
  misc_feature: Utility: Useful for making taller plants and plants with longer inflorescences
MGSATNTPQINSDEEENFLFAMQLASASVLPMVLKSAIELDLLELIKKSGAGAFVSPVDLAAQLPTTNPDAHVMLDRILRLLTSYAILECRLKTLPDGGVERLYGLAPVCKFLTKNEDGVSMAPLTLMNQDKVLMESWYHLSDAVVDGGIPFNKAYGMTAFEYHGTDPRFNKVFNQGMSNHSTITMKKILETYTGFDGLKTVVDVGGGTGATLNMIVSKYPSIKGINFDLPHVIEDAPSYPGVEHVGGDMFVSVPKGDAIFMKWICHDWSDEHCVKFLKNCYDALPQNGKVILAECVLPEAPDTGLATKNVVHIDVIMLAHNPGGKERTEKEFQGLAKAAGFKQFNKACCAYNTWIMELLK

SEQ ID NO: 669 - protein, 360 aa, Glycine max
  misc_feature (1)..(360): Ceres CLONE ID no. 561287
  misc_feature: Utility: Useful for delaying flowering time
  misc_feature: Utility: Useful for delaying senescence
  misc_feature: Utility: Useful for increasing seed/fruit yield or modifying fruit content
  misc_feature: Utility: Useful for making plants sterile and for genetic confinement
  misc_feature: Utility: Useful for making smaller plants
  misc_feature: Utility: Useful for making taller plants and plants with longer inflorescences
MHLKQVEEEQDGILFAMNMMSTMVYPFVVRTAIELGIFDIIAKAGEGAKLSAEEIIEQLGTKNPEAPTMLDRLLRLLASHSMLSSSLDTEDLQHGQNSPKRLYSLTYASKYFVTDADGVSFGATLNLLLDKVFLESWTELKGAILEGGVAFNRVHSMHSFEYPAVDPRFNDVFNKAMFNLTTIVMKRVLEFYEGFKNINRLVDVGGGLGINLNLITSKYPHVQGVNFDLPHVIEHAPTYPGIEHVGGDMFESVPNGDAIFMKWILHDWSDEQCLKLLKNCHKAIPSDGKVIVVDLILPILPESTVTAKSGFQADLLMMTQNSGGKERTQHEFMELALSSGFSGIKIVCSVSGFWVMEFYK

SEQ ID NO: 670 - protein, 362 aa, Glycine max
  misc_feature (1)..(362): Public GI no. 4808524
  misc_feature: Utility: Useful for delaying flowering time
  misc_feature: Utility: Useful for delaying senescence
  misc_feature: Utility: Useful for increasing seed/fruit yield or modifying fruit content
  misc_feature: Utility: Useful for making plants sterile and for genetic confinement
  misc_feature: Utility: Useful for making smaller plants
  misc_feature: Utility: Useful for making taller plants and plants with longer inflorescences
MGSTQKNHNLTPEEEEEACLHAMQLASASVLPMVLKAAIELSVLEIIAKAGQGAYVAPTEIASQLSTSNSQAPIILDRILRLLASYKVLTCNLRTLEDGGVERLYGLAPVCKFLVKNEDGVSIAPLVLMNQDKVLMESWYHLKDAVLDGGIPFNKAYGMTAFEYHGTDPRFNKVFNRGMADHSTITMKKLLELYKGFEGLKSVVDVGGGTGATINMIVTKHPTIKGINFDLPHVIDDAPAYPGVEHIGGDMFVSVPKGDAIFMKWILHDWSDEHSVKFLKNCYESIPADGKVIIVESILPVYPETNLASNACFQLDNIMLAHNPGGKERTEKDFEALSAKAGFTGFKIVCGAFGSWVMEFCK

SEQ ID NO: 671 - protein, 365 aa, Glycine max
  misc_feature (1)..(365): Public GI no. 57157826
  misc_feature: Utility: Useful for delaying flowering time
  misc_feature: Utility: Useful for delaying senescence
  misc_feature: Utility: Useful for increasing seed/fruit yield or modifying fruit content
  misc_feature: Utility: Useful for making plants sterile and for genetic confinement
  misc_feature: Utility: Useful for making smaller plants
  misc_feature: Utility: Useful for making taller plants and plants with longer inflorescences
MDSTPVIQIPTPYPFSDEEACLYAMQLRSFSVLPMTLKAAIELDLLEIIAKAGPGAYLSPAEISSQLPTENPEAPAMIDRMLRLLACYSVVSCRVDAAGDDGKPRRRYGAERVVKYLTKNEDGVSMAALTLMNQDKVFMESWYHLKDAVLEGGIPFKKAFGMSPFEYQGTDPRFNKVFNEGMRNHSAFIMKKILETYQGFDSVKLLVDVGGGLGGTMKAIVTKYPHIEGINFDLSHVISEAPPIPGVKHVGGDMFESVPSGDAIFMKWILHDWSDAHCLKLLSNCWKALPEDGKVIVMEGILPTIPEPTSAAQGVVHIDLVMMAHNPGGKERTKAEFESLARDAGFSGSKALCSYANCWILEFYK

SEQ ID NO: 672 - DNA, 713 bp, Arabidopsis thaliana
  misc_feature (1)..(713): Ceres CLONE ID no. 98855
  misc_feature (1)..(713): Also known as  Ceres CDNA ID no. 23360333
acacatctcactgctcactactctcactgtaatcccttagatcttcttttcaaatttcaatggcgtccggtgatgttgagtatcggtgcttcgttggaggtctagcatgggccactgatgacagagctcttgagactgccttcgctcaatacggcgacgttattgattccaagatcattaacgatcgtgagactggaagatcaaggggattcggattcgtcaccttcaaggatgagaaagccatgaaggatgcgattgagggaatgaacggacaagatctcgatggccgtagcatcactgttaacgaggctcagtcacgaggaagcggtggcggcggaggccaccgtggaggtggtggcggcggttactcctcaagaggtggtggtggcggaagctacggtggtggaagacgtgagggaggaggaggatacggtggtggtgaaggaggaggttacggaggaaacggtggtggtggaggatggtaattcctttaattaggtttgggattaccaatgaatgttctctctctcgcttgttatgcttctacttggttttgtgtgttctctattttgttctggttctgctttagatttgatgtaacagttcgtgattaggtattttggtatctggaaacgtaatgttaagtcacttgtcattctctaaataacaaatttcttcggagatattatctctgttgattgattctatcatcg

SEQ ID NO: 673 - protein, 141 aa, Arabidopsis thaliana
  misc_feature (10)..(81): Pfam Name: RRM_1; Pfam Description: RNA recognition motif. (a.k.a. RRM, RBD, or RNP domain)
  misc_feature: Utility: Useful for delaying flowering time
MASGDVEYRCFVGGLAWATDDRALETAFAQYGDVIDSKIINDRETGRSRGFGFVTFKDEKAMKDAIEGMNGQDLDGRSITVNEAQSRGSGGGGGHRGGGGGGYSSRGGGGGSYGGGRREGGGGYGGGEGGGYGGNGGGGGW

SEQ ID NO: 674 - protein, 134 aa, Brassica napus
  misc_feature (1)..(134): Ceres CLONE ID no. 977670
  misc_feature: Utility: Useful for delaying flowering time
MASPDVEYRCFVGGLAWATDDRALETAFSQYGDVLDSKIINDRETGRSRGFGFVTFKDEKSMKDAIEGMNGQDLDGRSITVNEAQSRGGGGGGGRGGGGGGYRSGGGGGYGGGGGGYGGGGGRREGGYSGGGGG

SEQ ID NO: 675 - protein, 136 aa, Brassica napus
  misc_feature (1)..(136): Ceres CLONE ID no. 1091493
  misc_feature: Utility: Useful for delaying flowering time
MASPDVEYRCFVGGLAWATDDRALETAFSQFGDVLDSKIINDRETGRSRGFGFVTFKDEKSMKDAIEGMNGQDLDGRSITVNEAQSRGSGGGGGGRGGGGGGYRSGGGGGYGGGGGGYGGGGGRREGGYSGGGGGG

SEQ ID NO: 676 - protein, 151 aa, Brassica napus
  misc_feature (1)..(151): Ceres CLONE ID no. 945779
  misc_feature: Utility: Useful for delaying flowering time
MAAPDVEYRCFVGGLAWATDERSLETAFSKFGELVDSKIINDRETGRSRGFGFVTFKDEQSMKDAIEGMNGQDLDGRSITVNEAQSRGSGGGGRGGGGGYRGGGGGGYGGGGGGYGGGRREGGYSGGGGGYSSRGGGGGGYGGGGRREGGG

SEQ ID NO: 677 - protein, 153 aa, Brassica napus
  misc_feature (1)..(153): Ceres CLONE ID no. 1092319
  misc_feature: Utility: Useful for delaying flowering time
MAAPDVEYRCFVGGLAWATDERSLETAFSKFGELVDSKIINDRETGRSRGFGFVTFKDEQSMKDAIEGMNGQDLDGRSITVNEAQSRGSGGGGGGRGGGGGYRGGGGGGGYGGGGGGYGGGRREGGYSGGGGGYSSRGGGGGGYGGGGRREGG

SEQ ID NO: 678 - protein, 146 aa, Brassica napus
  misc_feature (1)..(146): Ceres CLONE ID no. 965777
  misc_feature: Utility: Useful for delaying flowering time
MASPDVEYRCFVGGLAWATDERSLETAFSKFGELVDSKIINDRETGRSRGFGFVTFKDEQSMKDAIEGMNGQDLDGRSITVNEAQSRGSGGGGGGRGGGGGYRGGGGGYGGGGGYGGGRREGGYSGGGGGGYSSRGGGGGGYGGGG

SEQ ID NO: 679 - protein, 133 aa, Brassica napus
  misc_feature (1)..(133): Ceres CLONE ID no. 963616
  misc_feature: Utility: Useful for delaying flowering time
  misc_feature (13)..(13): Xaa is any aa, unknown, or other
MSEVEYRCFVGGXAWATGDAELERTFSQFGEVIDSKIINDRETGRSRGFGFVTFKDEKSMKDAIDEMNGKELDGRTITVNEAQSRGGGGGGGRGGGGYGDRRGGGGYGSGGGGYGGGGGRRDGGGYGGGDGSY

SEQ ID NO: 680 - protein, 123 aa, Brassica napus
  misc_feature (1)..(123): Ceres CLONE ID no. 972545
  misc_feature: Utility: Useful for delaying flowering time
  misc_feature (11)..(11): Xaa is any aa, unknown, or other
  misc_feature (27)..(27): Xaa is any aa, unknown, or other
  misc_feature (78)..(78): Xaa is any aa, unknown, or other
  misc_feature (80)..(80): Xaa is any aa, unknown, or other
  misc_feature (108)..(108): Xaa is any aa, unknown, or other
  misc_feature (120)..(120): Xaa is any aa, unknown, or other
MSEVEYRCFVXGLAWATGDAELERTFXQFGEVIDSKIINDRETGRSRGFGFVTFKDEKSMKDAIDEMNGKELDGRTIXVXEAQSRGGGGGGGRGGGGYGDRRGGGGYXSGGGGRGGGGYXSGG

SEQ ID NO: 681 - DNA, 765 bp, Arabidopsis thaliana
  misc_feature (1)..(765): Ceres CLONE ID no. 99657
  misc_feature (1)..(765): Also known as  Ceres CDNA ID no. 23371734
gacaaaaaaagaaacagtgaagaagaaaaaaaaaaaaggtcattttcattttctccatttgatttttgccgaccggagaaaatatcttcttgccgtcttcttcttcatttcaccaggaacttttatttgaaatcggtttgatttagccatggcaaacgcggcatcgggaatggctgtgcatgatgattgcaagctgaaatttatggaactgaaggcgaaaagaacattccgtaccatagtctacaagattgaggataagcaagtgattgtagagaaactcggtgaacctgaacaatcatatgatgactttgcagctagtcttccagctgatgattgccgatattgcatttacgatttcgactttgtcactgcggagaactgccagaagagcaagatcttcttgcatggtctccggacactgccaaagtgagagacaagatgatttacgcgagctctaaagataggttcaagagagaactagatggaattcaagtggaacttcaagctactgatccaacagaaatgggtcttgatgttttcaaaagccgcaccaactaagtaaaacaaaaccctgtaagggcatttgaataagtttggtttctggagtgaatatgtttcctctgactgttatgaaaactttttaacaccttcaacttcattctacttggtattattgtatgtctttgatgtgttatgtgtgccttgtgatggttttcaattagttttacatgtacaatacttgaaatcagattgttgctaagcttc

SEQ ID NO: 682 - protein, 93 aa, Arabidopsis thaliana
  misc_feature (12)..(85): Pfam Name: Cofilin_ADF; Pfam Description: Cofilin/tropomyosin-type actin- binding protein
  misc_feature: Utility: Useful for delaying flowering time
  misc_feature: Utility: Useful for delaying senescence
  misc_feature: Utility: Useful for making taller plants and plants with longer inflorescences
MANAASGMAVHDDCKLKFMELKAKRTFRTIVYKIEDKQVIVEKLGEPEQSYDDFAASLPADDCRYCIYDFDFVTAENCQKSKIFLHGLRTLPK

SEQ ID NO: 683 - protein, 112 aa, Brassica napus
  misc_feature (1)..(112): Ceres CLONE ID no. 976676
  misc_feature: Utility: Useful for delaying flowering time
  misc_feature: Utility: Useful for delaying senescence
  misc_feature: Utility: Useful for making taller plants and plants with longer inflorescences
MAVHDDCKLKFLELKAKRTFRTIVYKIEDKQVIVEKLGEPEQSYDDFAASLPDNECRYAIYDFDFVTEENCQKSKIFFIAWSPDTAKVRDKMIYASSKDRFKRELDGIQVEL

SEQ ID NO: 684 - protein, 96 aa, Brassica napus
  misc_feature (1)..(96): Ceres CLONE ID no. 962705
  misc_feature: Utility: Useful for delaying flowering time
  misc_feature: Utility: Useful for delaying senescence
  misc_feature: Utility: Useful for making taller plants and plants with longer inflorescences
MAVHDDCKLKFLELKAKRTYRFIVYKIEEQQKQVVVEKLGEPGQSHDDFAASLPADECRYAIFDFDFVTAENCQKSKIFFVAWSPDTARVRSKMIY

SEQ ID NO: 685 - protein, 96 aa, Brassica napus
  misc_feature (1)..(96): Ceres CLONE ID no. 1081690
  misc_feature: Utility: Useful for delaying flowering time
  misc_feature: Utility: Useful for delaying senescence
  misc_feature: Utility: Useful for making taller plants and plants with longer inflorescences
MAVHDDCKLKFLELKAKRTYRFIVYKIEEQQKQVVVEKLGEPGQSHDDFAASLPADECRYAIFDFDFVTAENCQKSKIFFIAWSPDTARVRSKMIY

SEQ ID NO: 686 - protein, 119 aa, Glycine max
  misc_feature (1)..(119): Ceres CLONE ID no. 1076675
  misc_feature: Utility: Useful for delaying flowering time
  misc_feature: Utility: Useful for delaying senescence
  misc_feature: Utility: Useful for making taller plants and plants with longer inflorescences
MAVHDDCKLKFLELKAKRTYRFIVYKIEEQQKQVVVEKLGEPGQSHDDFAASLPADECRYAIFDFDFVTAENCQKSKIFFIAWSPDTARVRSKMIYASSKDRFKRELDGIQVELQATDP

SEQ ID NO: 687 - protein, 97 aa, Brassica napus
  misc_feature (1)..(97): Ceres CLONE ID no. 1082802
  misc_feature: Utility: Useful for delaying flowering time
  misc_feature: Utility: Useful for delaying senescence
  misc_feature: Utility: Useful for making taller plants and plants with longer inflorescences
MAVHDDCKLKFLELKAKRTYRFIVYKIEEQQKQVVVEKLGEPGQSHDDFAASLPADECRYAIFDFDFVTAENCQKSKIFFIAWSPDTARVRSKMIYA

SEQ ID NO: 688 - protein, 84 aa, Brassica napus
  misc_feature (1)..(84): Ceres CLONE ID no. 1102921
  misc_feature: Utility: Useful for delaying flowering time
  misc_feature: Utility: Useful for delaying senescence
  misc_feature: Utility: Useful for making taller plants and plants with longer inflorescences
  misc_feature (82)..(82): Xaa is any aa, unknown, or other
MAVHDDCKLKFLELKAKRTYRFIVYKIEEQQKQVVVEKLGEPGQSHDDFAASLPADECRYAIFDFDFVTAENCQKSKIFFVXWS

SEQ ID NO: 689 - protein, 132 aa, Zea mays
  misc_feature (1)..(132): Ceres CLONE ID no. 1061399
  misc_feature: Utility: Useful for delaying flowering time
  misc_feature: Utility: Useful for delaying senescence
  misc_feature: Utility: Useful for making taller plants and plants with longer inflorescences
MAVHDDCKLKFLELKAKRTYRFIVYKIEEQQKQVVVEKLGEPGQSHDDFAASLPADECRYAIFDFDFVTAENCQKSKIFFVAWSPDTARVRSKMIYASSKDRFKRELDGIQVELQATDPTEMDLDVFKSRAN

SEQ ID NO: 690 - protein, 90 aa, Brassica napus
  misc_feature (1)..(90): Ceres CLONE ID no. 1040255
  misc_feature: Utility: Useful for delaying flowering time
  misc_feature: Utility: Useful for delaying senescence
  misc_feature: Utility: Useful for making taller plants and plants with longer inflorescences
MAVHDDCKLKFLELKAKRTFRFIVYKIEEQQKQVVVEKLGEPGQSHDDFAASLPADECRYAVFDFDFVTAESCQKSKIFFVAWSPDTARV

SEQ ID NO: 691 - protein, 106 aa, Brassica napus
  misc_feature (1)..(106): Ceres CLONE ID no. 1040515
  misc_feature: Utility: Useful for delaying flowering time
  misc_feature: Utility: Useful for delaying senescence
  misc_feature: Utility: Useful for making taller plants and plants with longer inflorescences
  misc_feature (104)..(104): Xaa is any aa, unknown, or other
MAVHDDCKLKFLELKAKRTFRFIVYKIEEQQKQVVVEKLGEPGQSHDDFAASLPADECRYAVFDFDFVTAESCQKSKIFFVAWSPDTARVRSKMIYASSKDRFXRE

SEQ ID NO: 692 - protein, 132 aa, Zea mays
  misc_feature (1)..(132): Ceres CLONE ID no. 1389554
  misc_feature: Utility: Useful for delaying flowering time
  misc_feature: Utility: Useful for delaying senescence
  misc_feature: Utility: Useful for making taller plants and plants with longer inflorescences
MAVHDDCKLKFLELKAKRTFRFIVYKIEEQQKQVVVEKLGEPGQSHDDFAASLPADECRYAVFDFDFVTAESCQKSKIFFVAWSPDTARVRSKMIYASSKDRFKRELDGIQVELQATDPTEMDLDVFKSRAN

SEQ ID NO: 693 - protein, 105 aa, Glycine max
  misc_feature (1)..(105): Ceres CLONE ID no. 615044
  misc_feature: Utility: Useful for delaying flowering time
  misc_feature: Utility: Useful for delaying senescence
  misc_feature: Utility: Useful for making taller plants and plants with longer inflorescences
MANAASGMAVHDDCKLKFLELKAKRTYRFIVFKIEEKQKQVIVEKLGEPANGYDDFAASLPADECRYAVYDFDFVTEENCQKSRIFFIAWSPDTSRVRSKMIYAS

SEQ ID NO: 694 - protein, 132 aa, Triticum aestivum
  misc_feature (1)..(132): Ceres CLONE ID no. 1053159
  misc_feature: Utility: Useful for delaying flowering time
  misc_feature: Utility: Useful for delaying senescence
  misc_feature: Utility: Useful for making taller plants and plants with longer inflorescences
MAVHDDCKLRFLELKAKRTHRFIVYKIEEKQKQVIVEKVGEPIQTYEDFAASLPAEECRYAIYDFDFVTAENCQKSKIFFIAWCPDVAKVRSKMIYASSKDRFKRELDGIQVELQATDPTEMDLDVFKSRVN

SEQ ID NO: 695 - protein, 120 aa, Brassica napus
  misc_feature (1)..(120): Ceres CLONE ID no. 1266787
  misc_feature: Utility: Useful for delaying flowering time
  misc_feature: Utility: Useful for delaying senescence
  misc_feature: Utility: Useful for making taller plants and plants with longer inflorescences
MAVHDDCKLRFLELKAKRTHRFIVYKIEEKQKQVIVEKVGEPIQTYEDFAASLPAEECRYAIYDFDFVTAENCQKSKIFFIAWCPDVAKVRSKMIYASSKDRFKRELDGIQVELQATDPT

SEQ ID NO: 696 - protein, 113 aa, Brassica napus
  misc_feature (1)..(113): Ceres CLONE ID no. 1309442
  misc_feature: Utility: Useful for delaying flowering time
  misc_feature: Utility: Useful for delaying senescence
  misc_feature: Utility: Useful for making taller plants and plants with longer inflorescences
  misc_feature (84)..(84): Xaa is any aa, unknown, or other
  misc_feature (110)..(110): Xaa is any aa, unknown, or other
MAVHDDCKLRFLELKAKRTHRFIVYKIEEKQKQVIVEKVGEPIQTYEDFAASLPAEECRYAIYDFDFVTAENCQKSKIFFIAWXPDVAKVRSKMIYASSKEASKDEPEEXKQA

SEQ ID NO: 697 - protein, 125 aa, Zea mays
  misc_feature (1)..(125): Ceres CLONE ID no. 1425999
  misc_feature: Utility: Useful for delaying flowering time
  misc_feature: Utility: Useful for delaying senescence
  misc_feature: Utility: Useful for making taller plants and plants with longer inflorescences
  misc_feature (100)..(100): Xaa is any aa, unknown, or other
  misc_feature (119)..(119): Xaa is any aa, unknown, or other
MAVHDDCKLRFLELKAKRTHRFIVYKIEEKQKQVIVEKVGEPIQTYEDFAASLPAEECRYAIYDFDFVTAENCQKSKIFFIAWCPDVAKVRSKMIYASSXDRFKRELDGIQVELQATDXTGDGSW

SEQ ID NO: 698 - protein, 183 aa, Glycine max
  misc_feature (1)..(183): Ceres CLONE ID no. 473223
  misc_feature: Utility: Useful for delaying flowering time
  misc_feature: Utility: Useful for delaying senescence
  misc_feature: Utility: Useful for making taller plants and plants with longer inflorescences
LHFLLPFLSSFLPQPNLRLRPQQLLLQDRCQRYFPFLPFILEKKMANAASGMAVHDECKLKFLELKAKRTYRYIVFKIEEKSKQVIVEKLGDPANGYDEFAASLPADECRYAVYDFDFVTEENCQKSRIFFIAWSPDTSRVRSKMIYASSKDRFKRELDGIQIELQATDPTEMGLDVFKSRAN

SEQ ID NO: 699 - DNA, 1093 bp, Arabidopsis thaliana
  misc_feature (1)..(1093): Ceres CLONE ID no. 100465
  misc_feature (1)..(1093): Also known as  Ceres CDNA ID no. 23362514
aatacctttgatatttgcctgcacgtccccaaacaagtagagaataataatcacatcaagattgattaaaaccctctcactaatcaccttcttaatcaccaccctctccggctctcaacagaacaacaacaaaaaaacagcttccgttgtcctgttccggcgaaatcggacggtcgagatcaatcatgcatcgtagagcagcaattcaagaatcggatgacgaagaagatgagacttacaacgacgtcgttcctgaatctccttcttcttgtgaagactcaaagatctcaaaaccaactccaaagaaaagtaggaggaacgtagagaagagagttgtctcagttccgatagctgacgtggaaggatctaagagcagaggcgaagtatatccaccgtccgattcatgggcctggagaaagtacggacaaaaaccgatcaaaggctcgccttatcccaggggatattacagatgtagtagctcaaaaggatgtccggcgaggaagcaggtggagagaagccgtgtggacccttctaagcttatgattacttacgcctgcgaccacaatcaccctttcccttcctcctccgctaacaccaaatcccaccaccgctcctccgtcgtcctcaaaaccgcaaagaaagaggaagaatacgaagaggaggaagaagaactaaccgtcaccgccgcagaggaaccaccggcgggacttgatctaagccacgtagactcaccgttgctattaggcggctgctacagcgaaatcggagagttcgggtggttctacgacgcgtcgatctcatcatcatctggttcttcgaatttcctcgacgtaactctagagagaggtttttcagtaggccaagaggaagatgagtctttgttcggtgatctcggtgatttacctgattgcgcctccgtgttccgccgtgggactgttgcgacggaggagcaacatcgaagatgtgattttggcgccattcctttctgtgatagttctagatgagtttgtgtgtgtagccaaaaccaaaagaaaaaaacacaatttttttattttccactgtaaaggtgtatcaatggtggattcattttttt

SEQ ID NO: 700 - protein, 272 aa, Arabidopsis thaliana
  misc_feature (70)..(130): Pfam Name: WRKY; Pfam Description: WRKY DNA -binding domain
  misc_feature: Utility: Useful for delaying flowering time
  misc_feature: Utility: Useful for increasing chlorophyll and photosynthetic capacity
  misc_feature: Utility: Useful for making smaller plants
  misc_feature: Utility: Useful for making stronger plants
MHRRAAIQESDDEEDETYNDVVPESPSSCEDSKISKPTPKKSRRNVEKRVVSVPIADVEGSKSRGEVYPPSDSWAWRKYGQKPIKGSPYPRGYYRCSSSKGCPARKQVERSRVDPSKLMITYACDHNHPFPSSSANTKSHHRSSVVLKTAKKEEEYEEEEEELTVTAAEEPPAGLDLSHVDSPLLLGGCYSEIGEFGWFYDASISSSSGSSNFLDVTLERGFSVGQEEDESLFGDLGDLPDCASVFRRGTVATEEQHRRCDFGAIPFCDSSR

SEQ ID NO: 701 - protein, 272 aa, Arabidopsis thaliana
  misc_feature (1)..(272): Public GI no. 49333371
  misc_feature: Utility: Useful for delaying flowering time
  misc_feature: Utility: Useful for increasing chlorophyll and photosynthetic capacity
  misc_feature: Utility: Useful for making smaller plants
  misc_feature: Utility: Useful for making stronger plants
MDGGGSSSNSFRKVRNPFVTDQELEESDNVSSVTGAESPPPSTTKKGKRSMQKRVVSVPIKDVEGSRLKGEGAPPSDSWAWRKYGQKPIKGSPYPRGYYRCSSSKGCPARKQVERSRVNPTMLVITYSCEHNHAWPASRHNNTSAKQAAAAAGEASESPTKSTTAVKHDPSTSQPDTEPDSGMEDGFACLTEDSILTTGDEFAWFGEMETTSSTVLESSLFSERDNSEADDTAVISPMREEDESLFADLGELPECSFVFRHQRNVGPQVGIC

SEQ ID NO: 702 - protein, 273 aa, Arabidopsis thaliana
  misc_feature (1)..(273): Public GI no. 49333385
  misc_feature: Utility: Useful for delaying flowering time
  misc_feature: Utility: Useful for increasing chlorophyll and photosynthetic capacity
  misc_feature: Utility: Useful for making smaller plants
  misc_feature: Utility: Useful for making stronger plants
MDSGGSSSSSFRKVRNPFVTDQELEESDNVSSVTGAESPPPSTTKKGKRSMQKRVVSVPIKDVEGSRLKGEGAPPSDSWAWRKYGQKPIKGSPYPRGYYRCSSSKGCPARKQVERSRVNPTMLVITYSCEHNHAWPASRHNNTSAKQAAAAAAGEASESPTKSSTAVKHEPSTSQPDTEPDSGMEDGFACLTEDSILTTGDEFAWFGEMETTSSTVLESPLFSERDNSEADDTAMIFPMREEDESLFADLEELPECSFVFRHQRNVGPQVGIC

SEQ ID NO: 703 - DNA, 1604 bp, Arabidopsis thaliana
  misc_feature (1)..(1604): Ceres CLONE ID no. 107731
  misc_feature (1)..(1604): Also known as  Ceres CDNA ID no. 23388514
  misc_feature (395)..(395): n is a, c, t, g, unknown, or other
  misc_feature (397)..(397): n is a, c, t, g, unknown, or other
aaaaaagagtcgcccattttcttctcatttttttttgctcttgacgaagaaaccaaaaaaaaaaaaaatgagagagatccttcatatccaaggcggtcaatgtggaaaccagatcggagcaaagttctgggaagtgatctgcgacgaacacggcattgatcacaccggtcaatacgtcggcgattctccgttacagcttgaacgtatcgatgtctatttcaacgaagctagcggtggaaagtacgttcctcgcgctgttcttatggatctggagcctggtaccatggattctctcagatctggtccgttcggtcagattttccgtcctgataacttcgtctttggtcaatctggtgccggaaataactgggcgaaaggtcattacaccgaagtcntngagttgattgattctgttctcgatgttgtgaggaaggaagctgagaacagcgattgtcttcaaggtttccaagtgtgtcattcattgggaggaggaactggatctggaatgggaactctattgatttctaagataagagaagagtatccagatcgtatgatgatgactttctcagtgtttccttctcctaaggtctctgacactgttgttgagccatacaatgcaactctctctgtgcatcagcttgtcgaaaacgctgacgagtgtatggttttggacaatgaggctctctacgatatctgtttccgtaccctcaagctcgctaatcctacctttggtgatcttaaccatctcatctctgctacaatgagtggtgttacttgctgtcttcgtttccctggtcagcttaactctgaccttaggaaactcgctgtgaaccttatcccattcccaaggcttcacttcttcatggttggtttcgcaccattgacatcgagaggatcacagcaatacagtgccttgagtgttcctgaactgacccagcagatgtgggatgcaaagaacatgatgtgtgctgctgaccctcgtcatggacgttacttgactgcatccgctgtgttccgtggaaagctgagcaccaaagaggttgacgagcagatgatgaacattcagaacaagaactcatcctactttgtggaatggatcccaaacaacgtcaagtccagtgtctgtgatattgcaccaaagggtttgaaaatggcgtctactttcattggtaactcaacctcaatccaggagatgttttaggcgtgtgagcgaacagttcacagctatgttcaggagaaaggctttccttcattggtacacaggagaaggcatggacgagatggagttcactgaagcagagagtaacatgaatgatcttgtcgcagagtaccagcagtaccaagatgctacagccggagaggaggagtacgaggaggaagaagaggagtacgagacttaagatgttgtcaatggctccctcggattcgtaagctgtgtaagcaagcagctttcactttcttctttccccttatcctgaatttttttcttcgtaatatctcttttattgtttcgttcatgtgtgttcgttttgttattgaaaccctatatcggttctggatttgttaaacttttgcgtgtattgcttattgtttttgtcggc

SEQ ID NO: 704 - protein, 331 aa, Arabidopsis thaliana
  misc_feature (64)..(197): Pfam Name: Tubulin; Pfam Description: Tubulin/FtsZ family, GTPase domain
  misc_feature (199)..(331): Pfam Name: Tubulin_C; Pfam Description: Tubulin/FtsZ family, C-terminal domain
  misc_feature: Utility: Useful for delaying flowering time
  misc_feature: Utility: Useful for increasing chlorophyll and photosynthetic capacity
  misc_feature: Utility: Useful for increasing increasing anthocyanin content
  misc_feature: Utility: Useful for making plants with altered leaf shape eg curled leaves
  misc_feature: Utility: Useful for making plants with modified flowers
  misc_feature (62)..(62): Xaa is any aa, unknown, or other
  misc_feature (63)..(63): Xaa is any aa, unknown, or other
MSISTKLAVESTFLALFLWIWSLVPWILSDLVRSVRFSVLITSSLVNLVPEITGRKVITPKXXELIDSVLDVVRKEAENSDCLQGFQVCHSLGGGTGSGMGTLLISKIREEYPDRMMMTFSVFPSPKVSDTVVEPYNATLSVHQLVENADECMVLDNEALYDICFRTLKLANPTFGDLNHLISATMSGVTCCLRFPGQLNSDLRKLAVNLIPFPRLHFFMVGFAPLTSRGSQQYSALSVPELTQQMWDAKNMMCAADPRHGRYLTASAVFRGKLSTKEVDEQMMNIQNKNSSYFVEWIPNNVKSSVCDIAPKGLKMASTFIGNSTSIQEMF

SEQ ID NO: 705 - protein, 381 aa, Glycine max
  misc_feature (1)..(381): Ceres CLONE ID no. 661643
  misc_feature: Utility: Useful for delaying flowering time
  misc_feature: Utility: Useful for increasing chlorophyll and photosynthetic capacity
  misc_feature: Utility: Useful for increasing increasing anthocyanin content
  misc_feature: Utility: Useful for making plants with altered leaf shape eg curled leaves
  misc_feature: Utility: Useful for making plants with modified flowers
MDLEPGTMDSVRSGPYGQIFRPDNFVFGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLATPTFGDLNHLISATMSGVTCCLRFPGQLNSDLRKLAVNLIPFPRLHFFMVGFAPLTSRGSQQYRALTVPELTQQMWDAKNMMCAADPRHGRYLTASAMFRGKMSTKEVDEQMINVQNKNSSYFVEWIPNNVKSSVCDIPPKGLKMASTFIGNSTSIQEMFRRVSEQFTAMFRRKAFLHWYTGEGMDEMEFTEAESNMNDLVAEYQQYQDATADEEEYEEEEEEEEIGA

SEQ ID NO: 706 - protein, 442 aa, Glycine max; identical to SEQ ID NO: 459
  misc_feature (1)..(442): Ceres CLONE ID no. 471579
  misc_feature: Utility: Useful for delaying flowering time
  misc_feature: Utility: Useful for increasing chlorophyll and photosynthetic capacity
  misc_feature: Utility: Useful for increasing increasing anthocyanin content
  misc_feature: Utility: Useful for making plants with altered leaf shape eg curled leaves
  misc_feature: Utility: Useful for making plants with modified flowers

SEQ ID NO: 707 - protein, 379 aa, Zea mays
  misc_feature (1)..(379): Ceres CLONE ID no. 364892
  misc_feature: Utility: Useful for delaying flowering time
  misc_feature: Utility: Useful for increasing chlorophyll and photosynthetic capacity
  misc_feature: Utility: Useful for increasing increasing anthocyanin content
  misc_feature: Utility: Useful for making plants with altered leaf shape eg curled leaves
  misc_feature: Utility: Useful for making plants with modified flowers
MDLEPGTMDSVRTGPYGQIFRPDNFVFGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLTTPSFGDLNHLISATMSGVTCCLRFPGQLNSDLRKLAVNLIPFPRLHFFMVGFAPLTSRGSQQYRALTVPELTQQMWDAKNMMCAADPRHGRYLTASAMFRGKMSTKEVDEQMINVQNKNSSYFVEWIPNNVKSSVCDIPPRGLSMASTFIGNSTSIQEMFRRVSEQFTAMFRRKAFLHWYTGEGMDEMEFTEAESNMNDLVSEYQQYQDATADEEEYEDEEEVHDE

SEQ ID NO: 708 - protein, 445 aa, Triticum aestivum; identical to SEQ ID NO: 465
  misc_feature (1)..(445): Ceres CLONE ID no. 726433
  misc_feature: Utility: Useful for delaying flowering time
  misc_feature: Utility: Useful for increasing chlorophyll and photosynthetic capacity
  misc_feature: Utility: Useful for increasing increasing anthocyanin content
  misc_feature: Utility: Useful for making plants with altered leaf shape eg curled leaves
  misc_feature: Utility: Useful for making plants with modified flowers

SEQ ID NO: 709 - protein, 445 aa, Zea mays; identical to SEQ ID NO: 464
  misc_feature (1)..(445): Ceres CLONE ID no. 705622
  misc_feature: Utility: Useful for delaying flowering time
  misc_feature: Utility: Useful for increasing chlorophyll and photosynthetic capacity
  misc_feature: Utility: Useful for increasing increasing anthocyanin content
  misc_feature: Utility: Useful for making plants with altered leaf shape eg curled leaves
  misc_feature: Utility: Useful for making plants with modified flowers

SEQ ID NO: 710 - protein, 373 aa, Zea mays
  misc_feature (1)..(373): Ceres CLONE ID no. 306678
  misc_feature: Utility: Useful for delaying flowering time
  misc_feature: Utility: Useful for increasing chlorophyll and photosynthetic capacity
  misc_feature: Utility: Useful for increasing increasing anthocyanin content
  misc_feature: Utility: Useful for making plants with altered leaf shape eg curled leaves
  misc_feature: Utility: Useful for making plants with modified flowers
MDSVRSGPFGQIFRPDNFVFGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLSTPSFGDLNHLISATMSGVTCCLRFPGQLNSDLRKLAVNLIPFPRLHFFMVGFAPLTSRGSQQYRALTVPELTQQMWDAKNMMCAADPRHGRYLTASAMFRGKMSTKEVDEQMLNVQNKNSSYFVEWIPNNVKSSVCDIPPRGLKMAGTFVGNSTSIQEMFRRVSEQFTAMFRRKAFLHWYTGEGMDEMEFTEAESNMNDLVAEYQQYQDATADEEYEDEEEEENVAE

SEQ ID NO: 711 - protein, 445 aa, Triticum aestivum; identical to SEQ ID NO: 458
  misc_feature (1)..(445): Ceres CLONE ID no. 861902
  misc_feature: Utility: Useful for delaying flowering time
  misc_feature: Utility: Useful for increasing chlorophyll and photosynthetic capacity
  misc_feature: Utility: Useful for increasing increasing anthocyanin content
  misc_feature: Utility: Useful for making plants with altered leaf shape eg curled leaves
  misc_feature: Utility: Useful for making plants with modified flowers

SEQ ID NO: 712 - protein, 447 aa, Triticum aestivum; identical to SEQ ID NO: 463
  misc_feature (1)..(447): Ceres CLONE ID no. 725504
  misc_feature: Utility: Useful for delaying flowering time
  misc_feature: Utility: Useful for increasing chlorophyll and photosynthetic capacity
  misc_feature: Utility: Useful for increasing increasing anthocyanin content
  misc_feature: Utility: Useful for making plants with altered leaf shape eg curled leaves
  misc_feature: Utility: Useful for making plants with modified flowers

SEQ ID NO: 713 - protein, 447 aa, Zea mays; identical to SEQ ID NO: 468
  misc_feature (1)..(447): Ceres CLONE ID no. 1412402
  misc_feature: Utility: Useful for delaying flowering time
  misc_feature: Utility: Useful for increasing chlorophyll and photosynthetic capacity
  misc_feature: Utility: Useful for increasing increasing anthocyanin content
  misc_feature: Utility: Useful for making plants with altered leaf shape eg curled leaves
  misc_feature: Utility: Useful for making plants with modified flowers

SEQ ID NO: 714 - protein, 445 aa, Zea mays; identical to SEQ ID NO: 460
  misc_feature (1)..(445): Ceres CLONE ID no. 422618
  misc_feature: Utility: Useful for delaying flowering time
  misc_feature: Utility: Useful for increasing chlorophyll and photosynthetic capacity
  misc_feature: Utility: Useful for increasing increasing anthocyanin content
  misc_feature: Utility: Useful for making plants with altered leaf shape eg curled leaves
  misc_feature: Utility: Useful for making plants with modified flowers

SEQ ID NO: 715 - protein, 445 aa, Zea mays; identical to SEQ ID NO: 467
  misc_feature (1)..(445): Ceres CLONE ID no. 264576
  misc_feature: Utility: Useful for delaying flowering time
  misc_feature: Utility: Useful for increasing chlorophyll and photosynthetic capacity
  misc_feature: Utility: Useful for increasing increasing anthocyanin content
  misc_feature: Utility: Useful for making plants with altered leaf shape eg curled leaves
  misc_feature: Utility: Useful for making plants with modified flowers

SEQ ID NO: 716 - protein, 444 aa, Triticum aestivum; identical to SEQ ID NO: 461
  misc_feature (1)..(444): Ceres CLONE ID no. 686137
  misc_feature: Utility: Useful for delaying flowering time
  misc_feature: Utility: Useful for increasing chlorophyll and photosynthetic capacity
  misc_feature: Utility: Useful for increasing increasing anthocyanin content
  misc_feature: Utility: Useful for making plants with altered leaf shape eg curled leaves
  misc_feature: Utility: Useful for making plants with modified flowers

SEQ ID NO: 717 - DNA, 1670 bp, Arabidopsis thaliana
  misc_feature (1)..(1670): Ceres CLONE ID no. 110454
  misc_feature (1)..(1670): Also known as  Ceres CDNA ID no. 23462475
aaaaaggatcaaacatagtatagcttggactctttttgccgtctatgatctctctcaatctctcatcttagctttctttctctctctctttgtgtcttcatttgtttatctcatcaatggattcaaattttcattactcgatagatcttaacgaagatcaaaaccatcacgaacaaccctttttctatcctcttggatcctcttcctcgcttcatcatcatcatcatcatcatcatcatcaagtcccttctaattcttcatcttcttcttcgtccatttcatcgctctcctcttacctccctttcttgatcaactctcaagaagatcaacatgttgcctacaacaacacttatcacgctgatcatctccatctttctcaacccctcaaggccaagatgtttgtggctaacggtggatcatcatcatgcgatcacatggtgccaaagaaggagacaagactgaaactaacgataaggaaaaaagatcacgaagaccaaccccatcctcttcatcaaaacccgacaaaacccgattcagactccgacaagtggttgatgtccccaaagatgcggttgatcaagaaaacaatcaccaacaataaacagctcactgatcagactaataataataatcataaagaaagtgatcactaccctttgaatcataagactaatttcgacgaggatcaccatgaagatcttaatttcaagaacgtcttgaccaggaagaccacggccgcgaccaccgagaatcgctacaatacaatcaacgagaacggttatagtaataacaatggcgtgattagggtttgttcggattgtaacaccaccaagactcctctttggcgaagtggacctcgaggtcccaagtctctttgtaacgcatgtggtatacggcaaagaaaggcaaggcgagccgctatggccgcggccgctgcagccggcgaccaagaggtggcggtagcgccccgagtgcaacaattaccgctgaaaaagaagttgcaaaataaaaaaaaagagatcaaacggaggggaaaaatacaatcactctcctccaatggtggccaaggccaaaaagtgcaagatcaaagaggaagaggagaaggaaatggaagcggaaacggttgccggagattcagagatcagcaaatctacaacttcttctaattcttcgatttcgtcaaacaaattttgcttcgatgatttgacaataatgttgagcaaaagctcagcttatcaacaagtgttcccacaagatgagaaggaggctgctgttttgctcatggctctgtcgtatggaatggttcacggttgatcagatcatcacaatatcctcattacaaaaaggtttattttaatagtaatatatagattatagtaatcataataatgattgattgttaaatcttggagtgattagtttagtttttgcagttggtctaatatcaggagtcaaaacattttataataagagtgtgtgagagtttaatatgataattaatagctctatatatgtttatggagattttggttttgagtttgttgtgtttttgttttccgatggaacgaacattagtcacccgataatgtgggtaattcttgttcatttacaagttttatagtactgtattgtgtaacgaggttggagaaataatataatcaattaagggt

SEQ ID NO: 718 - protein, 349 aa, Arabidopsis thaliana
  misc_feature (232)..(267): Pfam Name: GATA; Pfam Description: GATA zinc finger
  misc_feature: Utility: Useful for delaying flowering time
  misc_feature: Utility: Useful for increasing chlorophyll and photosynthetic capacity
  misc_feature: Utility: Useful for increasing increasing anthocyanin content
  misc_feature: Utility: Useful for making plants with increased biomass and foliage
  misc_feature: Utility: Useful for making smaller plants
MDSNFHYSIDLNEDQNHHEQPFFYPLGSSSSLHHHHHHHHHQVPSNSSSSSSSISSLSSYLPFLINSQEDQHVAYNNTYHADHLHLSQPLKAKMFVANGGSSSCDHMVPKKETRLKLTIRKKDHEDQPHPLHQNPTKPDSDSDKWLMSPKMRLIKKTITNNKQLTDQTNNNNHKESDHYPLNHKTNFDEDHHEDLNFKNVLTRKTTAATTENRYNTINENGYSNNNGVIRVCSDCNTTKTPLWRSGPRGPKSLCNACGIRQRKARRAAMAAAAAAGDQEVAVAPRVQQLPLKKKLQNKKKEIKRRGKIQSLSSNGGQGQKVQDQRGRGEGNGSGNGCRRFRDQQIYNFF

SEQ ID NO: 719 - protein, 353 aa, Arabidopsis thaliana
  misc_feature (1)..(353): Public GI no. 50906397
  misc_feature: Utility: Useful for delaying flowering time
  misc_feature: Utility: Useful for increasing chlorophyll and photosynthetic capacity
  misc_feature: Utility: Useful for increasing increasing anthocyanin content
  misc_feature: Utility: Useful for making plants with increased biomass and foliage
  misc_feature: Utility: Useful for making smaller plants
MSTIYMSQLPATLPLMEGDQDQGLYPAFHRAKDPPILFPFMIDSAVEHQGQIYGDQGLRRQQVLGESNQQFNDHMMMGGSDVFLTPSPFRPTIQSIGSDMIQRSSYDPYDIESNNKQHANGSTSKWMSTPPMKMRIIRKGAATDPEGGAVRKPRRRAQAHQDESQQQLQQALGVVRVCSDCNTTKTPLWRSGPCGPKSLCNACGIRQRKARRAMAAAANGGAAVAPAKSVAAAPVNNKPAAKKEKRAADVDRSLPFKKRCKMVDHVAAAVAATKPTAAGEVVAAAPKDQDHVIVVGGENAAATSMPAQNPISKAAATAAAAAASPAFFHGLPRDEITDAAMLLMTLSCGLVHS

SEQ ID NO: 720 - protein, 356 aa, Triticum aestivum
  misc_feature (1)..(356): Ceres CLONE ID no. 788183
  misc_feature: Utility: Useful for delaying flowering time
  misc_feature: Utility: Useful for increasing chlorophyll and photosynthetic capacity
  misc_feature: Utility: Useful for increasing increasing anthocyanin content
  misc_feature: Utility: Useful for making plants with increased biomass and foliage
  misc_feature: Utility: Useful for making smaller plants
MSTIYMSQLSTSFPLMEEDHHQDHHQGHFQAFTLPKDPPILFPFVISNSSPSDNSSLGYGSDQHLMQHHAMLDQPQHMIGGSSSVFSTPFPTVESIRDDMIERSYSYDPYDMEKLQATSGGSLKIGKWAAPAPAAKMRITRKTSDPGVKKPRKRAQAYEDHGHMGGMNQALGVIRTCSDCNTTKTPLWRSGPCGPKSLCNACGIRQRKARRAMMATGAAPATDVGAKAAAPGDAAVTVRPPKVKKEKRAVDVDRSLPFKKRCKVVQDHTATHDAASTTVEAAAEPPVVVPTTAPAAAPGSDLVDTIGANWSKSPTAAPAACFRPSPAPFAVPVPVQDEITDAAMLLMTLSCELVRS

SEQ ID NO: 721 - protein, 306 aa, Glycine max
  misc_feature (1)..(306): Ceres CLONE ID no. 544756
  misc_feature: Utility: Useful for delaying flowering time
  misc_feature: Utility: Useful for increasing chlorophyll and photosynthetic capacity
  misc_feature: Utility: Useful for increasing increasing anthocyanin content
  misc_feature: Utility: Useful for making plants with increased biomass and foliage
  misc_feature: Utility: Useful for making smaller plants
MTPYSLNPPGPSIQAGQTQLFNISPNNQDCRTIFNIFDPRKTRIEIGGLRDNYHQQDDKMMVLHDGSSSNSNKSSFNNNISPEPVVVMVDPIISSACDQQHNLPYEEESKNIDDHGSGNKWMSSKMRLMKKMMRPSMSPTTDKAINSGLESSSSRYSQRSLCNNNASSTTRVCSDCNTSTTPLWRSGPKGPKSLCNACGIRQRKARRAMTKATSGLITPITCAKTRVHNKEKKSRANHFAQFKNKYKSTTTTSAGSSEGVRKLEYLKDFAISLRSNNSDFEQGFPRDEVAEAALLLMDLSCGFVHL

SEQ ID NO: 722 - protein, 370 aa, Zea mays
  misc_feature (1)..(370): Ceres CLONE ID no. 1536888
  misc_feature: Utility: Useful for delaying flowering time
  misc_feature: Utility: Useful for increasing chlorophyll and photosynthetic capacity
  misc_feature: Utility: Useful for increasing increasing anthocyanin content
  misc_feature: Utility: Useful for making plants with increased biomass and foliage
  misc_feature: Utility: Useful for making smaller plants
MSAIYMSQLSTALPLMEGDHQDHHHHHQGHFQAFTLPKETPILFPFVISNSSASEGSLSYGSAADHHLLRQRHQAMLEPQHMIGGSSTATGNSVFSTPFPTVESIRDDMIEPASYDPYDMGKLQVGGSMDACSWTPAAAKMRITRKATADPSAGKKPRRRAQAGYDDTMSGQPNLGVIRVCSDCNTTKTPLWRSGPCGPKSLCNACGIRQRKARRAMMAAASGSVSAVPTDSGKASPSNAAVAAAAAHPKVKKEKRVDVDRSLPFKKRCKVVQQGHGAAVVVAAPAAATDSATVVQATAEDGDDDTCPSRDLLVDDIGGLISWSRSPAAPASAAAATCSFRASPALSVQQDEITDAAMLLMTLSCGLVRS

SEQ ID NO: 723 - DNA, 1257 bp, Arabidopsis thaliana
  misc_feature (1)..(1257): Ceres CLONE ID no. 116257
  misc_feature (1)..(1257): Also known as  Ceres CDNA ID no. 23374085
agtataaagacgacaaagtaaaccaaaaaaaaaagagttctcctacaattttcctaaattcttggatttgagatttcactttttccgatttgaaacaatgatgataactcgcggtggagccaaggcggcgaaatcgctgttaatggcggctggaccacgtttgttctcgacggtccgtacggtttcgtctcacgaggctttatcagcaagccatattttgaagcctggtgttacatctgcttggatatggactagagctccgacgattggaggtatgagattcgctagcacgatcactctgggagagaaaactccgatgaaggaggaggacgcgaatcagaagaaaacagagaacgaatccaccggtggagacgccgccggaggtaataacaagggagataaaggaatcgcgagctattggggtgttgaacctaataagattactaaagaagatggttctgaatggaagtggaactgtttcaggccatgggagacgtataaagctgatatagatagatctgaagaagcatcatgttccaacgacgtttcttgatagaatagcttattggactgttaaatctcttcgttggcctaccgatttgttcttccagaggagatatggatgtcgagctatgatgcttgaaactgtagcagcagtacctggaatggttggaggaatgttactacactgcaaatcgcttcgacgttttgagcaaagtggaggatggattaaggctcttcttgaggaagcagagaatgagagaatgcatcttatgacattcatggaagtcgcgaaaccgaaatggtacgagagagcgctcgtgatcactgtgcaaggagtcttcttcaacgcttatttccttggttacttaatctctcccaagtttgctcatcgtatggttgggtaccttgaagaagaagcgatccattcttatactgagtttctcaaggaacttgacaaaggtaacattgagaatgttcctgctccggctattgctattgattactggaggcttcctgctgatgcgacacttcgtgatgttgtgatggttgttcgtgctgacgaggctcatcaccgtgatgtaaaccattttgcatctgatattcactaccaaggtcgtgaactaaaggaagctccagctccaattgggtatcattgattcgattaaaagaagagctttttctcaagtttaaaactttgttctaaagaatttaagttctttgacttgtatatacataatcacctctgcttaagct

SEQ ID NO: 724 - protein, 175 aa, Arabidopsis thaliana
  misc_feature (1)..(173): Pfam Name: AOX; Pfam Description: Alternative oxidase
  misc_feature: Utility: Useful for delaying flowering time
  misc_feature: Utility: Useful for increasing chlorophyll and photosynthetic capacity
  misc_feature: Utility: Useful for making plants sterile and for genetic confinement
  misc_feature: Utility: Useful for making plants with increased biomass and foliage
  misc_feature: Utility: Useful for making stronger plants
MMLETVAAVPGMVGGMLLHCKSLRRFEQSGGWIKALLEEAENERMHLMTFMEVAKPKWYERALVITVQGVFFNAYFLGYLISPKFAHRMVGYLEEEAIHSYTEFLKELDKGNIENVPAPAIAIDYWRLPADATLRDVVMVVRADEAHHRDVNHFASDIHYQGRELKEAPAPIGYH

SEQ ID NO: 725 - protein, 325 aa, Arabidopsis thaliana
  misc_feature (1)..(325): Public GI no. 2506082
  misc_feature: Utility: Useful for delaying flowering time
  misc_feature: Utility: Useful for increasing chlorophyll and photosynthetic capacity
  misc_feature: Utility: Useful for making plants sterile and for genetic confinement
  misc_feature: Utility: Useful for making plants with increased biomass and foliage
  misc_feature: Utility: Useful for making stronger plants
MMMSRRYGAKLMETAVTHSHLLNPRVPLVTENIRVPAMGVVRVFSKMTFEKKKTTEEKGSSGGKADQGNKGEQLIVSYWGVKPMKITKEDGTEWKWSCFRPWETYKSDLTIDLKKHHVPSTLPDKLAYWTVKSLRWPTDLFFQRRYGCRAMMLETVAAVPGMVGGMLVHCKSLRRFEQSGGWIKALLEEAENERMHLMTFMEVAKPNWYERALVIAVQGIFFNAYFLGYLISPKFAHRMVGYLEEEAIHSYTEFLKELDNGNIENVPAPAIAIDYWRLEADATLRDVVMVVRADEAHHRDVNHYASDIHYQGRELKEAPAPIGYH

SEQ ID NO: 726 - protein, 320 aa, Glycine max
  misc_feature (1)..(320): Ceres CLONE ID no. 604415
  misc_feature: Utility: Useful for delaying flowering time
  misc_feature: Utility: Useful for increasing chlorophyll and photosynthetic capacity
  misc_feature: Utility: Useful for making plants sterile and for genetic confinement
  misc_feature: Utility: Useful for making plants with increased biomass and foliage
  misc_feature: Utility: Useful for making stronger plants
MMMMSRSGANRVANTAMFVAKGLSGEVGGLRALYGGGVRSESTLALSEKEKIEKKVGLSSAGGNKEEKVIVSYWGIQPSKITKKDGTEWKWNCFRPWETYKADLSIDLEKHHAPTTFLDKMAFWTVKVLRYPTDVFFQRRYGCRAMMLETVAAVPGMVAGMLLHCKSLRRFEHSGGWIKALLEEAENERMHLMTFMEVAKPKWYERALVITVQGVFFNAYFLGYLLSPKFAHRMVGYLEEEAIHSYTEFLKELDKGNIENVPAPAIAIDYWQLPPGSTLRDVVMVVRADEAHHRDVNHFASDIHYQGRELREAAAPIGYH

SEQ ID NO: 727 - protein, 321 aa, Glycine max
  misc_feature (1)..(321): Public GI no. 395216
  misc_feature: Utility: Useful for delaying flowering time
  misc_feature: Utility: Useful for increasing chlorophyll and photosynthetic capacity
  misc_feature: Utility: Useful for making plants sterile and for genetic confinement
  misc_feature: Utility: Useful for making plants with increased biomass and foliage
  misc_feature: Utility: Useful for making stronger plants
MMMMMSRSGANRVANTAMFVAKGLSGEVGGLRALYGGGVRSESTLALSEKEKIEKKVGLSSAGGNKEEKVIVSYWGIQPSKITKKDGTEWKWNCFSPWGTYKADLSIDLEKHMPPTTFLDKMAFWTVKVLRYPTDVFFQRRYGCRAMMLETVAAVPGMVAGMLLHCKSLRRFEHSGGWFKALLEEAENERMHLMTFMEVAKPKWYERALVITVQGVFFNAYFLGYLLSPKFAHRMFGYLEEEAIHSYTEFLKELDKGNIENVPAPAIAIDYWQLPPGSTLRDVVMVVRADEAHHRDVNHFASDIHYQGRELREAAAPIGYH

SEQ ID NO: 728 - protein, 328 aa, Zea mays
  misc_feature (1)..(328): Ceres CLONE ID no. 292667
  misc_feature: Utility: Useful for delaying flowering time
  misc_feature: Utility: Useful for increasing chlorophyll and photosynthetic capacity
  misc_feature: Utility: Useful for making plants sterile and for genetic confinement
  misc_feature: Utility: Useful for making plants with increased biomass and foliage
  misc_feature: Utility: Useful for making stronger plants
MSSRAGSILLRHAGSRLFTAAAISPAAASRPLLAGGNGVPAVMLRLMSTSSPAAPTEAKDEAAKASKVGGDKKAVVINSYWGIEQNNKLARDDGTEWKWTCFRPWETYTADTSIDLTRHYEPKTLMDKVAYWTVKSLRFPTDIFFQRRYGCRAMMLETVAAVPGMVGGMLLHLRSLRRFEQSGGWIRALLEEAENERMHLMTFMEVAKPRWYERALVITVQGVFFNAYFLGYLLSPKFAHRVVGYLEEEAIHSYTEYLKDLEAGKIENVPAPAIAIDYWRLPANATLKDVVTVVRADEAHHRDVNHFASDIHCQGMQLKQSPAPIGYH

SEQ ID NO: 729 - protein, 332 aa, Triticum aestivum
  misc_feature (1)..(332): Ceres CLONE ID no. 569711
  misc_feature: Utility: Useful for delaying flowering time
  misc_feature: Utility: Useful for increasing chlorophyll and photosynthetic capacity
  misc_feature: Utility: Useful for making plants sterile and for genetic confinement
  misc_feature: Utility: Useful for making plants with increased biomass and foliage
  misc_feature: Utility: Useful for making stronger plants
MAGSVLLRRAGAGASRLFATTPSPAARAVLGGGEGAWVRLMSTSAASQVKDEAAKAVKAEAAKAVKAEAAKGDGEKKEVAISSYWGIEQSKKLVREDGTEWKWSCFRPWETYTADTSIDLTKHHVPNTMLDKIAYYTVKSLRFPTDIFFQRRYGCRAMMLETVAAVPGMVGGMLLHLRSLRRFEQSGGWIRALLEEAENERMHLMTFMEVAQPRWYERALVIAVQGVFFNAYFFGYLISPKFAHRVVGYLEEEAVHSYTEFLKDLDDGKIDNVPAPAIAIDYWRLPANATLKDVVTVVRADEAHHRDVNHFASDVYYQGMQLKATPAPIGYH

SEQ ID NO: 730 - protein, 324 aa, Triticum aestivum
  misc_feature (1)..(324): Ceres CLONE ID no. 780669
  misc_feature: Utility: Useful for delaying flowering time
  misc_feature: Utility: Useful for increasing chlorophyll and photosynthetic capacity
  misc_feature: Utility: Useful for making plants sterile and for genetic confinement
  misc_feature: Utility: Useful for making plants with increased biomass and foliage
  misc_feature: Utility: Useful for making stronger plants
MAGSVLLRRAGAGAGRLFATTASPAARTALGGGGGAWVRMMSTSAASQVKDEAAKGVKAEAAKGDGEKKEVAISSYWGIDQSKKLVREDGTEWKWSCFRPWETYTADTSIDLTKHHVPNTMLDKIAYYTVKSLRFPTDIFFQRRYGCRAMMLETVAAVPGMVGGMLLHLRSLRRFEQSGGWIRALLEEAENERMHLMTFMEVAQPRWYERALVIAVQGVFFNAYFFGYLISPKFAHRVVGYLEEEAVHSYTEFLKDLDDGKIDNVPAPAIAIDYWRLPANATLKDVVTVVRADEAHHRDVNHFASDVYYQGMQLKATPAPIGYH

SEQ ID NO: 731 - protein, 328 aa, Zea mays
  misc_feature (1)..(328): Ceres CLONE ID no. 322131
  misc_feature: Utility: Useful for delaying flowering time
  misc_feature: Utility: Useful for increasing chlorophyll and photosynthetic capacity
  misc_feature: Utility: Useful for making plants sterile and for genetic confinement
  misc_feature: Utility: Useful for making plants with increased biomass and foliage
  misc_feature: Utility: Useful for making stronger plants
MAGAALLRHLGPRLFAAGPAVSGLTARGGMPAAARLLPARMASTAAEAAREDAGANKRHGGTEKHEEEAAGGQSKKAVVSYWGIDTPKLVKEDGTEWKWTSFRPWDAYTSDTSIDIGKHHAPTTLPDKAAYLIVKSLHVPMDLFFQRRHASHALLLETVAAVPGMVGGMLLHLRSLRRFEHSGGWIRALLEEAENERMHLMTFLEVTQPRWWERALVLTAQGVFFNAYFVGYLLSPKFAHRVVGYLEEEAVHSYTEYLKDLEAGIIDNTPAPAIAIDYWRLPADAKLKDVVTVVRADEAHHRDVNHFASVRTLHLATGFIAVSNLQQF

SEQ ID NO: 732 - protein, 303 aa, Glycine max
  misc_feature (1)..(303): Ceres CLONE ID no. 544846
  misc_feature: Utility: Useful for delaying flowering time
  misc_feature: Utility: Useful for increasing chlorophyll and photosynthetic capacity
  misc_feature: Utility: Useful for making plants sterile and for genetic confinement
  misc_feature: Utility: Useful for making plants with increased biomass and foliage
  misc_feature: Utility: Useful for making stronger plants
MPYAAAETRLLCAGGANGWFFYWKRTMVSPAEAKVPEKEKEKEKAKAEKSVVESSYWGISRPKVVREDGTEWPWNCFMPWESYRSNVSIDLTKHHVPKNVLDKVAYRTVKLLRIPTDLFFKRRYGCRAMMLETVAAVPGMVGGMLLHLRSLRKFQQSGGWIKALLEEAENERMHLMTMVELVKPKWYERLLVLAVQGVFFNAFFVLYILSPKVAHRIVGYLEEEAIHSYTEYLKDLESGAIENVPAPAIAIDYWRLPKDARLKDVITVIRADEAHHRDVNHFASDIHFQGKELREAPAPIGYH

SEQ ID NO: 733 - DNA, 1425 bp, Arabidopsis thaliana
  misc_feature (1)..(1425): Ceres CLONE ID no. 116843
  misc_feature (1)..(1425): Also known as  Ceres CDNA ID no. 23374523
aatggcgtcgacgaagcccgattccgcaatcaaccttgaagaagaggctgaaggcgacggtgtagccgtagacgatccgattttcataccggagaccacgaacttactcgtccgttactcgccattcgacgacagggacatcgattgcaatccttatttccctttcacaggcccgatttcagattctggatcaggttcttactcggattctgagcccgatcccaacagctgtcccatcgatttcttcgatcgagattcttccgatgttgacgtggctgagtacttggaatcaggagggctgaccgccggtgattataatatttggggcttttatgaccccaaggaagacgaggaagaggaggagatagttttggggacttccgggtcggatctgcaaccgggtgattcaggggagcaagggcttcgagtgaccggtatcgattcagattccgattgtgaagatggcgtgtttgattttatctctgaggatagtagcgggaataggggaaatgattcgggtcgggtcgaggttggtacgggtcttcctcctgtgtgggatcatctcttcggagagggaaccgtgttggctgatgaagaatgggaggaggtgcagaacgcgattaactggacagcttttagtggacccgaagatgaggacgaagaagatgaattgtcttcactatcaagggatgatgaagaagaagatcatgaactggactggcaggttttgttaactgttaacaatgttgttaattatatcgaacaagctgaaggaatcatgctaaatcctgatgatatcgatccggattattacctgtatctatctggtttggatgaatttgatgaaaatcagagtggacattatgatgctgatgctattcttgggcaaatgtttgatgacgagactggaatcaggggaaatcctccagcagccaaaagtgtaattcaggatcttccggttgtggagcttgctgtggaagagttagacaaagggaacaatgtttgtgcggtatgcaaagatgaaatgttagtggaggagaaagtaaggaggcttccttgtagtcatttctatcatggagagtgtatcataccttggttggggataaggaatacttgcccggtttgtcggtatgagctgcctactgatgatcttgagtatgaaagacataagagctcagaaaggggcgatactggtttggcaaggaacgtgttgccgggtagatatagttaattgaatatttgaagtgatctattcttcaagttaatagacatggtttcagaggcaagatccttgaaccactttgtttatggtaagcacttatcgtgaatgtgataatgtttaagttgtatatattccttttgttttgtgaaataaatcatgttaaactttgaacccttatcttgaagtgtttgtgaagttaattc

SEQ ID NO: 734 - protein, 409 aa, Arabidopsis thaliana
  misc_feature (335)..(375): Pfam Name: zf-C3HC4; Pfam Description: Zinc finger, C3HC4 type (RING finger)
  misc_feature: Utility: Useful for delaying flowering time
  misc_feature: Utility: Useful for making ornamental plants with modified flowers
  misc_feature: Utility: Useful for making plants sterile and for genetic confinement
  misc_feature: Utility: Useful for making smaller plants
  misc_feature: Utility: Useful for modifying plant architecture, ie amount of  branching
MASTKPDSAINLEEEAEGDGVAVDDPIFIPETTNLLVRYSPFDDRDIDCNPYFPFTGPISDSGSGSYSDSEPDPNSCPIDFFDRDSSDVDVAEYLESGGLTAGDYNIWGFYDPKEDEEEEEIVLGTSGSDLQPGDSGEQGLRVTGIDSDSDCEDGVFDFISEDSSGNRGNDSGRVEVGTGLPPVWDHLFGEGTVLADEEWEEVQNAINWTAFSGPEDEDEEDELSSLSRDDEEEDHELDWQVLLTVNNVVNYIEQAEGIMLNPDDIDPDYYLYLSGLDEFDENQSGHYDADAILGQMFDDETGIRGNPPAAKSVIQDLPVVELAVEELDKGNNVCAVCKDEMLVEEKVRRLPCSHFYHGECIIPWLGIRNTCPVCRYELPTDDLEYERHKSSERGDTGLARNVLPGRYS

SEQ ID NO: 735 - protein, 131 aa, Arabidopsis thaliana
  misc_feature (1)..(131): Public GI no. 4651204
  misc_feature: Utility: Useful for delaying flowering time
  misc_feature: Utility: Useful for making ornamental plants with modified flowers
  misc_feature: Utility: Useful for making plants sterile and for genetic confinement
  misc_feature: Utility: Useful for making smaller plants
  misc_feature: Utility: Useful for modifying plant architecture, ie amount of  branching
ERGVGLEHEDENIADLYLAVQDGIISGTTDYDILFGQLLENESGLKGSPPTAKSFVENLPLVELTEEELKGKDIVCAVCKDEVMLEEKVRKLPCSHCYHGDCILPWLSIRNTCPVCRFELPTDDADYERSK

SEQ ID NO: 736 - protein, 298 aa, Zea mays
  misc_feature (1)..(298): Ceres CLONE ID no. 299434
  misc_feature: Utility: Useful for delaying flowering time
  misc_feature: Utility: Useful for making ornamental plants with modified flowers
  misc_feature: Utility: Useful for making plants sterile and for genetic confinement
  misc_feature: Utility: Useful for making smaller plants
  misc_feature: Utility: Useful for modifying plant architecture, ie amount of  branching
MADFGDELFLDVGDDGFGDLSYVSFSESIELDLACPRDVFSAGFDPETLTHIPGSPISFDSDPDLRHLSPSLTCSPPFWDCLDDAASFEWEEIADAALGVGGGAGGAGGGGQGLEGDADADADVFGFLDEREMLGVMEGIDSGDDDSIFSDEPPFDFGDGDTELEGIFRSGVGWELLPVPLDEDEFEVLPGHVVEVGGAPPAARAVVERLQVVAVRGEEVVQECAVCKEGMEQGELTTGLPCGHFYHGACIGPWLAIRNTCPVCRYELPTDDPEYEKRRARRHSAGGSTPQLGAPMQV

SEQ ID NO: 737 - protein, 271 aa, Zea mays
  misc_feature (1)..(271): Public GI no. 50947067
  misc_feature: Utility: Useful for delaying flowering time
  misc_feature: Utility: Useful for making ornamental plants with modified flowers
  misc_feature: Utility: Useful for making plants sterile and for genetic confinement
  misc_feature: Utility: Useful for making smaller plants
  misc_feature: Utility: Useful for modifying plant architecture, ie amount of  branching
MASSSLLVRLASDEMPQTLDASSSSSCYDAFVPVFHPDPSSGFSAASVVAAADRLRSQFLSVEPDLFHDALVAPSPDHLGFPDEEEEEEIRWDCLQLDDDDEEEEGVADLRLEASNAAEEFDWEEVASPSGGAGMDQPEPEWEVLADVPPPPPPPADEGFVYTSDRDVYEVLVGEGLFLKSKPPAARSAVEALPSAVVAAGEDGEGEECAVCRDGVAAGERVKRLPCSHGYHEECIMPWLDVRNSCPLCRFELPTDDPQYESWKASRAAAA

SEQ ID NO: 738 - DNA, 1669 bp, Arabidopsis thaliana
  misc_feature (1)..(1669): Ceres CLONE ID no. 119256
  misc_feature (1)..(1669): Also known as  Ceres CDNA ID no. 23375558
atttctaatatctctttccatttcttgaaatggtcctcctctcaccttaactttataagaatctgaccacctctcaggtttccagtttcttcactttctcgttctctggacactgaatgtgatacatatatagaagaagaaagctataagagattgatcgatggaggtgaatgttcttgcatccaagagaagtcttctcctttttcttcttattgtaagtctctctttgagccagaaggtcagacatatctctgcctttaacgacaccaaaccatacagacaagtcagtagcttgagacttgcgaggatccaaaagcacttgaacaagatcaacaagtctcctgtcttcaccattcagagtccagatggtgatgtaatagattgtgtacccaaaagaaagcagccagctttggatcatccactcttaaagcatcacaagattcagaaagcaccgaagaaaatgccgaagatgaagggaaaagatgatgatgttaaagaagcagagaatgtattggaaggtgcatggcaaatgtggcacgtgaacggcacgaggtgccctaaggggaccgttcccatacgacgcaacacaatgaacgatgtgctcagagccaagtctttgtttgactttggcaaaaagcgacggagtatttaccttgatcaacggacagaaaagcctgatgcccttggtaccaatggacatgagcatgcgatcgcttatacagaatcatcgtcggagatatatggagcaaaggcgactataaacgtttgggatccaaagatagaagaagtgaatgagtttagtctctctcagatttggattctttctggatctttcgtaggtcctgatctcaatagtattgaagctggctggcaggtcagtccggagctgtatggtgacaacagaccaagattgttcacttattggacgagtgattcatatcaagcaacaggatgttacaatcttctatgttcgggatttatccaaacaaataacaagattgccattggagcagccatatctcctctttctactttcaaaggaaaccagtttgatatcacaatactcatttggaaggatccgaaaatggggaattggtggatgggtttaggggatagcacactagtcgggtattggccagccgagctattcacgcacttggccgaccacgcgactaccgtggaatggggcggtgaagtcgtcaacacacgtgcttcaggcaggcacacgacgacccaaatgggctctggtcattttccagacgaagggtttgggaaagcaagttattttcggaatttggaagttgtggattcggacaacagtctcgtaccggtgcatgatgtcaagatactagccgagaacaccgaatgttacgacattaagagttcgtatagtaatgaatggggaacttatttttactatggtgggccggggtttaatcctaggtgtaattgaaattaaagtgtacatagttcgggttggaggagtggaggaaaaaaaagagggggtcgaaatatgtaatttttttcaagtatgggtagtgaaagattgaatattggcttattgtttttgatttgtcatattgttggttgaaatctagtaatttattgccctcataggaaaaagaagtgtgtatgcaataatgaaagtatgagacaattttttctttgc

SEQ ID NO: 739 - protein, 430 aa, Arabidopsis thaliana
  misc_feature (193)..(388): Pfam Name: DUF239; Pfam Description: Arabidopsis proteins of unknown function
  misc_feature: Utility: Useful for delaying flowering time
  misc_feature: Utility: Useful for increasing chlorophyll and photosynthetic capacity
  misc_feature: Utility: Useful for making plants sterile and for genetic confinement
  misc_feature: Utility: Useful for making plants with increased biomass and foliage
  misc_feature: Utility: Useful for making smaller plants
MEVNVLASKRSLLLFLLIVSLSLSQKVRHISAFNDTKPYRQVSSLRLARIQKHLNKINKSPVFTIQSPDGDVIDCVPKRKQPALDHPLLKHHKIQKAPKKMPKMKGKDDDVKEAENVLEGAWQMWHVNGTRCPKGTVPIRRNTMNDVLRAKSLFDFGKKRRSIYLDQRTEKPDALGTNGHEHAIAYTESSSEIYGAKATINVWDPKIEEVNEFSLSQIWILSGSFVGPDLNSIEAGWQVSPELYGDNRPRLFTYWTSDSYQATGCYNLLCSGFIQTNNKIAIGAAISPLSTFKGNQFDITILIWKDPKMGNWWMGLGDSTLVGYWPAELFTHLADHATTVEWGGEVVNTRASGRHTTTQMGSGHFPDEGFGKASYFRNLEVVDSDNSLVPVHDVKILAENTECYDIKSSYSNEWGTYFYYGGPGFNPRCN

SEQ ID NO: 740 - protein, 306 aa, Zea mays
  misc_feature (1)..(306): Ceres CLONE ID no. 324710
  misc_feature: Utility: Useful for delaying flowering time
  misc_feature: Utility: Useful for increasing chlorophyll and photosynthetic capacity
  misc_feature: Utility: Useful for making plants sterile and for genetic confinement
  misc_feature: Utility: Useful for making plants with increased biomass and foliage
  misc_feature: Utility: Useful for making smaller plants
MLQMWHRNGRCPEGTVPIRRTKKDDLLRASSVRRYGRKRHTAPNPLSVDPNMLSEGGHQHAIAYVQGDKYYGAKATINVWEPKIQQANEFSLSQLWILGGSFGEDLNSIEAGWQVSPDLYGDNNTRLFTYWTSDAYQATGCYNMLCSGFIQINSEVAMGASIFPISNYAGSQYDISILIWKDPKEGNWWMQFGKEYVLGYWPSFLFSYLADSASMIEWGGEVVNSEPDGTHTSTQMGSGHFPEEGFSKASYFKNVQVVYSSNQLSAPKGVGTFTEQSNCYDVQNGNNGDWGTYFYYGGPGKNSNCP

SEQ ID NO: 741 - protein, 408 aa, Zea mays
  misc_feature (1)..(408): Public GI no. 50935081
  misc_feature: Utility: Useful for delaying flowering time
  misc_feature: Utility: Useful for increasing chlorophyll and photosynthetic capacity
  misc_feature: Utility: Useful for making plants sterile and for genetic confinement
  misc_feature: Utility: Useful for making plants with increased biomass and foliage
  misc_feature: Utility: Useful for making smaller plants
MAAAWVLAAAAALALWAAAAEGARSPAARVHRHLKRLNKPAVKSIESPDGDIIDCVHLSHQPAFDHPLLKNHTLQMRPAYHPEGLYDDDKRSVASDNAGEKPMLQLWHQKGRCPEGTVPIRRTKKDDLLRASSLRRYGRKRHTAVNPLSIDPNMLNEGGHQHAIAYVEGDKYYGAKATINVWEPKIQQPNEFSLSQLWILGGSFGEDLNSIEAGWQVSPDLYGDNNTRLFTYWTSDAYQATGCYNILCSGFIQINSEIAMGASIFPISNIAGSQYDISILIWKDPKEGNWWMQFGREYVLGYWPSFLFSYLVDSASMVEWGGEVVNSEPDGTHTSTQMGSGRFPEEGFGKASYFKNIQVVDSSNQLKAPKGVGTYTEQSNCYDVQNGNNGDWGTYFYYGGPGKNSNCP

SEQ ID NO: 742 - protein, 428 aa, Zea mays
  misc_feature (1)..(428): Ceres CLONE ID no. 403558
  misc_feature: Utility: Useful for delaying flowering time
  misc_feature: Utility: Useful for increasing chlorophyll and photosynthetic capacity
  misc_feature: Utility: Useful for making plants sterile and for genetic confinement
  misc_feature: Utility: Useful for making plants with increased biomass and foliage
  misc_feature: Utility: Useful for making smaller plants
MAAARACFVALALVAALFVAGSAAAAAGNAGGRSQLTLRQRRRQLLRQRQVRSHLKRLNKAPLATIESPDGDIIDCVHISNQPALDHPFLKNHTVQMRPAYHPEGLYDDESKVASQRNAQTITQMWHQNGRCPEGTIPIRRTKEEDVLRASSVRRYGKKKRRSAPNPMSVDPDMLNESGHQHAIAYVEGDKYYGAKATINVWQPKIEQANEFSLSQLWILGGSFGQDLNSIEAGWQVSPDLYGDNNTRLFTYWTSDAYQATGCYNLLCSGFIQINNQIAMGASIFPISNYGGSQYDINILVWKDPKEGNWWLQFGNDYVLGYWPSFLFSYLADSASMIEWGGEVVNSEPDGSHTSTQMGSGHFPEEGFGKASYFRNVQVVDSTNNLKAPRGVGTFTEQSSCYDVQDGSNADWGTYFYYGGPGKNSNCP

SEQ ID NO: 743 - protein, 418 aa, Glycine max
  misc_feature (1)..(418): Ceres CLONE ID no. 473726
  misc_feature: Utility: Useful for delaying flowering time
  misc_feature: Utility: Useful for increasing chlorophyll and photosynthetic capacity
  misc_feature: Utility: Useful for making plants sterile and for genetic confinement
  misc_feature: Utility: Useful for making plants with increased biomass and foliage
  misc_feature: Utility: Useful for making smaller plants
MGSSCGCGVTLVLVFCLWGVLISLSSAARLSASRQKLEVAKHLNRLNKPPVKTIQSPDGDTIDCVPISKQPAFDHPFLKDHKIQTRPSFHPEGLFEENKLSEKPDAKTHTPITQLWHANGRCPEDTIPVRRAKEEDVLRASSVKRYGRKKHRAIPKPRSAEPDLINQSGHQHAIAYVEGDKYYGAKATLNVWEPRIQQPNEFSLSQLWILGGSFGQDLNSIEAGWQVSPDLYGDNNTRLFTYWTSDAYQATGCYNLLCSGFIQVNSEIAMGATISPVSAYRNSQFDISILIWKDPKEGHWWMQFGNDYVLGYWPSFLFSYLADSASMIEWGGEVVNSEPDGQHTSTQMGSGHFPEEGFGKASYFRNIQVVDSSNNLKAPKGIGTFTEQSNCYDVQTGSNGDWGHYFYYGGPGKNPNCQ

SEQ ID NO: 744 - protein, 419 aa, Triticum aestivum
  misc_feature (1)..(419): Ceres CLONE ID no. 847500
  misc_feature: Utility: Useful for delaying flowering time
  misc_feature: Utility: Useful for increasing chlorophyll and photosynthetic capacity
  misc_feature: Utility: Useful for making plants sterile and for genetic confinement
  misc_feature: Utility: Useful for making plants with increased biomass and foliage
  misc_feature: Utility: Useful for making smaller plants
MAAPYSPSPSPSHPTAAALVLLLLLLHVALLGKCAAAANVTFRPGEELRRYRRVQALLTRLNKPSLRTIQSPDGDLIDCVPAHLQPAFDYPRLRGQRPLGPPVRPSGHHRRPNHTADVGVQLWAVSGASCPEGSVPVRRITEADVLRASSVRRFGRVPMARVRRDTVAGGHEHAVGYVAGDEYYGARASINVWAPKVSTPTEFSLSQIWVIGGTFGNDLNTIEAGWQVSPQLYGDNSPRFFTYWTTDAYQTTGCYNLLCSGFVQTNSRIAMGAAISPTSGYKGGQFDISLLIWKDPNHGNWWLEFGSGELVGYWPSFLFSHLASHASMVQFGGKVVDTRAEGSHTATQMGSGHFPGEGFGRSSYFRNLEVVDWDNSLIPLTTFHVTADHPNCYDIQGGVNAVWGNYFYYGGPGRNVRCT

SEQ ID NO: 745 - protein, 430 aa, Triticum aestivum
  misc_feature (1)..(430): Public GI no. 50938543
  misc_feature: Utility: Useful for delaying flowering time
  misc_feature: Utility: Useful for increasing chlorophyll and photosynthetic capacity
  misc_feature: Utility: Useful for making plants sterile and for genetic confinement
  misc_feature: Utility: Useful for making plants with increased biomass and foliage
  misc_feature: Utility: Useful for making smaller plants
MAAAAAARRGCLVALLAVLFLACAAEGGAAAASAAQQQQQLRRRRHLLRRQRQVHSHLRRLNKAPLASIESPDGDIIDCVHISNQPAFDHPFLKNHTIQMRPDYHPEGLYDESKVASQQNTQTITQMWHKNGVCPENTIPIRRTKKEDVLRASSIRRYGKKKHKSTPNPMSVDPDMLNESGHQHAIAYVEGDKYYGAKATINVWQPRIEQANEFSLSQLWILGGSFGQDLNSIEAGWQVSPDLYGDNNTRLFTYWTSDAYQATGCYNLLCSGFIQINNQIAMGASISPLSNYGGSQYDINILVWKDPKEGNWWLQFGNDYVLGYWPSFLFSYLADSASMIEWGGEVVNSEPDGSHTSTQMGSGHFPEEGFGKSSYFKNIQVVDSSNNLRAPSGIGSFTEQSNCYDVQNGNNGDWGTYFYYGGPGKNPNCP

SEQ ID NO: 746 - DNA, 1385 bp, Arabidopsis thaliana
  misc_feature (1)..(1385): Ceres CLONE ID no. 123905
  misc_feature (1)..(1385): Also known as  Ceres CDNA ID no. 23449548
gaaaacaaaaacacaaacaaaactcatattttcaatctccaggtgctttacaccaacagagtcgcaagaaaacaaaaaccaaactcggatttagtttgacagaagaaggaatcgagagtcgggtatgcattatcctaacaacagaaccgaattcgtcggagctccagccccaacccggtatcaaaaggagcagttgtcaccggagcaagagctttcagttattgtctctgctttgcaacacgtgatctcaggggaaaacgaaacggcgccgtgtcagggtttttccagtgacagcacagtgataagcgcgggaatgcctcggttggattcagacacttgtcaagtctgtaggatcgaaggatgtctcggctgtaactactttttcgcgccaaatcagagaattgaaaagaatcatcaacaagaagaagagattactagtagtagtaacagaagaagagagagctctcccgtggcgaagaaagcggaaggtggcgggaaaatcaggaagaggaagaacaagaagaatggttacagaggagttaggcaaagaccttggggaaaatttgcagctgagatcagagatcctaaaagagccacacgtgtttggcttggtactttcgaaaccgccgaagatgcggctcgagcttatgatcgagccgcgattggattccgtgggccaagggctaaactcaacttcccctttgtggattacacgtcttcagtttcatctcctgttgctgctgatgatataggagcaaatgcaagtgcaagcgccagtgtgagcgccacagattcagttgaagcagagcaatggaacggaggaggaggggattgcaatatggagtggatgaatatgatgatgatgatggattttgggaatggagattcttcagattcaggaaatacaattgctgatatgttccagtgataaatgagctctttcttgttggcgttttttggagttaagtgcaagaagagattgacactgtggcttgtttaaagtgaacaagaacaagaaagcatgtaattagtagtctcattcttttgtttgtggtcaattctatgtttatctcatataaaatctgagttaaacctatctgaggagagagtaaataaagaggttaagaaacccaacattggtctgaattataaacgtaagtgtcaacgttgtttataaaggagaaaactataattggtgacaaaagacataaagaaaagatgtctactcctacaaagcatcgcgtgcagctattcgacaaacaatggcatctcccagagaggaaattccgagctcttggctagttatcttgtaatgctgaaaacatgaatgtatttgagtttatttctgtaacattggaagcgaaataaaagggttatcaactgtt

SEQ ID NO: 747 - protein, 267 aa, Arabidopsis thaliana
  misc_feature (134)..(197): Pfam Name: AP2; Pfam Description: AP2 domain
  misc_feature: Utility: Useful for delaying flowering time
  misc_feature: Utility: Useful for increasing chlorophyll and photosynthetic capacity
  misc_feature: Utility: Useful for making larger plants
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with altered leaf shape eg curled leaves
  misc_feature: Utility: Useful for making plants with enhanced plant architecture
  misc_feature: Utility: Useful for making plants with increased biomass
  misc_feature: Utility: Useful for making plants with increased biomass and foliage
  misc_feature: Utility: Useful for making smaller plants
  misc_feature: Utility: Useful for modifying plant structure, ie increased branching
MHYPNNRTEFVGAPAPTRYQKEQLSPEQELSVIVSALQHVISGENETAPCQGFSSDSTVISAGMPRLDSDTCQVCRIEGCLGCNYFFAPNQRIEKNHQQEEEITSSSNRRRESSPVAKKAEGGGKIRKRKNKKNGYRGVRQRPWGKFAAEIRDPKRATRVWLGTFETAEDAARAYDRAAIGFRGPRAKLNFPFVDYTSSVSSPVAADDIGANASASASVSATDSVEAEQWNGGGGDCNMEWMNMMMMMDFGNGDSSDSGNTIADMFQ

SEQ ID NO: 748 - protein, 214 aa, Zea mays
  misc_feature (1)..(214): Ceres CLONE ID no. 392659
  misc_feature: Utility: Useful for delaying flowering time
  misc_feature: Utility: Useful for increasing chlorophyll and photosynthetic capacity
  misc_feature: Utility: Useful for making larger plants
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with altered leaf shape eg curled leaves
  misc_feature: Utility: Useful for making plants with enhanced plant architecture
  misc_feature: Utility: Useful for making plants with increased biomass
  misc_feature: Utility: Useful for making plants with increased biomass and foliage
  misc_feature: Utility: Useful for making smaller plants
  misc_feature: Utility: Useful for modifying plant structure, ie increased branching
MAAPRLERGGFQLPNTEQENSLFLRALISVVSGDTAALLPEAAAVEAPAAPVACARCGADGCAAAGCCELVAGSSSDSDGGLGLAAGKRRGRGRKVIQYRGVRRRPWGKWAAEIRDPRRAARKWLGTFDTAEDAARAYDVAAVELRGQRAKLNFPAQPPHHRPLPDQQSLRENSGSNAASPVHVALAPTTQQDIWEGLNEIMMMEEERSFWSMR

SEQ ID NO: 749 - protein, 253 aa, Triticum aestivum
  misc_feature (1)..(253): Ceres CLONE ID no. 901326
  misc_feature: Utility: Useful for delaying flowering time
  misc_feature: Utility: Useful for increasing chlorophyll and photosynthetic capacity
  misc_feature: Utility: Useful for making larger plants
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with altered leaf shape eg curled leaves
  misc_feature: Utility: Useful for making plants with enhanced plant architecture
  misc_feature: Utility: Useful for making plants with increased biomass
  misc_feature: Utility: Useful for making plants with increased biomass and foliage
  misc_feature: Utility: Useful for making smaller plants
  misc_feature: Utility: Useful for modifying plant structure, ie increased branching
MVPRLERGGGGGFQLPNSEQENSLFLRALISVVSGDTAAPALHPEPSNPPFAAAAAAPVPACGRCGADGCPGCEFAAAAAAATTGSSSEGEECSAASFVRNGGVGKRRAGGGGSKFRGVRQRPWGKWAAEIRDPHRAVRKWLGTFDTAAEAARAYDVAALEFRGHRAKLNFPASSSAASASASASASSWAAAQPHPQRQQRPESPREKCGSNASSPAHVPEQGRPVAREQEIWDGLHEIMMMDDGSFWSNPKP

SEQ ID NO: 750 - protein, 230 aa, Zea mays
  misc_feature (1)..(230): Ceres CLONE ID no. 1446523
  misc_feature: Utility: Useful for delaying flowering time
  misc_feature: Utility: Useful for increasing chlorophyll and photosynthetic capacity
  misc_feature: Utility: Useful for making larger plants
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with altered leaf shape eg curled leaves
  misc_feature: Utility: Useful for making plants with enhanced plant architecture
  misc_feature: Utility: Useful for making plants with increased biomass
  misc_feature: Utility: Useful for making plants with increased biomass and foliage
  misc_feature: Utility: Useful for making smaller plants
  misc_feature: Utility: Useful for modifying plant structure, ie increased branching
MTSRLESGGFQLPNTEQENALLLRALISVVSGDTASASLVPEAAAAEAPAAAASACGCPGGCELAAASSSDSDGAECSASGGGAGKRRRRRSRASSYMGVRRRPWGKWAAEIRDPRRAARKWLGTFDTAEDAARAYDAAAVELRGRRAKLNFPDAAAAAAARDVQPRRPLPGQSLRENCGSNAASPLHVAVARAPTTLQGTGPAPPKDQDIWDGLNEIMTMDDGSFWSMP

SEQ ID NO: 751 - protein, 236 aa, Zea mays
  misc_feature (1)..(236): Ceres CLONE ID no. 461977
  misc_feature: Utility: Useful for delaying flowering time
  misc_feature: Utility: Useful for increasing chlorophyll and photosynthetic capacity
  misc_feature: Utility: Useful for making larger plants
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with altered leaf shape eg curled leaves
  misc_feature: Utility: Useful for making plants with enhanced plant architecture
  misc_feature: Utility: Useful for making plants with increased biomass
  misc_feature: Utility: Useful for making plants with increased biomass and foliage
  misc_feature: Utility: Useful for making smaller plants
  misc_feature: Utility: Useful for modifying plant structure, ie increased branching
MAAPRLERGGFQLPNTEQENSLFLRALISVVSGDTAALLPEAAAVEAPAAPVACARCGADGCAAAGCCELVAGSSSDSDDAGCSGTRANGGGLGLGLGASKRRGRGRKVIQYRGVRRRPWGKWAAEIRDPRRAARKWLGTFDTAEDAARAYDVAAVELRGQRAKLNFPARAAAAAPAAVQPPHHRPLPDRSLRENCGSNAASPVHVALAPTTQQNIWEGLNEIMMMEEERSFWSMR

SEQ ID NO: 752 - protein, 242 aa, Zea mays
  misc_feature (1)..(242): Public GI no. 50913081
  misc_feature: Utility: Useful for delaying flowering time
  misc_feature: Utility: Useful for increasing chlorophyll and photosynthetic capacity
  misc_feature: Utility: Useful for making larger plants
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with altered leaf shape eg curled leaves
  misc_feature: Utility: Useful for making plants with enhanced plant architecture
  misc_feature: Utility: Useful for making plants with increased biomass
  misc_feature: Utility: Useful for making plants with increased biomass and foliage
  misc_feature: Utility: Useful for making smaller plants
  misc_feature: Utility: Useful for modifying plant structure, ie increased branching
MVPRVERGGGGFHLPNSEREDSLFIRALISVVSGDTTVPTLLPEPTMATVVAGAATCARCGVDGCIGVDCEVVVLAAAAGSSCSDEEDEGECTTGAVASGGVTGGVGKRRPRRRSGGEGSRYRGVRRRPWGKWAAEIRDPRRAVCKWLGTFDTAEDAARAYDVAALEFRGQRAKLNFPASTAAQQPRPLLHHNLRENCGSNASSPVHAPEHARTAAAAKDQEIWDGLREIMMLDDGSFWSMP

SEQ ID NO: 753 - DNA, 1499 bp, Arabidopsis thaliana
  misc_feature (1)..(1499): Ceres CLONE ID no. 141805
  misc_feature (1)..(1499): Also known as  Ceres CDNA ID no. 23375958
atctcttgttctctccgcccatctctgctctcttttattttcccagaaagtttttttttttttcccgaattccgttaatctcattggggtttccattgatagcaatggcgacggctttcgctcccactaagctcactgccacggttcctctgcatggatcccatgagaatcgtctcttgctcccgatccgattggctcctccttcttctttcctcggatccacccgttccctctcccttcgcagactcaatcactccaacgccacccgtcgatctcccgtcgtctctgtccaggaagttgtcaaggagaagcaatccaccaataataccagcctgttgataaccaaagaggaaggattggagttgtatgaagatatgatactaggtagatctttcgaagacatgtgtgctcaaatgtattaccgaggcaagatgtttggttttgttcacttgtacaatggccaagaggctgtttctactggctttatcaagctccttaccaagtctgactctgtcgttagtacctaccgtgaccatgtccatgccctcagcaaaggtgtctctgctcgtgctgttatgagcgagctcttcggcaaggttactggatgctgcagaggccaaggtggatccatgcacatgttctccaaagaacacaacatgcttggtggctttgcttttattggtgaaggcattcctgtcgccactggtgctgcctttagctccaagtacaggagggaagtcttgaaacaggattgtgatgatgtcactgtcgcctttttcggagatggaacttgtaacaacggacagttcttcgagtgtctcaacatggctgctctctataaactgcctattatctttgttgtcgagaataacttgtgggccattgggatgtctcacttgagagccacttctgaccccgagatttggaagaaaggtcctgcatttgggatgcctggtgttcatgttgacggtatggatgtcttgaaggtcagggaagtcgctaaagaggctgtcactagagctagaagaggagaaggtccaaccttggttgaatgtgagacttatagatttagaggacactccttggctgatcccgatgagctccgtgatgctgctgagaaagccaaatacgcggctagagacccaatcgcagcattgaagaagtatttgatagagaacaagcttgcaaaggaagcagagctaaagtcaatagagaaaaagatagacgagttggtggaggaagcggttgagtttgcagacgctagtccacagcccggtcgcagtcagttgctagagaatgtgtttgctgatccaaaaggatttggaattggacctgatggacggtacagatgtgaggaccccaagtttaccgaaggcacagctcaagtctgagaagacaagtttaaccataagctgtctactgtctcttcgatgtttctatatatcttattaagttaaatgctacagagaatcagtttgaatcatttgcactttttgctg

SEQ ID NO: 754 - protein, 428 aa, Arabidopsis thaliana
  misc_feature (89)..(393): Pfam Name: E1_dh; Pfam Description: Dehydrogenase E1 component
  misc_feature (165)..(317): Pfam Name: TPP_enzyme_C; Pfam Description: Thiamine pyrophosphate enzyme, C-terminal TPP binding domain
  misc_feature: Utility: Useful for delaying flowering time
MATAFAPTKLTATVPLHGSHENRLLLPIRLAPPSSFLGSTRSLSLRRLNHSNATRRSPVVSVQEVVKEKQSTNNTSLLITKEEGLELYEDMILGRSFEDMCAQMYYRGKMFGFVHLYNGQEAVSTGFIKLLTKSDSVVSTYRDHVHALSKGVSARAVMSELFGKVTGCCRGQGGSMHMFSKEHNMLGGFAFIGEGIPVATGAAFSSKYRREVLKQDCDDVTVAFFGDGTCNNGQFFECLNMAALYKLPIIFVVENNLWAIGMSHLRATSDPEIWKKGPAFGMPGVHVDGMDVLKVREVAKEAVTRARRGEGPTLVECETYRFRGHSLADPDELRDAAEKAKYAARDPIAALKKYLIENKLAKEAELKSIEKKIDELVEEAVEFADASPQPGRSQLLENVFADPKGFGIGPDGRYRCEDPKFTEGTAQV

SEQ ID NO: 755 - protein, 425 aa, Arabidopsis thaliana
  misc_feature (1)..(425): Public GI no. 50921411
  misc_feature: Utility: Useful for delaying flowering time
MAAASSFTAAAKFLAPVSARSAGDYKPPLPLPASASLRPGRKPAPRLRTALAVSSDVLPGNKAAPAAAAHSAVTREEALELYEDMVLGRIFEDMCAQMYYRGKMFGFVHLYNGQEAVSTGFIKLLNQADCVVSTYRDHVHALSKGVPARSVMAELFGKATGCCRGQGGSMHMFSEPHNLLGGFAFIGEGIPVATGAAFAAKYRHEVLKQSSPDGLDVTLAFFGDGTCNNGQFFECLNMAQLWKLPIVFVVENNLWAIGMSHLRATSDPEIYKKGPAFGMPGVHVDGMDVLKVREVAKEAIERARRGEGPTLVECETYRFRGHSLADPDELRRPDEKSHYAARDPITALKKYIIEQNLATESELKSIEKKIDDVVEEAVEFADASPLPPRSQLLENVFSDPKGFGIGPDGKYRCEDPLFTQGTAQV

SEQ ID NO: 756 - protein, 420 aa, Triticum aestivum
  misc_feature (1)..(420): Ceres CLONE ID no. 616282
  misc_feature: Utility: Useful for delaying flowering time
  misc_feature (164)..(164): Xaa is any aa, unknown, or other
  misc_feature (217)..(217): Xaa is any aa, unknown, or other
  misc_feature (218)..(218): Xaa is any aa, unknown, or other
  misc_feature (219)..(219): Xaa is any aa, unknown, or other
MAAASFTAAKFLAPAAARSGGDRAPFPAPSAFSMRSLRHRPARRLSSVLAVSSDVLKAAPAAAAYPAVTREEALELYEDMILGRNFEDMCAQMYYRGKMFGFVHLYNGQEAVSTGFIKQLNQPDCVVSTYRDHVHALSKGVPARAVMAELFGKATGCCRGQGGXMHMFSEPHNLLGGFAFIGEGIPVATGAAFAAKYRHEVLKQSSPDGLDVTLAFXXXGTCNNGQFFECLNMAQLWKLPIIFVVENNLWAIGMSHLRSTSDPEIWKKGPAFGMPGVHVDGMDVLKVREVAKEAIDRARRGEGPTLVECETYRFRGHSLADPDELRRPDEKSHYAARDPITSLKKYIIEQNLASEAELKNIEKKIDDVVEEAVEFADASPLPPRSQLLENVFADPKGFGIGPDGKYRCEDPKFTQGTAQV

SEQ ID NO: 757 - protein, 432 aa, Glycine max
  misc_feature (1)..(432): Ceres CLONE ID no. 524063
  misc_feature: Utility: Useful for delaying flowering time
MSFTATKFSPSPLPLTSTTPRSNDKPLSFSFDHSKPNPSSSFLGSTRKLLRFNALARPHAHPRASSSPAAAVLLERTSNLLVTKEEGLELYEDMILGRFFEDKCAEMYYRGKMFGFVHLYNGQEAVSTGFIKLLKKEDSVVSTYRDHVHALSKGVPSRQVMSELFGKATGCCRGQGGSMHMFSKEHNLLGGFAFIGEGIPVATGAAFSSKYRREVLKQADCDHVTLAFFGDGTCNNGQFYECLNMAALWKLPIVFVVENNLWAIGMSHLRATSDPQIWKKGPAFGMPGVHVDGMDVLKVREVAKEAVERARRGDGPTLVECETYRFRGHSLADPDELRDPAEKEHYAGRDPITALKQYLIENNLANEQELKAIEKKIDEILEDAVEFADSSPLPPRSQLLENVFADPKGFGIGPDGRYRCEDPKFTEGTAHV

SEQ ID NO: 758 - protein, 427 aa, Glycine max
  misc_feature (1)..(427): Ceres CLONE ID no. 482085
  misc_feature: Utility: Useful for delaying flowering time
MSLSVPKLARPLPLHHHSSYGSLTMSFHTFTPFLGSTHKLRFISPIKLNAPRFNSSVVSVSDLFKNNKPKSTTNLLITKEEGLQLYEDMVLGRSFEDMCAQMYYRGKMFGFVHLYNGQEAVSTGFINFLKKEDCVVSTYRDHVHALSKGVPARAVMSELFGKATGCSRGQGGSMHMFSKEHNLIGGFAFIAEGIPVATGAAFSSKYRREVLKEADCDHVTLAFFGDGTCNNGQFYECLNMAALWKLPIVFVVENNLWAIGMSHLRATSDPQIWKKGPAFGMPGVHVDGMDVLKVREVAKEAIERARRGEGPTLVECETYRFRGHSLADPDELRDPAEKAHYAGRDPISALKKYMIENKLASEQELKTIDKKIEEVVEDAVEFADESPHPPRSQLLENVFADPKGFGIGPDGKYRCEDPKFTEGTAHV

SEQ ID NO: 759 - DNA, 1355 bp, Arabidopsis thaliana
  misc_feature (1)..(1355): Ceres CLONE ID no. 141890
  misc_feature (1)..(1355): Also known as  Ceres CDNA ID no. 23380862
ataacttataaacctttgttgcagaatctcatttaattctctctatgcaatcttttctttttgttctgtgaaggtctaaattcttgaaggattcaaaagtttccgatgaatacacgttattccaatcagccggagttatcttctagtaatatcacgatcactatttcatcgtctgctttgttaagctcctcaccgcgaggcgataacagtcatgttgctgctgctaatggtcaagagaggtctccatcttcgttttatataaggctggctatgaaggtatctagagctagatggttcatcttcttgagaagagtgtttcactaccagaacggttcaagatctgaccttgggtctaatcctttcaattctagcacttggatgatgtctgagctcattgctctacttgttcagctcactgtgataacattcactctagctatctccaaagaagagagaccaatttggccagtgaggctatggatcacaggatacgatgtgggatgtcttttgaatctcatgctgttatatggtcggtatcgtcaactagacattaaccaaggaaatgggtttgtccttggcgatgttgagcagcaacagagaggcagagaagaaactaggtcctctcacttgatgaacaaatgcagaacgtcgctagagcttttctttgcgatttggtttgtgattggaaatgtttgggtgttcgattctaggtttggttctttccaccatgctcccaagcttcacgttctctgcgtctctcttttagcttggaacgctatctgctattcctttccctttcttctcttcctcttcctctgttgccttgttcctctcataagtagcctccttggatataacatgaacatgggatcctcagacagagcagcatcagatgaccaaatctctagtctccctagctggaaattcaaacgaatcgacgatagtgcttctgattctgattcagattcagctactgtaactgatgatccagagtgttgtatatgtttggcaaagtataaagacaaagaagaagtaaggaagcttccatgttcacataagtttcactcaaagtgtgtagatcaatggcttcgtatcatctcttgttgtcctctctgcaaacaagatcttccaagatgacaaagcaaataccctaaaagcaacaaaagctcaatataatttttttctttcaaagtttttttttttttttagttttggattgaagcaaagtcgattacttgtgtgagtgtcaaattttttgtacataaagagctcaccagtaatcgttatgtacattgtgagtagatgatgcaaatcacaatggcaacaactttataaaatcttaatatagtgtttat

SEQ ID NO: 760 - protein, 343 aa, Arabidopsis thaliana
  misc_feature (297)..(337): Pfam Name: zf-C3HC4; Pfam Description: Zinc finger, C3HC4 type (RING finger)
  misc_feature: Utility: Useful for delaying flowering time
  misc_feature: Utility: Useful for increasing chlorophyll and photosynthetic capacity
  misc_feature: Utility: Useful for making smaller plants
MNTRYSNQPELSSSNITITISSSALLSSSPRGDNSHVAAANGQERSPSSFYIRLAMKVSRARWFIFLRRVFHYQNGSRSDLGSNPFNSSTWMMSELIALLVQLTVITFTLAISKEERPIWPVRLWITGYDVGCLLNLMLLYGRYRQLDINQGNGFVLGDVEQQQRGREETRSSHLMNKCRTSLELFFAIWFVIGNVWVFDSRFGSFHHAPKLHVLCVSLLAWNAICYSFPFLLFLFLCCLVPLISSLLGYNMNMGSSDRAASDDQISSLPSWKFKRIDDSASDSDSDSATVTDDPECCICLAKYKDKEEVRKLPCSHKFHSKCVDQWLRIISCCPLCKQDLPR

SEQ ID NO: 761 - protein, 304 aa, Arabidopsis thaliana
  misc_feature (1)..(304): Public GI no. 34911538
  misc_feature: Utility: Useful for delaying flowering time
  misc_feature: Utility: Useful for increasing chlorophyll and photosynthetic capacity
  misc_feature: Utility: Useful for making smaller plants
MRPPSSSATPGTGRVSAFTMRAVARMSRARWFIFLRRVYQYQNGPRSDLGSNPFNSPGWLALELGVIMAQMVVTTAVVATSPKERPAWPLRVWVAAYNVGNVLSLPLLYWRHRHSSSGARGGTLSDDPEMHGANDPLRNRSYLMNKARAFLELFFAMWFVMGNVWVFDARLGSFHRAPRLYALCIGLLAWNAVVYSLPFLLFLLLCCFVPAVGYALGYNMNSASVGRGASDEQLAALPQWRFKEPADAPRDRDHDDQECCICLAQYKEKEEVRQLPCTHMFHLKCVDRWLRIISSCPLCKQELS

SEQ ID NO: 762 - DNA, 648 bp, n/a
  misc_feature (1)..(648): Ceres CLONE ID no. 147358
  misc_feature (1)..(648): Also known as  Ceres CDNA ID no. 0
aaaaaacaaaaagcgtcactaggaagctgcgactatttgactgactctaatttcacgcaactccttgtgagattctccgattgcttcgcctgagtttctgggttaactctccacgccgtcactttgatctttgcttttccgatctttagggtttttgtttagggatttatcgaagactctgctctatcatgtctggaagaaaagaaacggttttagatttggccaagtttgtagataagggtgtgcaagttaagctcactggtggtagacaagtgactggaactcttaaaggctatgaccaattgcttaatcttgttcttgatgaagcagtcgagtttgttcgagatcatgatgatcctttgaagactacggatcagacaagacgccttggtttgattgtttgccgtggaacagcggtgatgcttgtctcaccaaccgatggcaccgaagaaatcgctaacccgttcgttacagcagaggctgtctaaaagactttcttctcaaacaatatgtctctctattagtttaacttggcgatttagagagtattttatctaactctctggtgtgatgttggaaacatatatgttcaatttaaactatttggaacatcatggacacttcttcttgttacctaacttcgttccc

SEQ ID NO: 763 - protein, 99 aa, n/a
  misc_feature (9)..(82): Pfam Name: LSM; Pfam Description: LSM domain
  misc_feature: Utility: Useful for delaying flowering time
  misc_feature: Utility: Useful for increasing chlorophyll and photosynthetic capacity
  misc_feature: Utility: Useful for making lethal plants for genetic confinement systems
  misc_feature: Utility: Useful for making ornamental plants with modified leaves
  misc_feature: Utility: Useful for making plants with altered leaf shape eg curled leaves
  misc_feature: Utility: Useful for making plants with increased biomass and foliage
  misc_feature: Utility: Useful for making smaller plants
  misc_feature: Utility: Useful for making stronger plants
MSGRKETVLDLAKFVDKGVQVKLTGGRQVTGTLKGYDQLLNLVLDEAVEFVRDHDDPLKTTDQTRRLGLIVCRGTAVMLVSPTDGTEEIANPFVTAEAV

SEQ ID NO: 764 - protein, 99 aa, Brassica napus; identical to SEQ ID NO: 643
  misc_feature (1)..(99): Ceres CLONE ID no. 1064362
  misc_feature: Utility: Useful for delaying flowering time
  misc_feature: Utility: Useful for increasing chlorophyll and photosynthetic capacity
  misc_feature: Utility: Useful for making lethal plants for genetic confinement systems
  misc_feature: Utility: Useful for making ornamental plants with modified leaves
  misc_feature: Utility: Useful for making plants with altered leaf shape eg curled leaves
  misc_feature: Utility: Useful for making plants with increased biomass and foliage
  misc_feature: Utility: Useful for making smaller plants
  misc_feature: Utility: Useful for making stronger plants

SEQ ID NO: 765 - protein, 99 aa, Brassica napus; identical to SEQ ID NO: 642
  misc_feature (1)..(99): Ceres CLONE ID no. 1073419
  misc_feature: Utility: Useful for delaying flowering time
  misc_feature: Utility: Useful for increasing chlorophyll and photosynthetic capacity
  misc_feature: Utility: Useful for making lethal plants for genetic confinement systems
  misc_feature: Utility: Useful for making ornamental plants with modified leaves
  misc_feature: Utility: Useful for making plants with altered leaf shape eg curled leaves
  misc_feature: Utility: Useful for making plants with increased biomass and foliage
  misc_feature: Utility: Useful for making smaller plants
  misc_feature: Utility: Useful for making stronger plants

SEQ ID NO: 766 - protein, 98 aa, Brassica napus; identical to SEQ ID NO: 645
  misc_feature (1)..(98): Public GI no. 50941651
  misc_feature: Utility: Useful for delaying flowering time
  misc_feature: Utility: Useful for increasing chlorophyll and photosynthetic capacity
  misc_feature: Utility: Useful for making lethal plants for genetic confinement systems
  misc_feature: Utility: Useful for making ornamental plants with modified leaves
  misc_feature: Utility: Useful for making plants with altered leaf shape eg curled leaves
  misc_feature: Utility: Useful for making plants with increased biomass and foliage
  misc_feature: Utility: Useful for making smaller plants
  misc_feature: Utility: Useful for making stronger plants

SEQ ID NO: 767 - protein, 156 aa, Zea mays
  misc_feature (1)..(156): Ceres CLONE ID no. 226155
  misc_feature: Utility: Useful for delaying flowering time
  misc_feature: Utility: Useful for increasing chlorophyll and photosynthetic capacity
  misc_feature: Utility: Useful for making lethal plants for genetic confinement systems
  misc_feature: Utility: Useful for making ornamental plants with modified leaves
  misc_feature: Utility: Useful for making plants with altered leaf shape eg curled leaves
  misc_feature: Utility: Useful for making plants with increased biomass and foliage
  misc_feature: Utility: Useful for making smaller plants
  misc_feature: Utility: Useful for making stronger plants
MYGQGPALFLGEFFPLPPLRPCRAAAAASTVRAKIRSSLSAIFGRRRQQDLREGFRVEMAGRKETALDLAKFVDKGVQVKLTGGRQVTGTLKGYDQLLNLVLDEAVENEREQDDPLKLSGKTRQLGLIVCRGTAVMLVSPTDGTDEIANPFLADGA

SEQ ID NO: 768 - protein, 98 aa, Zea mays
  misc_feature (1)..(98): Ceres CLONE ID no. 1452131
  misc_feature: Utility: Useful for delaying flowering time
  misc_feature: Utility: Useful for increasing chlorophyll and photosynthetic capacity
  misc_feature: Utility: Useful for making lethal plants for genetic confinement systems
  misc_feature: Utility: Useful for making ornamental plants with modified leaves
  misc_feature: Utility: Useful for making plants with altered leaf shape eg curled leaves
  misc_feature: Utility: Useful for making plants with increased biomass and foliage
  misc_feature: Utility: Useful for making smaller plants
  misc_feature: Utility: Useful for making stronger plants
MAGRKETALDLAKFVDKGVQVKLTGGRQVTGTLKGYDQLLNLVLDEAVENEREQDDPLKLSGKTRQLGLIVCRGTAVMLVSPTDGTDEIANPFLADGA

SEQ ID NO: 769 - protein, 100 aa, Triticum aestivum; identical to SEQ ID NO: 649
  misc_feature (1)..(100): Ceres CLONE ID no. 606064
  misc_feature: Utility: Useful for delaying flowering time
  misc_feature: Utility: Useful for increasing chlorophyll and photosynthetic capacity
  misc_feature: Utility: Useful for making lethal plants for genetic confinement systems
  misc_feature: Utility: Useful for making ornamental plants with modified leaves
  misc_feature: Utility: Useful for making plants with altered leaf shape eg curled leaves
  misc_feature: Utility: Useful for making plants with increased biomass and foliage
  misc_feature: Utility: Useful for making smaller plants
  misc_feature: Utility: Useful for making stronger plants

SEQ ID NO: 770 - protein, 100 aa, Zea mays; identical to SEQ ID NO: 649
  misc_feature (1)..(100): Ceres CLONE ID no. 1502051
  misc_feature: Utility: Useful for delaying flowering time
  misc_feature: Utility: Useful for increasing chlorophyll and photosynthetic capacity
  misc_feature: Utility: Useful for making lethal plants for genetic confinement systems
  misc_feature: Utility: Useful for making ornamental plants with modified leaves
  misc_feature: Utility: Useful for making plants with altered leaf shape eg curled leaves
  misc_feature: Utility: Useful for making plants with increased biomass and foliage
  misc_feature: Utility: Useful for making smaller plants
  misc_feature: Utility: Useful for making stronger plants

SEQ ID NO: 771 - protein, 100 aa, Triticum aestivum; identical to SEQ ID NO: 649
  misc_feature (1)..(100): Ceres CLONE ID no. 1018838
  misc_feature: Utility: Useful for delaying flowering time
  misc_feature: Utility: Useful for increasing chlorophyll and photosynthetic capacity
  misc_feature: Utility: Useful for making lethal plants for genetic confinement systems
  misc_feature: Utility: Useful for making ornamental plants with modified leaves
  misc_feature: Utility: Useful for making plants with altered leaf shape eg curled leaves
  misc_feature: Utility: Useful for making plants with increased biomass and foliage
  misc_feature: Utility: Useful for making smaller plants
  misc_feature: Utility: Useful for making stronger plants

SEQ ID NO: 772 - protein, 104 aa, Triticum aestivum; identical to SEQ ID NO: 646
  misc_feature (1)..(104): Ceres CLONE ID no. 685838
  misc_feature: Utility: Useful for delaying flowering time
  misc_feature: Utility: Useful for increasing chlorophyll and photosynthetic capacity
  misc_feature: Utility: Useful for making lethal plants for genetic confinement systems
  misc_feature: Utility: Useful for making ornamental plants with modified leaves
  misc_feature: Utility: Useful for making plants with altered leaf shape eg curled leaves
  misc_feature: Utility: Useful for making plants with increased biomass and foliage
  misc_feature: Utility: Useful for making smaller plants
  misc_feature: Utility: Useful for making stronger plants

SEQ ID NO: 773 - protein, 98 aa, Zea mays; identical to SEQ ID NO: 647
  misc_feature (1)..(98): Ceres CLONE ID no. 462970
  misc_feature: Utility: Useful for delaying flowering time
  misc_feature: Utility: Useful for increasing chlorophyll and photosynthetic capacity
  misc_feature: Utility: Useful for making lethal plants for genetic confinement systems
  misc_feature: Utility: Useful for making ornamental plants with modified leaves
  misc_feature: Utility: Useful for making plants with altered leaf shape eg curled leaves
  misc_feature: Utility: Useful for making plants with increased biomass and foliage
  misc_feature: Utility: Useful for making smaller plants
  misc_feature: Utility: Useful for making stronger plants

SEQ ID NO: 774 - protein, 98 aa, Zea mays; identical to SEQ ID NO: 647
  misc_feature (1)..(98): Ceres CLONE ID no. 393073
  misc_feature: Utility: Useful for delaying flowering time
  misc_feature: Utility: Useful for increasing chlorophyll and photosynthetic capacity
  misc_feature: Utility: Useful for making lethal plants for genetic confinement systems
  misc_feature: Utility: Useful for making ornamental plants with modified leaves
  misc_feature: Utility: Useful for making plants with altered leaf shape eg curled leaves
  misc_feature: Utility: Useful for making plants with increased biomass and foliage
  misc_feature: Utility: Useful for making smaller plants
  misc_feature: Utility: Useful for making stronger plants

SEQ ID NO: 775 - DNA, 1279 bp, Arabidopsis thaliana
  misc_feature (1)..(1279): Ceres CLONE ID no. 148943
  misc_feature (1)..(1279): Also known as  Ceres CDNA ID no. 23365865
atccacacactgagaaacagcagaagaaaggcttgagagccttcttctccactattttcaatggctttaacattgtcaaccacaaagaccttcactaacataaactgctcaaacaatacttccaacataaccacctttaagcctctcaagcttcctcttttctggccatggcaaaaggtcaaaatgggtcctttaagtgtttctcctatgggttttgggacatgggcttggggtaatcagcttctttggggttatcagacttccatggatgatcagcttcaacaagcttttgaattggctttggaaaatggaatcaatttgtttgatactgctgattcttatggcactggtaggcttaatggccaaagtgagagacttttggggaaattcattaaagaatctcaaggacttaaagggaaacaaaatgaagtagtggtagctacaaagtttgcagcttatccatggaggttaacttcaggacagtttgtgaatgcctgcagagcttctttagaccggcttcagatagaccagctcgggattggacagcttcactggtcaactgcaaactacgcgcctctacaagagcttgttctttgggatggtctagtgcaaatgtacgaaaagggtttagttagagccgttggagttagtaactatggacctcaacagcttgtgaagattcatgattaccttaaaactcgaggggttcctttatgttctgcccaagtgcaattctcattgctaagcatgggaaaagagcaactagagatcaagagtatatgcgacgagctcgggattcgtttaatctcttatagtcctcttgggctaggaatgctaactgggaaatactcctcttcaaaacttcccactggtccacgatcattgctgttccgacaaattcttcctggattagaacctcttcttttagcactgagcgagattgcaaagaaacgaggaaagactatgcctcaggttgcaataaactggtgcatatgcaaagggacagtaccgataccgggaatcaagtcggtaagacatgtttaagataatttgggtgctctgggatggaaacttacaaatgatgaacagcttcagttagaatatgcagctaaagaatcaccaaagtcaatgattcagaatatttttcagacaagatgataggataagagaagatgcttatacacatctagaccacaaatgagaacaatgtgtataagtagaagttttaatctacttctttatatatgcacatattgtgaagaacacagatagttttctt

SEQ ID NO: 776 - protein, 286 aa, Arabidopsis thaliana
  misc_feature (2)..(279): Pfam Name: Aldo_ket_red; Pfam Description: Aldo/keto reductase family
  misc_feature (2)..(279): Pfam Name: Aldo_ket_red; Pfam Description: Aldo/keto reductase family
  misc_feature: Utility: Useful for delaying flowering time
  misc_feature: Utility: Useful for making ornamental plants with modified leaves
  misc_feature: Utility: Useful for making plants with altered leaf shape eg curled leaves
  misc_feature: Utility: Useful for making plants with increased biomass and foliage
  misc_feature: Utility: Useful for making smaller plants
MGPLSVSPMGFGTWAWGNQLLWGYQTSMDDQLQQAFELALENGINLFDTADSYGTGRLNGQSERLLGKFIKESQGLKGKQNEVVVATKFAAYPWRLTSGQFVNACRASLDRLQIDQLGIGQLHWSTANYAPLQELVLWDGLVQMYEKGLVRAVGVSNYGPQQLVKIHDYLKTRGVPLCSAQVQFSLLSMGKEQLEIKSICDELGIRLISYSPLGLGMLTGKYSSSKLPTGPRSLLFRQILPGLEPLLLALSEIAKKRGKTMPQVAINWCICKGTVPIPGIKSVRHV

SEQ ID NO: 777 - protein, 371 aa, Zea mays
  misc_feature (1)..(371): Ceres CLONE ID no. 294527
  misc_feature: Utility: Useful for delaying flowering time
  misc_feature: Utility: Useful for making ornamental plants with modified leaves
  misc_feature: Utility: Useful for making plants with altered leaf shape eg curled leaves
  misc_feature: Utility: Useful for making plants with increased biomass and foliage
  misc_feature: Utility: Useful for making smaller plants
MALPPGAGAVAPATPFAANPCRLRRASGPPAAALRLGPLFWPWEKVKIGPLSVSPMGFGTWAWGNQLLWGYQESMDNELQDCFNLALRNGINLFDTADSYGTGRLNGQSERLLGKFILEFEGRIKSPDDVVIATKFAAYPWRLTSGQFVSACKSSLERLQLDRLGIGQLHWSTANYAPLQERALWDGLVEMYEKGLVSAVGVSNYGPKQLLKIHSYLASRGVPLSSAQVQFSLLSMGDDQMELKSVCDSLGIRIIAYSPLGLGMLTGKYGASNLPKGPRSVLFRQILPGLEPLLSCLRRIAEKKGKTMPQVAINWCMCKGTVPIPGVKTVRHVQENLGALGWRLSSAEISELESAAMAAPRKMIQNVFQTA

SEQ ID NO: 778 - protein, 375 aa, Zea mays
  misc_feature (1)..(375): Public GI no. 37536088
  misc_feature: Utility: Useful for delaying flowering time
  misc_feature: Utility: Useful for making ornamental plants with modified leaves
  misc_feature: Utility: Useful for making plants with altered leaf shape eg curled leaves
  misc_feature: Utility: Useful for making plants with increased biomass and foliage
  misc_feature: Utility: Useful for making smaller plants
MALPVTTRAAPAMPFAPQPRTAGGGLLRRPSPPAAALRIAPPLFWPWQKVKVGPLSVSPMGFGTWAWGNQLLWGYQESMDTELQECFNLALKNGINLFDTADSYGTGRLNGQSERLLGKFIREYEGPMKSPDDVIIATKFAAYPWRLTSGQFVSACKSSLERLQLDRLGIGQLHWSTANYAPLQERALWDGLVEMYEKGLVRAVGVSNYGPKQLLKIHSHLSSRGVPLSSAQVQFSLLSMGDEQMELKTVCDSLGIRLIAYSPLGLGMLTGKYTTSNLPSGPRSVLFRQILPGLESLLTCLKRIAERKGKTMSQVAINWCICKGTIPIPGVKTVRHVEDNLGALGWRLSPAEVSELEAAAMESPKRMVQNIFQTA

SEQ ID NO: 779 - protein, 376 aa, Zea mays
  misc_feature (1)..(376): Public GI no. 34899608
  misc_feature: Utility: Useful for delaying flowering time
  misc_feature: Utility: Useful for making ornamental plants with modified leaves
  misc_feature: Utility: Useful for making plants with altered leaf shape eg curled leaves
  misc_feature: Utility: Useful for making plants with increased biomass and foliage
  misc_feature: Utility: Useful for making smaller plants
MAGTLQVAGGCLAPLLPSRRAAAAVRPPRASGASASAAAAAAAVEEDGKVRLGGSDVAVTKLGIGAWSWGDTTYWNEFQWDDRKLKAAKGAFDASVDCGITFFDTAEVYGAGISGAINSESLLGRFIKERQQKEQVEVAIATKFAALPWRLGRGSVISALKDSLSRLGVSSVELYQLHWPGIWGNEGYLDGLGDAYEQGLVKAVGVSNYSEKRLRDAYERLKKRGVPLASNQVNYSLIYRNPEENGVKAACDELGITLIAYSPIAQGVLTGKYTPNNPPTGPRGRIYTPEFLTKLQPLINRIKEIGGSYEKTPTQVVLNWLICQGNVVPIPGAKNAEQAREFAGALGWSLTDQEVEELRSMAREIKPVIGFPVEKL

SEQ ID NO: 780 - protein, 376 aa, Zea mays
  misc_feature (1)..(376): Public GI no. 50882170
  misc_feature: Utility: Useful for delaying flowering time
  misc_feature: Utility: Useful for making ornamental plants with modified leaves
  misc_feature: Utility: Useful for making plants with altered leaf shape eg curled leaves
  misc_feature: Utility: Useful for making plants with increased biomass and foliage
  misc_feature: Utility: Useful for making smaller plants
MAAAMALQVVAGGGCCCQRPVLGAGRRRLAAARAVASDAAAAKVSEEEGKVRLGGSEVAVSKLGIGAWSWGDTTYWNDSEWDDRRLQEAKAAFDTSIDNGMTLFDTAEVYGTALMGAVNSESLLGGFIKERQEKEQIDVAVATKFAALPWRFGRGSVLSALKKSLDRLGLSSVELYQLHWPGLWGNEGYLDGLADAYEQGLVKAVGVSNYNEKRLRDAYARMKKRGVPLAANQVNYSLIYRTPELNGVKAACDELGITLIAYSPIAQGVLSGKYTPEKPPTGPRANTYTPEFLTKLQPLMNRIKEIGESYGKNPTQVSLNWLTCQGNVVPIPGAKNAGQAQEFAGALGWSLTGDEVEELRSLAREIKGIKMPIEES

SEQ ID NO: 781 - protein, 375 aa, Zea mays
  misc_feature (1)..(375): Ceres CLONE ID no. 338088
  misc_feature: Utility: Useful for delaying flowering time
  misc_feature: Utility: Useful for making ornamental plants with modified leaves
  misc_feature: Utility: Useful for making plants with altered leaf shape eg curled leaves
  misc_feature: Utility: Useful for making plants with increased biomass and foliage
  misc_feature: Utility: Useful for making smaller plants
MITALQVSGGGLPLLFARRRRRAFRPPQAVASDAAAAAEGTAREDGGKVALGGSGVSVTKLGVGAWSWGDTTYWNEFRWDDTKLKAAKGAFDASIDCGITFFDTAEVYGAGVSGAINSESLLGRFIKERQRKEQVDVAVATKFAALPWRFGRGSVICALKASLDRLGVSSVELYQLHWPGIWGNEDYLDGLGDAVEQGLVKAVGVSNYSEKRLRDAYERLRKRGVPLASNQVNYSLIYRNPEENGVKAACDELGVTLIAYSPIAQDALTGKYTPESPPKGPRGRIYTPEFLTKLQPLINRIKEIGGSYGRTSTQVVLNWLVCQGNVVPIPGAKNAEQAREFAGALGWSLAPDEVEELRSMARQVKPVIGFPVEKL

SEQ ID NO: 782 - protein, 377 aa, Zea mays
  misc_feature (1)..(377): Public GI no. 24111265
  misc_feature: Utility: Useful for delaying flowering time
  misc_feature: Utility: Useful for making ornamental plants with modified leaves
  misc_feature: Utility: Useful for making plants with altered leaf shape eg curled leaves
  misc_feature: Utility: Useful for making plants with increased biomass and foliage
  misc_feature: Utility: Useful for making smaller plants
MAMATHFTFPFNYVVSEGSHGRRSFVRKLVRAVASGDSVAPAISEESKVKLGGSDLKVTKLGIGVWSWGDNSYWNDFQWDDRKLKAAKGAFDTSLDNGIDFFDTAEVYGSKFSLGAISSETLLGRFIRERKERYPGAEVSVATKFAALPWRFGRESVVTALKDSLSRLELSSVDLYQLHWPGLWGNEGYLDGLGDAVEQGLVKAVGVSNYSEKRLRDAYERLKKRGIPLASNQVNYSLIYRAPEQTGVKAACDELGVTLIAYSPIAQGALTGKYTPENPPSGPRGRIYTREFLTKLQPLLNRIKQIGENYSKTPTQIALNWLVAQGNVIPIPGAKNAEQAKEFAGAIGWSLTDNEVSELRSLASEIKPVVGFPVEYL

SEQ ID NO: 783 - DNA, 461 bp, Arabidopsis thaliana
  misc_feature (1)..(461): Ceres CLONE ID no. 149402
  misc_feature (1)..(461): Also known as  Ceres CDNA ID no. 23361827
aacttgtagcgaatcaaacattcttgtttttcagtgagctcacttcttcttcttctctactttccacaagactttgacttcgaagagcagaaaatggaaggaagaggtaaagtcagcttgatcaacggtggagatggaactagaaaaggtggtagagaacacagtagccgtccgatcccgaagagagggcaagtcaaagttgggatcttgcttggttttgctaattcttttgcttccatctttggctcaacgagaaacttccatggatcctaaacttaatcttctatcttctcatttcccacagaaatattttcattcactttttagaattttctgtggtttattggagtgagataagattggtgatcttgtagtgtctagtttgttgagttcaatttcatttttgtacaaatcctatgtagtttctcttgttaaaatatatatattgtgatctttccttc

SEQ ID NO: 784 - protein, 72 aa, Arabidopsis thaliana
  misc_feature: Utility: Useful for delaying flowering time
  misc_feature: Utility: Useful for making larger plants
  misc_feature: Utility: Useful for making ornamental plants with modified leaves
  misc_feature: Utility: Useful for making plants sterile and for genetic confinement
  misc_feature: Utility: Useful for making plants with altered leaf shape eg curled leaves
  misc_feature: Utility: Useful for making plants with increased biomass
  misc_feature: Utility: Useful for making plants with increased biomass and foliage
  misc_feature: Utility: Useful for making smaller plants
MELEKVVENTVAVRSRREGKSKLGSCLVLLILLLPSLAQRETSMDPKLNLLSSHFPQKYFHSLFRIFCGLLE

SEQ ID NO: 785 - DNA, 1471 bp, Arabidopsis thaliana
  misc_feature (1)..(1471): Ceres CLONE ID no. 157547
  misc_feature (1)..(1471): Also known as  Ceres CDNA ID no. 23384444
atctttggtttttcttcactgacaaaacccctaaaaatggccgactcattcgagctaattgtaacccgaaaagaacctgttctcgtctctccagcctccgaaactccaaaaggtctccattatctctcaaatctcgatcaaaacatcgccatcattgtcaaaacattctactacttcaaatcaaactcaagatccaacgaagaatcctatgaagtcatcaagaagtcactctccgaggtcctcgttcactactatcctgccgcagggagactcacgatcagtcctgaaggaaagatcgctgtggattgcaccggagaaggagttgtagtggtggaagctgaggccaattgtgggatagagaagataaagaaggctatatcggagattgatcaaccagagactcttgaaaagttggtttacgacgttcccggtgctcggaatattctcgagattcctccagtggttgttcaggtgacaaatttcaagtgtggagggttcgtgctaggactaggcatgaaccacaatatgttcgatggtatcgcagccatggagttcctcaactcttgggccgagacggctcgtggccttcctctctccgttccacctttcttggaccgcacacttctccgaccacgaaccccaccaaagatcgaattcccacacaacgagttcgaggacctcgaagacatctccggcaccggaaaactctactccgacgagaaactcgtctacaaatccttcctcttcggacccgaaaaactcgagaggcttaagatcatggcagagacgagatccacgacttttcaaaccctaaccgggtttctgtggagagctcgttgtcaagccttagggcttaaacctgatcaacggatcaagcttctctttgctgcagatggaaggtcgagattcgttccggaacttcctaaaggatattccggtaacgggattgtgttcacttattgcgttacaacggcaggtgaagtgactttaaaccctctttctcattcagtgtgtttggtcaaaagagccgttgaaatggtcaacgacggtttcatgaggtcagcgattgattactttgaggtgactcgagctaggccgagcctaacggcaacacttctgatcacgtcgtgggcaaaactgtcgtttcatactaaggatttcggttggggtgaaccggttgtatctggaccggtcggtttacctgagaaggaagtgattctgtttctgccatgtggtagtgacacgaattatcaatgtgctgcttggacttcctggctcggctatgaaagtgttccaagggattatggatatatgaatcattaaaattatttatggtttaatgtttgaatttaaattaactatgatttaaaaagcaaataatgatgatatatcaattacgtgtttgtggtcgtatgaaatattgttcgtcggtggagcaaaaatgtaactaagatgttaaagtatcaagttt

SEQ ID NO: 786 - protein, 269 aa, Arabidopsis thaliana
  misc_feature (1)..(227): Pfam Name: Transferase; Pfam Description: Transferase family
  misc_feature: Utility: Useful for delaying flowering time
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with increased biomass
  misc_feature: Utility: Useful for making plants with increased biomass and foliage
  misc_feature: Utility: Useful for making smaller plants
MNHNMFDGIAAMEFLNSWAETARGLPLSVPPFLDRTLLRPRTPPKIEFPHNEFEDLEDISGTGKLYSDEKLVYKSFLFGPEKLERLKIMAETRSTTFQTLTGFLWRARCQALGLKPDQRIKLLFAADGRSRFVPELPKGYSGNGIVFTYCVTTAGEVTLNPLSHSVCLVKRAVEMVNDGFMRSAIDYFEVTRARPSLTATLLITSWAKLSFHTKDFGWGEPVVSGPVGLPEKEVILFLPCGSDTNYQCAAWTSWLGYESVPRDYGYMNH

SEQ ID NO: 787 - protein, 431 aa, Glycine max
  misc_feature (1)..(431): Ceres CLONE ID no. 520302
  misc_feature: Utility: Useful for delaying flowering time
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with increased biomass
  misc_feature: Utility: Useful for making plants with increased biomass and foliage
  misc_feature: Utility: Useful for making smaller plants
MSSIKLNVKQQGEPTRVLPAEETEKGLYFLSNLDQNIAVPVRTVYCFKSGSRGNEDAAQVIKESLSKILVPYYPMAGTLRISSEEKLIVDNPGEGAVFVEAEADFDIEEIGDLTKPDPDALGKLVYYVPGAPSILEMPLMTVQVTKFKCGGFTLGLCMIHCMKDGLCAMEFVNAWSQIARGLNLKTPPFLDRTIIKARDPPKIEFQHTEFAEIEDISNTKKLYEEENMLYRSVCFDTEKLDMLKKKATEDGVLEKCSTFEALSGFVWRARTAALGMQPDQQTKLLFAVDGRKRFVPPIPKGYFGNAIVLTNSLCNAGELLKNPLSFSVGLIREAIDMVTDSYMRSAIDYFEVTRARPSLTATLLITTWTKLSFHTADFGWGEPLCSGPVTLPEKEVILFLSHGQERKSVNVLLGLPSSAMVIFEALMMMQV

SEQ ID NO: 788 - protein, 435 aa, Triticum aestivum
  misc_feature (1)..(435): Ceres CLONE ID no. 922101
  misc_feature: Utility: Useful for delaying flowering time
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with increased biomass
  misc_feature: Utility: Useful for making plants with increased biomass and foliage
  misc_feature: Utility: Useful for making smaller plants
  misc_feature (180)..(180): Xaa is any aa, unknown, or other
MAGSKVQLMSVKRGEPTLVSPAEATPTGEQYYLSNLDQNIAVIVQTVYCFKCPSGRGNEGAADALRAALARVLVHYHPLAGRLGISPEMKLIVECTGEGVPFVEAEAACDLALIGDLSTPDPAALGQLVYSVPGAKSILEMPPMTAQVTRFECGGFSIGLAMNHCMFDGLGAMEFVNSWXEMARGATELTVPPFLDRSVLRARDPPVISNPHHEFEEIADVSEMAALYGGQELVYRSFCFDPDRLERVRGLALADGDLERCTTFEALSGLVWRARTRALGLAPEQQTKLLFAVDGRRRFVPPLPKGYFGNGIVLTNALATAGDLLSAPVSRAAGKVQEAVRMVTDEYMRSAVDYFEATRSRPSLASTLLITTWSRLAFNGADFGWGEPTMSGPVTLPEKEVILFLAHGKERKSINVLLGLPASAMDTFQELMDEI

SEQ ID NO: 789 - protein, 442 aa, Zea mays
  misc_feature (1)..(442): Ceres CLONE ID no. 265717
  misc_feature: Utility: Useful for delaying flowering time
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with increased biomass
  misc_feature: Utility: Useful for making plants with increased biomass and foliage
  misc_feature: Utility: Useful for making smaller plants
MKENGGAVLAAGEKAPQVVVKRGEPTLVPPAEATPTGGQYYLSNLDQNIAVIVQTVYCYKPSGGGGDVAAALRDALARVLVHYYPLAGRLGVSPEMKLTVELTGEGAVFVEADAACELATVGDLTKPDPAALGQLVYSVPGAKHILEMPPMTAQVTRFKCGGFALGLAMNHCMFDGIGAMEFVNSWAETARGVAELTVPPFLDRSVLKARDPPVHTFPHHEFAEIPDVSDTAALYGAQELQYRSFCFDPDRLERVRGLALADGALGRCTTFEALSGLVWRARTKALGLAPGQRTKLLFAVDGRRRFVPPLPRGYFGNGIVLTNALATAGELLSAPVSRAAGLVQEAVRMVTDDYMRSAVDYFEATRARPSLASTLLITTWSRLEFHGADFGWGEPVMSGPVTLPEKEVILFLAHGKERKSINVLLGLPATAMDAFQELVDEI

SEQ ID NO: 790 - protein, 453 aa, Zea mays
  misc_feature (1)..(453): Ceres CLONE ID no. 298205
  misc_feature: Utility: Useful for delaying flowering time
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with increased biomass
  misc_feature: Utility: Useful for making plants with increased biomass and foliage
  misc_feature: Utility: Useful for making smaller plants
MVVEMKENGVAAMAAGEKAPQLGVKRGEPTLVPPAEATPTGGQYYLSNLDQNIAVIVQTVYCYKPSSPPGGGEGKDVDVAAALRDALARVLVHYHPLAGRLGVSPEMKLTVELTGEGAVFVEADAACDLAAVGDLTKPDPAALGQLVYSVPGAKHILEMPPMTAQVTRFKCGGFALGLAMNHCMFDGIGAMEFVNSWAETARGVAELTVPPFLDRSVLKARDPPVPTFPHHEFAEIPDVSDTAALYGAQELLYRSFCFDPDRLERVRGLALADGALGRCTTFEALSGLVWRARTKALGLAPEQRTKLLFAVDGRRRFAPPLPRGYFGNGIVLTNALATAGELLSAPVSRAAGLVQDAVRMVTDDYMRSAVDYFEATRARPSLASTLLITTWSRLEFHGADFGWGEPVMSGPVTLPEKEVILFLAHGKERKSINVLLGLPATAMDAFQELMDEI

SEQ ID NO: 791 - DNA, 936 bp, Arabidopsis thaliana
  misc_feature (1)..(936): Ceres CLONE ID no. 158333
  misc_feature (1)..(936): Also known as  Ceres CDNA ID no. 23480081
cacgagaccattacctagaacatcctaatcgaaaaaagaaacttaatcacaactctctctttaatctctttgtctctctctctctctctctatctctctctcattttaatggcgacccaagattctcaagggattaaactctttggtaaaaccataacattcaacgccaacatcacacagacgataaaaaaagaagagcagcaacaacaacaacagccagagctacaagcaacaacagccgttagatcaccctcatcggatctgacggctgagaagcgtccagacaagatcataccatgtccgagatgcaagagcatggagactaagttttgttacttcaacaactacaacgttaatcaaccaagacacttctgcaaaggttgtcaacgttactggaccgccggtggagctctccggaatgttcccgtcggtgccggtcgtcggaagtcaaaacctcccggacgtgtcggtgggttcgctgagttgcttggagctgcgactggagctgttgatcaggtcgagctagatgctttgctagtggaagagtggagagctgctacggcgtctcacggtggtttccggcatgattttccggtgaagaggctccgttgttacaccgatggtcaatcttgttaattatttttacatttttatttgtttgttttcgggtttgggtttgggtggtttgctataatttaacccgtagaacgaaagaacgtggttaaatttgctttgctttgattactctggatacgtacaggctagcaacaaaatttaactagttaattactaattaattagtaggtttttaatacttgcttatctactaaacagctgtcgctttttaatctctcttgttgtaaattgaagctcgtggccgtgggatttttcttctctaaacaaagacggtgtggttgaccaaaaaaaaaaaaaaaa

SEQ ID NO: 792 - protein, 175 aa, Arabidopsis thaliana
  misc_feature (57)..(119): Pfam Name: zf-Dof; Pfam Description: Dof domain, zinc finger
  misc_feature: Utility: Useful for delaying flowering time
  misc_feature: Utility: Useful for increasing chlorophyll and photosynthetic capacity
  misc_feature: Utility: Useful for increasing seed/fruit yield or modifying fruit content
  misc_feature: Utility: Useful for making larger plants
  misc_feature: Utility: Useful for making ornamental plants with modified leaves
  misc_feature: Utility: Useful for making plants sterile and for genetic confinement
  misc_feature: Utility: Useful for making plants that grow better in shade
  misc_feature: Utility: Useful for making plants with altered leaf shape eg curled leaves
  misc_feature: Utility: Useful for making plants with increased biomass
  misc_feature: Utility: Useful for making plants with increased biomass and foliage
  misc_feature: Utility: Useful for making smaller plants
  misc_feature: Utility: Useful for modifying fruit shape, composition and seed yield
MATQDSQGIKLFGKTITFNANITQTIKKEEQQQQQQPELQATTAVRSPSSDLTAEKRPDKIIPCPRCKSMETKFCYFNNYNVNQPRHFCKGCQRYWTAGGALRNVPVGAGRRKSKPPGRVGGFAELLGAATGAVDQVELDALLVEEWRAATASHGGFRHDFPVKRLRCYTDGQSC

SEQ ID NO: 793 - protein, 152 aa, Brassica napus
  misc_feature (1)..(152): Ceres CLONE ID no. 1118660
  misc_feature: Utility: Useful for delaying flowering time
  misc_feature: Utility: Useful for increasing chlorophyll and photosynthetic capacity
  misc_feature: Utility: Useful for increasing seed/fruit yield or modifying fruit content
  misc_feature: Utility: Useful for making larger plants
  misc_feature: Utility: Useful for making ornamental plants with modified leaves
  misc_feature: Utility: Useful for making plants sterile and for genetic confinement
  misc_feature: Utility: Useful for making plants that grow better in shade
  misc_feature: Utility: Useful for making plants with altered leaf shape eg curled leaves
  misc_feature: Utility: Useful for making plants with increased biomass
  misc_feature: Utility: Useful for making plants with increased biomass and foliage
  misc_feature: Utility: Useful for making smaller plants
  misc_feature: Utility: Useful for modifying fruit shape, composition and seed yield
  misc_feature (39)..(39): Xaa is any aa, unknown, or other
KKLSYNSLFSIYISLIFMATKDSPGIKLFGKTITFNADXNNIIQTIKKEEGQEQQPELQTKTAVRSPSSSDLMAEKRPDKIIACPRCKSMETKFCYFNNYNVNQPRHFCKGCQRYWTAGGALRNVPVGAGRRRSKPPGRAGGFSELLGAATG

SEQ ID NO: 794 - protein, 170 aa, Brassica napus
  misc_feature (1)..(170): Public GI no. 62319965
  misc_feature: Utility: Useful for delaying flowering time
  misc_feature: Utility: Useful for increasing chlorophyll and photosynthetic capacity
  misc_feature: Utility: Useful for increasing seed/fruit yield or modifying fruit content
  misc_feature: Utility: Useful for making larger plants
  misc_feature: Utility: Useful for making ornamental plants with modified leaves
  misc_feature: Utility: Useful for making plants sterile and for genetic confinement
  misc_feature: Utility: Useful for making plants that grow better in shade
  misc_feature: Utility: Useful for making plants with altered leaf shape eg curled leaves
  misc_feature: Utility: Useful for making plants with increased biomass
  misc_feature: Utility: Useful for making plants with increased biomass and foliage
  misc_feature: Utility: Useful for making smaller plants
  misc_feature: Utility: Useful for modifying fruit shape, composition and seed yield
MATQDSQGIKLFGKTIAFNTRTIKNEEETHPPEQEATIAVRSSSSSDLTAEKRPDKIIACPRCKSMETKFCYFNNYNVNQPRHFCKGCHRYWTAGGALRNVPVGAGRRKSKPPGRVVVGMLGDGNGVRQVELINGLLVEEWQHAAAAAHGSFRHDFPMKRLRCYSDGQSC

SEQ ID NO: 795 - DNA, 848 bp, Zea mays
  misc_feature (1)..(848): Ceres CLONE ID no. 225157
  misc_feature (1)..(848): Also known as  Ceres CDNA ID no. 23749861
acgatacatgcagctagctcaagggaaaggcaagagactccttgctagccatggccttctactatgcaatagcattgcttggcatgcttgctgtcttctcctcgggggggaatgcactcgatgacaatatgctgaaaaccacggtatacatacaacagcttccctatcaaaaccagagaggtgtagcagaaggtacggcagtaattagctggtacataaaggatgggccaggtgcttctgcgaatacaatcgggcatgcggagggcctggtaatcttgacagatatagccaggtcttcgtggctaatcactacggacttggtgttcgacggtggaagcctcgcagggtcctcacttcaagtgatggggcagcatgagtcttcaggccagtggagcattatgggcggcactggacaatttaccatggcacgaggtgttatagagtacaaaacaatccaagaggacagtagcagcaggacctttgaagtatgcatatatgcatactacactcccatgaacggatggaaagccggtctggctttaggtgacactggcagtaaaccttgaggactacgatcgagatttagacgaccatccatgtgtgcgcgcgccaatgcaaggagtgacgtacggcagccagatctacaatctttttttatgcttcatccaataataaatgaaccccactcccttatattatgaattagaaaaacacaatcatttgttgtattattccagacaacgaatttatttgcagtttattcagttattttctgtctcatgcatgttccccttgtctcaacagtggtcatcaataagacgtgtcttcggtggaaatatattaattgt

SEQ ID NO: 796 - protein, 171 aa, Zea mays
  misc_feature (59)..(150): Pfam Name: Dirigent; Pfam Description: Dirigent-like protein
  misc_feature (59)..(150): Pfam Name: Dirigent; Pfam Description: Dirigent-like protein
  misc_feature: Utility: Useful for delaying flowering time
  misc_feature: Utility: Useful for increasing chlorophyll and photosynthetic capacity
MAFYYAIALLGMLAVFSSGGNALDDNMLKTTVYIQQLPYQNQRGVAEGTAVISWYIKDGPGASANTIGHAEGLVILTDIARSSWLITTDLVFDGGSLAGSSLQVMGQHESSGQWSIMGGTGQFTMARGVIEYKTIQEDSSSRTFEVCIYAYYTPMNGWKAGLALGDTGSKP

SEQ ID NO: 797 - DNA, 674 bp, Zea mays
  misc_feature (1)..(674): Ceres CLONE ID no. 227651
  misc_feature (1)..(674): Also known as  Ceres CDNA ID no. 23742072
aaaaccctagcttgcagcgccgcctggatcgagcagccgagcgactaagcgaagactcccttttccccgagcacaagagaaccatggcggcggcggcagtttacggcggcttcaaagggaagcttggcgtcgaggatgcccccgagctgcagctcaaccgcatccgcatcacactctcatccaagaacgtcaagaacttggagaaagtttgtgcggatttggtaaagggagccaaggacaagcatttgagggttaagggacctgtcaggatccctactaaggttctccacatcaccactcgcaagtccccttgcggtgaaggaacaaacacatgggatcggtttgagttccgcattcacaagagggtgattgacctaatcagctcccctgatgtggtgaagcagatcacctccatcacaattgagcccggtgttgaggttgaggtgaccattgccgacgtgtaaggacgtgaagttcagcaatgtcatcgacaatctttttctttgtgctccctgtgacctgtgtgctcgcaagagagattttgagttattattagcatacaacacttcttcccccctataattctatgttagctgtttgtctgatttatggcctgttcaacttgaaattttgattcagtaatctttatgtggtgctaattgaacttggatcgc

SEQ ID NO: 798 - protein, 126 aa, Zea mays
  misc_feature (26)..(121): Pfam Name: Ribosomal_S10; Pfam Description: Ribosomal protein S10p/S20e
  misc_feature: Utility: Useful for delaying flowering time
  misc_feature: Utility: Useful for making larger plants
  misc_feature: Utility: Useful for making ornamental plants with modified leaves
  misc_feature: Utility: Useful for making plants with increased biomass
MAAAAVYGGFKGKLGVEDAPELQLNRIRITLSSKNVKNLEKVCADLVKGAKDKHLRVKGPVRIPTKVLHITTRKSPCGEGTNTWDRFEFRIHKRVIDLISSPDVVKQITSITIEPGVEVEVTIADV

SEQ ID NO: 799 - protein, 117 aa, Glycine max
  misc_feature (1)..(117): Ceres CLONE ID no. 628769
  misc_feature: Utility: Useful for delaying flowering time
  misc_feature: Utility: Useful for making larger plants
  misc_feature: Utility: Useful for making ornamental plants with modified leaves
  misc_feature: Utility: Useful for making plants with increased biomass
MKPTKPGLEESQEQIHKIRITLSSKNVKNLEKVCADLVRGAKDKHLRVKGPVRMPTKVLNITTRKSPCGEGTNTWDRFELRVHKRVIDLYSSPDVVKQITSITIEPGVEVKVTIADA

SEQ ID NO: 800 - protein, 116 aa, Glycine max
  misc_feature (1)..(116): Ceres CLONE ID no. 620287
  misc_feature: Utility: Useful for delaying flowering time
  misc_feature: Utility: Useful for making larger plants
  misc_feature: Utility: Useful for making ornamental plants with modified leaves
  misc_feature: Utility: Useful for making plants with increased biomass
MKPNKPGLEESQEQIHKIRITLSSKHVKNLEKVCGDLVRGAKDKRLRVKGPVRMPTKVLHITTRKSPCGEGTNTWDRFELRVHKRVIDLYSSPDVVKQITSITIEPGVEVEVTIAD

SEQ ID NO: 801 - protein, 117 aa, Glycine max
  misc_feature (1)..(117): Ceres CLONE ID no. 691483
  misc_feature: Utility: Useful for delaying flowering time
  misc_feature: Utility: Useful for making larger plants
  misc_feature: Utility: Useful for making ornamental plants with modified leaves
  misc_feature: Utility: Useful for making plants with increased biomass
  misc_feature (71)..(71): Xaa is any aa, unknown, or other
  misc_feature (109)..(109): Xaa is any aa, unknown, or other
MKPTKPGLEESQEQIHKIRITLSSKNVKNLEKVCADLVRGAKDKHLRVKGPVRMPTKVLNITTRKSPCGEXTNTWDRFELRVHKRVIDLYSSPDVVKQITSITIEPGVXVEVTIADA

SEQ ID NO: 802 - protein, 117 aa, Arabidopsis thaliana
  misc_feature (1)..(117): Ceres CLONE ID no. 8700
  misc_feature: Utility: Useful for delaying flowering time
  misc_feature: Utility: Useful for making larger plants
  misc_feature: Utility: Useful for making ornamental plants with modified leaves
  misc_feature: Utility: Useful for making plants with increased biomass
MKPTKAGLEAPLEQIHKIRITLSSKNVKNLEKVCTDLVRGAKDKRLRVKGPVRMPTKVLKITTRKAPCGEGTNTWDRFELRVHKRVIDLFSSPDVVKQITSITIEPGVEVEVTIADS

SEQ ID NO: 803 - protein, 117 aa, Zea mays
  misc_feature (1)..(117): Ceres CLONE ID no. 1387338
  misc_feature: Utility: Useful for delaying flowering time
  misc_feature: Utility: Useful for making larger plants
  misc_feature: Utility: Useful for making ornamental plants with modified leaves
  misc_feature: Utility: Useful for making plants with increased biomass
MKQGKTGFEAPQEQIHKIRITLSSKNVKNLEKVCTDLVRGAKDKRLRVKGPVRMPTKVLKITTRKAPCGEGTNTWDRFELRVHKRVIDLFSSPDVVKQITSITIEPGVEVEVTIADS

SEQ ID NO: 804 - protein, 117 aa, Triticum aestivum
  misc_feature (1)..(117): Ceres CLONE ID no. 761484
  misc_feature: Utility: Useful for delaying flowering time
  misc_feature: Utility: Useful for making larger plants
  misc_feature: Utility: Useful for making ornamental plants with modified leaves
  misc_feature: Utility: Useful for making plants with increased biomass
MKSGKLGFEGTQEVQHRIRITLSSKSVKNLEKVCSDLVKGAKEKQLKVKGPVRMPTKVLNITTRKSPCGEGTNTWDRFEMRVHKRVIDLVSSPDVVKQITSITIEPGVEVEVTISDQ

SEQ ID NO: 805 - protein, 127 aa, Triticum aestivum
  misc_feature (1)..(127): Ceres CLONE ID no. 615315
  misc_feature: Utility: Useful for delaying flowering time
  misc_feature: Utility: Useful for making larger plants
  misc_feature: Utility: Useful for making ornamental plants with modified leaves
  misc_feature: Utility: Useful for making plants with increased biomass
MATELAYAPPMKSGKAGFEGPQEAQHRIRITLSSKSVKNLEKVCSDLVRGAKDKLLRVKGPVRMPTKVLNITTRKSPCGEGTNTWDRFEMRVHKRVIDLVSSPDVVKQITSITIEPGVEVEVTISDQ

SEQ ID NO: 806 - protein, 117 aa, Triticum aestivum; identical to SEQ ID NO: 804
  misc_feature (1)..(117): Ceres CLONE ID no. 1326610
  misc_feature: Utility: Useful for delaying flowering time
  misc_feature: Utility: Useful for making larger plants
  misc_feature: Utility: Useful for making ornamental plants with modified leaves
  misc_feature: Utility: Useful for making plants with increased biomass

SEQ ID NO: 807 - protein, 127 aa, Triticum aestivum; identical to SEQ ID NO: 805
  misc_feature (1)..(127): Ceres CLONE ID no. 757080
  misc_feature: Utility: Useful for delaying flowering time
  misc_feature: Utility: Useful for making larger plants
  misc_feature: Utility: Useful for making ornamental plants with modified leaves
  misc_feature: Utility: Useful for making plants with increased biomass

SEQ ID NO: 808 - protein, 117 aa, Glycine max
  misc_feature (1)..(117): Ceres CLONE ID no. 1417385
  misc_feature: Utility: Useful for delaying flowering time
  misc_feature: Utility: Useful for making larger plants
  misc_feature: Utility: Useful for making ornamental plants with modified leaves
  misc_feature: Utility: Useful for making plants with increased biomass
  misc_feature (116)..(116): Xaa is any aa, unknown, or other
  misc_feature (117)..(117): Xaa is any aa, unknown, or other
MKSGKLGFEGTQEVQHRIRITLSSKSVKNLEKVCSDLVKGAKEKQLKVKGPVRMPTKVLNITTRKSPCGEGTNTWDRFEMRVHKRVIDLVSSPDVVKQITSITIEPGVEVEVTISXX

SEQ ID NO: 809 - protein, 117 aa, Glycine max
  misc_feature (1)..(117): Ceres CLONE ID no. 1057479
  misc_feature: Utility: Useful for delaying flowering time
  misc_feature: Utility: Useful for making larger plants
  misc_feature: Utility: Useful for making ornamental plants with modified leaves
  misc_feature: Utility: Useful for making plants with increased biomass
MKQGKTGLEEPQEQIHKIRITLSSKNVKNLEKVCTDLVRGAKDKRLRVKGPVRMPTKVLKITTRKAPCGEGTNTWDRFELRVHKRVIDLFSSPDVVKQITSITIEPGVEVEVTIADS

SEQ ID NO: 810 - protein, 117 aa, Zea mays
  misc_feature (1)..(117): Ceres CLONE ID no. 1443563
  misc_feature: Utility: Useful for delaying flowering time
  misc_feature: Utility: Useful for making larger plants
  misc_feature: Utility: Useful for making ornamental plants with modified leaves
  misc_feature: Utility: Useful for making plants with increased biomass
MKQGKTGFEEPQEQIHKIRITLSSKNVKNLEKVCTDLVRGAKDKRLRVKGPVRMPTKVLKITTRKAPCGEGTNTWDRFELRVHKRVIDLFSSPDVVKQITSITIEPGVEVEVTIADS

SEQ ID NO: 811 - protein, 117 aa, Zea mays; identical to SEQ ID NO: 809
  misc_feature (1)..(117): Ceres CLONE ID no. 1386515
  misc_feature: Utility: Useful for delaying flowering time
  misc_feature: Utility: Useful for making larger plants
  misc_feature: Utility: Useful for making ornamental plants with modified leaves
  misc_feature: Utility: Useful for making plants with increased biomass

SEQ ID NO: 812 - protein, 122 aa, Brassica napus
  misc_feature (1)..(122): Ceres CLONE ID no. 1068506
  misc_feature: Utility: Useful for delaying flowering time
  misc_feature: Utility: Useful for making larger plants
  misc_feature: Utility: Useful for making ornamental plants with modified leaves
  misc_feature: Utility: Useful for making plants with increased biomass
MAYAAMKPTKAGLEEPLEQIHKIRITLSSKNVKNLEKVCADLVRGAKDKRLRTKGPVRMPTKVLKITTRKAPCGEGTNTWDRFELRVHKRVIDLFSSPDVVKQITSITIEPGVEVEVTIADS

SEQ ID NO: 813 - protein, 122 aa, Brassica napus; identical to SEQ ID NO: 812
  misc_feature (1)..(122): Ceres CLONE ID no. 1081109
  misc_feature: Utility: Useful for delaying flowering time
  misc_feature: Utility: Useful for making larger plants
  misc_feature: Utility: Useful for making ornamental plants with modified leaves
  misc_feature: Utility: Useful for making plants with increased biomass

SEQ ID NO: 814 - protein, 122 aa, Glycine max; identical to SEQ ID NO: 812
  misc_feature (1)..(122): Ceres CLONE ID no. 1070341
  misc_feature: Utility: Useful for delaying flowering time
  misc_feature: Utility: Useful for making larger plants
  misc_feature: Utility: Useful for making ornamental plants with modified leaves
  misc_feature: Utility: Useful for making plants with increased biomass

SEQ ID NO: 815 - DNA, 1024 bp, Zea mays
  misc_feature (1)..(1024): Ceres CLONE ID no. 235672
  misc_feature (1)..(1024): Also known as  Ceres CDNA ID no. 23784995
acagagcgccacgaggcgagcagtcgagtgttccctagagtccccgttcctccgccgccgcctgcaaccgcttcacgtgccctgatccatcgcaggtcccctttctgaccccaaatggagccgaagaagtcctctgctcagcaccagccccacgccatggaacccaagaagtcctctccacgcggcgccggggccgtcgccgccaccgccactgaagccgagtccccgttgagcagcttgttctacccgccggcgcccgcggcaaatgggaaagatcaggagttgtacagcattatttacaaagggcagagcgggagcgcacaagctggcgcgacaggtaatggtaaaccgcaatgggctccttccaaaagtcataccgcgtacgcaaaggacggtaaacattcaccaccttatgatacgtcatgttttgggtcatctgtgcattatggtggtcgagattatttctacggcagctctacaaccaagaaagcgacagaatcctccactgactacaaaggggacaagaaagatccagtcgcagattctcatggcgactggtggcaaggctcattttattactaagagaacctggtggcctctccttggagaacaaggaacagaaggaggggcagtgaagctcggtttccttgattgctagcagtattatcttgtgtcatagtggacccgctttcgtccagtggtggtgcgccaatatttagaagcgtcacctggcctgggcagatgtagtgtgcgtcttatagtctctgctttagatgtgcaatgtaacgaagctttagcacagtatgaactagaccgcataaaagaatccatgtccattccgccagtaatatgagcgggttggtatctgactccttagagtcaaaattctgtacaattggatcgtcgctccaaagcaaaaaaaaaaaacaataataatgtgctggagaagcggcgatgacttcacattgtacacctttaccagctggaatttgacagaagtttggaaactgttcttgtcaattgc

SEQ ID NO: 816 - protein, 75 aa, Zea mays
  misc_feature: Utility: Useful for delaying flowering time
  misc_feature: Utility: Useful for making larger plants
  misc_feature: Utility: Useful for making plants with increased biomass and foliage
  misc_feature: Utility: Useful for making plants with increased size and biomass
  misc_feature (69)..(69): Xaa is any aa, unknown, or other
MEPKKSSAQHQPHAMEPKKSSPRGAGAVAATATEAESPLSSLFYPPAPAANGKDQELYSIIYKGQSGSXTSWRDR

SEQ ID NO: 817 - protein, 75 aa, Zea mays; identical to SEQ ID NO: 816
  misc_feature (1)..(75): Ceres CLONE ID no. 235672
  misc_feature: Utility: Useful for delaying flowering time
  misc_feature: Utility: Useful for making larger plants
  misc_feature: Utility: Useful for making plants with increased biomass and foliage
  misc_feature: Utility: Useful for making plants with increased size and biomass
  misc_feature (69)..(69): Xaa is any aa, unknown, or other

SEQ ID NO: 818 - protein, 156 aa, Zea mays
  misc_feature (1)..(156): Public GI no. 56784045
  misc_feature: Utility: Useful for delaying flowering time
  misc_feature: Utility: Useful for making larger plants
  misc_feature: Utility: Useful for making plants with increased biomass and foliage
  misc_feature: Utility: Useful for making plants with increased size and biomass
MEPKRSPALPQPNVETKKSPPRAAAGGGGGGTAAVGGESPLSSLFHQPSHGAKGKEDIYSIFYKGQNGTAQAGTADGKSQWTPPKSRTVYTKDNKQSNQYDSVDTSCFGSSVNYGGRDYYGISGHKQSTESNDYKADKKDPSTDSHGDWWQGSFYY

SEQ ID NO: 819 - DNA, 1290 bp, Zea mays
  misc_feature (1)..(1290): Ceres CLONE ID no. 241131
  misc_feature (1)..(1290): Also known as  Ceres CDNA ID no. 23773411
ttttcctcccataaaagcctctccctccgctagtccgctctcaagtaaaaagctcccgaaatcccctcacctactcctctccctctccctctggcagcgccgcctcgccggcggttgcctgcctgcaccttcgccccccgtctcgacctcgacgcggcctccgttcctccgcgagacgcagcatggatgtgcgccctgcgaatgcggccgacgactcgtctctcggagacctgttcccgcaccagcccgccggtttggagagtgacgagagcaacacagaatggctctctggttacgtagaggactgcttttcgagctccacgtcgtacacaaatcccgtctctgcaatggcaagcgagggtgtcggaaaaccaaagctacctccaccaccatcctccaacggcaggagaaagaaacggagcttggcctccgtcatgaccaacggcgactaccaacaattcgtcctcccgctgtacgtcgagccaccgctgatcctgatcgaccagaaacactggatggcagagagcgagctgatccaccccaagaaggacgacgacgaccgakaggtttgccagcaacaagggcaggagcaagagaagggcgtgccgcggctggtgaagatgtgcagcaactgtctgtcaagccaaacgccacggtggagggacgggccgtcggggcgccagatgatgtgcagcgcatgcggcatgaggctcaagccagagaccaggttgtcagccgagcagcagtacggccaggaagaacccaccaggaaggagcaagagccagacaggaagaggaagaaggcggccaagaagacgtgctacgagagcagcgacgccccgccgtcgtcggaccagcaagagaagcggtgcgcccactgcctgtcctccaagaccccgcagtggagggcggggcctctggggcccaagaccctgtgcaacgcctgcggcgtcaggttcaagtccggcaggctgctgcccgagtaccggcccgccaacagccccaccttcgtgagctgcttgcactccaactcccacaagaaggtcatgcagatgcggcaggccgtcgcgcagcagcagtgaggccgacgtctcccggaatctatcgttggaagcgcgttaggggatctcttagatcgtagcttagtcgatgctcagagaggatgagaacagagactttggttatagtagtagtaggcaatcgtcgttagctctagcggtgttctagctcagactgatttgctcggtgtttttagacgtcggattcaatacaatctcgatgttgtcctgg

SEQ ID NO: 820 - protein, 299 aa, Zea mays
  misc_feature (230)..(265): Pfam Name: GATA; Pfam Description: GATA zinc finger
  misc_feature: Utility: Useful for delaying flowering time
  misc_feature: Utility: Useful for making plants with altered leaf shape eg curled leaves
  misc_feature: Utility: Useful for making smaller plants
MDVRPANAADDSSLGDLFPHQPAGLESDESNTEWLSGYVEDCFSSSTSYTNPVSAMASEGVGKPKLPPPPSSNGRRKKRSLASVMTNGDYQQFVLPLYVEPPLILIDQKHWMAESELIHPKKDDDDREVCQQQGQEQEKGVPRLVKMCSNCLSSQTPRWRDGPSGRQMMCSACGMRLKPETRLSAEQQYGQEEPTRKEQEPDRKRKKAAKKTCYESSDAPPSSDQQEKRCAHCLSSKTPQWRAGPLGPKTLCNACGVRFKSGRLLPEYRPANSPTFVSCLHSNSHKKVMQMRQAVAQQQ

SEQ ID NO: 821 - protein, 99 aa, Glycine max
  misc_feature (1)..(99): Ceres CLONE ID no. 674257
  misc_feature: Utility: Useful for delaying flowering time
  misc_feature: Utility: Useful for making plants with altered leaf shape eg curled leaves
  misc_feature: Utility: Useful for making smaller plants
  misc_feature (9)..(9): Xaa is any aa, unknown, or other
  misc_feature (46)..(46): Xaa is any aa, unknown, or other
  misc_feature (57)..(57): Xaa is any aa, unknown, or other
  misc_feature (94)..(94): Xaa is any aa, unknown, or other
MSKESFGDXELEEGSNGQQPMPTRRCSHCLAQRTPQWRAGPLGPKXLCNACGVRYKXGRLLPEYRPAKSPTFVSYLHSNSHKKVMEMRMAVFSXISSEQ

SEQ ID NO: 822 - protein, 111 aa, Glycine max
  misc_feature (1)..(111): Ceres CLONE ID no. 621746
  misc_feature: Utility: Useful for delaying flowering time
  misc_feature: Utility: Useful for making plants with altered leaf shape eg curled leaves
  misc_feature: Utility: Useful for making smaller plants
MAKEDEEKVIINVSKEISFGDSELDEGSNGQQQPMPRRCTHCLAQRTPQWRAGPLGPKTLCNACGVRYKSGRLLPEYRPAKSPTFVSYLHSNSHKKVMEMRMSVYSISSEQ

SEQ ID NO: 823 - protein, 250 aa, Arabidopsis thaliana
  misc_feature (1)..(250): Ceres CLONE ID no. 1334990
  misc_feature: Utility: Useful for delaying flowering time
  misc_feature: Utility: Useful for making plants with altered leaf shape eg curled leaves
  misc_feature: Utility: Useful for making smaller plants
MFPALPSDLTSCPKGAARVRIPNNMIPALKQSCSSEALSGINSTPHQSSAPPDIKVSYLFQSLTPVSVLENSYGSLSTQNSGSQRLAFPVKGMRSKRRRPTTVRLSYLFPFEPRKSTPGESVTEGYYSSEQHAKKKRKIHLITHTESSTLESSKSDGIVRICTHCETITTPQWRQGPSGPKTLCNACGVRFKSGRLVPEYRPASSPTFIPSVHSNSHRKIIEMRKKDDEFDTSMIRSDIQKVKQGRKKMV

SEQ ID NO: 824 - protein, 247 aa, Arabidopsis thaliana
  misc_feature (1)..(247): Ceres CLONE ID no. 18857
  misc_feature: Utility: Useful for delaying flowering time
  misc_feature: Utility: Useful for making plants with altered leaf shape eg curled leaves
  misc_feature: Utility: Useful for making smaller plants
MDMFPTLPSDLTSCGSGMAKAPRVDIQRNIPALKQSYSSEALSSTLHQSSAPPEIKVSKLFQSLSPVSVLENSYGSLSTHNNGSQRLAFPVKGMRSKRKRPTTLRLSYLFPSEPRKPEKSTPGKPESECYFSSEQHAKKKRKIHLTTRTVSSTLEASNSDGIVRKCTHCETTKTPQWREGPSGPKTLCNACGVRFRSGRLVPEYRPASSPTFIPAVHSNSHRKIIEMRRKDDEQFDSSMIRAVISRG

SEQ ID NO: 825 - DNA, 910 bp, Arabidopsis thaliana
  misc_feature (1)..(910): Ceres CLONE ID no. 262460
  misc_feature (1)..(910): Also known as  Ceres CDNA ID no. 23365397
atcaactctctctctcactttcacaactctccctttctatttctctctctagaaaaatatcatcatctatcaattatatagagtacttatttagattcatttcataaaaatggagaaaagagaaagtagtggtggttctggatcaggagatgcagaggtgagaaaagggccatggacgatggaagaagatttgattctcatcaattatatcgccaatcatggtgaaggtgtttggaactctctcgccaaatctgcaggactaaaacgcaccgggaaaagttgccggctccggtggctgaactacctccgacctgatgtgcgacggggaaatatcacaccagaagaacagctcaccatcatggaacttcatgcaaaatggggaaataggtggtcaaaaattgcaaagcatttaccaggaaggaccgacaatgagataaagaacttttggaggactaagatccagaaatacatcatcaagagcggagaaacgacgaccgttggatcacaaagctccgagtttataaaccatcatgcgacaacgagccatgtcatgaatgatactcaagaaaccatggatatgtattctccaacgacgtcgtatcaacatgccagcaatattaatcagcagcttaattatggtaattatgtgcctgaatccagttcgatcatgatgccattatctgttgatcaatccgaacaaaactattggagcgtcgatgatctttggcccatgaatatatataatggtaattaataaataagttcgttaaaacttatatatatttacggtccaaagagggttctatataaacagagtactgtatgggtttgcctcattgtttagaggtaggtacttaatataaggttggagatcttatatgaattaataaataactcgtatttactagat

SEQ ID NO: 826 - protein, 191 aa, Arabidopsis thaliana
  misc_feature (2)..(43): Pfam Name: Myb_DNA-binding; Pfam Description: Myb-like DNA-binding domain
  misc_feature: Utility: Useful for delaying flowering time
  misc_feature: Utility: Useful for making larger plants
  misc_feature: Utility: Useful for making ornamental plants with modified leaves
  misc_feature: Utility: Useful for making plants with altered leaf shape eg curled leaves
  misc_feature: Utility: Useful for making plants with increased biomass
  misc_feature: Utility: Useful for making plants with increased biomass and foliage
  misc_feature: Utility: Useful for making smaller plants
MEEDLILINYIANHGEGVWNSLAKSAGLKRTGKSCRLRWLNYLRPDVRRGNITPEEQLTIMELHAKWGNRWSKIAKHLPGRTDNEIKNFWRTKIQKYIIKSGETTTVGSQSSEFINHHATTSHVMNDTQETMDMYSPTTSYQHASNINQQLNYGNYVPESSSIMMPLSVDQSEQNYWSVDDLWPMNIYNGN

SEQ ID NO: 827 - protein, 226 aa, Arabidopsis thaliana
  misc_feature (1)..(226): Public GI no. 26451911
  misc_feature: Utility: Useful for delaying flowering time
  misc_feature: Utility: Useful for making larger plants
  misc_feature: Utility: Useful for making ornamental plants with modified leaves
  misc_feature: Utility: Useful for making plants with altered leaf shape eg curled leaves
  misc_feature: Utility: Useful for making plants with increased biomass
  misc_feature: Utility: Useful for making plants with increased biomass and foliage
  misc_feature: Utility: Useful for making smaller plants
MEKRGGGSSGGSGSSAEAEVRKGPWTMEEDLILINYIANHGDGVWNSLAKSAGLKRTGKSCRLRWLNYLRPDVRRGNITPEEQLIIMELHAKWGNRWSKIAKHLPGRTDNEIKNFWRTRIQKYIKQSDVTTTSSVGSHHSSEINDQAASTSSHNVFCTQDQAMETYSPTPTSYQHTNMEFNYGNYSAAAVTATVDYPVPMTVDDQTGENYWGMDDIWSSMHLLNGN

SEQ ID NO: 828 - protein, 182 aa, Glycine max
  misc_feature (1)..(182): Ceres CLONE ID no. 549651
  misc_feature: Utility: Useful for delaying flowering time
  misc_feature: Utility: Useful for making larger plants
  misc_feature: Utility: Useful for making ornamental plants with modified leaves
  misc_feature: Utility: Useful for making plants with altered leaf shape eg curled leaves
  misc_feature: Utility: Useful for making plants with increased biomass
  misc_feature: Utility: Useful for making plants with increased biomass and foliage
  misc_feature: Utility: Useful for making smaller plants
  misc_feature (11)..(11): Xaa is any aa, unknown, or other
  misc_feature (13)..(13): Xaa is any aa, unknown, or other
  misc_feature (102)..(102): Xaa is any aa, unknown, or other
  misc_feature (151)..(151): Xaa is any aa, unknown, or other
  misc_feature (174)..(174): Xaa is any aa, unknown, or other
  misc_feature (177)..(177): Xaa is any aa, unknown, or other
MEEDLILITYXAXHGEGVWNSLAKAAGLKRTGKSCRLRWLNYLRPDVRRGNITPEEQLLIMELHAKWGNRWSKIAKHLPGRTDNEIKNYWRTRIQKHLMQAXSSFQQQSSNSEIIYHPQACTSQVSTMAQPIETYSPPSYQGMLDPFSIQXPTNPHHSSCCPMTTTTLLLEHGXYLXCISHY

SEQ ID NO: 829 - protein, 226 aa, Glycine max
  misc_feature (1)..(226): Public GI no. 2280528
  misc_feature: Utility: Useful for delaying flowering time
  misc_feature: Utility: Useful for making larger plants
  misc_feature: Utility: Useful for making ornamental plants with modified leaves
  misc_feature: Utility: Useful for making plants with altered leaf shape eg curled leaves
  misc_feature: Utility: Useful for making plants with increased biomass
  misc_feature: Utility: Useful for making plants with increased biomass and foliage
  misc_feature: Utility: Useful for making smaller plants
MEKRGGGSSGGSGSSAEAEVRKGPWTMEEDLILINYIANHGDGVWNSLAKSAGLKRTGKSCRLRWLNYLRPDVRRGNITPEEQLIIMELHAKWGNRWSKIAKHLPGRTDNEIKNFCRTRIQKYIKQSDVTTTSSVGSHHSSEINDQAASTSSHNVFCTQDQAMETYSPTPTSYQHTNMEFNYGNYSAAAVTATVDYPVPMTVDDQTGENYWGMDDIWSSMHLLNGN

SEQ ID NO: 830 - protein, 204 aa, Glycine max
  misc_feature (1)..(204): Ceres CLONE ID no. 544897
  misc_feature: Utility: Useful for delaying flowering time
  misc_feature: Utility: Useful for making larger plants
  misc_feature: Utility: Useful for making ornamental plants with modified leaves
  misc_feature: Utility: Useful for making plants with altered leaf shape eg curled leaves
  misc_feature: Utility: Useful for making plants with increased biomass
  misc_feature: Utility: Useful for making plants with increased biomass and foliage
  misc_feature: Utility: Useful for making smaller plants
MDKKLGNTSHDPEVRKGPWTMEEDLILITYIANHGEGVWNSLAKAAGLKRTGKSCRLRWLNYLRPDVRRGNITPEEQLLIMELHAKWGNRWSKIAKHLPGRTDNEIKNYWRTRIQKHLKQASSSFQQQSSNSEIIYHPQACTSQVSTMAQPIETYSPPSYQGMLDPFSIQFPTNPHHSSCCTNDDDNNNYWSMEDIWSMQLANY

SEQ ID NO: 831 - protein, 217 aa, Glycine max
  misc_feature (1)..(217): Public GI no. 1841475
  misc_feature: Utility: Useful for delaying flowering time
  misc_feature: Utility: Useful for making larger plants
  misc_feature: Utility: Useful for making ornamental plants with modified leaves
  misc_feature: Utility: Useful for making plants with altered leaf shape eg curled leaves
  misc_feature: Utility: Useful for making plants with increased biomass
  misc_feature: Utility: Useful for making plants with increased biomass and foliage
  misc_feature: Utility: Useful for making smaller plants
MDKKPCNSSQDPEVRKGPWTMEEDLILINYIANHGEGVWNSLAKAAGLKRTGKSCRLRWLNYLRPDVRRGNITPEEQLLIMELHSKWGNRWSKIAKHLPGRTDNEIKNFWRTRIQKHIKQVDNPNQQNFQQKMSLEINDHHHHHPHQPSSSQVSNLVEPMETYSPTSYQGTLEPFPTQFPTINNDHHQNSNCCANDNNNNNYWSMEDIWSMQLLNGD

SEQ ID NO: 832 - DNA, 467 bp, Arabidopsis thaliana
  misc_feature (1)..(467): Ceres CLONE ID no. 270555
  misc_feature (1)..(467): Also known as  Ceres CDNA ID no. 23557625
gataacaaattttcactgtcttgtcattcttctcatctcctagacaaaggaaactcaggagatgagaagaaaattttggtggttgtttataaactataatataatacacatcaaatctttgacacgataccaacttaaagaagaagaagaagaagctgcattgatcttcccaaaagatcctccatggttcaaggcatggatggttcctgtgatgatgcttttcgttttctttgtattttctattgtaggaatttgtcgacgttgtcgcaattgtcgccgtggtgaaaattctcccagcattcatcctattaactaattatttagattttttttcctttttcttttctttctataatatgtaaatcattgttggtgaaatgtaaaattttacagtttcaccatatcgatttcttatcgctttgatctaatgaaagcaaaaaagaataaatatgccaaagattaaggat

SEQ ID NO: 833 - protein, 84 aa, Arabidopsis thaliana
  misc_feature: Utility: Useful for delaying flowering time
  misc_feature: Utility: Useful for making plants with increased biomass and foliage
  misc_feature: Utility: Useful for making smaller plants
MRRKFWWLFINYNIIHIKSLTRYQLKEEEEEAALIFPKDPPWFKAWMVPVMMLFVFFVFSIVGICRRCRNCRRGENSPSIHPIN

SEQ ID NO: 834 - protein, 85 aa, Brassica napus
  misc_feature (1)..(85): Ceres CLONE ID no. 1087479
  misc_feature: Utility: Useful for delaying flowering time
  misc_feature: Utility: Useful for making plants with increased biomass and foliage
  misc_feature: Utility: Useful for making smaller plants
MGRNIWWLFLNNEIRHIKSFTRYEVKDEEAALIFPKDPPWFKLWMVPVMMLFIFFIVVVILICRRCQNCRRGENSPSIHPISQNT

SEQ ID NO: 835 - DNA, 1159 bp, Glycine max
  misc_feature (1)..(1159): Ceres CLONE ID no. 481710
  misc_feature (1)..(1159): Also known as  Ceres CDNA ID no. 23664396
atatatatccctcactcactctatctcttttctccagcagcaccaaaaccacccaacactcgaactcaatatccattattaccaaaaaaaaagaaaaaaggatatcaaacacccttttcatcattaaaactctcagttccctctttccctatcaaaaccctttcccacaacactactcactccagtacaagaaaccctttttcaatttggtttcaacagcacacacacacacacatatatatatatatagcatgtttaccttgaatcattcttctgatttgtaccatgtttcccctgagctctcatcttccttggacacatcctcgccggcttcggagggctctcgtggcgtggcattttccgacgaggaggtgcggctggcggtgaggcacccgaagaagcgggcaggtcggaagaagttccgggagacgcgccacccggtgtaccggggggtgaggaggaggaactcggataagtgggtgtgtgaggtgagggagcccaacaagaagaccaggatttggctggggactttccccacgccggagatggcggctcgggcgcacgacgtggcggcaatggccctgaggggccggtatgcctgtctaaactttgctgactcggcctggcggttacctgttcccgccacggccgaggcaaaggatatacagaaggcagcagcagaagctgcccaggctttcagaccagatcaaaccttaaaaaatgctaatacaaggcaggagtgtgtggaggcggtggcggtggcggtggcggagacaacaacggcgacggcacaaggggtgttttatatggaggaagaagagcaggtgttggatatgcctgagttgcttaggaatatggtgctcatgtccccaacacattgcttagggtatgagtatgaagatgctgacttggatgcccaagatgctgaggtgtcactatggaatttctcaatttaataatgtgttttggtttggtttttgttgttagttttttggagtgaacagtgtctgtactggttttttattagtagtacggatactagttataggtggaaagattgcgagggaccaaaaggaattttcttttgaacccttttttgtcaatgtaatcaatatcacgtatatcatgaagtgaatcccttcaagtttatgtataaatt

SEQ ID NO: 836 - protein, 234 aa, Glycine max
  misc_feature (63)..(126): Pfam Name: AP2; Pfam Description: AP2 domain
  misc_feature (63)..(126): Pfam Name: AP2; Pfam Description: AP2 domain
  misc_feature: Utility: Useful for delaying flowering time
  misc_feature: Utility: Useful for increasing chlorophyll and photosynthetic capacity
  misc_feature: Utility: Useful for making plants with increased biomass and foliage
  misc_feature: Utility: Useful for making smaller plants
MFTLNHSSDLYHVSPELSSSLDTSSPASEGSRGVAFSDEEVRLAVRHPKKRAGRKKFRETRHPVYRGVRRRNSDKWVCEVREPNKKTRIWLGTFPTPEMAARAHDVAAMALRGRYACLNFADSAWRLPVPATAEAKDIQKAAAEAAQAFRPDQTLKNANTRQECVEAVAVAVAETTTATAQGVFYMEEEEQVLDMPELLRNMVLMSPTHCLGYEYEDADLDAQDAEVSLWNFSI

SEQ ID NO: 837 - protein, 215 aa, Glycine max
  misc_feature (1)..(215): Public GI no. 37147896
  misc_feature: Utility: Useful for delaying flowering time
  misc_feature: Utility: Useful for increasing chlorophyll and photosynthetic capacity
  misc_feature: Utility: Useful for making plants with increased biomass and foliage
  misc_feature: Utility: Useful for making smaller plants
MNIFRSYYSDPLTESSSSFSDSSIYSPNRAIFSDEEVILASNNPKKPAGRKKFRETRHPVYRGVRKRNSGKWVCEVREPNKKSRIWLGTFPTAEMAARAHDVAAIALRGRSACLNFADSAWRLPVPASSDTKDIQKAAAEAAEAFRPLKLEGISKESSSSTPESMFFMDEEALFCMPGLLTNMAEGLMLPPPQCAEIGDHVETADADTPLWSYSI

SEQ ID NO: 838 - protein, 215 aa, Glycine max
  misc_feature (1)..(215): Public GI no. 40647095
  misc_feature: Utility: Useful for delaying flowering time
  misc_feature: Utility: Useful for increasing chlorophyll and photosynthetic capacity
  misc_feature: Utility: Useful for making plants with increased biomass and foliage
  misc_feature: Utility: Useful for making smaller plants
MNIFRSYYSDPLTESSSSFSDSSIYSPNRAIFSDEEVILASNNPKKPAGRKKFRETRHPVYRGVRKRNSGKWVCEVREPNKKSRIWLGTFPTAEMAARAHDVAAIALRGRSACLNFADSAWRLPVPASSDTKDIQKAAAEAAEALRPLKLEGISKESSSSTPESMFFMDEEALFCMPGLLTNMAEGLMLPPPQCAEIGDHVETADADTPLWSYSI

SEQ ID NO: 839 - protein, 205 aa, Glycine max
  misc_feature (1)..(205): Public GI no. 45826358
  misc_feature: Utility: Useful for delaying flowering time
  misc_feature: Utility: Useful for increasing chlorophyll and photosynthetic capacity
  misc_feature: Utility: Useful for making plants with increased biomass and foliage
  misc_feature: Utility: Useful for making smaller plants
MFYSDPRIESCSSFSDSIRANHSDEEVILASNNPKKPAGRKKFRETRHPVYRGVRKRNSGKWVCEVREPNKKTRIWLGTFPTAEMAARAHDVAAIALRGRSACLNFADSAWRLPTPDSSDTKDIQKAAAQAAEIFRPLKSEEEESVVKDQSTTPDDMFFMDEEALFCMPGLLTNMAEGLMVPPPQCTEMGDHVEADDMPLWSYSI

SEQ ID NO: 840 - protein, 176 aa, Parthenium argentatum
  misc_feature (1)..(176): Ceres CLONE ID no. 1604576
  misc_feature: Utility: Useful for delaying flowering time
  misc_feature: Utility: Useful for increasing chlorophyll and photosynthetic capacity
  misc_feature: Utility: Useful for making plants with increased biomass and foliage
  misc_feature: Utility: Useful for making smaller plants
MELKLASQNPKKRAGRKKFKETRHPIYRGVRRRNSEKWVCEVREPNKQSRVWLGTYPTAEMAARAHDVAVLAMRGRSACLNFADSVWRLPVPESSNVKDIQKAAAEAAEAFRETEDIAVETNEVPEVVVYADEEEMFGMPEFIDSMAEGMMLPPPQMVGDANFVDNVDFWGDLSLW

SEQ ID NO: 841 - protein, 216 aa, Parthenium argentatum
  misc_feature (1)..(216): Public GI no. 41351817
  misc_feature: Utility: Useful for delaying flowering time
  misc_feature: Utility: Useful for increasing chlorophyll and photosynthetic capacity
  misc_feature: Utility: Useful for making plants with increased biomass and foliage
  misc_feature: Utility: Useful for making smaller plants
MNSFSAFAEMFGSEYESPVTVGGDYCPTLATSCPKKPAGRKKFRETRHPIYRGVRRRNSGKWVCEVREPNKKSRIWLGTFPTAEMAARAHDVAAIALRGRSACLNFADSAWRLRIPESTCAKDIQKAAAEAAVAFQAEMSDTMTSDHGLDMEETTVEVIVTEEEQSEGFYMDEEAMFGMPRLLANMAEGMLLPPPSVQWGHNYDCDGDADVSLWSY

SEQ ID NO: 842 - protein, 219 aa, Parthenium argentatum
  misc_feature (1)..(219): Public GI no. 12003384
  misc_feature: Utility: Useful for delaying flowering time
  misc_feature: Utility: Useful for increasing chlorophyll and photosynthetic capacity
  misc_feature: Utility: Useful for making plants with increased biomass and foliage
  misc_feature: Utility: Useful for making smaller plants
MDIFRSYYSDPLAEYSSISDSSSSSCNRANHSDEEVMLASNNPKKRAGRKKFRETRHPVYRGVRKRNSDKWVCELREPNKKSRIWLGTFPSAEMAARAHDVAAIALRGRSACLNFADSAWKLPIPASTDAKDIQKAAAEAAEAFRSSEAENMPEYSGEDTKEVNSTPENMFYMDEEALFFMPGLLVNMAEGLMLPPPQCSQIGDHMEADVDMPLWSYSI

SEQ ID NO: 843 - protein, 207 aa, Arabidopsis thaliana
  misc_feature (1)..(207): Ceres CLONE ID no. 1014380
  misc_feature: Utility: Useful for delaying flowering time
  misc_feature: Utility: Useful for increasing chlorophyll and photosynthetic capacity
  misc_feature: Utility: Useful for making plants with increased biomass and foliage
  misc_feature: Utility: Useful for making smaller plants
MFGSDYESSVSSGGDYIPTLASSCPKKPAGRKKFRETRHPIYRGVRRRNSGKWVCEVREPNKKTRIWLGTFQTAEMAARAHDVAALALRGRSACLNFADSAWRLRIPESTCAKDIQKAAAEAALAFQDEMCDATTDHGFDMEETLVEAIYTAEQSENAFYMHDEAMFEMPSLLANMAEGMLLPLPSVQWNHNHEVDGDDDDVSLWSY

SEQ ID NO: 844 - protein, 210 aa, Arabidopsis thaliana
  misc_feature (1)..(210): Public GI no. 45826359
  misc_feature: Utility: Useful for delaying flowering time
  misc_feature: Utility: Useful for increasing chlorophyll and photosynthetic capacity
  misc_feature: Utility: Useful for making plants with increased biomass and foliage
  misc_feature: Utility: Useful for making smaller plants
MNIFETYYSDSLILTESSSSSSSSSFSEEEVILASNNPKKPAGRKKFRETRHPIYRGIRKRNSGKWVCEVREPNKKTRIWLGTFPTAEMAARAHDVAALALRGRSACLNFSDSAWRLPIPASSNSKDIQKAAAQAVEIFRSEEVSGESPETSENVQESSDFVDEEAIFFMPGLLANMAEGLMLPPPQCAEMGDHCVETDAYMITLWNYSI

SEQ ID NO: 845 - protein, 240 aa, Arabidopsis thaliana
  misc_feature (1)..(240): Public GI no. 49658405
  misc_feature: Utility: Useful for delaying flowering time
  misc_feature: Utility: Useful for increasing chlorophyll and photosynthetic capacity
  misc_feature: Utility: Useful for making plants with increased biomass and foliage
  misc_feature: Utility: Useful for making smaller plants
MDMFFSQLSDSVDQPQSSLLSDASVTTRGASCSDGDVILASSRPKKRAGRRVFKETRHPVYRGVRRRNNDKWVCEMREPNKKKSRIWLGTYPTAEMAARAHDVAALAFRGKLACINFADSAWRLPVPASMDTMDIRRAAAEAAEGFRPVEFGGVCSGSSDEKERMVVQVEEKNKKGSVNLERSRSLSLSYWDEEEVFHMPRLLHDMAEGLLLSPSQCLGGYMNLDDMGTDADVKLWSFSI

SEQ ID NO: 846 - DNA, 1050 bp, Glycine max
  misc_feature (1)..(1050): Ceres CLONE ID no. 482122
  misc_feature (1)..(1050): Also known as  Ceres CDNA ID no. 23664111
aactctcactccacaactcaactaagcgcaaaccaaaccaacacaaacaaaaacatctctcagcaaatgaatattctcggacaatcactccaccaatcaaacaacggcagctactcttgttcgtcgccggagactgcaaactcctctaaccttccgaccactccgaaagccgttcactccgacgaggaagtgaacacattagcatcggctcatcctaagaaacgtgcggggcgtcgaatttttaaggagacaaggcatcccgtgtacagaggagtgcggcggaggaacaacaacaagtgggtctgcgaggttcgtgttcccaacgacaagtccacgaggatttggctcggaacgtatccaacgcctgagatggccgcacgtgcgcacgacgtcgccgcgctctcgcttcgaggtaagtcggcgtgtctcaacttcgccgactcgggcgtggcggttgcccttgccggcgtcgaccaatgcgaaggagattcggcgcgtggcggcggcggctgctgtagcgattgcggcggaagacagccgcggcaagcagttgcggactaatgcgattgatgccgttgctgattgcgaagttagcagcagtgacataggcgtcgatgaaaattgcaataacaataaagcttcgcagaggttttgtgatttggatgaaattacaatgccagatgcaccggtttttgagracatgcatgagtggcttcagactatggctgctgaaccattaagatcacctacttttgtaacatatgttaatrttagggatgtctggaactttgtggaggatgatgctgaggtttccttgtggagcttcaccgtctgaagagcatgcaatttaggctttaggtgtatttagtgtgtttagctttctttctcttcttttggtttttgtacataattaggaacggaggactacgaaaatgtacaaagaccgaaacgatataaggagatagctatctaggtaggaacataaaagtgtgaaacattgtaacttttctcattcggttgtttttgtaaaataaaaattctattttcatc

SEQ ID NO: 847 - protein, 255 aa, Glycine max
  misc_feature (65)..(129): Pfam Name: AP2; Pfam Description: AP2 domain
  misc_feature (65)..(129): Pfam Name: AP2; Pfam Description: AP2 domain
  misc_feature: Utility: Useful for delaying flowering time
  misc_feature: Utility: Useful for increasing chlorophyll and photosynthetic capacity
  misc_feature: Utility: Useful for making plants sterile and for genetic confinement
  misc_feature: Utility: Useful for making shorter plants and plants with modified flowers
  misc_feature: Utility: Useful for making smaller plants
MNILGQSLHQSNNGSYSCSSPETANSSNLPTTPKAVHSDEEVNTLASAHPKKRAGRRIFKETRHPVYRGVRRRNNNKWVCEVRVPNDKSTRIWLGTYPTPEMAARAHDVAALSLRGKSACLNFADSAWRLPLPASTNAKEIRRVAAAAAVAIAAEDSRGKQLRTNAIDAVADCEVSSSDIGVDENCNNNKASQRFCDLDEITMPDAPVFEDMHEWLQTMAAEPLRSPTFVTYVNVRDVWNFVEDDAEVSLWSFTV

SEQ ID NO: 848 - protein, 215 aa, Glycine max; identical to SEQ ID NO: 837
  misc_feature (1)..(215): Public GI no. 37147896
  misc_feature: Utility: Useful for delaying flowering time
  misc_feature: Utility: Useful for increasing chlorophyll and photosynthetic capacity
  misc_feature: Utility: Useful for making plants sterile and for genetic confinement
  misc_feature: Utility: Useful for making shorter plants and plants with modified flowers
  misc_feature: Utility: Useful for making smaller plants

SEQ ID NO: 849 - protein, 215 aa, Glycine max; identical to SEQ ID NO: 838
  misc_feature (1)..(215): Public GI no. 40647095
  misc_feature: Utility: Useful for delaying flowering time
  misc_feature: Utility: Useful for increasing chlorophyll and photosynthetic capacity
  misc_feature: Utility: Useful for making plants sterile and for genetic confinement
  misc_feature: Utility: Useful for making shorter plants and plants with modified flowers
  misc_feature: Utility: Useful for making smaller plants

SEQ ID NO: 850 - protein, 219 aa, Glycine max; identical to SEQ ID NO: 842
  misc_feature (1)..(219): Public GI no. 12003384
  misc_feature: Utility: Useful for delaying flowering time
  misc_feature: Utility: Useful for increasing chlorophyll and photosynthetic capacity
  misc_feature: Utility: Useful for making plants sterile and for genetic confinement
  misc_feature: Utility: Useful for making shorter plants and plants with modified flowers
  misc_feature: Utility: Useful for making smaller plants

SEQ ID NO: 851 - protein, 226 aa, Glycine max
  misc_feature (1)..(226): Ceres CLONE ID no. 1609048
  misc_feature: Utility: Useful for delaying flowering time
  misc_feature: Utility: Useful for increasing chlorophyll and photosynthetic capacity
  misc_feature: Utility: Useful for making plants sterile and for genetic confinement
  misc_feature: Utility: Useful for making shorter plants and plants with modified flowers
  misc_feature: Utility: Useful for making smaller plants
MNIFKSPLDHDLNCGGIFHDSAEASYSSETRSTPSDEEVILASARPKKRAGRRVFKETRHPVYRGVRRRNKNKWVCEMRVPNNNSRIWLGTYPTPEMAARAHDVAALALRGKSACLNFADSRWRLTVPATTNAEEIRRAAGEAAEAFAVADGDDVNIDQQQSVMATNDDEVQEPLQQEEVQDLHDLLLSIANEPLMSPPPCARDGRDWNDVDIFDDDEISLWNFSI

SEQ ID NO: 852 - protein, 219 aa, Glycine max
  misc_feature (1)..(219): Public GI no. 38683266
  misc_feature: Utility: Useful for delaying flowering time
  misc_feature: Utility: Useful for increasing chlorophyll and photosynthetic capacity
  misc_feature: Utility: Useful for making plants sterile and for genetic confinement
  misc_feature: Utility: Useful for making shorter plants and plants with modified flowers
  misc_feature: Utility: Useful for making smaller plants
MNSSFSAFSEMFGSEYESPVSSGGGDYCPTLATSCPKKPAGRKKFRETRHPVYRGVRRRNSGKWVCEVREPNKKSRIWLGTFPTADMAARAHDVAAIALRGRSACLNFADSAWRLRIPESTGAKEIQKAAAEAALAFQDEMMMSDTTTTDHGFDMEETFVEAIVTAEQSASLYIDEEDMFGMPSLMASMAEGMLLPLPSVQWNHNYDIDGDDDVSLWSY

SEQ ID NO: 853 - protein, 234 aa, Glycine max
  misc_feature (1)..(234): Public GI no. 55824656
  misc_feature: Utility: Useful for delaying flowering time
  misc_feature: Utility: Useful for increasing chlorophyll and photosynthetic capacity
  misc_feature: Utility: Useful for making plants sterile and for genetic confinement
  misc_feature: Utility: Useful for making shorter plants and plants with modified flowers
  misc_feature: Utility: Useful for making smaller plants
MFTLNHSSDLYHVSPELSSSLDTSSPASEGSRGVAFSDEEVRLAVRHPKKRAGRKKFRETRHPVYRGVRRRNSDKWVCEVREPNKKTRIWLGTFPTPEMAARAHDVAAMALRGRYACLNFADSAWRLPVPATAEAKDIQKAAAEAAQAFRPDQTLKNANTRQECVEAVAVAVADTTTATAQGVFYMEEEEQVLDMPELLRNMVLMSPTHCLGYEYEDADLDAQDAEVSLWNFSI

SEQ ID NO: 854 - protein, 207 aa, Arabidopsis thaliana; identical to SEQ ID NO: 843
  misc_feature (1)..(207): Ceres CLONE ID no. 1014380
  misc_feature: Utility: Useful for delaying flowering time
  misc_feature: Utility: Useful for increasing chlorophyll and photosynthetic capacity
  misc_feature: Utility: Useful for making plants sterile and for genetic confinement
  misc_feature: Utility: Useful for making shorter plants and plants with modified flowers
  misc_feature: Utility: Useful for making smaller plants

SEQ ID NO: 855 - protein, 234 aa, Glycine max; identical to SEQ ID NO: 836
  misc_feature (1)..(234): Ceres CLONE ID no. 481710
  misc_feature: Utility: Useful for delaying flowering time
  misc_feature: Utility: Useful for increasing chlorophyll and photosynthetic capacity
  misc_feature: Utility: Useful for making plants sterile and for genetic confinement
  misc_feature: Utility: Useful for making shorter plants and plants with modified flowers
  misc_feature: Utility: Useful for making smaller plants

SEQ ID NO: 856 - protein, 234 aa, Glycine max; identical to SEQ ID NO: 836
  misc_feature (1)..(234): Public GI no. 33304979
  misc_feature: Utility: Useful for delaying flowering time
  misc_feature: Utility: Useful for increasing chlorophyll and photosynthetic capacity
  misc_feature: Utility: Useful for making plants sterile and for genetic confinement
  misc_feature: Utility: Useful for making shorter plants and plants with modified flowers
  misc_feature: Utility: Useful for making smaller plants

SEQ ID NO: 857 - protein, 232 aa, Glycine max
  misc_feature (1)..(232): Public GI no. 23495458
  misc_feature: Utility: Useful for delaying flowering time
  misc_feature: Utility: Useful for increasing chlorophyll and photosynthetic capacity
  misc_feature: Utility: Useful for making plants sterile and for genetic confinement
  misc_feature: Utility: Useful for making shorter plants and plants with modified flowers
  misc_feature: Utility: Useful for making smaller plants
MDMIYSQLSDLASMENPDTSSFSDASVTARRASLSDEEVILASSCPKRRAGRRVFKETRHPVYRGVRRRNNNKWVCELRAPNNKKARIWLGTYPTAEMAARAHDVAVLAFRGKLACLNFADSAWRLPVPASTDAAEIRRAATEAAEAFRQAEDGGVDEKESKAVVSEEKGCVGMEGSSNLFYLDEDEIFEMPRLLDDMADGIMLCPPQCLDGYMDWNDVETVDDLKLWSFSI

SEQ ID NO: 858 - protein, 231 aa, Glycine max
  misc_feature (1)..(231): Ceres CLONE ID no. 1620272
  misc_feature: Utility: Useful for delaying flowering time
  misc_feature: Utility: Useful for increasing chlorophyll and photosynthetic capacity
  misc_feature: Utility: Useful for making plants sterile and for genetic confinement
  misc_feature: Utility: Useful for making shorter plants and plants with modified flowers
  misc_feature: Utility: Useful for making smaller plants
MYTLNHSSYLYHVSPELSSSLDSSSPASEGSRGVAFSDEEVRLAVRHPKKRAGRKKFRETRHPVYRGVRRRNTDKWVSEVREPNKKTRIWLGTFPTPEMAARAHDVAAMALRGRYACLNFADSTWRLPIPATANAKDIQKAAAEAAEAFRPSQTLENTNTKQECVKVVTTTTITEQKRGMFYMEEEEQVLDMPELLRNMVLMSPTHCIGYEYEDADLDAQDAEVSLWSFSI

SEQ ID NO: 859 - protein, 240 aa, Glycine max; identical to SEQ ID NO: 845
  misc_feature (1)..(240): Public GI no. 49658405
  misc_feature: Utility: Useful for delaying flowering time
  misc_feature: Utility: Useful for increasing chlorophyll and photosynthetic capacity
  misc_feature: Utility: Useful for making plants sterile and for genetic confinement
  misc_feature: Utility: Useful for making shorter plants and plants with modified flowers
  misc_feature: Utility: Useful for making smaller plants

SEQ ID NO: 860 - DNA, 680 bp, Glycine max
  misc_feature (1)..(680): Ceres CLONE ID no. 536457
  misc_feature (1)..(680): Also known as  Ceres CDNA ID no. 23689039
aagtgtgagtgatatttgagcttaaaccctagccgctcttctcttcattcttcactttggaaacaatcataatggcgttctgtaataaggttggaaatgtcttgaggcagggtgctgctcgcagcacacatgcccctgttgcgtccatgcttaattacatccgctgcatgtcttcaagcaagcttttcattggaggcctttcatatggagttgatgaccagtctcttaaggatgcattttctggctttggagatgtggttgatgcaaaagttataactgatagagacagtggaagatcaaggggatttggatttgtcaacttctccaatgatgagtctgcaagttcggcactctctgcaatggacgggaaggatctaaatgggcgaagcattcgggtatcctatgcaaatgataaaccatctgcacctcgacctggtggcggtggcggttatcgtggcggggattatgatggtgattttgcttctcgtagtggtggttggtgatcaaatttttgtttgttgcgccttctgcttagttgagattttatgtttatgcctagcacttcgattaaggtggtcactcaagtggtaaagtagtaattattggaattttatgtttttccccgttacatttyttggttatgttattctgtgattttaatggagcatttgtttccatcc

SEQ ID NO: 861 - protein, 143 aa, Glycine max
  misc_feature (38)..(109): Pfam Name: RRM_1; Pfam Description: RNA recognition motif. (a.k.a. RRM, RBD, or RNP domain)
  misc_feature: Utility: Useful for delaying flowering time
  misc_feature: Utility: Useful for making larger plants
  misc_feature: Utility: Useful for making smaller plants
MAFCNKVGNVLRQGAARSTHAPVASMLNYIRCMSSSKLFIGGLSYGVDDQSLKDAFSGFGDVVDAKVITDRDSGRSRGFGFVNFSNDESASSALSAMDGKDLNGRSIRVSYANDKPSAPRPGGGGGYRGGDYDGDFASRSGGW

SEQ ID NO: 862 - protein, 113 aa, Glycine max
  misc_feature (1)..(113): Ceres CLONE ID no. 744170
  misc_feature: Utility: Useful for delaying flowering time
  misc_feature: Utility: Useful for making larger plants
  misc_feature: Utility: Useful for making smaller plants
MLNYIRCMSSSKLFIGGLSYGVDDQSLKDAFSGFGDVVDAKVITDRDSGRSRGFGFVNFSNDESASSALSAMDGKDLDGRSIRVSYANDRPSGPQSGGGGGGGYRSGGFGGGW

SEQ ID NO: 863 - protein, 150 aa, Arabidopsis thaliana
  misc_feature (1)..(150): Ceres CLONE ID no. 7191
  misc_feature: Utility: Useful for delaying flowering time
  misc_feature: Utility: Useful for making larger plants
  misc_feature: Utility: Useful for making smaller plants
MAFCNKLGGLLRQNISSNGNVPVTSMLGSLRLMSTKLFIGGLSWGTDDASLRDAFAHFGDVVDAKVIVDRETGRSRGFGFVNFNDEGAATAAISEMDGKELNGRHIRVNPANDRPSAPRAYGGGGGYSGGGGGGYGGGGGSYGGGDGGGY

SEQ ID NO: 864 - protein, 112 aa, Brassica napus
  misc_feature (1)..(112): Ceres CLONE ID no. 954739
  misc_feature: Utility: Useful for delaying flowering time
  misc_feature: Utility: Useful for making larger plants
  misc_feature: Utility: Useful for making smaller plants
MLRYMSTKLFIGGLSPGTDDQSLKDAFSTFNGVTEARVMTNKVTGRSRGYGFVNFTSEDSAKSAISAMDGQELNGRNIRVDVAKEWPSLPFSSVEGTEDEKKGNKMVSRSVW

SEQ ID NO: 865 - protein, 158 aa, Arabidopsis thaliana
  misc_feature (1)..(158): Ceres CLONE ID no. 16314
  misc_feature: Utility: Useful for delaying flowering time
  misc_feature: Utility: Useful for making larger plants
  misc_feature: Utility: Useful for making smaller plants
MAFCNKLGGLLRQNISSNGNVPVTSMLGSLRLMSTKLFIGGLSWGTDDASLRDAFAHFGDVVDAKVIVDRETGRSRGFGFVNFNDEGAATAAISEMDGKELNGRHIRVNPANDRPSAPRAYGGGGGYSGGGGGYGGGGGGYGGGGGGYGGGGDGGGGF

SEQ ID NO: 866 - protein, 139 aa, Brassica napus
  misc_feature (1)..(139): Ceres CLONE ID no. 971630
  misc_feature: Utility: Useful for delaying flowering time
  misc_feature: Utility: Useful for making larger plants
  misc_feature: Utility: Useful for making smaller plants
MHLQMAVCTKLGVLQNRNVPVTSMLRYMSTKLFIGGLSPGTDDQSLKDAFSTFNGVTEARVMTNKVTGRSRGYGFVNFTSEDSAKSAISAMDGQELNGRNIRVDVAKEWPSLPFSSVEGTEDEKKGNKMVSRSVWKDPF

SEQ ID NO: 867 - protein, 136 aa, Arabidopsis thaliana
  misc_feature (1)..(136): Ceres CLONE ID no. 40714
  misc_feature: Utility: Useful for delaying flowering time
  misc_feature: Utility: Useful for making larger plants
  misc_feature: Utility: Useful for making smaller plants
MAFCNKLSGILRQGVSQSSNGPVTSMLGSLRYMSSKLFVGGLSWGTDDSSLKQAFTSFGEVTEATVIADRETGRSRGFGFVSFSCEDSANNAIKEMDGKELNGRQIRVNLATERSSAPRSSFGGGGGYGGGGGGGY

SEQ ID NO: 868 - protein, 136 aa, Arabidopsis thaliana
  misc_feature (1)..(136): Ceres CLONE ID no. 18903
  misc_feature: Utility: Useful for delaying flowering time
  misc_feature: Utility: Useful for making larger plants
  misc_feature: Utility: Useful for making smaller plants
MAFCNKLSGILRQGVSHSSNGPVTSMLGSLRYMSSKLFVGGLSWGTDDSSLKQAFTSFGEVTEATVIADRETGRSRGFGFVSFSCEDSANNAIKEMDGKELNGRQIRVNLATERSSAPRSSFGGGGGYGGGGGGGY

SEQ ID NO: 869 - protein, 113 aa, Triticum aestivum
  misc_feature (1)..(113): Ceres CLONE ID no. 703819
  misc_feature: Utility: Useful for delaying flowering time
  misc_feature: Utility: Useful for making larger plants
  misc_feature: Utility: Useful for making smaller plants
MCAGQPADGSKLFVGGLAWATDDHSLKEAFQCFGEVVEARVITDRETGRSRGFGFVSFASGEDAKSAAENMDGKELAGRNVRVNSAEEEEEQTRRAKMKTILASETMEIPEEV

SEQ ID NO: 870 - protein, 141 aa, Brassica napus
  misc_feature (1)..(141): Ceres CLONE ID no. 1070258
  misc_feature: Utility: Useful for delaying flowering time
  misc_feature: Utility: Useful for making larger plants
  misc_feature: Utility: Useful for making smaller plants
MAVCTRFRVLQNRNVAATSMLRYMSTKLFIGGLSPGTDDNSLKDAFSTFNGVTEARVMTNEVTGRSRGYGFVNFKIEESAKSAISAMDGQELNGCNIRVDAAKEWPSLPLSLGEGTEDEKKGNKMVSRSVWKDPFVDAFLM

SEQ ID NO: 871 - DNA, 594 bp, Glycine max
  misc_feature (1)..(594): Ceres CLONE ID no. 536796
  misc_feature (1)..(594): Also known as  Ceres CDNA ID no. 3265003
tcacaaataaataaaaaaaattgttttcgtgtggaaacaaaaaaacaattcaaaaacaaacatatgatggtgaagccgagtagcgaaaagccagaggagcatagggattccaagtactacaaaggggtccgaaagagaaaatggggcaaatgggtatccgaaataagactacccaacagccgtcagaggatttggttgggatccttcgacacccccgagaaggccgcgcgtgccttcgacgccgcaatgttctgcttacgtggccgcaacgccaagttcaatttccccgacaacccacccgacatcgccggcggggaatccatgacgccgtcacagattcaggtcgccgccgcacaattcgccaacgctgggccccacgagggacattcgggtcgacccgaacattctcccatgcaatctctatcgccttctgtttcagaagggaccgttctaacggacagtgacgtcaccacacttaacggttcgctaacggatttgttcactcccgttgggtcgagtggttacgcatccgattacgggattttccccggtgttgatgatttcagtggcggtttttatgtgccggaaatgctg

SEQ ID NO: 872 - protein, 177 aa, Glycine max
  misc_feature (17)..(80): Pfam Name: AP2; Pfam Description: AP2 domain
  misc_feature (17)..(80): Pfam Name: AP2; Pfam Description: AP2 domain
  misc_feature: Utility: Useful for delaying flowering time
  misc_feature: Utility: Useful for making larger plants
  misc_feature: Utility: Useful for making plants with increased biomass and foliage
  misc_feature: Utility: Useful for making smaller plants
MMVKPSSEKPEEHRDSKYYKGVRKRKWGKWVSEIRLPNSRQRIWLGSFDTPEKAARAFDAAMFCLRGRNAKFNFPDNPPDIAGGESMTPSQIQVAAAQFANAGPHEGHSGRPEHSPMQSLSPSVSEGTVLTDSDVTTLNGSLTDLFTPVGSSGYASDYGIFPGVDDFSGGFYVPEML

SEQ ID NO: 873 - protein, 185 aa, Glycine max
  misc_feature (1)..(185): Public GI no. 29893536
  misc_feature: Utility: Useful for delaying flowering time
  misc_feature: Utility: Useful for making larger plants
  misc_feature: Utility: Useful for making plants with increased biomass and foliage
  misc_feature: Utility: Useful for making smaller plants
MEGSSSSMQSKYKGVRKRKWGKWVSEIRLPNSRERIWLGSYDTPEKAARAFDAALYCLRGNNAKFNFPDNPPVISGGRNLSRSEIREAAARFANSAEDDSSGGAGYEIRQESASTSMDVDSEFLSMLPTVGSGNFASEFGLFPGFDDFSDEYSGDRFREQLSPTQDYYQLGEETYADGSMFLWNF

SEQ ID NO: 874 - protein, 185 aa, Brassica napus
  misc_feature (1)..(185): Ceres CLONE ID no. 973892
  misc_feature: Utility: Useful for delaying flowering time
  misc_feature: Utility: Useful for making larger plants
  misc_feature: Utility: Useful for making plants with increased biomass and foliage
  misc_feature: Utility: Useful for making smaller plants
MKLSPPPLTNNEQPAADTAVKSCGGGGRETFSATRHPVYHGVRKRRWGKWVSEIREPRKKSRIWLGSFPIPEMAAKAYDVAALCLKGRKAQLNFPDEIDDLPRPSTCTARDIQVAAAKAANAVKIIKTGDDVANIGDGDDFWEGIELPELMMTRCGWSPEPFVAGDDATWLVDEDSYQYQFMACL

SEQ ID NO: 875 - protein, 186 aa, Parthenium argentatum
  misc_feature (1)..(186): Ceres CLONE ID no. 1609832
  misc_feature: Utility: Useful for delaying flowering time
  misc_feature: Utility: Useful for making larger plants
  misc_feature: Utility: Useful for making plants with increased biomass and foliage
  misc_feature: Utility: Useful for making smaller plants
MKPKSSEGSSSSTHEPKYKGVRLRKWGKWVSEIRLPNSRERIWLGSYDSPEKAARAFDAAAFCLRGHAAKFNFPDQPPNIPGGRSLSSAQIQDAAARYANSVPDETVIPMEDSTSSSIMLNDDSNYNNNSSSSNNNNNVTDYDIFPGFDDYFMQPPPMVSPQFADYDEGNSSDGDISQGPSFLWNY

SEQ ID NO: 876 - protein, 149 aa, Brassica napus
  misc_feature (1)..(149): Ceres CLONE ID no. 1081780
  misc_feature: Utility: Useful for delaying flowering time
  misc_feature: Utility: Useful for making larger plants
  misc_feature: Utility: Useful for making plants with increased biomass and foliage
  misc_feature: Utility: Useful for making smaller plants
MSSPSSSSSSLSTSSSISKSNLAKKYKGVRMRSWGSWVSEIRAPNQKTRIWLGSYSTAEAAARAYDAALLCLKGSSASNLNFPEISSSLYNTNNGDNKNNINMSPKYIQRVAAAAANADPSSSSVSTSSPLLSSSPSEDLYDVVSMSQY

SEQ ID NO: 877 - DNA, 919 bp, Glycine max
  misc_feature (1)..(919): Ceres CLONE ID no. 572121
  misc_feature (1)..(919): Also known as  Ceres CDNA ID no. 23395381
aaacataagagaaggtttcgtggcagtggcgagtgaagaagctatgcctgatgagtgagtcatttttttctctctggtgggtcccatcctcttctgctctgagaacctttataagtgttatatgagtcattgagaagtgaccccaggaaaaagaaaagaaaagaaaaacttcacttcacttgcatgccaaatgagaacaacctcttcttagaataatttcctcggtgtttaagccttgtcgatttccgaacaccaatccgagttaattaaacaatgagagtttcgacagaaaagttagagacagagccggagagcaaaaagataaaacgcattcgtggcggcggcggcggggactcgagcaataagcaccctttgtaccgcggcgtgcggatgcggaactgggggaaatgggtgtcggaaatccgcgagccgcggaagaagtcgcggatatggctaggcacattcccgacgccggaaatggcggcgagggcgcacgacgtggcggctctcagcatcaaaggctccgccgccattctcaacttccctcactttgccaactcgctccctcgcccggcttctctcgcgccgcgcgacgttcaagccgcggcggccaaagcggcgcacatggacccttcttccctctcctcccttgtctccgcaatggacttgtcctctgcctctgacgagttgagccaaatcatagagcttccttctttggaaagcaccgatgatggctccgtcgtcttagagaaagagtttgtttttgttgactcccttgatgcttggatgtatcagccaccctttggttttgacaccgaacaagacactggtttcgagggtttgatgtggaattactagtttcgatccatgtttctgttctattctatgtcttatgttgwataaattaatattgatcgtc

SEQ ID NO: 878 - protein, 194 aa, Glycine max
  misc_feature (33)..(96): Pfam Name: AP2; Pfam Description: AP2 domain
  misc_feature: Utility: Useful for delaying flowering time
  misc_feature: Utility: Useful for increasing seed/fruit yield or modifying fruit content
  misc_feature: Utility: Useful for making plants sterile and for genetic confinement
  misc_feature: Utility: Useful for modifying plant structure, ie increased branching
MRVSTEKLETEPESKKIKRIRGGGGGDSSNKHPLYRGVRMRNWGKWVSEIREPRKKSRIWLGTFPTPEMAARAHDVAALSIKGSAAILNFPHFANSLPRPASLAPRDVQAAAAKAAHMDPSSLSSLVSAMDLSSASDELSQIIELPSLESTDDGSVVLEKEFVFVDSLDAWMYQPPFGFDTEQDTGFEGLMWNY

SEQ ID NO: 879 - protein, 155 aa, Glycine max
  misc_feature (1)..(155): Ceres CLONE ID no. 1169111
  misc_feature: Utility: Useful for delaying flowering time
  misc_feature: Utility: Useful for increasing seed/fruit yield or modifying fruit content
  misc_feature: Utility: Useful for making plants sterile and for genetic confinement
  misc_feature: Utility: Useful for modifying plant structure, ie increased branching
MRNWGKWVSEIREPRKKSRIWLGTFPTPEMAARAHDVAALSIKGPAAILNFPHLANSLPRPASLAPRDVQAAAAKAAHMDPSSLSSLVSAMDLSSASDELSQIIELPSLESTDDGSVDLKKEFVFVDSLDAWMYQPPFGFDTEQDTGFEGLMWNY

SEQ ID NO: 880 - DNA, 596 bp, Glycine max
  misc_feature (1)..(596): Ceres CLONE ID no. 641355
  misc_feature (1)..(596): Also known as  Ceres CDNA ID no. 23400957
agaacatcctaatcgaaaaaattaattaaggcatcacaatggaagaggagtcaaaggagaaaaagaaggacactaaggaggaaccacgttatagaggagtgcggcggcggccgtgggggaagttcgcggccgagattcgggacccggcccggcacggtgcccgagtgtggctggggacatttctcacggcggaggaggctgctagggcttatgaccgagctgcctatgagatgaggggcgctttagccgttctcaattttccaaatgagtatccttcatgctcttctatgaactcatcttcaacattagcaccttcatcttcttcttcaaattcaatgcttaaaagtgatcatggtaaacaagttattgagttcgagtgcttggatgacaaattgttagaggaccttcttgattgtgatgactatgcctacgagaaagacttgcctaagaactgaacggtttgatcaaatttgaatgttagattgatttcaaagcatacctatagtagggkgaatgtcttcatatatgatatgatttccttttaggcagcmctttactttggtgagtatggtttataacttaagaatgactttgtt

SEQ ID NO: 881 - protein, 138 aa, Glycine max
  misc_feature (16)..(80): Pfam Name: AP2; Pfam Description: AP2 domain
  misc_feature: Utility: Useful for delaying flowering time
  misc_feature: Utility: Useful for increasing chlorophyll and photosynthetic capacity
  misc_feature: Utility: Useful for making plants that grow better in shade
  misc_feature: Utility: Useful for making plants with enhanced abiotic stress tolerance
  misc_feature: Utility: Useful for making plants with increased biomass
  misc_feature: Utility: Useful for making plants with increased biomass and foliage
  misc_feature: Utility: Useful for making smaller plants
  misc_feature: Utility: Useful for modifying plant architecture, ie amount of  branching
MEEESKEKKKDTKEEPRYRGVRRRPWGKFAAEIRDPARHGARVWLGTFLTAEEAARAYDRAAYEMRGALAVLNFPNEYPSCSSMNSSSTLAPSSSSSNSMLKSDHGKQVIEFECLDDKLLEDLLDCDDYAYEKDLPKN

SEQ ID NO: 882 - protein, 133 aa, Glycine max
  misc_feature (1)..(133): Public GI no. 57012753
  misc_feature: Utility: Useful for delaying flowering time
  misc_feature: Utility: Useful for increasing chlorophyll and photosynthetic capacity
  misc_feature: Utility: Useful for making plants that grow better in shade
  misc_feature: Utility: Useful for making plants with enhanced abiotic stress tolerance
  misc_feature: Utility: Useful for making plants with increased biomass
  misc_feature: Utility: Useful for making plants with increased biomass and foliage
  misc_feature: Utility: Useful for making smaller plants
  misc_feature: Utility: Useful for modifying plant architecture, ie amount of  branching
MDQGGRSSGSGGGGAEQGKYRGVRRRPWGKYAAEIRDSRKHGERVWLGTFDTAEDAARAYDRAAYSMRGKAAILNFPHEYNMGTGSSSTAANSSSSSQQVFEFEYLDDSVLDELLEYGENYNKTHNINMGKRQ

SEQ ID NO: 883 - protein, 131 aa, Glycine max
  misc_feature (1)..(131): Public GI no. 48479320
  misc_feature: Utility: Useful for delaying flowering time
  misc_feature: Utility: Useful for increasing chlorophyll and photosynthetic capacity
  misc_feature: Utility: Useful for making plants that grow better in shade
  misc_feature: Utility: Useful for making plants with enhanced abiotic stress tolerance
  misc_feature: Utility: Useful for making plants with increased biomass
  misc_feature: Utility: Useful for making plants with increased biomass and foliage
  misc_feature: Utility: Useful for making smaller plants
  misc_feature: Utility: Useful for modifying plant architecture, ie amount of  branching
MDQGGRGVGAEHGKYRGVRRRPWGKYAAEIRDSRKHGERVWLGTFDTAEEAARAYDQAAYSMRGQAAILNFPHEYNMGSGGSSSTAMAGSSSSSASASSSSRQVFEFEYLDDSVLEELLEEGEKPNKGKKK

SEQ ID NO: 884 - protein, 128 aa, Glycine max
  misc_feature (1)..(128): Public GI no. 48479286
  misc_feature: Utility: Useful for delaying flowering time
  misc_feature: Utility: Useful for increasing chlorophyll and photosynthetic capacity
  misc_feature: Utility: Useful for making plants that grow better in shade
  misc_feature: Utility: Useful for making plants with enhanced abiotic stress tolerance
  misc_feature: Utility: Useful for making plants with increased biomass
  misc_feature: Utility: Useful for making plants with increased biomass and foliage
  misc_feature: Utility: Useful for making smaller plants
  misc_feature: Utility: Useful for modifying plant architecture, ie amount of  branching
MKYRGVRKRPWGKYAAEIRDSARHGARVWLGTFNTAEDAARAYDRAAFGMRGQRAILNFPHEYQMMKDGPNGSHENAVASSSSGYRGGGGGDDGREVIEFEYLDDSLLEELLDYGERSNQDNCNDANR

SEQ ID NO: 885 - protein, 139 aa, Glycine max
  misc_feature (1)..(139): Public GI no. 62632035
  misc_feature: Utility: Useful for delaying flowering time
  misc_feature: Utility: Useful for increasing chlorophyll and photosynthetic capacity
  misc_feature: Utility: Useful for making plants that grow better in shade
  misc_feature: Utility: Useful for making plants with enhanced abiotic stress tolerance
  misc_feature: Utility: Useful for making plants with increased biomass
  misc_feature: Utility: Useful for making plants with increased biomass and foliage
  misc_feature: Utility: Useful for making smaller plants
  misc_feature: Utility: Useful for modifying plant architecture, ie amount of  branching
MERIESYNTNEMKYRGVRKRPWGKYAAEIRDSARHGARVWLGTFNTAEDAARAYDRAAFGMRGQRAILNFPHEYQMMKDGPNGSHENAVASSSSGYRGGGGGDDGREVIEFEYLDDSLLEELLDYGERSNQDNCNDANR

SEQ ID NO: 886 - protein, 131 aa, Glycine max
  misc_feature (1)..(131): Public GI no. 8843894
  misc_feature: Utility: Useful for delaying flowering time
  misc_feature: Utility: Useful for increasing chlorophyll and photosynthetic capacity
  misc_feature: Utility: Useful for making plants that grow better in shade
  misc_feature: Utility: Useful for making plants with enhanced abiotic stress tolerance
  misc_feature: Utility: Useful for making plants with increased biomass
  misc_feature: Utility: Useful for making plants with increased biomass and foliage
  misc_feature: Utility: Useful for making smaller plants
  misc_feature: Utility: Useful for modifying plant architecture, ie amount of  branching
MDQGGRGVGAEHGKYRGVRRRPWGKYAAEIRDSRKHGERVWLGTFDTAEEAARAYDQAAYSMRGQAAILNFPHEYNMGSGVSSSTAMAGSSSASASASSSSRQVFEFEYLDDSVLEELLEEGEKPNKGKKK

SEQ ID NO: 887 - protein, 124 aa, Glycine max
  misc_feature (1)..(124): Public GI no. 31432356
  misc_feature: Utility: Useful for delaying flowering time
  misc_feature: Utility: Useful for increasing chlorophyll and photosynthetic capacity
  misc_feature: Utility: Useful for making plants that grow better in shade
  misc_feature: Utility: Useful for making plants with enhanced abiotic stress tolerance
  misc_feature: Utility: Useful for making plants with increased biomass
  misc_feature: Utility: Useful for making plants with increased biomass and foliage
  misc_feature: Utility: Useful for making smaller plants
  misc_feature: Utility: Useful for modifying plant architecture, ie amount of  branching
MEDNRSKDTATKYRGVRRRPWGKFAAEIRDPERGGARVWLGTFDTAEEAARAYDRAAYAQRGAAAVLNFPAAAAAGRGGGAGGAASGSSSSSSAQRGRGDKIEFEYLDDKVLDDLLDDEKYRGK

SEQ ID NO: 888 - protein, 136 aa, Glycine max
  misc_feature (1)..(136): Public GI no. 50948573
  misc_feature: Utility: Useful for delaying flowering time
  misc_feature: Utility: Useful for increasing chlorophyll and photosynthetic capacity
  misc_feature: Utility: Useful for making plants that grow better in shade
  misc_feature: Utility: Useful for making plants with enhanced abiotic stress tolerance
  misc_feature: Utility: Useful for making plants with increased biomass
  misc_feature: Utility: Useful for making plants with increased biomass and foliage
  misc_feature: Utility: Useful for making smaller plants
  misc_feature: Utility: Useful for modifying plant architecture, ie amount of  branching
MDGDGGGGWDDQGNGGGETTKYRGVRRRPSGKFAAEIRDSSRQSVRVWLGTFDTAEEAARAYDRAAYAMRGHLAVLNFPAEARNYVRGSGSSSSSRQHQQRQVIELECLDDQVLQEMLKGGDDQYRSAAGSKRNNY

SEQ ID NO: 889 - protein, 139 aa, Glycine max
  misc_feature (1)..(139): Public GI no. 34221729
  misc_feature: Utility: Useful for delaying flowering time
  misc_feature: Utility: Useful for increasing chlorophyll and photosynthetic capacity
  misc_feature: Utility: Useful for making plants that grow better in shade
  misc_feature: Utility: Useful for making plants with enhanced abiotic stress tolerance
  misc_feature: Utility: Useful for making plants with increased biomass
  misc_feature: Utility: Useful for making plants with increased biomass and foliage
  misc_feature: Utility: Useful for making smaller plants
  misc_feature: Utility: Useful for modifying plant architecture, ie amount of  branching
MESSNRSSNNQSQDDKQARFRGVRRRPWGKFAAEIRDPSRNGARLWLGTFETAEEAARAYDRAAFNLRGHLAILNFPNEYYPRMDDYSLRPPYASSSSSSSSGSTSTNVSRQNQREVFEFEYLDDKVLEELLDSEERKR

SEQ ID NO: 890 - protein, 128 aa, Glycine max
  misc_feature (1)..(128): Public GI no. 50921987
  misc_feature: Utility: Useful for delaying flowering time
  misc_feature: Utility: Useful for increasing chlorophyll and photosynthetic capacity
  misc_feature: Utility: Useful for making plants that grow better in shade
  misc_feature: Utility: Useful for making plants with enhanced abiotic stress tolerance
  misc_feature: Utility: Useful for making plants with increased biomass
  misc_feature: Utility: Useful for making plants with increased biomass and foliage
  misc_feature: Utility: Useful for making smaller plants
  misc_feature: Utility: Useful for modifying plant architecture, ie amount of  branching
MEDDKKEAASKYRGVRRRPWGKFAAEIRDPERGGSRVWLGTFDTAEEAARAYDRAAFAMKGAMAVLNFPGRTSSTGSSSSSSSTPPAPVTTSRHCADTTEKVELVYLDDKVLDELLAEDYSYRNNNNY

SEQ ID NO: 891 - protein, 131 aa, Glycine max
  misc_feature (1)..(131): Public GI no. 52076099
  misc_feature: Utility: Useful for delaying flowering time
  misc_feature: Utility: Useful for increasing chlorophyll and photosynthetic capacity
  misc_feature: Utility: Useful for making plants that grow better in shade
  misc_feature: Utility: Useful for making plants with enhanced abiotic stress tolerance
  misc_feature: Utility: Useful for making plants with increased biomass
  misc_feature: Utility: Useful for making plants with increased biomass and foliage
  misc_feature: Utility: Useful for making smaller plants
  misc_feature: Utility: Useful for modifying plant architecture, ie amount of  branching
MDHHHQQQQQEGELVAKYRGVRRRPWGKFAAEIRDSSRHGVRVWLGTFDTAEEAARAYDRSAYSMRGANAVLNFPADAHIYARQLHNNNAAAGSSSSSSAAAAAARPPPIEFEYLDDHVLQEMLRDHTTNK

SEQ ID NO: 892 - DNA, 505 bp, Glycine max
  misc_feature (1)..(505): Ceres CLONE ID no. 657337
  misc_feature (1)..(505): Also known as  Ceres CDNA ID no. 23489477
atcacgcttatttcaaatcccttcctctttctctttctctcattcccccactaacctacctgtaccatcacaaaatcctcaattccccttcctccactctttttcctcttactgaagacaaacaacacacacaaagacacagaacaacaacgtcgaaaaatgtcgacaaaccactacaccatggaccttcccgaaccaacactctggtggccacacccacaccaacaacaactaaccttaatagatccagaccctctccctctgaacctcaacaacgacgacaacgacaatggcgacgacaacgacaacgacgaaaaccaaacagttacaacaaccacaacaggaggagaagaagaaataataaacaataaagaaccgatgttcgagaagccgctaaccccgagcgacgtggggaagctgaaccgcctcgtaatcccgaagcagcacgctgagaagtactttccactgagtggtggtgactcgggcagtagcgagtgcaaggggc

SEQ ID NO: 893 - protein, 122 aa, Glycine max
  misc_feature: Utility: Useful for delaying flowering time
  misc_feature: Utility: Useful for increasing chlorophyll and photosynthetic capacity
  misc_feature: Utility: Useful for making ornamental plants with modified leaves
  misc_feature: Utility: Useful for making plants with increased biomass and foliage
  misc_feature: Utility: Useful for making smaller plants
HAYFKSLPLSLSLIPPLTYLYHHKILNSPSSTLFPLTEDKQHTQRHRTTTSKNVDKPLHHGPSRTNTLVATPTPTTTNLNRSRPSPSEPQQRRQRQWRRQRQRRKPNSYNNHNRRRRRNNKQ

SEQ ID NO: 894 - DNA, 1338 bp, Glycine max
  misc_feature (1)..(1338): Ceres CLONE ID no. 660003
  misc_feature (1)..(1338): Also known as  Ceres CDNA ID no. 23704291
gtcataactttgctagatccatcaaagaagcagtgattcccccagcttccacatcaaatgaagccataatcatcatcatcatcaccacgcctcttctttctctttctccctaccattcacaatgtcatcgatacaccactactcaccggaaacaacactatactggaccagcgaccaccagcaacaacaacaacaacaacaacaacaacaacaacaagctgccacgtggcttagtaattcccacactccccgtttcaacctgaacgaagacgacgacgaggaagacgacgttgtcgtttcggacaaggctactaataatttggcgcaagaacaggagaaagaagcgatgttcgagaagccgttgacgccgagcgacgtcgggaagctgaaccggctcgtgatcccgaaacagcacgcggagaagtacttccctcttgactcgtccggcggtgactcggcggcggcgaaagggctcttgctgagtttcgaggacgagtcggggaagtgctggcgcttccgttactcttattggaacagtagccagagttacgttttgaccaaaggctggagccgttacgtcaaagacaaacgcctccacgcaggcgacgtcgttttgttccacagacaccgcgcccaccctcaacgcttcttcatctcctgcacccgccaccaacccaaccccaaccctcccgcgcacgttagcatcagatcctcctcctactctgcgctcccagcttatcctacgcaccatcatcatcacctccccttcccataccaacctcactctcttcacgcaccaggtggagggtcccaaggacagaacgaaacgacaccaggagggaacagttcaagtggcagggtgctgaggctgtttggggtgaacatggaatgccaacctgataatgataatgattcccaaaactccacacatgaatgctcctacacccacttataccaccatcaaacctcttcttatccttcttcaaaccctcaccatcacatgctacctcaacaaccataatagaaattagatatatatgcccccctctttattagattctcccccgttttttttttttcatttccagcttcagggttgaagtatgcccttaaattaattttagtcaatgaccgtgtcgttaacatgaacccgtgaaaggaacccttcttttattattagtatatttaggttgacgttgaagattatagaggatctttcttgtcttgaattagggagatgcatgcaaatggaaatgccttgtttattcgttttatcggatcttcttgttccctgtcactcgagcatattaattatcgactaagctgtgaatgcatgcc

SEQ ID NO: 895 - protein, 299 aa, Glycine max
  misc_feature (76)..(181): Pfam Name: B3; Pfam Description: B3 DNA binding domain
  misc_feature: Utility: Useful for delaying flowering time
  misc_feature: Utility: Useful for increasing chlorophyll and photosynthetic capacity
  misc_feature: Utility: Useful for making larger plants
  misc_feature: Utility: Useful for making ornamental plants with modified leaves
  misc_feature: Utility: Useful for making plants with increased biomass and foliage
  misc_feature: Utility: Useful for making smaller plants
  misc_feature (239)..(239): Xaa is any aa, unknown, or other
MSSIHHYSPETTLYWTSDHQQQQQQQQQQQQQAATWLSNSHTPRFNLNEDDDEEDDVVVSDKATNNLAQEQEKEAMFEKPLTPSDVGKLNRLVIPKQHAEKYFPLDSSGGDSAAAKGLLLSFEDESGKCWRFRYSYWNSSQSYVLTKGWSRYVKDKRLHAGDVVLFHRHRAHPQRFFISCTRHQPNPNPPAHVSIRSSSYSALPAYPTHHHHHLPFPYQPHSLHAPGGGSQGQNETTPXGNSSSGRVLRLFGVNMECQPDNDNDSQNSTHECSYTHLYHHQTSSYPSSNPHHHMLPQQP

SEQ ID NO: 896 - protein, 244 aa, Glycine max
  misc_feature (1)..(244): Public GI no. 26450255
  misc_feature: Utility: Useful for delaying flowering time
  misc_feature: Utility: Useful for increasing chlorophyll and photosynthetic capacity
  misc_feature: Utility: Useful for making larger plants
  misc_feature: Utility: Useful for making ornamental plants with modified leaves
  misc_feature: Utility: Useful for making plants with increased biomass and foliage
  misc_feature: Utility: Useful for making smaller plants
MSINQYSSDFHYHSLMWQQQQQQQQHQNDVVEEKEALFEKPLTPSDVGKLNRLVIPKQHAERYFPLAAAAADAVEKGLLLCFEDEEGKPWRFRYSYWNSSQSYVLTKGWSRYVKEKHLDAGDVVLFHRHRSDGGRFFIGWRRRGDSSSSSDSYRHVQSNASLQYYPHAGAQAVESQRGNSKTLRLFGVNMECQLDSDWSEPSTPDGSNTYTTNHDQFHFYPQQQHYPPPYYMDISFTGDMNRTS

SEQ ID NO: 897 - protein, 279 aa, Triticum aestivum
  misc_feature (1)..(279): Ceres CLONE ID no. 763852
  misc_feature: Utility: Useful for delaying flowering time
  misc_feature: Utility: Useful for increasing chlorophyll and photosynthetic capacity
  misc_feature: Utility: Useful for making larger plants
  misc_feature: Utility: Useful for making ornamental plants with modified leaves
  misc_feature: Utility: Useful for making plants with increased biomass and foliage
  misc_feature: Utility: Useful for making smaller plants
MAMNPLSQEHPNAWPWGVAMYTNLHYQQYHYEKEHLFEKALTPSDVGKLNRLVIPKQHAERCFPLGGDSGEKGLLLSFDDEAGKPWRFRYSYWTSSQSYVLTKGWSRYVKEKHLEAGDVVHFERVRGLGTGDRLFIGCRRRGDVSAPTAVAPPPAVHVVPASGQSPREQQQHQQPWSPMCYSTSTSYPTSPATSHAYRRSAEHDHSDMHHAGESQWDADTRSCSPASAPTRRLRLFGVNLDCAPEPEAEAVPATPAMYGYVHQSPYAAVSPVPSNWGSS

SEQ ID NO: 898 - DNA, 1040 bp, Glycine max
  misc_feature (1)..(1040): Ceres CLONE ID no. 664365
  misc_feature (1)..(1040): Also known as  Ceres CDNA ID no. 23401946
aataaaaacagagtaactctgttatactcttctcgagttccctccaaacacccaacactttgaatggattgttcctccgttctccactcatcaaactcctcattcttccccttcaacgaaaacgaccccgaagagatgctcctctacggcatgatcacgtcataccaagaaaaagtgatcatcaaagaagaggaagtgaactcagaggaaaacaacaacaagaataagaaaaacaacaacaagagcagcttccgcggcgtgcggagtcgcccgtgggggaagttcgcggcggagataagggactccacgcggcacggcgtgagggtgtggcttgggacattcgacagcgccgaggccgcggcgctggcctatgaccaagccgcgttctccatgaggggctccgccgcggtgctcaacttccccgtggagaaggtgaaggagtcattaagagacatgaattgcactctctctcagcttgatgggtcttctcccgtcgtggccttgaagaggagacactccttaggacgcaaaatggctgctaagaagaagaaggtggaagagactcatggtgatgttcggttagagaatgtggttgtgttggaagacctaggggctgagtatttggaacacttgttgatgatgtcctctcatgatactactagttgttcttggtgaatctaattatgtacaagtagaaccattgtttaatctttcatgagttgcaacaatttctttttcctacatgtttttttctttaaaagcaattctgtttgaatcttgatttatcatgttgcagaaaattaacttgagctattaattgtttagttaatatatcctatgtacttttttcagtgaccatggtcattatggtcattgaatttttctttataggatcttagagtttaaagcttggataatttgtaccgagttatcttggtggcacccatctcctatgttcttttgttcttgtattttatcattcaacatttattttggtggaaagaacatttgtcataatgtacgttactgatgttagaatg

SEQ ID NO: 899 - protein, 203 aa, Glycine max
  misc_feature (61)..(125): Pfam Name: AP2; Pfam Description: AP2 domain
  misc_feature: Utility: Useful for delaying flowering time
  misc_feature: Utility: Useful for increasing chlorophyll and photosynthetic capacity
  misc_feature: Utility: Useful for making plants with enhanced abiotic stress tolerance
  misc_feature: Utility: Useful for making plants with increased biomass and foliage
  misc_feature (51)..(51): Xaa is any aa, unknown, or other
  misc_feature (57)..(57): Xaa is any aa, unknown, or other
  misc_feature (58)..(58): Xaa is any aa, unknown, or other
MDCSSVLHSSNSSFFPFNENDPEEMLLYGMITSYQEKVIIKEEEVNSEENXNKNKKXXNKSSFRGVRSRPWGKFAAEIRDSTRHGVRVWLGTFDSAEAAALAYDQAAFSMRGSAAVLNFPVEKVKESLRDMNCTLSQLDGSSPVVALKRRHSLGRKMAAKKKKVEETHGDVRLENVVVLEDLGAEYLEHLLMMSSHDTTSCSW

SEQ ID NO: 900 - protein, 203 aa, Glycine max; identical to SEQ ID NO: 899
  misc_feature (1)..(203): Ceres CLONE ID no. 664365
  misc_feature: Utility: Useful for delaying flowering time
  misc_feature: Utility: Useful for increasing chlorophyll and photosynthetic capacity
  misc_feature: Utility: Useful for making plants with enhanced abiotic stress tolerance
  misc_feature: Utility: Useful for making plants with increased biomass and foliage
  misc_feature (51)..(51): Xaa is any aa, unknown, or other
  misc_feature (57)..(57): Xaa is any aa, unknown, or other
  misc_feature (58)..(58): Xaa is any aa, unknown, or other

SEQ ID NO: 901 - protein, 240 aa, Glycine max; identical to SEQ ID NO: 365
  misc_feature (1)..(240): Public GI no. 23452024
  misc_feature: Utility: Useful for delaying flowering time
  misc_feature: Utility: Useful for increasing chlorophyll and photosynthetic capacity
  misc_feature: Utility: Useful for making plants with enhanced abiotic stress tolerance
  misc_feature: Utility: Useful for making plants with increased biomass and foliage

SEQ ID NO: 902 - protein, 166 aa, Glycine max
  misc_feature (1)..(166): Public GI no. 50920293
  misc_feature: Utility: Useful for delaying flowering time
  misc_feature: Utility: Useful for increasing chlorophyll and photosynthetic capacity
  misc_feature: Utility: Useful for making plants with enhanced abiotic stress tolerance
  misc_feature: Utility: Useful for making plants with increased biomass and foliage
MDAHGQEEEEEPMQVQQQQAFRGVRKRPWGKFAAEIRDSTRNGVRVWLGTFDSAEEAALAYDQAAFAMRGSAAVLNFPMEQVRRSMDMSLLQEGASPVVALKRRHSMRAAAAGRRRKSAAPAPADQEGGGGVMELEDLGPDYLEELLAASQPIDITCCTSPSHHSI

SEQ ID NO: 903 - protein, 229 aa, Arabidopsis thaliana
  misc_feature (1)..(229): Ceres CLONE ID no. 21068
  misc_feature: Utility: Useful for delaying flowering time
  misc_feature: Utility: Useful for increasing chlorophyll and photosynthetic capacity
  misc_feature: Utility: Useful for making plants with enhanced abiotic stress tolerance
  misc_feature: Utility: Useful for making plants with increased biomass and foliage
QSSQETEYFFYMDPLLIQSPFSGFSPEYSIGSSPESFSSSSSNNYSLPFNENDSEEMFLYGLIEQSTQQTYIDSELQDLPIKSVSSRKSEKSYRGVRRRPWGKFAAEIRDSTRNGIRVWLGTFESAEEAALAYDQAAFSMRGSSAILNFSAERVQESLSEIKCTYEDGCSPVVALKRKHSMRRRMTNKKTKDSDFDHRSVKLDNVVVFEDLGEQYLEELLGSSENSGTW

SEQ ID NO: 904 - protein, 218 aa, Arabidopsis thaliana; identical to SEQ ID NO: 363
  misc_feature (1)..(218): Public GI no. 21554205
  misc_feature: Utility: Useful for delaying flowering time
  misc_feature: Utility: Useful for increasing chlorophyll and photosynthetic capacity
  misc_feature: Utility: Useful for making plants with enhanced abiotic stress tolerance
  misc_feature: Utility: Useful for making plants with increased biomass and foliage

SEQ ID NO: 905 - protein, 218 aa, Arabidopsis thaliana
  misc_feature (1)..(218): Public GI no. 57012702
  misc_feature: Utility: Useful for delaying flowering time
  misc_feature: Utility: Useful for increasing chlorophyll and photosynthetic capacity
  misc_feature: Utility: Useful for making plants with enhanced abiotic stress tolerance
  misc_feature: Utility: Useful for making plants with increased biomass and foliage
MDPFLIQSPFSGFSPEYSIGSSPDSFSSSSSNNYSLPFNENDSEEMFLYGLIEQSTQQTYIDSDSQDLPIKSVSSRKSEKSYRGVRRRPWGKFAAEIRDSTRNGIRVWLGTFESAEEAALAYDQAAFSMRGSSAILNFSAERVQESLSEIKYTYEDGCSPVVALKRKHSMRRRMTNKKTKDSDFDHRSVKLDNVVVFEDLGEQYLEELLGSSENSGTW

SEQ ID NO: 906 - DNA, 541 bp, Glycine max
  misc_feature (1)..(541): Ceres CLONE ID no. 679923
  misc_feature (1)..(541): Also known as  Ceres CDNA ID no. 23702778
gctcaagtttccaagaccaagccaatggaaaacctttcaccattgatttacaaaaaccccattagaagaacttctaggcgatctacaatgtatcttggtgtgagaaaaaggccatggggaagatatgctgctgagattaggaacccatacaccaaagagagacactggctaggcacatttgacactgctgaagaggctgctatagcttatgatctttcatctatcaagatttgtggcattaatgctcgaactaattttcactacccttttgtgtctcttccaccacttcctatgtcgtcattgcctcctccaccgccaccgccgaccccagagttggatccaagtgttgaagtttgtctagagatgatgaatgctgcttcttacgatggtgatgatgaatctcttgttattgcttccattttgcaaagtttttctaattctggtaactgttctttttagtttttggttccaatgaggctatggcctgcctcttatcaaatcaataattctattttttttctttgcaaaaaaaaaaaaaaaa

SEQ ID NO: 907 - protein, 123 aa, Glycine max
  misc_feature (1)..(63): Pfam Name: AP2; Pfam Description: AP2 domain
  misc_feature: Utility: Useful for delaying flowering time
  misc_feature: Utility: Useful for delaying senescence
  misc_feature: Utility: Useful for making larger plants
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with altered leaf shape eg curled leaves
  misc_feature: Utility: Useful for making plants with enhanced plant architecture
  misc_feature: Utility: Useful for making plants with increased biomass and foliage
  misc_feature: Utility: Useful for making smaller plants
  misc_feature: Utility: Useful for making stronger plants
  misc_feature: Utility: Useful for modifying plant structure, ie increased branching
MYLGVRKRPWGRYAAEIRNPYTKERHWLGTFDTAEEAAIAYDLSSIKICGINARTNFHYPFVSLPPLPMSSLPPPPPPPTPELDPSVEVCLEMMNAASYDGDDESLVIASILQSFSNSGNCSF

SEQ ID NO: 908 - DNA, 1026 bp, Glycine max
  misc_feature (1)..(1026): Ceres CLONE ID no. 708342
  misc_feature (1)..(1026): Also known as  Ceres CDNA ID no. 23706745
aaaaaacgcagccaaaacagcaacaaacgacagagattcttcctcaacacaatcgaaaaaaaaaaaagcttccgattctaaaaccagaacaacaaaaaagtaaaacacacacgtcattttaaaacatttcatttttttggttatttatttaaagagcgagtgttgtaacaaatggtgaagccgaagagcgtggagaaacccgcagaggaacaacaacaacgaagtgtttcatcgtacagaggagtacggaagaggaagtgggggaagtacgtgtcggaaattaggttacccaacagccgtcaaaggatttggttgggttcctatgacagcgccgagaaggcggcacgcgcgttcgacgctgccatgttctgcttacgtggcagcggcgccaaatttaatttcccgagtgacccacccaacatcgccggcggggggaacatgacctcctcccagattcagatcgcggcggcgcgtttcgccaattcggagccccgaaatgagcgttcggatcaacccgtggagtctttaacttcggatgaggaaacggcatcgtttccggtcatttcggatacggatacatcatctcctcctctctcagacgtgacgttccaaaacgacgccgaattagtgactgggtcgttccctgatatgttttcggatttcgggtcgggcgattttgtgcccgatttctccgattttccgagcttcgacgatttcagccgggacttcttcttgcatgaacttccgggtttcaatttcggagaagagaacttggatggattgataattcaggactcgttcttgtggaatttctaagcgggtcagggttcggataattttattatatccgaacccgatatcagaatccggatcggatccgggtttgggttgggtcaaattttgcgtgccaagccctccatgtgttagtagttagtgatgattatagttttttttttaacgtaccaagtagtcaaatgtttcgattttttgggatgcgaatcataattcatttatttgtcatgactc

SEQ ID NO: 909 - protein, 214 aa, Glycine max
  misc_feature (20)..(83): Pfam Name: AP2; Pfam Description: AP2 domain
  misc_feature: Utility: Useful for delaying flowering time
  misc_feature: Utility: Useful for making plants sterile and for genetic confinement
  misc_feature: Utility: Useful for making plants with increased biomass and foliage
  misc_feature: Utility: Useful for making smaller plants
MVKPKSVEKPAEEQQQRSVSSYRGVRKRKWGKYVSEIRLPNSRQRIWLGSYDSAEKAARAFDAAMFCLRGSGAKFNFPSDPPNIAGGGNMTSSQIQIAAARFANSEPRNERSDQPVESLTSDEETASFPVISDTDTSSPPLSDVTFQNDAELVTGSFPDMFSDFGSGDFVPDFSDFPSFDDFSRDFFLHELPGFNFGEENLDGLIIQDSFLWNF

SEQ ID NO: 910 - protein, 185 aa, Glycine max; identical to SEQ ID NO: 873
  misc_feature (1)..(185): Public GI no. 29893536
  misc_feature: Utility: Useful for delaying flowering time
  misc_feature: Utility: Useful for making plants sterile and for genetic confinement
  misc_feature: Utility: Useful for making plants with increased biomass and foliage
  misc_feature: Utility: Useful for making smaller plants

SEQ ID NO: 911 - protein, 178 aa, Glycine max
  misc_feature (1)..(178): Public GI no. 12083252
  misc_feature: Utility: Useful for delaying flowering time
  misc_feature: Utility: Useful for making plants sterile and for genetic confinement
  misc_feature: Utility: Useful for making plants with increased biomass and foliage
  misc_feature: Utility: Useful for making smaller plants
MQSKYKGVRKRKWGKWVSEIRLPNSRERIWLGSYDTPEKAARAFDAALYCLRGNNAKFNFPDNPPVISGGRNLSRSEIREAAARFANSAEDDSSGGAGYEIRQESASTSMDVDSEFLSMLPTVGSGNFASEFGLFPGFDDFSDEYSGDRFREQLSPTQDYYQLGEETYADGSMFLWNF

SEQ ID NO: 912 - protein, 187 aa, Parthenium argentatum
  misc_feature (1)..(187): Ceres CLONE ID no. 1609832
  misc_feature: Utility: Useful for delaying flowering time
  misc_feature: Utility: Useful for making plants sterile and for genetic confinement
  misc_feature: Utility: Useful for making plants with increased biomass and foliage
  misc_feature: Utility: Useful for making smaller plants
MMKPKSSEGSSSSTHEPKYKGVRLRKWGKWVSEIRLPNSRERIWLGSYDSPEKAARAFDAAAFCLRGHAAKFNFPDQPPNIPGGRSLSSAQIQDAAARYANSVPDETVIPMEDSTSSSIMLNDDSNYNNNSSSSNNNNNVTDYDIFPGFDDYFMQPPPMVSPQFADYDEGNSSDGDISQGPSFLWNY

SEQ ID NO: 913 - protein, 243 aa, Parthenium argentatum
  misc_feature (1)..(243): Public GI no. 50946411
  misc_feature: Utility: Useful for delaying flowering time
  misc_feature: Utility: Useful for making plants sterile and for genetic confinement
  misc_feature: Utility: Useful for making plants with increased biomass and foliage
  misc_feature: Utility: Useful for making smaller plants
MDHIGISGGGEGGVVSPAQPSSPERRYKGVRLRKWGRWVSEIRMPNSRERIWLGSYESAEKAARAFDAAAVCLRGSRGAGSLNFPESPPPDVRRRFPGAALTVEQIQAEAARHANRPFPANTAAAGGSSSSYSISQRQEAAAPARSTSNDDTAMSSVPSTDGGAADYDGGDDVIDWSFMDTLPAMSSSAASTNADLVPAMDDFMYGFLHTMPPSPCEDGGEDVMIDGNCNMDQTFFSVDLWRF

SEQ ID NO: 914 - DNA, 653 bp, Brassica napus
  misc_feature (1)..(653): Ceres CLONE ID no. 969750
  misc_feature (1)..(653): Also known as  Ceres CDNA ID no. 23419038
acaaacacacaacacaacaatggattacatcgacaacaccgtcgaaactcaatcaaagtacaaaggcatccgtcgccggaaatgggggaaatgggtatcggagattcgagttccgggaactcgcgaccgtctctggttaggctcattctccacggcggaaggcgcagccgtggcgcacgacgtggctttctactgtttacaccaaccaaactcgctcgaatctctcaacttccctcacttgcttcctccttccatagtttccaagacttcgccgaggtctatccagcaagctgcttctaatgccggaatggccgttgacgccggaatcgttaacagctgtgatcacgcgtccgggaactctgggaatggagatacaacgacggcgtattgtgagaatggaggtgcgttgaatatatcagtgtatgattatttggacggtcacgatcacgtttgaacttcatcttcttgttttttcgtttaaagatacagctactcaaaagaaacagtgatggagcctggtgtgtaagcaaacaaagcgttgtaaatataattatacgtttatgtttcgctgttggcccaattcaagaaacttttgttgtacgattatatatatttttattttgaatgccttcaagaggattataatgcgagtg

SEQ ID NO: 915 - protein, 144 aa, Brassica napus
  misc_feature (12)..(77): Pfam Name: AP2; Pfam Description: AP2 domain
  misc_feature: Utility: Useful for delaying flowering time
  misc_feature: Utility: Useful for making larger plants
MDYIDNTVETQSKYKGIRRRKWGKWVSEIRVPGTRDRLWLGSFSTAEGAAVAHDVAFYCLHQPNSLESLNFPHLLPPSIVSKTSPRSIQQAASNAGMAVDAGIVNSCDHASGNSGNGDTTTAYCENGGALNISVYDYLDGHDHV

SEQ ID NO: 916 - protein, 144 aa, Arabidopsis thaliana
  misc_feature (1)..(144): Ceres CLONE ID no. 26867
  misc_feature: Utility: Useful for delaying flowering time
  misc_feature: Utility: Useful for making larger plants
MDYRESTGESQSKYKGIRRRKWGKWVSEIRVPGTRDRLWLGSFSTAEGAAVAHDVAFFCLHQPDSLESLNFPHLLNPSLVSRTSPRSIQQAASNAGMAIDAGIVHSTSVNSGCGDTTTYYENGADQVEPLNISVYDYLGGHDHV

SEQ ID NO: 917 - protein, 144 aa, Arabidopsis thaliana; identical to SEQ ID NO: 916
  misc_feature (1)..(144): Public GI no. 21555003
  misc_feature: Utility: Useful for delaying flowering time
  misc_feature: Utility: Useful for making larger plants

SEQ ID NO: 918 - protein, 179 aa, Zea mays
  misc_feature (1)..(179): Ceres CLONE ID no. 1469452
  misc_feature: Utility: Useful for delaying flowering time
  misc_feature: Utility: Useful for making larger plants
MRRAEPVGEQADAERRMSGYKGVRRRRWGKWVSEIRVPGSRERLWLGSYATPEAAAVAHDTAVYFLRGGGGGPGDVAALNFPERAAAAYGAGGRLSPRSVQRVASDAGMAADAQLVAAREDTRAHRTGIGGGASARPRDRDAGDACAGRAHNASLHSTGAGREQPVSGEISVDDMDILL

SEQ ID NO: 919 - DNA, 867 bp, Arabidopsis thaliana
  misc_feature (1)..(867): Ceres CLONE ID no. 1001432
  misc_feature (1)..(867): Also known as  Ceres CDNA ID no. 23406024
agggtttattcttcattgcttgagcttccttctcttcttcttcttcaagccgcggctgaagatccctacttctctcgacacttatagagtttcaggtccattctctgattcctgttttttcattttctaatttcctatttacgggtttttactaatcttctagtgatcctccagtcatggccgcctccgcagaaatcgacgctgagattcaacagcagcttaccaatgaggttaagctcttcaaccgttggagctttgatgacgtttcggttacggatattagtcttgtggactacattggtgttcagccatcgaagcacgcaacttttgttccccatactgctggacgatactctgtgaagaggttcagaaaggcgcagtgcccaattgttgagaggctcactaactctctcatgatgcacggaagaaacaatggtaagaagttgatggctgtcaggatcgtcaagcatgccatggagattatccacctcttgtctgacttgaacccgattcaagttatcattgatgccattgttaacagtggtccacgtgaagatgctaccaggattggatctgctggtgtggttaggaggcaggctgttgatatctctcctctaagacgtgtgaaccaagcgatcttcttgcttacaactggtgcacgtgaagctgcctttagaaacatcaagacaatcgctgagtgccttgctgatgaactcatcaatgctgcaaagggatcttccaacagctatgccatcaagaagaaagatgagattgagagagttgctaaggccaatcgttaagggatctccctttcctctaagtttgcattatatcaaagagtttttgtgttgtttccattagctttgg

SEQ ID NO: 920 - protein, 207 aa, Arabidopsis thaliana [sequence omitted]

SEQ ID NO: 921 - protein, 204 aa, Glycine max; identical to SEQ ID NO: 86
  misc_feature (1)..(204): Ceres CLONE ID no. 533766
  misc_feature: Utility: Useful for delaying flowering time
  misc_feature: Utility: Useful for increasing chlorophyll and photosynthetic capacity
  misc_feature: Utility: Useful for increasing increasing anthocyanin content
  misc_feature: Utility: Useful for making ornamental plants with modified leaves
  misc_feature: Utility: Useful for making plants with altered leaf shape eg curled leaves
  misc_feature: Utility: Useful for making plants with increased biomass and foliage
  misc_feature: Utility: Useful for making smaller plants
  misc_feature: Utility: Useful for making stronger plants

SEQ ID NO: 922 - protein, 204 aa, Glycine max; identical to SEQ ID NO: 87
  misc_feature (1)..(204): Ceres CLONE ID no. 471212
  misc_feature: Utility: Useful for delaying flowering time
  misc_feature: Utility: Useful for increasing chlorophyll and photosynthetic capacity
  misc_feature: Utility: Useful for increasing increasing anthocyanin content
  misc_feature: Utility: Useful for making ornamental plants with modified leaves
  misc_feature: Utility: Useful for making plants with altered leaf shape eg curled leaves
  misc_feature: Utility: Useful for making plants with increased biomass and foliage
  misc_feature: Utility: Useful for making smaller plants
  misc_feature: Utility: Useful for making stronger plants

SEQ ID NO: 923 - protein, 204 aa, Triticum aestivum; identical to SEQ ID NO: 87
  misc_feature (1)..(204): Ceres CLONE ID no. 792839
  misc_feature: Utility: Useful for delaying flowering time
  misc_feature: Utility: Useful for increasing chlorophyll and photosynthetic capacity
  misc_feature: Utility: Useful for increasing increasing anthocyanin content
  misc_feature: Utility: Useful for making ornamental plants with modified leaves
  misc_feature: Utility: Useful for making plants with altered leaf shape eg curled leaves
  misc_feature: Utility: Useful for making plants with increased biomass and foliage
  misc_feature: Utility: Useful for making smaller plants
  misc_feature: Utility: Useful for making stronger plants

SEQ ID NO: 924 - protein, 200 aa, Triticum aestivum; identical to SEQ ID NO: 92
  misc_feature (1)..(200): Ceres CLONE ID no. 741488
  misc_feature: Utility: Useful for delaying flowering time
  misc_feature: Utility: Useful for increasing chlorophyll and photosynthetic capacity
  misc_feature: Utility: Useful for increasing increasing anthocyanin content
  misc_feature: Utility: Useful for making ornamental plants with modified leaves
  misc_feature: Utility: Useful for making plants with altered leaf shape eg curled leaves
  misc_feature: Utility: Useful for making plants with increased biomass and foliage
  misc_feature: Utility: Useful for making smaller plants
  misc_feature: Utility: Useful for making stronger plants

SEQ ID NO: 925 - protein, 200 aa, Triticum aestivum; identical to SEQ ID NO: 89
  misc_feature (1)..(200): Ceres CLONE ID no. 1033671
  misc_feature: Utility: Useful for delaying flowering time
  misc_feature: Utility: Useful for increasing chlorophyll and photosynthetic capacity
  misc_feature: Utility: Useful for increasing increasing anthocyanin content
  misc_feature: Utility: Useful for making ornamental plants with modified leaves
  misc_feature: Utility: Useful for making plants with altered leaf shape eg curled leaves
  misc_feature: Utility: Useful for making plants with increased biomass and foliage
  misc_feature: Utility: Useful for making smaller plants
  misc_feature: Utility: Useful for making stronger plants

SEQ ID NO: 926 - protein, 200 aa, Triticum aestivum; identical to SEQ ID NO: 93
  misc_feature (1)..(200): Public GI no. 34893994
  misc_feature: Utility: Useful for delaying flowering time
  misc_feature: Utility: Useful for increasing chlorophyll and photosynthetic capacity
  misc_feature: Utility: Useful for increasing increasing anthocyanin content
  misc_feature: Utility: Useful for making ornamental plants with modified leaves
  misc_feature: Utility: Useful for making plants with altered leaf shape eg curled leaves
  misc_feature: Utility: Useful for making plants with increased biomass and foliage
  misc_feature: Utility: Useful for making smaller plants
  misc_feature: Utility: Useful for making stronger plants

SEQ ID NO: 927 - protein, 199 aa, Zea mays; identical to SEQ ID NO: 91
  misc_feature (1)..(199): Ceres CLONE ID no. 287037
  misc_feature: Utility: Useful for delaying flowering time
  misc_feature: Utility: Useful for increasing chlorophyll and photosynthetic capacity
  misc_feature: Utility: Useful for increasing increasing anthocyanin content
  misc_feature: Utility: Useful for making ornamental plants with modified leaves
  misc_feature: Utility: Useful for making plants with altered leaf shape eg curled leaves
  misc_feature: Utility: Useful for making plants with increased biomass and foliage
  misc_feature: Utility: Useful for making smaller plants
  misc_feature: Utility: Useful for making stronger plants

SEQ ID NO: 928 - protein, 199 aa, Zea mays; identical to SEQ ID NO: 90
  misc_feature (1)..(199): Ceres CLONE ID no. 1281072
  misc_feature: Utility: Useful for delaying flowering time
  misc_feature: Utility: Useful for increasing chlorophyll and photosynthetic capacity
  misc_feature: Utility: Useful for increasing increasing anthocyanin content
  misc_feature: Utility: Useful for making ornamental plants with modified leaves
  misc_feature: Utility: Useful for making plants with altered leaf shape eg curled leaves
  misc_feature: Utility: Useful for making plants with increased biomass and foliage
  misc_feature: Utility: Useful for making smaller plants
  misc_feature: Utility: Useful for making stronger plants

SEQ ID NO: 929 - protein, 212 aa, Zea mays; identical to SEQ ID NO: 94
  misc_feature (1)..(212): Public GI no. 40748265
  misc_feature: Utility: Useful for delaying flowering time
  misc_feature: Utility: Useful for increasing chlorophyll and photosynthetic capacity
  misc_feature: Utility: Useful for increasing increasing anthocyanin content
  misc_feature: Utility: Useful for making ornamental plants with modified leaves
  misc_feature: Utility: Useful for making plants with altered leaf shape eg curled leaves
  misc_feature: Utility: Useful for making plants with increased biomass and foliage
  misc_feature: Utility: Useful for making smaller plants
  misc_feature: Utility: Useful for making stronger plants

SEQ ID NO: 930 - DNA, 1363 bp, Arabidopsis thaliana
  misc_feature (1)..(1363): Ceres CLONE ID no. 1002819
  misc_feature (1)..(1363): Also known as  Ceres CDNA ID no. 23557715
aaaatctagagaagcttgtttctagggtttcgactctcgacggccggtacgatttttcaactgcttgttctaaggaatcatgaagcctgtcttttgcggaaactttgagtatgatgctcgtgagagtgatcttgagcggcttttcagaaagtacggcaaggttgagagggttgatatgaaagctgggtttgcttttgtctatatggaagatgaaagggatgctgaagatgcaattcgagcgcttgatcgctttgaatatggtcgcacaggacgcagactccgtgttgagtggacaaagaatgaccgtggaggtgctggaagatcaggtggttcgaggagatcatcttctggcttgagaccttccaagactctgtttgtgatcaacttcgatgcacaaaacactaggactcgggacttggagaggcactttgagccgtatggtaaaattgttaatgttagaatcagaaggaattttgcattcatccaatatgaggcacaagaagatgctaccagagcactggatgctacaaattccagtaagctgatggataaggtgatctcagtggagtatgcagtgaaagatgatgattcaagaggaaatggatacagtcctgaaagacggcgtgataggtcacctgataggagaaggcgatcaccaagtccttacagaagagaaaggggaagtcctgactatggccgaggtgctagtccagtagctcacaaaagggaaaggactagtcctgattatggtcgtggaagacgcagccccagcccttacaagagagccaggcttagcccagattacaagagggatgaccgtaggagggagagagtggctagcccagagaatggagctgtaaggaaccgaagcccaagaaaaggacgtggtgaaagcaggagtcctcctccatatgagaagaggagggaaagcaggagtcctccgccatatgagaagagaagggaaagcaggagtcctcctccatatgagaagaggagggagaggtcaaggtcaaggtcgaagtcaagccctgagaatggtcaagttgagagccctgggcaaataatggaagtagaagctggaagaggatacgatggagcagacagcccgatacgcgagagcagcccctctcgttcgccgccagcagaggaatgattggagatgcagacagataattgtgttggattcacaaacaaaagatgtctctcaaagtagttgtatccgaaactgaagtcttttgctatgtcatgtagtatttagtgtgttattttgggtctttgttaagtgttttgtaaactttattatgactccattcgaaatcgcttgtcgtagtattggttaaaagattgctttttagtttggatt

SEQ ID NO: 931 - protein, 357 aa, Arabidopsis thaliana
  misc_feature (98)..(162): Pfam Name: RRM_1; Pfam Description: RNA recognition motif. (a.k.a. RRM, RBD, or RNP domain)
  misc_feature (98)..(162): Pfam Name: RRM_1; Pfam Description: RNA recognition motif. (a.k.a. RRM, RBD, or RNP domain)
  misc_feature: Utility: Useful for delaying flowering time
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with increased biomass and foliage
  misc_feature: Utility: Useful for making smaller plants
  misc_feature: Utility: Useful for making stronger plants
  misc_feature: Utility: Useful for making taller plants and plants with longer inflorescences
MKPVFCGNFEYDARESDLERLFRKYGKVERVDMKAGFAFVYMEDERDAEDAIRALDRFEYGRTGRRLRVEWTKNDRGGAGRSGGSRRSSSGLRPSKTLFVINFDAQNTRTRDLERHFEPYGKIVNVRIRRNFAFIQYEAQEDATRALDATNSSKLMDKVISVEYAVKDDDSRGNGYSPERRRDRSPDRRRRSPSPYRRERGSPDYGRGASPVAHKRERTSPDYGRGRRSPSPYKRARLSPDYKRDDRRRERVASPENGAVRNRSPRKGRGESRSPPPYEKRRESRSPPPYEKRRESRSPPPYEKRRERSRSRSKSSPENGQVESPGQIMEVEAGRGYDGADSPIRESSPSRSPPAEE

SEQ ID NO: 932 - protein, 350 aa, Arabidopsis thaliana
  misc_feature (1)..(350): Ceres CLONE ID no. 113457
  misc_feature: Utility: Useful for delaying flowering time
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with increased biomass and foliage
  misc_feature: Utility: Useful for making smaller plants
  misc_feature: Utility: Useful for making stronger plants
  misc_feature: Utility: Useful for making taller plants and plants with longer inflorescences
MKPVFCGNFEYDAREGDLERLFRKYGKVERVDMKAGFAFVYMEDERDAEDAIRALDRFEFGRKGRRLRVEWTKSERGGDKRSGGGSRRSSSSMRPSKTLFVINFDADNTRTRDLEKHFEPYGKIVNVRIRRNFAFIQYEAQEDATRALDASNNSKLMDKVISVEYAVKDDDARGNGHSPERRRDRSPERRRRSPSPYKRERGSPDYGRGASPVAAYRKERTSPDYGRRRSPSPYKKSRRGSPEYGRDRRGNDSPRRRERVASPTKYSRSPNNKRERMSPNHSPFKKESPRNGVGEVESPIERRERSRSSPENGQVESPGSIGRRDSDGGYDGAESPMQKSRSPRSPPADE

SEQ ID NO: 933 - DNA, 396 bp, Arabidopsis thaliana
  misc_feature (1)..(396): Ceres CLONE ID no. 1006934
  misc_feature (1)..(396): Also known as  Ceres CDNA ID no. 24374760
agaaacattttctttcaaaagagagattacaacaaccatgtgtggaatcttcgcgtatctgaattttcacgcgaacaaagagagacgatacattctcgatgttctcttcaatggtcttcgtcgtcttgaatacagaggctacgattctgctggaatcgccattgataattcttctccttcttcttctcctctcgtgtttcgtcaagcaggaaacattgaatcacttgttaattccgttaacgaagagattacgaatacggatttgaatctagacgaagttttctactttcatgctggaattgcacatacgaggtgggctactcatggtgagccagctccaaggaatagtcatcctcaatcttctggtcctggagatgattttttggtggttcataa

SEQ ID NO: 934 - protein, 119 aa, Arabidopsis thaliana
  misc_feature (2)..(119): Pfam Name: GATase_2; Pfam Description: Glutamine amidotransferases class- II
  misc_feature: Utility: Useful for delaying flowering time
  misc_feature: Utility: Useful for increasing chlorophyll and photosynthetic capacity
  misc_feature: Utility: Useful for making ornamental plants with modified leaves
  misc_feature: Utility: Useful for making plants with increased biomass and foliage
  misc_feature: Utility: Useful for making smaller plants
MCGIFAYLNFHANKERRYILDVLFNGLRRLEYRGYDSAGIAIDNSSPSSSPLVFRQAGNIESLVNSVNEEITNTDLNLDEVFYFHAGIAHTRWATHGEPAPRNSHPQSSGPGDDFLVVH

SEQ ID NO: 935 - DNA, 683 bp, Arabidopsis thaliana
  misc_feature (1)..(683): Ceres CLONE ID no. 1007549
  misc_feature (1)..(683): Also known as  Ceres CDNA ID no. 23416657
aacaaggagcaaagagttcatagcaaagcaaagcttcaaaacagagtaaacgcaaagagtagcaatcacaagaggaagtgaaacgatgtctctaattccaagcatcttcggaggaagaagaacaaacgttttcgatccgttctcgctggatgttttcgatccgttcgaaggtttcttgacgccgtcaggattggcaaacgcacccgctaaggatgtggcagcgttcacaaacgctaaagtggattggagggagacacctgaggcgcacgtgttcaaggcggatttaccgggactgaggaaggaagaggtgaaagtggaggttgaggatggcaacatacttcagataagtggagagaggagcaatgagaatgaagagaagaatgacaagtggcaccgtgtggagcggtcgagtgggaagttcacgaggaggtttaggctgccggagaatgctaagatggaggaaatcaaagccagtatggaaaatggtgtgttgtcggttaccgtgcccaaggtgccagagaaaaagccagaggttaagtccattgatatctctggttaaagggaattgtttaagaccaaaaatgtgtgatggtagtgaaataattggtgtgtgatgtgtttttcttgtaatcatgaatctcgttgtatcattatcataaaatcttaataagagtgtgttttgt

SEQ ID NO: 936 - protein, 157 aa, Arabidopsis thaliana
  misc_feature (53)..(156): Pfam Name: HSP20; Pfam Description: Hsp20/alpha crystallin family
  misc_feature (53)..(156): Pfam Name: HSP20; Pfam Description: Hsp20/alpha crystallin family
  misc_feature: Utility: Useful for delaying flowering time
  misc_feature: Utility: Useful for increasing chlorophyll and photosynthetic capacity
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with increased biomass
  misc_feature: Utility: Useful for making plants with increased biomass and foliage
  misc_feature: Utility: Useful for making smaller plants
  misc_feature: Utility: Useful for making stronger plants
MSLIPSIFGGRRTNVFDPFSLDVFDPFEGFLTPSGLANAPAKDVAAFTNAKVDWRETPEAHVFKADLPGLRKEEVKVEVEDGNILQISGERSNENEEKNDKWHRVERSSGKFTRRFRLPENAKMEEIKASMENGVLSVTVPKVPEKKPEVKSIDISG

SEQ ID NO: 937 - protein, 161 aa, Arabidopsis thaliana
  misc_feature (1)..(161): Public GI no. 21689719
  misc_feature: Utility: Useful for delaying flowering time
  misc_feature: Utility: Useful for increasing chlorophyll and photosynthetic capacity
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with increased biomass
  misc_feature: Utility: Useful for making plants with increased biomass and foliage
  misc_feature: Utility: Useful for making smaller plants
  misc_feature: Utility: Useful for making stronger plants
MSLIPSIFGGRRSNVFDPFSQDLWDPFEGFFTPSSALANASTARDVAAFTNARVDWKETPEAHVFKADLPGLKKEEVKVEVEDKNVLQISGERSKENEEKNDKWHRVERASGKFMRRFRLPENAKMEEVKATMENGVLTVVVPKAPEKKPQVKSIDISGAN

SEQ ID NO: 938 - protein, 157 aa, Arabidopsis thaliana
  misc_feature (1)..(157): Public GI no. 2465461
  misc_feature: Utility: Useful for delaying flowering time
  misc_feature: Utility: Useful for increasing chlorophyll and photosynthetic capacity
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with increased biomass
  misc_feature: Utility: Useful for making plants with increased biomass and foliage
  misc_feature: Utility: Useful for making smaller plants
  misc_feature: Utility: Useful for making stronger plants
MSLIPSFFGGRRTNVFDPFSLDLYDPFEGFLTPSGMTNATSKDVAAFTNAKVDWRETPEAHVFKADLPGLKKEEVKVEVEDGNILQISGERSSENEEKSDRWHRVERSSGKFMRRFKLPENAKVDEVKASMENGVLSVTVPKMAERKPEVKSIDISG

SEQ ID NO: 939 - protein, 157 aa, Arabidopsis thaliana
  misc_feature (1)..(157): Public GI no. 8250119
  misc_feature: Utility: Useful for delaying flowering time
  misc_feature: Utility: Useful for increasing chlorophyll and photosynthetic capacity
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with increased biomass
  misc_feature: Utility: Useful for making plants with increased biomass and foliage
  misc_feature: Utility: Useful for making smaller plants
  misc_feature: Utility: Useful for making stronger plants
MSLIPSFFGGRRTNVFDPFSLDLYDPFEGFLTPSGMTNTTSKDVAAFTNAKVDWRETAEAHVFKADLPGLKKEEVKVEVEDGNILKISGERSSENEEKSDKWHRVERSSGKFMRRFKLPENAKVDEVKASMENGVLSVTVPKMPERKPEVKSMDISG

SEQ ID NO: 940 - protein, 157 aa, Arabidopsis thaliana
  misc_feature (1)..(157): Public GI no. 71495
  misc_feature: Utility: Useful for delaying flowering time
  misc_feature: Utility: Useful for increasing chlorophyll and photosynthetic capacity
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with increased biomass
  misc_feature: Utility: Useful for making plants with increased biomass and foliage
  misc_feature: Utility: Useful for making smaller plants
  misc_feature: Utility: Useful for making stronger plants
MSIIPSFFGGRRSNVFDPFSLDVWDPFKDFPLVTSSASEFGKETAAFVNTHIDWKETPQAHVFKADLPGLKKEEVKVELEEGKVLQISGERNKEKEEKNDKWHRVERSSGKFLRRFRLPENAKVDEVKAAMANGVLTVTVPKVEIKKPEVKAIDISG

SEQ ID NO: 941 - protein, 159 aa, Arabidopsis thaliana
  misc_feature (1)..(159): Public GI no. 5732912
  misc_feature: Utility: Useful for delaying flowering time
  misc_feature: Utility: Useful for increasing chlorophyll and photosynthetic capacity
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with increased biomass
  misc_feature: Utility: Useful for making plants with increased biomass and foliage
  misc_feature: Utility: Useful for making smaller plants
  misc_feature: Utility: Useful for making stronger plants
MSLIPSFFDGRRSNIFDPFSLNIWDPFEGFPFSGTVANIPTSTRETAAFSSARIDWKETPESHVFKVDLPGIKKEEVKVEVEEGRVLQISGERSREQEEKNDKWHSMERSSGKFLRRFRLPENIKMEEIKATMENGVLTVTVPKMEEKKPEVKAIDISG

SEQ ID NO: 942 - protein, 155 aa, Arabidopsis thaliana
  misc_feature (1)..(155): Public GI no. 18073562
  misc_feature: Utility: Useful for delaying flowering time
  misc_feature: Utility: Useful for increasing chlorophyll and photosynthetic capacity
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with increased biomass
  misc_feature: Utility: Useful for making plants with increased biomass and foliage
  misc_feature: Utility: Useful for making smaller plants
  misc_feature: Utility: Useful for making stronger plants
MSIIPSLFAGRRSSVFDPFSLDVWDPFRDFPISSSSDVSRETSALVNARVDWKETPEAHVFKADLPGIKKEEVKVEVEDGNILQITGERNVEKEDKNDKWHRVERSSGKFTRRFRLPENAKMDQVKAAMENGVLTITVPKEEVKKPDVKSIEISG

SEQ ID NO: 943 - protein, 154 aa, Arabidopsis thaliana
  misc_feature (1)..(154): Public GI no. 46359518
  misc_feature: Utility: Useful for delaying flowering time
  misc_feature: Utility: Useful for increasing chlorophyll and photosynthetic capacity
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with increased biomass
  misc_feature: Utility: Useful for making plants with increased biomass and foliage
  misc_feature: Utility: Useful for making smaller plants
  misc_feature: Utility: Useful for making stronger plants
MALSLFGGRRSNVFDPFSLDIWDPFEGFSAVANVPPSARETTAFATARIDWKETPEAHIFKADLPGLKKEEVKVEVEDGNVLQISGERSKEHEEKNDKWHRVERSCGKFLRRFRLPENAKVEQVKANMENGVLTVIVPKEEQKKTEVKSIEISG

SEQ ID NO: 944 - protein, 157 aa, Parthenium argentatum
  misc_feature (1)..(157): Ceres CLONE ID no. 1609909
  misc_feature: Utility: Useful for delaying flowering time
  misc_feature: Utility: Useful for increasing chlorophyll and photosynthetic capacity
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with increased biomass
  misc_feature: Utility: Useful for making plants with increased biomass and foliage
  misc_feature: Utility: Useful for making smaller plants
  misc_feature: Utility: Useful for making stronger plants
MSIIPSIFGGRRTNVFDPFSLDIWDPFFNTSISNIIPAGARETSAFANAQIDWKETPEAHVFKADLPGLKKEEVKVELQEDRILQISGERSREKEEKNDKWHRVERSSGKFLRRFRLPENAKVDEVKAKMENGVLTVTVPKKEVKKPEVKAIDISAN

SEQ ID NO: 945 - protein, 155 aa, Parthenium argentatum
  misc_feature (1)..(155): Public GI no. 56606538
  misc_feature: Utility: Useful for delaying flowering time
  misc_feature: Utility: Useful for increasing chlorophyll and photosynthetic capacity
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with increased biomass
  misc_feature: Utility: Useful for making plants with increased biomass and foliage
  misc_feature: Utility: Useful for making smaller plants
  misc_feature: Utility: Useful for making stronger plants
MALIPSIFGGRRSNVFDPFSHDIWDPFQGLSSALANARDQETAAIANTRIDWKETPEAHVFKADLPGLKKEEIKVEVEDGRVLQISGERSKEQEEKTDTWHRVERSVGKFHRRFRLPENAKVDQVTASMENGVLTVTVPKKEEKEPEVKAIDISG

SEQ ID NO: 946 - DNA, 1194 bp, Arabidopsis thaliana
  misc_feature (1)..(1194): Ceres CLONE ID no. 1020202
  misc_feature (1)..(1194): Also known as  Ceres CDNA ID no. 23557695
atcttgttgttgttgtggtgatttaggtttgaggagatgtagcaaaagctgtagattgaggtggactaattatcttcgacctgggatcaagcgtggaaatttcaccgagcatgaagagaagatgattctccatcttcaagctcttttgggaaacaggtgggcagctatagcatcatatcttccagaaaggacagacaatgatataaagaactattggaacactcatttgaagaaaaagctcaagaagatgaatgattcttgtgatagtactatcaacaatggccttgataataaagacttctccatatcaaacaaaaacactacctcacatcaaagcagcaactccagtaaaggtcaatgggagagaaggcttcagacagatatcaacatggctaaacaagctctttgtgatgccttgtctattgacaaaccacaaaacccaactaatttttctattcccgatcttggttatggtccatcatcttcttcgtcctctaccaccaccaccaccaccaccaccaccacgagaaacactaatccatacccatctggggtctatgcttcaagtgctgagaacattgctcgtttgcttcagaattttatgaaagacacaccaaagacctcggtgcccttgccggttgcagccaccgagatggctatcaccacggcagcttcgagccctagcacaaccgaaggagacggagaagggattgaccattctttgttcagcttcaactccatagatgaagctgaagagaagcctaaactaatagaccatgacattaatggtctaattacacaaggctctctttctttgttcgagaaatggctctttgatgagcaaagccacgatatgatcatcaataacatgtcactagagggtcaggaagtgttgttctagaaagcattaaagtttgacgatttgcttgaggaaccacgaggcttagttataaacaatttgtataattaagtactctttagttttgttttcaatccttattatgatcatattgcagtaattagggattttagtctttagtagtaactcttaagttttaacacatttttctctatctttttagtagtaactctttattttttccttaaatctttgtcgacgtggagatgatatcttctatgtagtagaaactcaaaagtgtacatcatctttattaatgtaacgtctttttaagc

SEQ ID NO: 947 - protein, 259 aa, Arabidopsis thaliana
  misc_feature (2)..(36): Pfam Name: Myb_DNA-binding; Pfam Description: Myb-like DNA-binding domain
  misc_feature (2)..(36): Pfam Name: Myb_DNA-binding; Pfam Description: Myb-like DNA-binding domain
  misc_feature: Utility: Useful for delaying flowering time
  misc_feature: Utility: Useful for increasing chlorophyll and photosynthetic capacity
  misc_feature: Utility: Useful for making larger plants
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with increased biomass
  misc_feature: Utility: Useful for making plants with increased biomass and foliage
  misc_feature: Utility: Useful for making smaller plants
  misc_feature: Utility: Useful for making stronger plants
MILHLQALLGNRWAAIASYLPERTDNDIKNYWNTHLKKKLKKMNDSCDSTINNGLDNKDFSISNKNTTSHQSSNSSKGQWERRLQTDINMAKQALCDALSIDKPQNPTNFSIPDLGYGPSSSSSSTTTTTTTTTTRNTNPYPSGVYASSAENIARLLQNFMKDTPKTSVPLPVAATEMAITTAASSPSTTEGDGEGIDHSLFSFNSIDEAEEKPKLIDHDINGLITQGSLSLFEKWLFDEQSHDMIINNMSLEGQEVLF

SEQ ID NO: 948 - DNA, 960 bp, Glycine max
  misc_feature (1)..(960): Ceres CLONE ID no. 1043081
  misc_feature (1)..(960): Also known as  Ceres CDNA ID no. 25447431
acaaattctatacaccactctatcccccgttctctctcgcccgctttggtaaggcaagatagttctggccaacatggtgcaatcaaggaaattcagaggtgtgaggcaacgcaattggggctcttgggtttctgagattcgtcacccattattgaaaaggagggtgtggcttgggacattcgagacagctgatgaagcagctagagcatatgatgaggccgccattttgatgagtggaagaaatgccaaaacaaacttcccagttggtgaaaaccaaatgggaaatcatagttcaagtacttcatcttcctccaccactacattgtctgcagttctgagtgcaaaacttaggaagtgttgcaagtccccttcaccttccctcacttgcctgaggcttgacactgagaattcccacattggtgtgtggcagaagcgagcaggccctcgttctgactcaaactggatcatgatggttgagttggaaaagaagaacaacaagggtccttcttctgaatccgaattgcctgttgttgttgttgatgatgatgccccagagaaggtaaagcctgaggaaagcactggcttagatgaggaacagaaaatggccctacagatgatagaggaacttctgaataggaattgaattgaattgaattgaattagccccatcatcccaacatgcttttactttcacgtggtgcatgcaaggagtttgcaagttcaagtccccttctctagtccctttcacttcgttttatttctttgtttgtcccaaataggagataggagagtgagagagctactatattcatttcgtgaggaataaggatgtttagtgtctgtggctctgaatgtttccccatgtgtgcgtaactccctacctacacttctcgctgtggttaaacttcatttcctctgtcaaaaaaactattccttgcttttcgaaaaaaaaaaaaaaaa

SEQ ID NO: 949 - protein, 189 aa, Glycine max
  misc_feature (5)..(68): Pfam Name: AP2; Pfam Description: AP2 domain
  misc_feature: Utility: Useful for delaying flowering time
  misc_feature: Utility: Useful for increasing chlorophyll and photosynthetic capacity
  misc_feature: Utility: Useful for making plants with enhanced abiotic stress tolerance
  misc_feature: Utility: Useful for making plants with increased biomass
MVQSRKFRGVRQRNWGSWVSEIRHPLLKRRVWLGTFETADEAARAYDEAAILMSGRNAKTNFPVGENQMGNHSSSTSSSSTTTLSAVLSAKLRKCCKSPSPSLTCLRLDTENSHIGVWQKRAGPRSDSNWIMMVELEKKNNKGPSSESELPVVVVDDDAPEKVKPEESTGLDEEQKMALQMIEELLNRN

SEQ ID NO: 950 - protein, 200 aa, Glycine max
  misc_feature (1)..(200): Ceres CLONE ID no. 556472
  misc_feature: Utility: Useful for delaying flowering time
  misc_feature: Utility: Useful for increasing chlorophyll and photosynthetic capacity
  misc_feature: Utility: Useful for making plants with enhanced abiotic stress tolerance
  misc_feature: Utility: Useful for making plants with increased biomass
MVQSRKFRGVRQRHWGSWVSEIRHPLLKRRVWLGTFETAEEAARAYDEAAILMSGRNAKTNFPVGENQIVGNHSSNTSSSSTTTLSAVLSAKLRKCCKSPSPSLTCLRLDTENSHIGVWQKRAGPRSDSNWIMMVELENKNNDNEGDHHQGPSSSDDSEFPVVVVDVDAQEKVKPEEESTGLDEEQKMALQMIEELLNRN

SEQ ID NO: 951 - protein, 199 aa, Glycine max
  misc_feature (1)..(199): Public GI no. 28950721
  misc_feature: Utility: Useful for delaying flowering time
  misc_feature: Utility: Useful for increasing chlorophyll and photosynthetic capacity
  misc_feature: Utility: Useful for making plants with enhanced abiotic stress tolerance
  misc_feature: Utility: Useful for making plants with increased biomass
MVQTKKFRGVRQRHWGSWVAEIRHPLLKRRIWLGTFETAEEAARAYDEAAVLMSGRNAKTNFPLNNNNTGETSEGKTDISASSTMSSSTSSSSLSSILSAKLRKCCKSPSPSLTCLRLDTASSHIGVWQKRAGSKSDSSWVMTVELGPASSSQETTSKASQDAILAPTTEVEIGGSREEVLDEEEKVALQMIEELLNTN

SEQ ID NO: 952 - protein, 199 aa, Arabidopsis thaliana
  misc_feature (1)..(199): Ceres CLONE ID no. 17356
  misc_feature: Utility: Useful for delaying flowering time
  misc_feature: Utility: Useful for increasing chlorophyll and photosynthetic capacity
  misc_feature: Utility: Useful for making plants with enhanced abiotic stress tolerance
  misc_feature: Utility: Useful for making plants with increased biomass
MVQTKKFRGVRQRHWGSWVAEIRHPLLKRRIWLGTFETAEEAARAYHEAAVLMSGRNAKTNFPLNNNNTGETSEGKTDISASSTMSSSTSSSSLSSILSAKLRKCCKSPSPSLTCLRLDTASSHIGVWQKRAGSKSDSSWVMTVELGPASSSQETTSKASQDAILAPTTEVEIGGSREEVLDEEEKVALQMIEELLNTN

SEQ ID NO: 953 - protein, 199 aa, Arabidopsis thaliana; identical to SEQ ID NO: 952
  misc_feature (1)..(199): Public GI no. 21553845
  misc_feature: Utility: Useful for delaying flowering time
  misc_feature: Utility: Useful for increasing chlorophyll and photosynthetic capacity
  misc_feature: Utility: Useful for making plants with enhanced abiotic stress tolerance
  misc_feature: Utility: Useful for making plants with increased biomass

SEQ ID NO: 954 - protein, 213 aa, Zea mays
  misc_feature (1)..(213): Ceres CLONE ID no. 224679
  misc_feature: Utility: Useful for delaying flowering time
  misc_feature: Utility: Useful for increasing chlorophyll and photosynthetic capacity
  misc_feature: Utility: Useful for making plants with enhanced abiotic stress tolerance
  misc_feature: Utility: Useful for making plants with increased biomass
MTENLHSRKMVQPKKFRGVRQRHWGSWVSEIRHPLLKRRVWLGTFETAEEAARAYDEAAVLMSGRNAKTNFPIQRSSTGEPTPAAGRDARSNFSSGSSTTNLSQILSAKLRKCCKAPSPSLTCLRLDPEKSHIGVWQKRAGARADSNWVMTVELNKDAASTDAASQSTSATTAPPATPMDEEERIALQMIEELLSSSSPASPSNGDDQGRFII

SEQ ID NO: 955 - protein, 205 aa, Zea mays
  misc_feature (1)..(205): Public GI no. 50906071
  misc_feature: Utility: Useful for delaying flowering time
  misc_feature: Utility: Useful for increasing chlorophyll and photosynthetic capacity
  misc_feature: Utility: Useful for making plants with enhanced abiotic stress tolerance
  misc_feature: Utility: Useful for making plants with increased biomass
MVQPKKKFRGVRQRHWGSWVSEIRHPLLKRRVWLGTFETAEEAARAYDEAAVLMSGRNAKTNFPVQRNSTGDLATAADQDARSNGGSRNSSAGNLSQILSAKLRKCCKAPSPSLTCLRLDPEKSHIGVWQKRAGARADSNWVMTVELNKEVEPTEPAAQPTSTATASQVTMDDEEKIALQMIEELLSRSSPASPSHGEGEGSFVI

SEQ ID NO: 956 - protein, 228 aa, Zea mays
  misc_feature (1)..(228): Ceres CLONE ID no. 302607
  misc_feature: Utility: Useful for delaying flowering time
  misc_feature: Utility: Useful for increasing chlorophyll and photosynthetic capacity
  misc_feature: Utility: Useful for making plants with enhanced abiotic stress tolerance
  misc_feature: Utility: Useful for making plants with increased biomass
MGAAVKEEEVPRRQAAPLGLLGSPRSGTRCSRGGVWLGTFETAEEAARAYDEAAVLMSGRNAKTNFPVLPCGRTRGGGGGGGSSGNNTNASASTSTSNLSQVLSAKLRRCCKAPSPSLTCLRLDPERSHIGVWHKGAGARADSSWVMTVQLSDKDAAPAPSATSSATATTTTAASHPPPATVVVVDDEERIALQMIEELLGGGGGPVSQQPLGNGMLQIAAAGGGLVI

SEQ ID NO: 957 - DNA, 399 bp, n/a
  misc_feature (1)..(399): Ceres CLONE ID no. 1105554
  misc_feature (1)..(399): Also known as  Ceres CDNA ID no. 6424924
  misc_feature (93)..(93): n is a, c, t, g, unknown, or other
  misc_feature (94)..(94): n is a, c, t, g, unknown, or other
aaaaattagggtttgttgtttctctctttctttcgcaattttcaaagtaatccaatcggaatcaagtcaaaacacctatcttagccacaccannragagatctgacttctaaaagatgatgaccaacttgtctcttgcragagaaggagaagcagaagcaaagaagcccatagaaaaagttgagagagagcacatgttcgacaaagtggtgactccaagcgacgtagggaaactaaaccggctcgtgatcccaaagcaacacgcagaaagatacttccctctagattcatcctcaaacgggaaaggtttgcttttaaacttcgaagatctaacaggaaagtcatggaggttccgttactcttactggaacagtagccagagctatgtcatgactaaagg

SEQ ID NO: 958 - protein, 94 aa, n/a
  misc_feature (27)..(94): Pfam Name: B3; Pfam Description: B3 DNA binding domain
  misc_feature (27)..(94): Pfam Name: B3; Pfam Description: B3 DNA binding domain
  misc_feature: Utility: Useful for delaying flowering time
  misc_feature: Utility: Useful for increasing chlorophyll and photosynthetic capacity
  misc_feature: Utility: Useful for making ornamental plants with modified flowers
  misc_feature: Utility: Useful for making ornamental plants with modified leaves
  misc_feature: Utility: Useful for making plants with increased biomass
  misc_feature: Utility: Useful for making plants with increased biomass and foliage
  misc_feature: Utility: Useful for making smaller plants
  misc_feature (8)..(8): Xaa is any aa, unknown, or other
MMTNLSLXREGEAEAKKPIEKVEREHMFDKVVTPSDVGKLNRLVIPKQHAERYFPLDSSSNGKGLLLNFEDLTGKSWRFRYSYWNSSQSYVMTK

SEQ ID NO: 959 - DNA, 467 bp, Glycine max
  misc_feature (1)..(467): Ceres CLONE ID no. 1120124
  misc_feature (1)..(467): Also known as  Ceres CDNA ID no. 4865327
aaaaacaaaatagtctctcttctctcaaacgattacaaaaaaatgacgtcatccaaccgttcttcatcaccaacatcatcgtcttcggaccaatctgatgtaactacaacaacaagcacccacttgtccgaaacttcaccgagaaacaacaaaagaaagagaagcaaggattcttcttcttcttcttcttcctcttcttcaaagcttaagcatcctgtttacagaggtgtacggatgagaagctggggcaaatgggtctccgagatccgacagcctcgcaaaaagactcgaatctggctcggtacattcgccaccgcagacatggcggcgcgtgctcacgacgtcgctgctctcgccatcaaaggctcctccgccgtcatcaacttyyccggagcttgcctctatcctccctcgtccggcgtcatcctcgccgcatgatatccaagcagcagctgcggaagccgccg

SEQ ID NO: 960 - protein, 131 aa, n/a
  misc_feature (58)..(114): Pfam Name: AP2; Pfam Description: AP2 domain
  misc_feature (58)..(114): Pfam Name: AP2; Pfam Description: AP2 domain
  misc_feature: Utility: Useful for delaying flowering time
  misc_feature: Utility: Useful for increasing chlorophyll and photosynthetic capacity
  misc_feature: Utility: Useful for making ornamental plants with modified flowers
  misc_feature: Utility: Useful for making plants with increased biomass and foliage
  misc_feature: Utility: Useful for making smaller plants
  misc_feature (115)..(115): Xaa is any aa, unknown, or other
  misc_feature (116)..(116): Xaa is any aa, unknown, or other
MTSSNRSSSPTSSSSDQSDVTTTTSTHLSETSPRNNKRKRSKDSSSSSSSSSSKLKHPVYRGVRMRSWGKWVSEIRQPRKKTRIWLGTFATADMAARAHDVAALAIKGSSAVINXXGACLYPPSSGVILAA

SEQ ID NO: 961 - DNA, 524 bp, Brassica napus
  misc_feature (1)..(524): Ceres CLONE ID no. 1124135
  misc_feature (1)..(524): Also known as  Ceres CDNA ID no. 4852507
aactagcaaaaaagatatacaaaacatttgtttaccctcatagagaaataagaaggatgaacacaacatcgtcaaagagcaagaagaagcaagaagagggtagtgcgaggtttcttggggtgagaaggaggccttggggaagatacgcggctgagattagagacccaacaaccaaggagcgtcactggcttggcacatttgatacggccgaggaagctgccttggcctacgatagagccgccaggtccatgcgtggcactcgtgcccgaaccaacttcgtctactcagacatgcctccttcatcctccgtcacctccattatttctcctgatgatccgcctccccctccacctcctactgcagctgctcctccttgttctaatgatcctgtggattacatggtgatgtttaaccaatattcatcaacagattcgctaatgctgcagcctcattctgatcaagtggagagtagttacatgtttggtggctcctcttcttgttattctaacagcagcagcgagttg

SEQ ID NO: 962 - protein, 156 aa, Brassica napus
  misc_feature (17)..(74): Pfam Name: AP2; Pfam Description: AP2 domain
  misc_feature (17)..(74): Pfam Name: AP2; Pfam Description: AP2 domain
  misc_feature: Utility: Useful for delaying flowering time
  misc_feature: Utility: Useful for increasing chlorophyll and photosynthetic capacity
  misc_feature: Utility: Useful for making plants with altered leaf shape eg curled leaves
  misc_feature: Utility: Useful for making plants with increased biomass and foliage
  misc_feature: Utility: Useful for making smaller plants
MNTTSSKSKKKQEEGSARFLGVRRRPWGRYAAEIRDPTTKERHWLGTFDTAEEAALAYDRAARSMRGTRARTNFVYSDMPPSSSVTSIISPDDPPPPPPPTAAAPPCSNDPVDYMVMFNQYSSTDSLMLQPHSDQVESSYMFGGSSSCYSNSSSEL

SEQ ID NO: 963 - DNA, 403 bp, Arabidopsis thaliana
  misc_feature (1)..(403): Ceres CLONE ID no. 38416
  misc_feature (1)..(403): Also known as  Ceres CDNA ID no. 23386006
aatttgcacccaatttcttcgaatcaacttatcaatggcctcatcagctgcgatgttcatgctccctcttcctctaactcagcagataacaacaaacaatactctgcagactacagccacaccggaaccgtcagcctccatagttaaatgcctttttccggcgagaaactcatcggaaagttctgctcgttcgaagtttagtctttggctatttggcaatcccgctacgtatgacaagaggttccaagaagctattgaacttagttgcttgtgatggagatttggagatttttcctagtctttttcttgtgttttttaaatggacatattgtaatttcttcccaagtctcaccctccgctgtaatttatctaataatcaattcgatcaaagatgttccgactg

SEQ ID NO: 964 - protein, 79 aa, Arabidopsis thaliana
  misc_feature: Utility: Useful for delaying senescence
  misc_feature: Utility: Useful for increasing chlorophyll and photosynthetic capacity
  misc_feature: Utility: Useful for making ornamental plants with modified flowers
  misc_feature: Utility: Useful for making plants sterile and for genetic confinement
  misc_feature: Utility: Useful for making smaller plants
  misc_feature: Utility: Useful for modifying plant structure, ie increased branching
MASSAAMFMLPLPLTQQITTNNTLQTTATPEPSASIVKCLFPARNSSESSARSKFSLWLFGNPATYDKRFQEAIELSCL

SEQ ID NO: 965 - DNA, 2019 bp, Arabidopsis thaliana
  misc_feature (1)..(2019): Ceres CLONE ID no. 99298
  misc_feature (1)..(2019): Also known as  Ceres CDNA ID no. 23363651
gtaaatcaaaagagaactaaaccaagaaacaaaatgggatacgaaaggctcggaccatccggagcaactggttcggtcaccacctccactactacagctccaatccttaaccaagtctccacgtcagaacaaccggagaacaacaaccgaagaagcaaaaagaagcttgtagtatcatctatcgtcttagccatctcacttatcctcgccgccgcgatcttcgccggagtcagatcacgtctcaagttaaaccaatcagtcccaggcctagctcgtaaaccgagtcaagcaatctctaaagcttgtgagttaactcgtttccccgagttatgcgttgactcactcatggactttcccggctcactcgccgcttcctcctctaaagatctcatccacgtgactgtgaacatgacgctccaccacttcagccacgctctctactcgtctgcttccctctccttcgtcgacatgccgccacgtgctcgctcagcttacgactcttgcgtcgagctacttgacgattccgttgacgcgctatcacgcgctctttcctccgtcgtatcctcctccgctaagccgcaagatgttacaacgtggcttagcgcggctttaacaaaccatgacacgtgtactgaaggattcgacggcgtcgacgacggtggagtgaaggatcatatgacggcggcgttacagaatctttctgagcttgttagtaactgtcttgctatattctcggcgagtcacgacggtgacgatttcgccggagttccaatacagaacaggaggctgctgggagtggaggaacgagaagagaaattcccgagatggatgagaccaaaagaacgcgagatactggaaatgccggtatctcagatacaagctgatattatcgtatcgaaagacggtaacggcacgtgcaaaactatatcggaagctatcaagaaagctcctcagaacagtactcgccggataattatctacgtcaaggccggaagatatgaagagaacaacctcaaggtcggtaggaaaaaaattaatttgatgttcgttggagatggcaagggtaaaactgttatttcgggaggcaaaagtatatttgacaacatcactactttccacacggcgtcatttgctgcgaccggagctggatttattgcaagggacatcacattcgaaaactgggccggtccagcgaagcaccaagccgtggctctccgcatcggagctgaccacgcagtgatctaccgatgcaatataatcggttaccaagacacactctacgtccattcaaaccgccaattctttcgtgaatgcgatatctacggtacagtcgattttatctttggtaacgcagccgtcgtactacaaaactgtagcatctacgcacggaagccaatggattttcagaaaaatacaatcacggctcaaaacagaaaagatccgaaccaaaacaccggaatatcaatacatgcgtctagggttcttgcagcatccgatctccaagcgacaaacggtagtacacagacgtatctaggccgaccttggaagctattctctaggacagtgtatatgatgtcgtatatcggtggtcatgtacacacgagaggttggctcgagtggaacacaacatttgctttagatactttgtattacggagagtatttgaacagtggacctgggtcgggtctcgggcaacgtgtgagctggccgggttatcgggtcatcaattcgacggccgaggcaaaccggttcactgtggcagaatttatatacggttcctcgtggttgccatcgaccggagtttcgttcttggccggattaagcatataggtagagaaaaaattgaaatgcttatttttccgatgaattgtttcattcttacggtccttatattaatggacatatcagtattccaatatatatgagtatattttaactttaattgtaatgtctccactctccagaggtattattcaataatagatgaacactcgaggataattttcccttgttttcttg

SEQ ID NO: 966 - protein, 598 aa, Arabidopsis thaliana
  misc_feature (81)..(232): Pfam Name: PMEI; Pfam Description: Plant invertase/pectin methylesterase inhibitor
  misc_feature (81)..(232): Pfam Name: PMEI; Pfam Description: Plant invertase/pectin methylesterase inhibitor
  misc_feature (284)..(583): Pfam Name: Pectinesterase; Pfam Description: Pectinesterase
  misc_feature (284)..(583): Pfam Name: Pectinesterase; Pfam Description: Pectinesterase
  misc_feature: Utility: Useful for delaying senescence
MGYERLGPSGATGSVTTSTTTAPILNQVSTSEQPENNNRRSKKKLVVSSIVLAISLILAAAIFAGVRSRLKLNQSVPGLARKPSQAISKACELTRFPELCVDSLMDFPGSLAASSSKDLIHVTVNMTLHHFSHALYSSASLSFVDMPPRARSAYDSCVELLDDSVDALSRALSSVVSSSAKPQDVTTWLSAALTNHDTCTEGFDGVDDGGVKDHMTAALQNLSELVSNCLAIFSASHDGDDFAGVPIQNRRLLGVEEREEKFPRWMRPKEREILEMPVSQIQADIIVSKDGNGTCKTISEAIKKAPQNSTRRIIIYVKAGRYEENNLKVGRKKINLMFVGDGKGKTVISGGKSIFDNITTFHTASFAATGAGFIARDITFENWAGPAKHQAVALRIGADHAVIYRCNIIGYQDTLYVHSNRQFFRECDIYGTVDFIFGNAAVVLQNCSIYARKPMDFQKNTITAQNRKDPNQNTGISIHASRVLAASDLQATNGSTQTYLGRPWKLFSRTVYMMSYIGGHVHTRGWLEWNTTFALDTLYYGEYLNSGPGSGLGQRVSWPGYRVINSTAEANRFTVAEFIYGSSWLPSTGVSFLAGLSI

SEQ ID NO: 967 - protein, 587 aa, Arabidopsis thaliana
  misc_feature (1)..(587): Public GI no. 15293287
  misc_feature: Utility: Useful for delaying senescence
MGYDRLGPSGPSNPNQKDPATSLPELQKKTKTKLILFTLAVLVVGVVCFGIFAGIRAVDSGKTEPKLTRKPTQAISRTCSKSLYPNLCIDTLLDFPGSLTADENELIHISFNATLQKFSKALYTSSTITYTQMPPRVRSAYDSCLELLDDSVDALTRALSSVVVVSGDESHSDVMTWLSSAMTNHDTCTDGFDEIEGQGGEVKDQVIGAVKDLSEMVSNCLAIFAGKVKDLSGVPVVNNRKLLGTEETEELPNWLKREDRELLGTPTSAIQADITVSKDGSGTFKTIAEAIKKAPEHSSRRFVIYVKAGRYEEENLKVGRKKTNLMFIGDGKGKTVITGGKSIADDLTTFHTATFAATGAGFIVRDMTFENYAGPAKHQAVALRVGGDHAVVYRCNIIGYQDALYVHSNRQFFRECEIYGTVDFIFGNAAVILQSCNIYARKPMAQQKITITAQNRKDPNQNTGISIHACKLLATPDLEASKGSYPTYLGRPWKLYSRVVYMMSDMGDHIDPRGWLEWNGPFALDSLYYGEYMNKGLGSGIGQRVKWPGYHVITSTVEASKFTVAQFISGSSWLPSTGVSFFSGLSQ

SEQ ID NO: 968 - protein, 584 aa, Arabidopsis thaliana
  misc_feature (1)..(584): Public GI no. 2098711
  misc_feature: Utility: Useful for delaying senescence
MTHIKEFFTKLSESSSNQNISNIPKKKKKLFLALFATLLVVAAVIGIVAGVNSRKNSGDNGNEPHHAILKSSCSSTRYPDLCFSAIAAVPEASKKVTSQKDVIEMSLNITTTAVEHNYFGIQKLLKRTNLTKREKVALHDCLETIDETLDELHKAVEDLEEYPNKKSLSQHADDLKTLMSAAMTNQGTCLDGFSHDDANKHVRDALSDGQVHVEKMCSNALAMIKNMTDTDMMIMRTSNNRKLTEETSTVDGWPAWLSPGDRRLLQSSSVTPNAVVAADGSGNFKTVAAAVAAAPQGGTKRYIIRIKAGVYRENVEVTKKHKNIMFIGDGRTRTIITGSRNVVDGSTTFKSATVAVVGEGFLARDITFQNTAGPSKHQAVALRVGADLSAFYNCDMLAYQDTLYVHSNRQFFVNCLIAGTVDFIFGNAAAVLQNCDIHARKPNSGQKNMVTAQGRTDPNQNTGIVIQKSRIGATSDLKPVQGSFPTYLGRPWKEYSRTVIMQSSITDLIHPAGWHEWDGNFALNTLFYGEHQNSGAGAGTSGRVKWKGFRVITSATEAQAFTPGSFIAGSSWLGSTGFPFSLGL

SEQ ID NO: 969 - protein, 584 aa, Arabidopsis thaliana
  misc_feature (1)..(584): Public GI no. 57014097
  misc_feature: Utility: Useful for delaying senescence
MTRIKEFFTKLSESSTNQNISNIPKKKKKLFLALFATLLVVAAVIGIVAGVNSRKNSGDNGNEPHHAILKSSCSSTRYPDLCFSAIAAVPEASKKVTSQKDVIEMSLNITTTAVEHNYFGIQKLLKRTNLTKREKVALHDCLETIDETLDELHKAVEDLEEYPNKKSLSQHADDLKTLMSAAMTNQGTCLDGFSHDDANKHVRDALSDGQVHVEKMCSNALAMIKNMTDTDMMIMRTSNNRKLIEETSTVDGWPAWLSTGDRRLLQSSSVTPNVVVAADGSGNFKTVAASVAAAPQGGTKRYIIRIKAGVYRENVEVTKKHKNIMFIGDGRTRTIITGSRNVVDGSTTFKSATVAVVGEGFLARDITFQNTAGPSKHQAVALRVGADLSAFYNCDMLAYQDTLYVHSNRQFFVNCLIAGTVDFIFGNAAAVLQNCDIHARKPNSGQKNMVTAQGRADPNQNTGIVIQKSRIGATSDLKPVQGSFPTYLGRPWKEYSRTVIMQSSITDVIHPAGWHEWDGNFALNTLFYGEHQNAGAGAGTSGRVKWKGFRVITSATEAQAFTPGSFIAGSSWLGSTGFPFSLGL

SEQ ID NO: 970 - protein, 579 aa, Arabidopsis thaliana
  misc_feature (1)..(579): Public GI no. 8671350
  misc_feature: Utility: Useful for delaying senescence
MLDSGKNVNFSKGKKKLFLTVVASVLLVAAVIGVVVGVKFRSNNSDDHADIQAITSAAHAIVKSACENTLHPELCYSTIASVSDFSKKVTSQKDVIELSLNITCRAVQHNFFKVEKLIKTRKGLKPREKVALHDCLETIDETLDELHTAIKDLELYPNKKSLKAHADDLKTLISSAITNQETCLDGFSHDDADKKVRKALLKGQKHVEKMCSNALAMICNMTDTDIANEQKLKGTTTNRKLREDNSEWPEWLSAGDRRLLQSSTVRPDVVVAADGSGNFKTVSEAVAKAPEKSSKRYVIRIKAGVYRENVDVPKKKTNIMFMGDGRSNTIITGSRNVKDGSTTFHSATVAAVGEKFLARDITFQNTAGAAKHQAVALRVGSDLSAFYRCDILAYQDSLYVHSNRQYFVQCLIAGTVDFIFGNAAAVLQNCDIHARRPGSGQKNMVTAQGRSDPNQNTGIVIQKCRIGATSDLRPVQKSFPTYLGRPWKEYSRTVIMQSSITDVINSAGWHEWNGNFALNTLFYGEYQNTGAGAGTSGRVKWKGFKVITSATEAQAYTPGRFIAGGSWLSSTGFPFSLGL

SEQ ID NO: 971 - protein, 579 aa, Arabidopsis thaliana
  misc_feature (1)..(579): Public GI no. 29602797
  misc_feature: Utility: Useful for delaying senescence
MLDSGKNVNFSKGKKKLFLTVVASVLLVAAVIGVVVGVKFRSNNSDDHADIQAITSAAHAIVKSACENTLHPELCYSTIASVSDFSKKVTSQKDVIELSLNITCRAVQHNFFKVEKLIKTRKGLKPREKVALHDCLETIDETLDELHTAIKDLELYPNKKSLKAHADGLKTLISSAITNQETCLDGFSHDDADKKVRKALLKGQKHVEKMCSNALAMICNMTDTDIANEQKLKGTTTNRKLREDNSEWPEWLPAGDRRLLQSSTVRPDVVVAADGSGNFKTVSEAVAKAPEKSSKRYVIRIKAGVYRENVDVPKKKTNIMFMGDGRSNTIITGSRNVKDGSTTFHSATVAAVGEKFLARDITFQNTAGAAKHQAVALRVGSDLSAFYRCDILAYQDSLYVHSNRQYFVQCLIAGTVDFIFGNAAAVLQDCDIHARRPGSGQKNMVTAQGRSDPNQNTGIVIQKCRIGATSDLRPVQKSFPMYLGRPWKEYSRTVIMQSSITDVINSAGWHEWNGNFALNTLFYGEYQNTGAGAGTSGRVKWKGFKVITSATEAQAYTPGRFIAGGSWLSSTGFPFSLGL

SEQ ID NO: 972 - protein, 584 aa, Arabidopsis thaliana
  misc_feature (1)..(584): Public GI no. 54303968
  misc_feature: Utility: Useful for delaying senescence
MNKIKQSLTRISNSNKKKLFFSLFTALLITASIIAISASVTSSQKTKTKNNIVSSSLSLSHHSHTIIKTACTTTLYPDLCFSAISSEPNITHKINNHKDVISLSLNITTRAVEHNFFTVENLLRRKNLSEREKIALHDCLETIDDTLDELKEAQRDLVLYPNKKTLYQHADDLKTLISAAITNQVTCLDGFSHDGADKQVRKVLEQGQVHVEHMCSNALAMTKNMTDKDIAKFEENNNKKNRKLLEEENGVNWPEWISAGDRRLLQGAAVKADVVVAADGSGNFKTVSEAVAGAPLKSSKRYVIKIKAGVYKENVEVPKKKSNIMFLGDGKKNTIITASRNVVDGSTTFHSATVAVVGGNFLARDITFQNTAGPSKHQAVALRVGGDLSAFYNCDIIAYQDTLYVHNNRQFFVNCFISGTVDFIFGNSAVVFQNCDIHARKPDSGQKNMVTAQGRVDPNQNTGIVIQKCRIGATKDLEGLKGTFPTYLGRPWKEYSRTVIMQSSISDVIDPIGWHEWNGNFALNTLVYREYQNTGPGAGTSKRVNWKGFKVITSASEAQTFTPGNFIGGSTWLGSTGFPFSLGL

SEQ ID NO: 973 - protein, 576 aa, Arabidopsis thaliana
  misc_feature (1)..(576): Public GI no. 6689892
  misc_feature: Utility: Useful for delaying senescence
MLDSGKQIDFSKRKKKIYLAIVASVLLVAAVIGVVAGVKSRSNNSDDDADIMAISSSAHAIVKSACSNTLHPELCYSAIVNVTDFSKKVTSQKDVIELSLNITVKAVRRNYYAVKELIKTRKGLTPREKVALHDCLETMDETLDELHTAVADLELYPNKKSLKEHAEDLKTLISSAITNQETCLDGFSHDEADKKVRKVLLKGQKHVEKMCSNALAMICNMTNTDIANEMKLSGSRKLVEDNGEWPEWLSAGDRRLLQSSTVTPDVVVAADGSGDYKTVSEAVAKAPEKSSKRYVIRIKAGVYRENVDVPKKKTNIMFMGDGRSNTIITASRNVQDGSTTFHSATVAAVGEKFLARDITFQNTAGASKHQAVALRVGSDLSAFYKCDILAYQDTLYVHSNRQFFVQCLVAGTVDFIFGNGAAVLQDCDIHARRPGSGQKNMVTAQGRTDPNQNTGIVIQKCRIGATSDLRPVQKSFPTYLGRPWKEYSRTVIMQSSITDVIQPAGWHEWNGNFALNTLFYGEYANTGAGAATSGRVKWKGHKVITSSTEAQAYTPGSFIAGGSWLSSTGFPFSLGL

SEQ ID NO: 974 - DNA, 1536 bp, Arabidopsis thaliana
  misc_feature (1)..(1536): Ceres CLONE ID no. 100245
  misc_feature (1)..(1536): Also known as  Ceres CDNA ID no. 23363741
aattaaccttccatcgtcatctctttcccttttttttcccactttctttgcgaatcgcgagatctcggaatcgcatccttgattttgggatactgtttttttttttttttaatcttgtttcattttcacgtgaaattcttagctgctagaactggacttgaatttcaacgagaattttggagattttttttttgtttgggtttttcctttctgttttgtgtgtttggaattagggttgtcgagcgagaatggacaagtacgagctggtgaaagacataggtgctgggaattttggagttgccaggctcatgaaggtcaaaaactctaaggaacttgttgccatgaagtacatcgagcgtggtcctaagattgatgagaatgtggcaagagagatcattaatcacagatcacttcgccatccgaatataatccggttcaaggaggtggtgttgactccaacccatcttgccattgccatggaatatgctgctggtggtgaactattcgagcgtatatgcagtgctggaagatttagtgaggatgaggcgagatatttcttccagcagcttatatcaggtgttagctattgccatgctatgcaaatatgccatagagatctgaagctcgagaatacgctcttggatggaagtcctgctccacgtctgaaaatctgtgattttggttattccaagtcctctctgctgcactctaggcccaaatcaacagttggaactccagcatatattgcacctgaggtcctttctcgaagagaatatgatggcaagatggctgatgtatggtcttgtggtgtgactctttatgtcatgctggttggagcatacccatttgaagaccaggaagaccccaagaacttcaggaaaacaatacaaaaaataatggctgtccagtacaagatcccggactacgtccatatctcacaggattgtaaaaatctcctttcccgtatatttgtcgccaattcactcaagaggatcaccattgcagaaatcaagaaacattcatggttcctaaagaatttgccaagggaactcacagagacagctcaagctgcatatttcaagaaagagaacccaaccttctcccttcagaccgttgaagagatcatgaagatagtggctgacgccaaaacaccgcctcctgtttcccgatccatcggaggttttggctggggaggaaatggggatgcagatggaaaagaggaagatgcagaagacgtggaggaggaagaggaggaggtggaagaagaggaagacgatgaggatgaatacgataagactgtaaaggaagtacacgcaagtggagaagtgagaataagttgatattttggtttttggtctgtgtaagaaagaagtcgtcgttggtttgttgaaactgaaaagtctctgttctcgtgtttgcctttacaatgctttggctaaggttttggttctggttttggagatttgtaaaatttgcagtataagatgaacaaacagagaggttgatgatgagaatgagtcctttgctacgcatggt

SEQ ID NO: 975 - protein, 363 aa, Arabidopsis thaliana
  misc_feature (4)..(260): Pfam Name: Pkinase; Pfam Description: Protein kinase domain
  misc_feature (4)..(261): Pfam Name: Pkinase_Tyr; Pfam Description: Protein tyrosine kinase
  misc_feature: Utility: Useful for delaying senescence
  misc_feature: Utility: Useful for making plants sterile and for genetic confinement
  misc_feature: Utility: Useful for making smaller plants
  misc_feature: Utility: Useful for modifying fruit shape, composition and seed yield
MDKYELVKDIGAGNFGVARLMKVKNSKELVAMKYIERGPKIDENVAREIINHRSLRHPNIIRFKEVVLTPTHLAIAMEYAAGGELFERICSAGRFSEDEARYFFQQLISGVSYCHAMQICHRDLKLENTLLDGSPAPRLKICDFGYSKSSLLHSRPKSTVGTPAYIAPEVLSRREYDGKMADVWSCGVTLYVMLVGAYPFEDQEDPKNFRKTIQKIMAVQYKIPDYVHISQDCKNLLSRIFVANSLKRITIAEIKKHSWFLKNLPRELTETAQAAYFKKENPTFSLQTVEEIMKIVADAKTPPPVSRSIGGFGWGGNGDADGKEEDAEDVEEEEEEVEEEEDDEDEYDKTVKEVHASGEVRIS

SEQ ID NO: 976 - protein, 339 aa, Brassica napus
  misc_feature (1)..(339): Ceres CLONE ID no. 1099630
  misc_feature: Utility: Useful for delaying senescence
  misc_feature: Utility: Useful for making plants sterile and for genetic confinement
  misc_feature: Utility: Useful for making smaller plants
  misc_feature: Utility: Useful for modifying fruit shape, composition and seed yield
MKVKDSKELVAMKYIERGPKIDENVAREIYNHRSLRHPNIIRFKEVVLTPTHLAIAMEYAAGGELFERICGAGRFSEDEARYFFQQLISGVSYCHAMQICHRDLKLENTLLDGSPAPRLKICDFGYSKSSLLHSRPKSTVGTPAYIAPEVLSRREYDGKMADVWSCGVTLYVMLVGAYPFEDQEDPKNFRKTIQKIMAVQYKIPDYVHISQDCKHLLSRIFVANSLKRITIAEIKKHPWFTKNLPRELTETAQAAYFKKENPTFSAQTAEEIMKIVDDAKTPPPVSRSIGGFGWGGEGDLEGKEEEEVDEEEVEEEEDEEDEYDKTVKEVHASGEVRIS

SEQ ID NO: 977 - protein, 341 aa, Arabidopsis thaliana
  misc_feature (1)..(341): Ceres CLONE ID no. 95559
  misc_feature: Utility: Useful for delaying senescence
  misc_feature: Utility: Useful for making plants sterile and for genetic confinement
  misc_feature: Utility: Useful for making smaller plants
  misc_feature: Utility: Useful for modifying fruit shape, composition and seed yield
MRVKNSKELVAMKYIERGPKIDENVAREIINHRSLRHPNIIRFKEVVLTPTHIAIAMEYAAGGELFERICSAGRFSEDEARYFFQQLISGVSYCHAMQICHRDLKLENTLLDGSPAPRLKICDFGYSKSSLLHSMPKSTVGTPAYIAPEVLSRGEYDGKMADVWSCGVTLYVMLVGAYPFEDQEDPKNFKKTIQRIMAVKYKIPDYVHISQDCKHLLSRIFVTNSNKRITIADIKKHPWFLKNLPRELTEIAQAAYFRKENPTFSLQSVEEIMKIVEEAKTPARVSRSIGAFGWGGGEDAEGKEEDAEEEVEEVEEEEDEEDEYDKTVKQVHASMGEVRVS

SEQ ID NO: 978 - protein, 341 aa, Arabidopsis thaliana
  misc_feature (1)..(341): Ceres CLONE ID no. 260333
  misc_feature: Utility: Useful for delaying senescence
  misc_feature: Utility: Useful for making plants sterile and for genetic confinement
  misc_feature: Utility: Useful for making smaller plants
  misc_feature: Utility: Useful for modifying fruit shape, composition and seed yield
MRVKNSKELVAMKYIERGPKIDENVAREIINHRSLRHPNIIRFKEVVLTPTHIAIAMEYAAGGELFERICSAGRFSEDEARYFFQQLISGVSYCHAMQICHRDLKLENTLLDGSPAPRLKICDFGYSKSSLLHSMPKSTVGTPAYIAPEVLSRGEYDGKMADVWSCGVTLYVMLVGAYPFEDQEDPKNFKKTIQRIMAVKYKIPDYVHISQDCKHLLSRIFVTNSNKRITIGDIKKHPWFLKNLPRELTEIAQAAYFRKENPTFSLQSVEEIMKIVEEAKTPARVSRSIGAFGWGGGEDAEGKEEDAEEEVEEVEEEEDEEDEYDKTVKQVHASMGEVRVS

SEQ ID NO: 979 - protein, 331 aa, Glycine max
  misc_feature (1)..(331): Ceres CLONE ID no. 591143
  misc_feature: Utility: Useful for delaying senescence
  misc_feature: Utility: Useful for making plants sterile and for genetic confinement
  misc_feature: Utility: Useful for making smaller plants
  misc_feature: Utility: Useful for modifying fruit shape, composition and seed yield
MRNKETKELVAMKYIERGQKIDENVAREIINHRSLRHPNIIRFKEVVLTPTHLAIVMEYAAGGELFERICNAGRFSEDEARYFFQQLISGVHYCHAMQICHRDLKLENTLLDGSPAPRLKICDFGYSKSSLLHSRPKSTVGTPAYIAPEVLSRREYDGKLADVWSCGVTLYVMLVGAYPFEDQDDPRNFRKTIQRIMAVQYKIPDYVHISQDCRHLLSRIFVANPLRRISLKEIKSHPWFLKNLPRELTESAQAVYYQRGNPSFSIQSVEEIMKIVGEARDPPPVSRPVKGFGWDGEEDEGEEDVEEEEDEEDEYDKRVKEVHASGEFQIS

SEQ ID NO: 980 - protein, 352 aa, Glycine max
  misc_feature (1)..(352): Ceres CLONE ID no. 623826
  misc_feature: Utility: Useful for delaying senescence
  misc_feature: Utility: Useful for making plants sterile and for genetic confinement
  misc_feature: Utility: Useful for making smaller plants
  misc_feature: Utility: Useful for modifying fruit shape, composition and seed yield
MEKYELVKDIGSGNFGVARLMRHKDTKELVAMKYIERGHKIDENVAREIINHRSLRHPNIIRFKEVVLTPTHLGIVMEYAAGGELFERICSAGRFSEDEARYFFQQLISGVSYCHSMQICHRDLKLENTLLDGSPAPRLKICDFGYSKSSLLHSRPKSTVGTPAYIAPEVLSRREYDGKLADVWSCGVTLYVMLVGAYPFEDQEDPKNFRKTINRIMAVQYKIPDYVHISQDCRHLLSRIFVANPARRITIKEIKSHPWFVKNLPRELTEVAQAAYYRKENPTFSLQSIEDIMNIVEEAKAPPPASRSIGGFGWGGEEEEEDETKEAVAETEEDEYEKRVKEAQASGEFHVS

SEQ ID NO: 981 - protein, 329 aa, Glycine max
  misc_feature (1)..(329): Ceres CLONE ID no. 1100861
  misc_feature: Utility: Useful for delaying senescence
  misc_feature: Utility: Useful for making plants sterile and for genetic confinement
  misc_feature: Utility: Useful for making smaller plants
  misc_feature: Utility: Useful for modifying fruit shape, composition and seed yield
MRNKVTKELVAMKYIERGPKIDENVAREIMNHRSLRHPNIIRYKEVVLTPTHLAIVMEYAAGGELFERICSAGRFSEDEARYFFQQLISGVHFCHTMQICHRDLKLENTLLDGSPAPRLKICDFGYSKSSLLHSRPKSTVGTPAYIAPEVLSRREYDGKLADVWSCAVTLYVMLVGAYPFEDQDDPRNFRKTIQRIMAVQYKIPDYVHISQDCRHLLSRIFVANPLRRITIKEIKNHPWFLRNLPRELTESAQAIYYQRDSPNFHLQSVDEIMKIVGEARNPPPVSRALKGFGWEGEEDLDEEVEEEEDEDEYDKRVKEVHASGEFQIS

SEQ ID NO: 982 - protein, 356 aa, Zea mays
  misc_feature (1)..(356): Ceres CLONE ID no. 288489
  misc_feature: Utility: Useful for delaying senescence
  misc_feature: Utility: Useful for making plants sterile and for genetic confinement
  misc_feature: Utility: Useful for making smaller plants
  misc_feature: Utility: Useful for modifying fruit shape, composition and seed yield
MEKYELLKDIGAGNFGVARLMRNKETKELVAMKYIPRGQKIDENVAREIINHRSLRHPNIIRFKEVVLTPTHLAIVMEYAAGGELFDRICNAGRFSEDEARYFFQQLICGVSYCHSMQICHRDLKLENTLLDGSPAPRLKICDFGYSKSSLLHSKPKSTVGTPAYIAPEVLSRREYDGKTADVWSCGVTLYVMLVGGYPFEDPDDPKNFRKTIGRIMSIQYKIPEYVHVSQDCKELLSRIFVANSAKRITIREIRNHPWFLKNLPRELTEAAQAMYYKKDNSAPTYSVQSVEEIMKIVEKARTPPPSSTPVAGFGWAEEDEQEDSKEPDEEHEDGEDEYEKQVKQVHASGEFHLSC

SEQ ID NO: 983 - protein, 356 aa, Zea mays; identical to SEQ ID NO: 982
  misc_feature (1)..(356): Ceres CLONE ID no. 240283
  misc_feature: Utility: Useful for delaying senescence
  misc_feature: Utility: Useful for making plants sterile and for genetic confinement
  misc_feature: Utility: Useful for making smaller plants
  misc_feature: Utility: Useful for modifying fruit shape, composition and seed yield

SEQ ID NO: 984 - protein, 322 aa, Arabidopsis thaliana
  misc_feature (1)..(322): Ceres CLONE ID no. 31041
  misc_feature: Utility: Useful for delaying senescence
  misc_feature: Utility: Useful for making plants sterile and for genetic confinement
  misc_feature: Utility: Useful for making smaller plants
  misc_feature: Utility: Useful for modifying fruit shape, composition and seed yield
MKYIERGRKIDENVAREIINHRSLKHPNIIRFKEVILTPTHLAIVMEYASGGELFDRICTAGRFSEAEARYFFQQLICGVDYCHSLQICHRDLKLENTLLDGSPAPLLKICDFGYSKSSILHSRPKSTVGTPAYIAPEVLSRREYDGKHADVWSCGVTLYVMLVGAYPFEDPNDPKNFRKTIQRIMAVQYKIPDYVHISQECKHLLSRIFVTNSAKRITLKEIKNHPWYLKNLPKELLESAQAAYYKRDTSFSLQSVEDIMKIVGEARNPAPSTSAVKSSGSGADEEEEEDVEAEVEEEEDDEDEYEKHVKEAQSCQESDKA

SEQ ID NO: 985 - protein, 327 aa, Arabidopsis thaliana
  misc_feature (1)..(327): Ceres CLONE ID no. 39888
  misc_feature: Utility: Useful for delaying senescence
  misc_feature: Utility: Useful for making plants sterile and for genetic confinement
  misc_feature: Utility: Useful for making smaller plants
  misc_feature: Utility: Useful for modifying fruit shape, composition and seed yield
MKYIERGRKIDENVAREIINHRSLRHPNIIRFKEVILTPTHLAIVMEYASGGELFERICNAGRFSEAEARYFFQQLICGVDYCHSLQICHRDLKLENTLLDGSPAPLLKICDFGYSKSSLLHSRPKSTVGTPAYIAPEVLSRREYDGKHADVWSCGVTLYVMLVGGYPFEDPDDPRNFRKTIQRIMAVQYKIPDYVHISQECRHLLSRIFVTNSAKRITLKEIKKHPWYLKNLPKELTEPAQAAYYKRETPSFSLQSVEDIMKIVGEARNPAPSSNAVKGFDDDEEDVEDEVEEEEEEEEEEEEEEEEDEYEKHVKEAHSCQEPPKA

SEQ ID NO: 986 - protein, 344 aa, Zea mays
  misc_feature (1)..(344): Ceres CLONE ID no. 237589
  misc_feature: Utility: Useful for delaying senescence
  misc_feature: Utility: Useful for making plants sterile and for genetic confinement
  misc_feature: Utility: Useful for making smaller plants
  misc_feature: Utility: Useful for modifying fruit shape, composition and seed yield
MRNKDTKELVAMKYIPRGLKIDENVAREIINHRSLRHPNIIRFKEVVLTPTHLAIVMEYAAGGELFDRICSAGRFSEDEARYFFQQLICGVSYCHFMQICHRDLKLENTLLDGSPAPRLKICDFGYSKSSLLHSKPKSTVGTPAYIAPEVLSRREYDGKMADVWSCGVTLYVMLVGAYPFEDPDDPKNFRKTIGRIVSIQYQIPEYVHLSQDCRQLLARIFVANPAKRITIREIRNHPWFLKNLPRELTEAAQAKYYKKDNGAPTFSDQTVEEIMKIVEEARTPPQSPAPVAGFGWAEEEEQEDGKKPEDDEQDGEDEQYDGEDEYDKQVKQVHASGDFRHLIK

SEQ ID NO: 987 - protein, 339 aa, Glycine max
  misc_feature (1)..(339): Ceres CLONE ID no. 515236
  misc_feature: Utility: Useful for delaying senescence
  misc_feature: Utility: Useful for making plants sterile and for genetic confinement
  misc_feature: Utility: Useful for making smaller plants
  misc_feature: Utility: Useful for modifying fruit shape, composition and seed yield
MDERYETLKELGSGNFGVARLAKDKETGELVAIKYIERGKKIDANVQREIVNHRSLRHPNIIRFKEVFLTPTHLAIVLEYAAGGELFERICNAGRLSEDEARFFFQQLISGVSYCHSMQICHRDLKLENTLLDGNPAPRLKICDFGFSKSALLHSQPKSTVGTPAYIAPEVLSRKEYDGKVADVWSCGVTLYVMLVGAYPFEDPEDPKNFRKSIGRIMSVQYAIPDYVRVSKECRHLISRIFVANPAKRINISEIKQHLWFRKNLPREIIEAERRGYEETQKDQPSQSVEEIMQIIQEARTKIHTGEQAGTGTSDVVRGDEANEEVDINDHFAKYLTLD

SEQ ID NO: 988 - protein, 216 aa, Zea mays
  misc_feature (1)..(216): Ceres CLONE ID no. 679007
  misc_feature: Utility: Useful for delaying senescence
  misc_feature: Utility: Useful for making plants sterile and for genetic confinement
  misc_feature: Utility: Useful for making smaller plants
  misc_feature: Utility: Useful for modifying fruit shape, composition and seed yield
MEICHRDLKLENTLLDGSPTPRVKICDFGYSKSALLHSKPKSTVGTPAYIAPEVLSRKEYDGKVADVWSCGVTLYVMLVGSYPFEDPEDPRNFRKTISRILGVQYSIPDYVRVSSDCRRLLSQIFVADPSKRITIPEIKHHPWFLKNLPREISEREKANYKDADAAEPAQAVDEIMRIVEEAKTPGDMSKVVDPALLAEMAELESDEEEADADDTY

SEQ ID NO: 989 - DNA, 611 bp, Arabidopsis thaliana
  misc_feature (1)..(611): Ceres CLONE ID no. 101798
  misc_feature (1)..(611): Also known as  Ceres CDNA ID no. 23372982
atatccaacaaaaaaacataagctaagaaaacgaaactcaactaattttgttatcacccaaaaagaagttcaaacacaatggctttcgctttgaggttcttcacatgccttgttttaacggtgtgcatagttgcatcagtcgatgctgcaatctcatgtggcacagtggcaggtagcttggctccatgtgcaacctatctatcaaaaggtgggttggtgccaccttcatgttgtgcaggagtcaaaactttgaacagtatggctaaaaccacaccagaccgccaacaagcttgcagatgcatccagtccactgcgaagagcatttctggtctcaacccaagtctagcctctggccttcctggaaagtgcggtgttagcattccatatccaatctccatgagcactaactgcaacaacatcaagtgaaatggaagcttacgtcgccgttttggcgttaagagtatggtttaccagaagtactagaataaaatacggctatatatcttagctgatattaccatgtatttgtttttgtctcaatgctttgtcttattttcatatcatatgttgtattgatgtgctaaaactatgataatagtaccttattagtc

SEQ ID NO: 990 - protein, 115 aa, Arabidopsis thaliana
  misc_feature (27)..(111): Pfam Name: Tryp_alpha_amyl; Pfam Description: Protease inhibitor/seed storage/LTP family
  misc_feature: Utility: Useful for delaying senescence
  misc_feature: Utility: Useful for making plants sterile and for genetic confinement
  misc_feature: Utility: Useful for making smaller plants
MAFALRFFTCLVLTVCIVASVDAAISCGTVAGSLAPCATYLSKGGLVPPSCCAGVKTLNSMAKTTPDRQQACRCIQSTAKSISGLNPSLASGLPGKCGVSIPYPISMSTNCNNIK

SEQ ID NO: 991 - protein, 96 aa, Arabidopsis thaliana
  misc_feature (1)..(96): Ceres CLONE ID no. 43057
  misc_feature: Utility: Useful for delaying senescence
  misc_feature: Utility: Useful for making plants sterile and for genetic confinement
  misc_feature: Utility: Useful for making smaller plants
  misc_feature (86)..(86): Xaa is any aa, unknown, or other
MAFALRFFTCFVLTVFIVASVDAAITCGTVASSLSPCLGYLSKGGVVPPPCCAGVKKLNGMAQTTPDRQQACRCLQSAAKGVNPSXSLWPSWKVRC

SEQ ID NO: 992 - protein, 112 aa, Brassica napus
  misc_feature (1)..(112): Ceres CLONE ID no. 1084610
  misc_feature: Utility: Useful for delaying senescence
  misc_feature: Utility: Useful for making plants sterile and for genetic confinement
  misc_feature: Utility: Useful for making smaller plants
  misc_feature (35)..(35): Xaa is any aa, unknown, or other
  misc_feature (105)..(105): Xaa is any aa, unknown, or other
MASALSFFTCLVLTVCIVASVDAAISCGTVTSNLXPCAGYLMKGGPVPASCCAGVSKLNSMAKTTPDRQQACKCLKTAAKSVNPSLASSLPGKCGVSIPYPISMXTNCNTVK

SEQ ID NO: 993 - protein, 130 aa, Brassica napus
  misc_feature (1)..(130): Ceres CLONE ID no. 1256733
  misc_feature: Utility: Useful for delaying senescence
  misc_feature: Utility: Useful for making plants sterile and for genetic confinement
  misc_feature: Utility: Useful for making smaller plants
  misc_feature (7)..(7): Xaa is any aa, unknown, or other
  misc_feature (9)..(9): Xaa is any aa, unknown, or other
MLSCIFXMXLDKREKQKTMASALSFFTCLVLTVCIVASVDAAISCGTVTSNLAPCAVYLMKGGPVPAPCCAGVSKLNSMAKTTPDRQQACKCLKTAAKNVNPSLASSLPGKCGVSIPYPISMSTNCDTVK

SEQ ID NO: 994 - protein, 113 aa, Parthenium argentatum
  misc_feature (1)..(113): Ceres CLONE ID no. 1606591
  misc_feature: Utility: Useful for delaying senescence
  misc_feature: Utility: Useful for making plants sterile and for genetic confinement
  misc_feature: Utility: Useful for making smaller plants
MAMMVLCAIVTCMVVVAPYAEAISCGQVSGSLAPCIGYLTRGGGVPSACCNGVRGLNNAARTTPDRQTACNCLKSAYKSIRGINGGNAASLPGKCGVSIPYKISPNTDCTKVR

SEQ ID NO: 995 - protein, 113 aa, Parthenium argentatum; identical to SEQ ID NO: 994
  misc_feature (1)..(113): Ceres CLONE ID no. 1610037
  misc_feature: Utility: Useful for delaying senescence
  misc_feature: Utility: Useful for making plants sterile and for genetic confinement
  misc_feature: Utility: Useful for making smaller plants

SEQ ID NO: 996 - protein, 118 aa, Glycine max
  misc_feature (1)..(118): Ceres CLONE ID no. 473005
  misc_feature: Utility: Useful for delaying senescence
  misc_feature: Utility: Useful for making plants sterile and for genetic confinement
  misc_feature: Utility: Useful for making smaller plants
MASLKVAFLAAVLCMVVVSAPMAHAAITCGQVTNSLINCIGYLQNGGTPPSGCCNGVKSLNAAAKTTADRQTACNCLKSAASQISGFKANNAASLPGKCGVSIPYKISTSTNCATIKV

SEQ ID NO: 997 - protein, 118 aa, Glycine max; identical to SEQ ID NO: 996
  misc_feature (1)..(118): Ceres CLONE ID no. 745591
  misc_feature: Utility: Useful for delaying senescence
  misc_feature: Utility: Useful for making plants sterile and for genetic confinement
  misc_feature: Utility: Useful for making smaller plants

SEQ ID NO: 998 - protein, 115 aa, Triticum aestivum
  misc_feature (1)..(115): Ceres CLONE ID no. 618028
  misc_feature: Utility: Useful for delaying senescence
  misc_feature: Utility: Useful for making plants sterile and for genetic confinement
  misc_feature: Utility: Useful for making smaller plants
MARTAATKLVLVALVAAMLLVASDAAISCGQVNSALASCVSYAKGSGASPPGACCSGVRRLAGLARSTADKQAACRCIKSAAGGLNPGKAASIPSKCGVSIPYSISASVDCSKIH

SEQ ID NO: 999 - protein, 101 aa, Triticum aestivum
  misc_feature (1)..(101): Ceres CLONE ID no. 770864
  misc_feature: Utility: Useful for delaying senescence
  misc_feature: Utility: Useful for making plants sterile and for genetic confinement
  misc_feature: Utility: Useful for making smaller plants
MAGREASAALSCGQVDSKLAPCVAYVTGRASSISKECCSGVQGLNGLARSSPDRKIACRCLKSLATSIKSINMGKVSGVPGKCGVSVPFPISMSTNCNNVN

SEQ ID NO: 1000 - protein, 102 aa, Triticum aestivum
  misc_feature (1)..(102): Ceres CLONE ID no. 1017382
  misc_feature: Utility: Useful for delaying senescence
  misc_feature: Utility: Useful for making plants sterile and for genetic confinement
  misc_feature: Utility: Useful for making smaller plants
MMAGREASAALSCGQVDSKLAPCVAYVTGRASSISKECCSGVQGLNGLARSSPDRKIACRCLKSLATSIKSINMGKVSGVPGKCGVSVPFPISMSTNCNNVN

SEQ ID NO: 1001 - protein, 101 aa, Triticum aestivum
  misc_feature (1)..(101): Ceres CLONE ID no. 775154
  misc_feature: Utility: Useful for delaying senescence
  misc_feature: Utility: Useful for making plants sterile and for genetic confinement
  misc_feature: Utility: Useful for making smaller plants
  misc_feature (17)..(17): Xaa is any aa, unknown, or other
  misc_feature (44)..(44): Xaa is any aa, unknown, or other
  misc_feature (60)..(60): Xaa is any aa, unknown, or other
  misc_feature (76)..(76): Xaa is any aa, unknown, or other
MMAGREATALSCGQVDXKLAPCVSYVTGKAPSISKECCSGVQGXNGLARSSPDRKIACRXLKSLATSIKSINMDKXSGVPGKCGVSVPFPISMSTNCNNVN

SEQ ID NO: 1002 - protein, 105 aa, Glycine max
  misc_feature (1)..(105): Ceres CLONE ID no. 589684
  misc_feature: Utility: Useful for delaying senescence
  misc_feature: Utility: Useful for making plants sterile and for genetic confinement
  misc_feature: Utility: Useful for making smaller plants
MVVVITAPMTNAITCGEVARSLSPCINYLRSRRGGSPEAECCRGVTSLNRAASNTADRRTACNCLKSVAASISGLNANNAASLPGRCRVRVPYRISTSTNCNRIR

SEQ ID NO: 1003 - protein, 122 aa, Zea mays
  misc_feature (1)..(122): Ceres CLONE ID no. 325450
  misc_feature: Utility: Useful for delaying senescence
  misc_feature: Utility: Useful for making plants sterile and for genetic confinement
  misc_feature: Utility: Useful for making smaller plants
MAAVLNSRKTPQVVAVLVAAALLASSASAAITCGQVGSSLAPCIPYATGRASALPASCCSGVKSLNSAARTSADRQAACRCLKSLANSVKSVNMGTVATIPGKCGVSVGFPISMSTDCNKIS

SEQ ID NO: 1004 - protein, 118 aa, Glycine max
  misc_feature (1)..(118): Ceres CLONE ID no. 481690
  misc_feature: Utility: Useful for delaying senescence
  misc_feature: Utility: Useful for making plants sterile and for genetic confinement
  misc_feature: Utility: Useful for making smaller plants
MKVTSCMVAVLMVSFGHIIPLAEAEIPCGRVQITVAPCIGYLRGPGGGVPAACCNGVRSINKEAKTTPDRQGVCRCLKTTALSLPGLNLATLAALPSKCGVNLPYKISPTIDCNTVKH

SEQ ID NO: 1005 - DNA, 1363 bp, Arabidopsis thaliana
  misc_feature (1)..(1363): Ceres CLONE ID no. 38370
  misc_feature (1)..(1363): Also known as  Ceres CDNA ID no. 23377443
aaatacacctaacttgtttagtacacaacagcaacatcaaactctaataaacccaagttggtgtatactataatggtgatggctggtgcttcttctttggatgagatcagacaggctcagagagctgatggacctgcaggcatcttggctattggcactgctaaccctgagaaccatgtgcttcaggcggagtatcctgactactacttccgcatcaccaacagtgaacacatgaccgacctcaaggagaagttcaagcgcatgtgcgacaagtcgacaattcggaaacgtcacatgcatctgacggaggaattcctcaaggaaaacccacacatgtgtgcttacatggctccttctctggacaccagacaggacatcgtggtggtcgaagtccctaagctaggcaaagaagcggcagtgaaggccatcaaggagtggggccagcccaagtcaaagatcactcatgtcgtcttctgcactacctccggcgtcgacatgcctggtgctgactaccagctcaccaagcttcttggtctccgtccttccgtcaagcgtctcatgatgtaccagcaaggttgcttcgccggcggtactgtcctccgtatcgctaaggatctcgccgagaacaaccgtggagcacgtgtcctcgttgtctgctctgagatcacagccgttaccttccgtggtccctctgacacccaccttgactccctcgtcggtcaggctcttttcagtgatggcgccgccgcactcattgtggggtcggaccctgacacatctgtcggagagaaacccatctttgagatggtgtctgccgctcagaccatccttccagactctgatggtgccatagacggacatttgagggaagttggtctcaccttccatctcctcaaggatgttcccggcctcatctccaagaacattgtgaagagtctagacgaagcgtttaaacctttggggataagtgactggaactccctcttctggatagcccaccctggaggtccagcgatcctagaccaggtggagataaagctaggactaaaggaagagaagatgagggcgacacgtcacgtgttgagcgagtatggaaacatgtcgagcgcgtgcgttctcttcatactagacgagatgaggaggaagtcagctaaggatggtgtggccacgacaggagaagggttggagtggggtgtcttgtttggtttcggaccaggtctcactgttgagacagtcgtcttgcacagcgttcctctctaaacagaacgcttgccttctatctgcctacctacctacgcaaaactttaatcctgtcttatgttttatataatataatcattatatgtttacgcaataattaagg

SEQ ID NO: 1006 - protein, 395 aa, Arabidopsis thaliana
  misc_feature (7)..(233): Pfam Name: Chal_sti_synt_N; Pfam Description: Chalcone and stilbene synthases, N-terminal domain
  misc_feature (244)..(394): Pfam Name: Chal_sti_synt_C; Pfam Description: Chalcone and stilbene synthases, C-terminal domain
  misc_feature (7)..(233): Pfam Name: Chal_sti_synt_N; Pfam Description: Chalcone and stilbene synthases, N-terminal domain
  misc_feature (244)..(394): Pfam Name: Chal_sti_synt_C; Pfam Description: Chalcone and stilbene synthases, C-terminal domain
  misc_feature: Utility: Useful for increasing chlorophyll and photosynthetic capacity
  misc_feature: Utility: Useful for making ornamental plants with modified flowers
  misc_feature: Utility: Useful for making plants sterile and for genetic confinement
  misc_feature: Utility: Useful for making smaller plants
  misc_feature: Utility: Useful for making stronger plants
  misc_feature: Utility: Useful for modifying fiber content in seed
MVMAGASSLDEIRQAQRADGPAGILAIGTANPENHVLQAEYPDYYFRITNSEHMTDLKEKFKRMCDKSTIRKRHMHLTEEFLKENPHMCAYMAPSLDTRQDIVVVEVPKLGKEAAVKAIKEWGQPKSKITHVVFCTTSGVDMPGADYQLTKLLGLRPSVKRLMMYQQGCFAGGTVLRIAKDLAENNRGARVLVVCSEITAVTFRGPSDTHLDSLVGQALFSDGAAALIVGSDPDTSVGEKPIFEMVSAAQTILPDSDGAIDGHLREVGLTFHLLKDVPGLISKNIVKSLDEAFKPLGISDWNSLFWIAHPGGPAILDQVEIKLGLKEEKMRATRHVLSEYGNMSSACVLFILDEMRRKSAKDGVATTGEGLEWGVLFGFGPGLTVETVVLHSVPL

SEQ ID NO: 1007 - protein, 392 aa, Brassica napus
  misc_feature (1)..(392): Ceres CLONE ID no. 1091268
  misc_feature: Utility: Useful for increasing chlorophyll and photosynthetic capacity
  misc_feature: Utility: Useful for making ornamental plants with modified flowers
  misc_feature: Utility: Useful for making plants sterile and for genetic confinement
  misc_feature: Utility: Useful for making smaller plants
  misc_feature: Utility: Useful for making stronger plants
  misc_feature: Utility: Useful for modifying fiber content in seed
MGPSSLDEIRKAQRADGPAGILAIGTANPANHVLQAEYPDYYFRITNSEHMTDLKEKFKRMCDKSTIRKRHMHLTEEFLKENPNMCAYMAPSLDARQDLVVVEVPKLGKDAAVKAIKEWGQPKSKITHVVFCTTSGVDMPGADYQLTKLLGLRPSVKRLMMYQQGCFAGGTVLRLAKDLAENNRGARVLVVCSEITAVTFRGPSDTHLVSLVGQALFSDGAAALIVGSDPDVSAGEKPIFQMVSAAQTILPDSDGAIDGHLREVGLTFHLLKDVPGLISKNIEKSLDEAFKPLGISDWNSLFWIAHPGGPAILDDVEKKLGLKAEKMRATRHVLSEYGNMSSACVLFILDEMRRKSKEDGVATTGEGLEWGVLFGFGPGLTVETVVLHSVPL

SEQ ID NO: 1008 - protein, 211 aa, Parthenium argentatum
  misc_feature (1)..(211): Ceres CLONE ID no. 1604873
  misc_feature: Utility: Useful for increasing chlorophyll and photosynthetic capacity
  misc_feature: Utility: Useful for making ornamental plants with modified flowers
  misc_feature: Utility: Useful for making plants sterile and for genetic confinement
  misc_feature: Utility: Useful for making smaller plants
  misc_feature: Utility: Useful for making stronger plants
  misc_feature: Utility: Useful for modifying fiber content in seed
MASSIDIAAIREAQRARGPATILAIGTATPSNCVYQANYPDYYFRITKSEHMVDLKEKFKRMCDKSMIRKRYMHLTEEYLKENPNICEYMAPSLDARQDVVVVEVPKLGKEAAVKAIKEWGKPKSQITHLIFCTTSGVDMPGADYQLTKLLGLRPSVKRFMMYQQGCFAGGTVLRMAKDLAENTRAHASLLCALRSLRSRFVDRVILTLTP

SEQ ID NO: 1009 - protein, 252 aa, Triticum aestivum
  misc_feature (1)..(252): Ceres CLONE ID no. 615767
  misc_feature: Utility: Useful for increasing chlorophyll and photosynthetic capacity
  misc_feature: Utility: Useful for making ornamental plants with modified flowers
  misc_feature: Utility: Useful for making plants sterile and for genetic confinement
  misc_feature: Utility: Useful for making smaller plants
  misc_feature: Utility: Useful for making stronger plants
  misc_feature: Utility: Useful for modifying fiber content in seed
MASSTVCEIRRLQRADGPALVLAIGTANPPNHLSQEEYLEYYFRATKSEHLTDLKREFKSICDRTGTEKRFFHHTQELLDAHPRFFDGGHDRLEIAAAVAPDLAALAAAKAITKWGRPATDITHLIVSTNSCARAPGADLRIASLLGLRPSVVCTLLQINGCSAGSASLRLAKDIAENNRGARVLVVCVELSVAALRGPEENYPHTLISQAIFSDGAGAVIIGADTVHPLERPLFEMVSASQIVIPGTDHLP

SEQ ID NO: 1010 - protein, 369 aa, Triticum aestivum
  misc_feature (1)..(369): Ceres CLONE ID no. 764645
  misc_feature: Utility: Useful for increasing chlorophyll and photosynthetic capacity
  misc_feature: Utility: Useful for making ornamental plants with modified flowers
  misc_feature: Utility: Useful for making plants sterile and for genetic confinement
  misc_feature: Utility: Useful for making smaller plants
  misc_feature: Utility: Useful for making stronger plants
  misc_feature: Utility: Useful for modifying fiber content in seed
MLAIGTANPPHCVPQEDYPDYYFGVTKSDHLTDLKRTFAKLCGMTGIGRRFFHHTDELLATHPDLSLDARLDVVATAAPELAASAAANAIAEWGRPAGDITHLVVSTNAGSHAPGTDVRLVSLLGLRHDVLRTVLQLNGCASGCAALRLAKDLAENNHGARVLVACVELTITAFRGPDEADSFDTLIPQGLFGDGAGAAIVGAEPYVHERPLFEMVSASQYVIPDTEHMLTMQLGSGGIGGTIATGLPRLAAGIVEKCLLDAFGDRLAGIGGVVEWNNLFWAVHPGSSAMLDHIVRALRLAPAKLAASRTVVREYGNMLGATVIFVLDEVRRQREDPEGEGASHDEGWGVMMGFGPGFTVETMLLHAAT

SEQ ID NO: 1011 - protein, 409 aa, Zea mays
  misc_feature (1)..(409): Ceres CLONE ID no. 241538
  misc_feature: Utility: Useful for increasing chlorophyll and photosynthetic capacity
  misc_feature: Utility: Useful for making ornamental plants with modified flowers
  misc_feature: Utility: Useful for making plants sterile and for genetic confinement
  misc_feature: Utility: Useful for making smaller plants
  misc_feature: Utility: Useful for making stronger plants
  misc_feature: Utility: Useful for modifying fiber content in seed
MAAARPGNLSELEQKWHNGGGPACVLGVGTANPANCVRQDEYTDWYFRITKSDHLTHTKAIMRKTCEKMMVKKRYLQVNEELFSVHPEFLDPAAPSLQGKLAVVAGAMPGLVAAAAEKAIADWGRPAGDITHLVFATSSSAQLPHIDLRIAALLGLSTTVQRTVIGFHACSGSSAALRVAKYIAENNRSARVLVACADMWSVMDSYVVPNVDHRYGIIGHAFIGDGAGAVVVGSRPQEPVERPIFEMVSASQATVPGSERAVAVELTNCGLEYRLEFGDVAAEVGGNIERCLLDALSPLGIGSVGWNNLFWVVHPGGPRIMDTFTAALKLQPEKLSASRRVLREYGNITGPTLIFVLDEAIRRRQLDHEEGSCEWGLMVGLGPGFTIDVMALRACSGKSTPTPRIKSSL

SEQ ID NO: 1012 - DNA, 606 bp, Arabidopsis thaliana
  misc_feature (1)..(606): Ceres CLONE ID no. 1496
  misc_feature (1)..(606): Also known as  Ceres CDNA ID no. 23358648
tttctcaaacaagaaaatgcagatcttcgtgaaaaccctaacggggaagacaataaccttagaggtagaatcatcagacacaatcgacaatgtgaaagcgaagatccaagacaaggaaggaatcccaccggatcagcaacggttgatcttcgccggaaaacaattggaagatggaagaacactagctgattacaacatccagaaagagtcgacgcttcatttggttctacgtctgagaggaggtgcgaagaagaggaagaagaagacgtacacgaaacctaagaagattaagcatacgcacaagaaagtgaagctagcagttctgcagttttacaaggttgatggaagtgggaaagttcagaggttgaagaaagagtgtccttctgttagttgtggtcctggaactttcatggcgagtcatttcgataggcattattgtgggaaatgtggaactacttacgtgttcaagaaggctgatgaagagtaggttatgtctttttgcttttggaatttagattgttttttttttttaattcagatattttgagatggttttatactattgaggatggtttaattgttgcataatacattatattatctttg

SEQ ID NO: 1013 - protein, 156 aa, Arabidopsis thaliana
  misc_feature (1)..(74): Pfam Name: ubiquitin; Pfam Description: Ubiquitin family
  misc_feature (101)..(147): Pfam Name: Ribosomal_S27; Pfam Description: Ribosomal protein S27a
  misc_feature: Utility: Useful for increasing chlorophyll and photosynthetic capacity
  misc_feature: Utility: Useful for making ornamental plants with modified leaves
  misc_feature: Utility: Useful for making plants sterile and for genetic confinement
  misc_feature: Utility: Useful for making plants with increased biomass
  misc_feature: Utility: Useful for making plants with increased biomass and foliage
  misc_feature: Utility: Useful for making smaller plants
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHTHKKVKLAVLQFYKVDGSGKVQRLKKECPSVSCGPGTFMASHFDRHYCGKCGTTYVFKKADEE

SEQ ID NO: 1014 - protein, 158 aa, Glycine max
  misc_feature (1)..(158): Ceres CLONE ID no. 1120170
  misc_feature: Utility: Useful for increasing chlorophyll and photosynthetic capacity
  misc_feature: Utility: Useful for making ornamental plants with modified leaves
  misc_feature: Utility: Useful for making plants sterile and for genetic confinement
  misc_feature: Utility: Useful for making plants with increased biomass
  misc_feature: Utility: Useful for making plants with increased biomass and foliage
  misc_feature: Utility: Useful for making smaller plants
TPPLAYTESKMQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLAVLQFYKVDGSGKVQRLRKECPNATCGAGTFMASHFDRHYCGKCGLTY

SEQ ID NO: 1015 - protein, 169 aa, Zea mays
  misc_feature (1)..(169): Ceres CLONE ID no. 1449840
  misc_feature: Utility: Useful for increasing chlorophyll and photosynthetic capacity
  misc_feature: Utility: Useful for making ornamental plants with modified leaves
  misc_feature: Utility: Useful for making plants sterile and for genetic confinement
  misc_feature: Utility: Useful for making plants with increased biomass
  misc_feature: Utility: Useful for making plants with increased biomass and foliage
  misc_feature: Utility: Useful for making smaller plants
  misc_feature (163)..(163): Xaa is any aa, unknown, or other
  misc_feature (164)..(164): Xaa is any aa, unknown, or other
HSAVCFVSTAAKMQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLAVLQFYKVDGSGKVQRLRKECPNATCGAGTFMASHFDRHYCGKCGLTYVYXXEGAEA

SEQ ID NO: 1016 - protein, 157 aa, Arabidopsis thaliana
  misc_feature (1)..(157): Ceres CLONE ID no. 34004
  misc_feature: Utility: Useful for increasing chlorophyll and photosynthetic capacity
  misc_feature: Utility: Useful for making ornamental plants with modified leaves
  misc_feature: Utility: Useful for making plants sterile and for genetic confinement
  misc_feature: Utility: Useful for making plants with increased biomass
  misc_feature: Utility: Useful for making plants with increased biomass and foliage
  misc_feature: Utility: Useful for making smaller plants
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLAVLQFYKVDGSGKVQRLRKECPNATCGAGTFMASHFDRHYCGKCGLTYVYQKEGAQE

SEQ ID NO: 1017 - protein, 157 aa, Arabidopsis thaliana; identical to SEQ ID NO: 1016
  misc_feature (1)..(157): Public GI no. 23505779
  misc_feature: Utility: Useful for increasing chlorophyll and photosynthetic capacity
  misc_feature: Utility: Useful for making ornamental plants with modified leaves
  misc_feature: Utility: Useful for making plants sterile and for genetic confinement
  misc_feature: Utility: Useful for making plants with increased biomass
  misc_feature: Utility: Useful for making plants with increased biomass and foliage
  misc_feature: Utility: Useful for making smaller plants

SEQ ID NO: 1018 - protein, 161 aa, Glycine max
  misc_feature (1)..(161): Ceres CLONE ID no. 1060748
  misc_feature: Utility: Useful for increasing chlorophyll and photosynthetic capacity
  misc_feature: Utility: Useful for making ornamental plants with modified leaves
  misc_feature: Utility: Useful for making plants sterile and for genetic confinement
  misc_feature: Utility: Useful for making plants with increased biomass
  misc_feature: Utility: Useful for making plants with increased biomass and foliage
  misc_feature: Utility: Useful for making smaller plants
  misc_feature (65)..(65): Xaa is any aa, unknown, or other
  misc_feature (161)..(161): Xaa is any aa, unknown, or other
AVCFVSTAAKMQIFVKTLTGKTITLEVESSDTIDNVKAKIQDKEGIPPDQQRLIFAGKQLEDGRXLADYNIQKESTLHLVLRLRGGAKKRKKKTYTKPKKIKHKHKKVKLAVLQFYKVDGSGKVQRLRKECPNATCGAGTFMASHFDRHYCGKCGLTYVYX

SEQ ID NO: 1019 - protein, 155 aa, Glycine max
  misc_feature (1)..(155): Public GI no. 438111
  misc_feature: Utility: Useful for increasing chlorophyll and photosynthetic capacity
  misc_feature: Utility: Useful for making ornamental plants with modified leaves
  misc_feature: Utility: Useful for making plants sterile and for genetic confinement
  misc_feature: Utility: Useful for making plants with increased biomass
  misc_feature: Utility: Useful for making plants with increased biomass and foliage
  misc_feature: Utility: Useful for making smaller plants
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLAVLQFYKVDDSGKVQRLRKECPNAECGAGTFMANHFDRHYCGKCGQTYVYQKADA

SEQ ID NO: 1020 - protein, 155 aa, Glycine max
  misc_feature (1)..(155): Public GI no. 438109
  misc_feature: Utility: Useful for increasing chlorophyll and photosynthetic capacity
  misc_feature: Utility: Useful for making ornamental plants with modified leaves
  misc_feature: Utility: Useful for making plants sterile and for genetic confinement
  misc_feature: Utility: Useful for making plants with increased biomass
  misc_feature: Utility: Useful for making plants with increased biomass and foliage
  misc_feature: Utility: Useful for making smaller plants
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLAVLQFYKVDDSGKVQRLRKECPNTECGAGTFMANHFDRHYCGKCGKTYVYQKADA

SEQ ID NO: 1021 - protein, 156 aa, Glycine max
  misc_feature (1)..(156): Public GI no. 34581769
  misc_feature: Utility: Useful for increasing chlorophyll and photosynthetic capacity
  misc_feature: Utility: Useful for making ornamental plants with modified leaves
  misc_feature: Utility: Useful for making plants sterile and for genetic confinement
  misc_feature: Utility: Useful for making plants with increased biomass
  misc_feature: Utility: Useful for making plants with increased biomass and foliage
  misc_feature: Utility: Useful for making smaller plants
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLAVLQFYKVDDSGKVQRLRKECPNAECGAGTFMANHFDRHYCGKCGLTYVYNKAGGD

SEQ ID NO: 1022 - protein, 157 aa, Zea mays
  misc_feature (1)..(157): Ceres CLONE ID no. 1063698
  misc_feature: Utility: Useful for increasing chlorophyll and photosynthetic capacity
  misc_feature: Utility: Useful for making ornamental plants with modified leaves
  misc_feature: Utility: Useful for making plants sterile and for genetic confinement
  misc_feature: Utility: Useful for making plants with increased biomass
  misc_feature: Utility: Useful for making plants with increased biomass and foliage
  misc_feature: Utility: Useful for making smaller plants
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLAVLQFYKVDGSGKVQRLRKECPNATCGAGTFMASHFDRHYCGKCGLTYVYQKEGAEA

SEQ ID NO: 1023 - protein, 179 aa, Zea mays
  misc_feature (1)..(179): Ceres CLONE ID no. 1486090
  misc_feature: Utility: Useful for increasing chlorophyll and photosynthetic capacity
  misc_feature: Utility: Useful for making ornamental plants with modified leaves
  misc_feature: Utility: Useful for making plants sterile and for genetic confinement
  misc_feature: Utility: Useful for making plants with increased biomass
  misc_feature: Utility: Useful for making plants with increased biomass and foliage
  misc_feature: Utility: Useful for making smaller plants
KTKPTLSLVVSSFHLFVRTAAKMQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLAVLQFYKVDGSGKVQRLRKECPNATCGAGTFMASHFDRHYCGKCGLTYVYQKEGAEA

SEQ ID NO: 1024 - protein, 157 aa, Zea mays; identical to SEQ ID NO: 1022
  misc_feature (1)..(157): Ceres CLONE ID no. 1461422
  misc_feature: Utility: Useful for increasing chlorophyll and photosynthetic capacity
  misc_feature: Utility: Useful for making ornamental plants with modified leaves
  misc_feature: Utility: Useful for making plants sterile and for genetic confinement
  misc_feature: Utility: Useful for making plants with increased biomass
  misc_feature: Utility: Useful for making plants with increased biomass and foliage
  misc_feature: Utility: Useful for making smaller plants

SEQ ID NO: 1025 - protein, 154 aa, Zea mays
  misc_feature (1)..(154): Public GI no. 18252349
  misc_feature: Utility: Useful for increasing chlorophyll and photosynthetic capacity
  misc_feature: Utility: Useful for making ornamental plants with modified leaves
  misc_feature: Utility: Useful for making plants sterile and for genetic confinement
  misc_feature: Utility: Useful for making plants with increased biomass
  misc_feature: Utility: Useful for making plants with increased biomass and foliage
  misc_feature: Utility: Useful for making smaller plants
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLAVLQFYKVDDSRKVQRLRKECPNAECGAGTFMANHFDRHYCGKCGLTYVYQKAG

SEQ ID NO: 1026 - protein, 172 aa, Arabidopsis thaliana
  misc_feature (1)..(172): Ceres CLONE ID no. 1233
  misc_feature: Utility: Useful for increasing chlorophyll and photosynthetic capacity
  misc_feature: Utility: Useful for making ornamental plants with modified leaves
  misc_feature: Utility: Useful for making plants sterile and for genetic confinement
  misc_feature: Utility: Useful for making plants with increased biomass
  misc_feature: Utility: Useful for making plants with increased biomass and foliage
  misc_feature: Utility: Useful for making smaller plants
KNPHFDNLQQPLPQKMQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLAVLQFYKIDGSGKVQRLRKECPNATCGAGTFMASHFDRHYCGKCGLTYVYQKEGVEA

SEQ ID NO: 1027 - protein, 157 aa, Arabidopsis thaliana
  misc_feature (1)..(157): Public GI no. 21537196
  misc_feature: Utility: Useful for increasing chlorophyll and photosynthetic capacity
  misc_feature: Utility: Useful for making ornamental plants with modified leaves
  misc_feature: Utility: Useful for making plants sterile and for genetic confinement
  misc_feature: Utility: Useful for making plants with increased biomass
  misc_feature: Utility: Useful for making plants with increased biomass and foliage
  misc_feature: Utility: Useful for making smaller plants
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLAVLQFYKIDGSGKVQRLRKECPNATCGAGTFMASHFDRHYCGKCGLTYVYQKEGVEA

SEQ ID NO: 1028 - protein, 155 aa, Glycine max
  misc_feature (1)..(155): Ceres CLONE ID no. 544375
  misc_feature: Utility: Useful for increasing chlorophyll and photosynthetic capacity
  misc_feature: Utility: Useful for making ornamental plants with modified leaves
  misc_feature: Utility: Useful for making plants sterile and for genetic confinement
  misc_feature: Utility: Useful for making plants with increased biomass
  misc_feature: Utility: Useful for making plants with increased biomass and foliage
  misc_feature: Utility: Useful for making smaller plants
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLGILQFYKVDDSGKVQRLRKECPNAECGAGTFMANHFDRHYCGKCGLTYVYQKADA

SEQ ID NO: 1029 - protein, 155 aa, Glycine max; identical to SEQ ID NO: 1028
  misc_feature (1)..(155): Ceres CLONE ID no. 545629
  misc_feature: Utility: Useful for increasing chlorophyll and photosynthetic capacity
  misc_feature: Utility: Useful for making ornamental plants with modified leaves
  misc_feature: Utility: Useful for making plants sterile and for genetic confinement
  misc_feature: Utility: Useful for making plants with increased biomass
  misc_feature: Utility: Useful for making plants with increased biomass and foliage
  misc_feature: Utility: Useful for making smaller plants

SEQ ID NO: 1030 - protein, 155 aa, Glycine max
  misc_feature (1)..(155): Ceres CLONE ID no. 850326
  misc_feature: Utility: Useful for increasing chlorophyll and photosynthetic capacity
  misc_feature: Utility: Useful for making ornamental plants with modified leaves
  misc_feature: Utility: Useful for making plants sterile and for genetic confinement
  misc_feature: Utility: Useful for making plants with increased biomass
  misc_feature: Utility: Useful for making plants with increased biomass and foliage
  misc_feature: Utility: Useful for making smaller plants
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLALLQFYKVDDSGKVQRLRKECPNAECGAGTFMANHFDRHYCGKCGLTYVYQKAEA

SEQ ID NO: 1031 - DNA, 639 bp, Arabidopsis thaliana
  misc_feature (1)..(639): Ceres CLONE ID no. 2561
  misc_feature (1)..(639): Also known as  Ceres CDNA ID no. 23384666
cagcaaaaaaaaaccctaatttcttcacaaattcagcggcgatgaagttcaatccgcgtgtgagctcttctcgccggaagaacaggaaggctcacttcacagctccttcaagcgtgaggcgcgttctcatgagctcgccgttatccaaggatctccgtaacaaacacaacgtcagatccatgccgattcgtaaagacgacgaagtgcaagttgttcgtgggacgttcaagggaagagaagggaaggtgatgcaggtgtatcgccgcaagtgggtgattcacatcgagagaatcacaagggagaaagtcaacggatccacggtcaacgtcggagtcaatgcttcgaatgtgatgatcactaagctccgtctcgataaggataggaagtcgcttttggagcgtaaggctaatggacgcgccgccgccgataaggagaagggaaccaagttttcagccgaagatgtcatggagaacgtagattgatcttaacgtatggttttttcttcttcttttctagttttctattttgatttcattgatgatgatatgattcagaattcgaagttgaattttgtggttttcttatcaatgtacctcatttatgcttatatttctagctattgaaattggattgagattt

SEQ ID NO: 1032 - protein, 92 aa, Arabidopsis thaliana
  misc_feature (2)..(28): Pfam Name: KOW; Pfam Description: KOW motif
  misc_feature: Utility: Useful for increasing chlorophyll and photosynthetic capacity
  misc_feature: Utility: Useful for making ornamental plants with modified leaves
  misc_feature: Utility: Useful for making plants sterile and for genetic confinement
  misc_feature: Utility: Useful for making smaller plants
MQVVRGTFKGREGKVMQVYRRKWVIHIERITREKVNGSTVNVGVNASNVMITKLRLDKDRKSLLERKANGRAAADKEKGTKFSAEDVMENVD

SEQ ID NO: 1033 - protein, 146 aa, Glycine max
  misc_feature (1)..(146): Ceres CLONE ID no. 1248535
  misc_feature: Utility: Useful for increasing chlorophyll and photosynthetic capacity
  misc_feature: Utility: Useful for making ornamental plants with modified leaves
  misc_feature: Utility: Useful for making plants sterile and for genetic confinement
  misc_feature: Utility: Useful for making smaller plants
MKYNPRVTSSRRKNRKAHFTASSSERRVIMSSPLSTDLRAKYNVRSMPIRKDDEVQIVRGTYKGREGKVVQVYRRKWVIHIERITREKVNGTTVNVGVQPSKVVITKLRLDKDRKSLLERKAKGRAAADKDKGTKFTAEDVMQNVD

SEQ ID NO: 1034 - protein, 146 aa, Arabidopsis thaliana
  misc_feature (1)..(146): Ceres CLONE ID no. 22819
  misc_feature: Utility: Useful for increasing chlorophyll and photosynthetic capacity
  misc_feature: Utility: Useful for making ornamental plants with modified leaves
  misc_feature: Utility: Useful for making plants sterile and for genetic confinement
  misc_feature: Utility: Useful for making smaller plants
MKYNPRVTSSRRKNRKAHFTASSSERRVIMSSPLSTDLRQKYNVRSMPIRKDDEVQIVRGTYKGREGKVVQVYRRKWVIHIERITREKVNGTTVNVGIQPSKVVITKLRLDKDRKSLLERKAKGRAAADKEKGTKFTSEDVMQNVD

SEQ ID NO: 1035 - protein, 146 aa, Glycine max
  misc_feature (1)..(146): Ceres CLONE ID no. 463579
  misc_feature: Utility: Useful for increasing chlorophyll and photosynthetic capacity
  misc_feature: Utility: Useful for making ornamental plants with modified leaves
  misc_feature: Utility: Useful for making plants sterile and for genetic confinement
  misc_feature: Utility: Useful for making smaller plants
MKFNPRVSSSRRKSRKAHFTAPSSVRRVLMSAPLSTDLRSKYNVRSIPVRKDDEVQVVRGTYKGREGKVVQVYRRKWVIHIERITREKVNGSTVNVGIHPSKVVVTKLRMDKDRKSLLDRKAKGRAAADKEKGTKFAPEDVMQTVD

SEQ ID NO: 1036 - protein, 146 aa, Glycine max
  misc_feature (1)..(146): Ceres CLONE ID no. 1608715
  misc_feature: Utility: Useful for increasing chlorophyll and photosynthetic capacity
  misc_feature: Utility: Useful for making ornamental plants with modified leaves
  misc_feature: Utility: Useful for making plants sterile and for genetic confinement
  misc_feature: Utility: Useful for making smaller plants
MKFNPRVSSSRRKSRKAHFTAPSSVRRVLMSAPLSTDLRSKYNVRSIPVRKDDEVQVVRGTYKGREGKVVQVYRRKWVIHIERITREKVNGSTVNVGIHPSKVVVTKLRMDKDRKSLLDRKAKGRAAADKEKGTKFAPEDIMQTVD

SEQ ID NO: 1037 - protein, 157 aa, Zea mays
  misc_feature (1)..(157): Ceres CLONE ID no. 1440308
  misc_feature: Utility: Useful for increasing chlorophyll and photosynthetic capacity
  misc_feature: Utility: Useful for making ornamental plants with modified leaves
  misc_feature: Utility: Useful for making plants sterile and for genetic confinement
  misc_feature: Utility: Useful for making smaller plants
MKRNPRVTSSRRKCRKAHFTAPSSVRRVLMSAALSSELRHKYNVRSIPIRKDDEVQVVRGTFKGREGKVVQVYRRRWVIHVERITREKVNGSTVNVGIHPSKVIVTKLKLDKDRKALLDRKARGRAADKAKGKFTAEDVAAAAGGATATGASLQEID

SEQ ID NO: 1038 - protein, 128 aa, Zea mays
  misc_feature (1)..(128): Ceres CLONE ID no. 297892
  misc_feature: Utility: Useful for increasing chlorophyll and photosynthetic capacity
  misc_feature: Utility: Useful for making ornamental plants with modified leaves
  misc_feature: Utility: Useful for making plants sterile and for genetic confinement
  misc_feature: Utility: Useful for making smaller plants
MSAALSTELRHKYNVRSIPIRKDDEVQVVRGTYKGREGKVVQVYRRRWVIHVERITREKVNGSTVNVGIHPSKVMVTKLKLDKDRKALLDRKARGRAADKAKGKFTADDVAAAAGGAAATGASLQEID

SEQ ID NO: 1039 - protein, 135 aa, Glycine max
  misc_feature (1)..(135): Ceres CLONE ID no. 479756
  misc_feature: Utility: Useful for increasing chlorophyll and photosynthetic capacity
  misc_feature: Utility: Useful for making ornamental plants with modified leaves
  misc_feature: Utility: Useful for making plants sterile and for genetic confinement
  misc_feature: Utility: Useful for making smaller plants
MSAPLSAELRSKYNVRSIPVRKEDEVQVMRGTYKGREGKVTQVYRRKWVIHIERITREKVNGSTVNVGIHPSKVVLTKLKLDKDRKAILDRKAKGRAAADKEKGSGLRNRSLENKALIVSGSGEECLACNCRRKG

SEQ ID NO: 1040 - protein, 146 aa, Glycine max
  misc_feature (1)..(146): Ceres CLONE ID no. 467309
  misc_feature: Utility: Useful for increasing chlorophyll and photosynthetic capacity
  misc_feature: Utility: Useful for making ornamental plants with modified leaves
  misc_feature: Utility: Useful for making plants sterile and for genetic confinement
  misc_feature: Utility: Useful for making smaller plants
MKFNPRVSSSRRKSRKAHFTAPSSVRRVLMSAPLSAELRSKYNVRSIPVRKEDEVQVVRGTYKGREGKVTQVYRRKWVIHIERITREKVNGSTVNVGIHPSKVVVTKLKLDKDRKAILDRKAKGRAAADKEKGTKFAPEDIMQTVD

SEQ ID NO: 1041 - protein, 106 aa, Triticum aestivum
  misc_feature (1)..(106): Ceres CLONE ID no. 1316364
  misc_feature: Utility: Useful for increasing chlorophyll and photosynthetic capacity
  misc_feature: Utility: Useful for making ornamental plants with modified leaves
  misc_feature: Utility: Useful for making plants sterile and for genetic confinement
  misc_feature: Utility: Useful for making smaller plants
  misc_feature (3)..(3): Xaa is any aa, unknown, or other
  misc_feature (21)..(21): Xaa is any aa, unknown, or other
  misc_feature (28)..(28): Xaa is any aa, unknown, or other
  misc_feature (35)..(35): Xaa is any aa, unknown, or other
  misc_feature (36)..(36): Xaa is any aa, unknown, or other
  misc_feature (39)..(39): Xaa is any aa, unknown, or other
  misc_feature (45)..(45): Xaa is any aa, unknown, or other
  misc_feature (51)..(51): Xaa is any aa, unknown, or other
  misc_feature (56)..(56): Xaa is any aa, unknown, or other
  misc_feature (57)..(57): Xaa is any aa, unknown, or other
  misc_feature (60)..(60): Xaa is any aa, unknown, or other
MTXVQVVRGTFKGREGKVVQXYRRRWVXHVERITXXKVXGSTVNXGIHPSXVIVTXXKLXKDRKALLVRKARGRAADKAKGKFTAEEVAAAAGGSTATGASLQEID

SEQ ID NO: 1042 - DNA, 814 bp, Arabidopsis thaliana
  misc_feature (1)..(814): Ceres CLONE ID no. 3618
  misc_feature (1)..(814): Also known as  Ceres CDNA ID no. 23375900
gatacttcaaaaaacacaaaaagaaatttatatttattgatgatggaagaagagcaaagcaaatgagagacagagacacagaccctatatcagagagtaaattggtgaagtggattggatcacataagccatggagtctccgagaaaccatggaggctctgaagaggaggaatacagcagttgtgagtcagggtggactatgtacatagaagacgccttccatggaaatgaccaatcatctgttgttgtcgatgatgatgatgatgatacacaggttaaagaggctgatgatggttatgagaacaatgatggcgatactagtgatgatggtggtgatgaagagagtgatgattccatggcttctgatgcatcctcggggcctagcaatcagcttccaaagcacatcaacaaacatgcagctaggaagaatggttctaaacaagtctaccttcaaaaacgccaacacacagagaaaacaatcagcaacgaaggagaaaaatcagacctcaaagctagaacaagaacaagtgcagctagtcgtgtccagagtagagggaaggtgagcaaaaccaaataaaactcatggcgaatgagagaagaagatatgggggttcacaaagaatccaaatcctgtagtgaagagagacgtttcaggggtctcaccaatcgtgttgtttgcctttaataagccatgtgtaggtagttgcattgttttcttttgccggaatatgtttttttgtagaagctgtcccaaataagttatctgcacggttctccgttggaaccctgttatataatatgtaccttgttctcc

SEQ ID NO: 1043 - protein, 148 aa, Arabidopsis thaliana
  misc_feature: Utility: Useful for increasing chlorophyll and photosynthetic capacity
  misc_feature: Utility: Useful for increasing seed/fruit yield or modifying fruit content
  misc_feature: Utility: Useful for making larger plants
  misc_feature: Utility: Useful for making ornamental plants with modified flowers
  misc_feature: Utility: Useful for making plants sterile and for genetic confinement
  misc_feature: Utility: Useful for making plants with altered leaf shape eg curled leaves
  misc_feature: Utility: Useful for making plants with increased biomass and foliage
  misc_feature: Utility: Useful for making shorter plants and plants with modified flowers
  misc_feature: Utility: Useful for making smaller plants
  misc_feature: Utility: Useful for making stronger plants
  misc_feature: Utility: Useful for modifying fruit shape, composition and seed yield
MESPRNHGGSEEEEYSSCESGWTMYIEDAFHGNDQSSVVVDDDDDDTQVKEADDGYENNDGDTSDDGGDEESDDSMASDASSGPSNQLPKHINKHAARKNGSKQVYLQKRQHTEKTISNEGEKSDLKARTRTSAASRVQSRGKVSKTK

SEQ ID NO: 1044 - protein, 164 aa, Arabidopsis thaliana
  misc_feature (1)..(164): Public GI no. 50947055
  misc_feature: Utility: Useful for increasing chlorophyll and photosynthetic capacity
  misc_feature: Utility: Useful for increasing seed/fruit yield or modifying fruit content
  misc_feature: Utility: Useful for making larger plants
  misc_feature: Utility: Useful for making ornamental plants with modified flowers
  misc_feature: Utility: Useful for making plants sterile and for genetic confinement
  misc_feature: Utility: Useful for making plants with altered leaf shape eg curled leaves
  misc_feature: Utility: Useful for making plants with increased biomass and foliage
  misc_feature: Utility: Useful for making shorter plants and plants with modified flowers
  misc_feature: Utility: Useful for making smaller plants
  misc_feature: Utility: Useful for making stronger plants
  misc_feature: Utility: Useful for modifying fruit shape, composition and seed yield
MESSHITGDDGEGCNSSESGWTMYLASPMHGDDDGGGKRSGSEGSNVDDGYGYISGRGSRKEYEDDGDGDDDDSLASDASTGPAKVKVPSAPDGDDAGGRRKHDGDEDGGGKGEEEEEEDHGLHTKFSMSSGKKAGKTEKGGEGKSSKKGQNKRGSSSRTRFFW

SEQ ID NO: 1045 - protein, 157 aa, Glycine max
  misc_feature (1)..(157): Ceres CLONE ID no. 520298
  misc_feature: Utility: Useful for increasing chlorophyll and photosynthetic capacity
  misc_feature: Utility: Useful for increasing seed/fruit yield or modifying fruit content
  misc_feature: Utility: Useful for making larger plants
  misc_feature: Utility: Useful for making ornamental plants with modified flowers
  misc_feature: Utility: Useful for making plants sterile and for genetic confinement
  misc_feature: Utility: Useful for making plants with altered leaf shape eg curled leaves
  misc_feature: Utility: Useful for making plants with increased biomass and foliage
  misc_feature: Utility: Useful for making shorter plants and plants with modified flowers
  misc_feature: Utility: Useful for making smaller plants
  misc_feature: Utility: Useful for making stronger plants
  misc_feature: Utility: Useful for modifying fruit shape, composition and seed yield
MDPSQDLASEVEFNGTESGWTTYIGSPIYNEQSNGDDEHSVDFEDYGNNYKNSHRSIYDDDNKRENNDDFNRDTDEESDDSMASDAASGPSHLHLVRINSEGSHGGLDFTEHTENDNDKIRLTKRTTKQVRKTRYEGIVGEKEEASLLVADSAASHA

SEQ ID NO: 1046 - protein, 123 aa, Glycine max
  misc_feature (1)..(123): Ceres CLONE ID no. 1171157
  misc_feature: Utility: Useful for increasing chlorophyll and photosynthetic capacity
  misc_feature: Utility: Useful for increasing seed/fruit yield or modifying fruit content
  misc_feature: Utility: Useful for making larger plants
  misc_feature: Utility: Useful for making ornamental plants with modified flowers
  misc_feature: Utility: Useful for making plants sterile and for genetic confinement
  misc_feature: Utility: Useful for making plants with altered leaf shape eg curled leaves
  misc_feature: Utility: Useful for making plants with increased biomass and foliage
  misc_feature: Utility: Useful for making shorter plants and plants with modified flowers
  misc_feature: Utility: Useful for making smaller plants
  misc_feature: Utility: Useful for making stronger plants
  misc_feature: Utility: Useful for modifying fruit shape, composition and seed yield
MYIGSPIDDAGHSSDNDDNNKKGTQAHPQDDDDDDDESDDSMASDASSGPSHHHGFADFRRDAEEENDENKYCLEKKAGKTQHKQMEGKKVEKKGMLIVDSKDKSPVQGCGKVRKNYFVGKRK

SEQ ID NO: 1047 - protein, 182 aa, Zea mays
  misc_feature (1)..(182): Ceres CLONE ID no. 301153
  misc_feature: Utility: Useful for increasing chlorophyll and photosynthetic capacity
  misc_feature: Utility: Useful for increasing seed/fruit yield or modifying fruit content
  misc_feature: Utility: Useful for making larger plants
  misc_feature: Utility: Useful for making ornamental plants with modified flowers
  misc_feature: Utility: Useful for making plants sterile and for genetic confinement
  misc_feature: Utility: Useful for making plants with altered leaf shape eg curled leaves
  misc_feature: Utility: Useful for making plants with increased biomass and foliage
  misc_feature: Utility: Useful for making shorter plants and plants with modified flowers
  misc_feature: Utility: Useful for making smaller plants
  misc_feature: Utility: Useful for making stronger plants
  misc_feature: Utility: Useful for modifying fruit shape, composition and seed yield
MESSSHITGGDDDAGGEGCNSCESGWTMYLASPMHMHGHDDDDDAGGSANQGSSVDDGYGYMISGGGNKKQDYDDDDGDGDSLASDASTGPAKAANKSPSPPPEHKHGKEDDDRGHRGGGGGGKEETKLATSSRKKAAAAGNGKLMDKAAAAAAGGGEGNSSRRGHGKGGGGGSSRRSFFLW

SEQ ID NO: 1048 - DNA, 666 bp, Arabidopsis thaliana
  misc_feature (1)..(666): Ceres CLONE ID no. 7191
  misc_feature (1)..(666): Also known as  Ceres CDNA ID no. 23372297
attcattcttcatttcctctgcctctttctcagatcacaaaaccctaatttcgaatctttattcttcagaatggctttctgtaacaaactcggtggtctattgagacaaaacatttcttctaacggaaatgttccggttacgtctatgctcggatctctccggttgatgtctaccaagcttttcatcggaggtctctcatggggaaccgatgacgcatccttaagggatgcttttgctcacttcggtgacgttgttgatgctaaagttatcgttgataaagagacaggaagatcaagggggtttggatttgtcaacttcaatgatgagggcgctgcaactgctgccatatcagagatggacggaaaggaactgaatggtcgtcacatccgagtgaatcctgctaatgatagaccaagtgctccacgggcttatggaggcggtggtggatacagcggaggaggtggtggtggctatggaggaggaggtggcagctacggtggtggtgatggtggtggttactaaacagaggatgtggttgtgaagaagcagttaatggttctsyttmsttsstttcttctattgaatcttatgttagtacaaaacctgaatgggatttgctgaaaactcattactcttttttttttggttaccaatcaatttggttg

SEQ ID NO: 1049 - protein, 150 aa, Arabidopsis thaliana; identical to SEQ ID NO: 863
  misc_feature (37)..(108): Pfam Name: RRM_1; Pfam Description: RNA recognition motif. (a.k.a. RRM, RBD, or RNP domain)
  misc_feature: Utility: Useful for increasing chlorophyll and photosynthetic capacity
  misc_feature: Utility: Useful for making smaller plants

SEQ ID NO: 1050 - protein, 153 aa, Zea mays
  misc_feature (1)..(153): Ceres CLONE ID no. 1388283
  misc_feature: Utility: Useful for increasing chlorophyll and photosynthetic capacity
  misc_feature: Utility: Useful for making smaller plants
MAFCKSLGGLLRQGVVSQTGNIPVTSVLGSLRYMSTKLFVGGLSWGTDDQSLREAFANFGEVVDAKVIVDRETGRSRGFGFVNFTDETAANTAISEMDGKDLNGRSIRVNVANERPSTPRYGGGGGYGGGGGYGGGGYGGGSYGAGGGDGGGY

SEQ ID NO: 1051 - protein, 119 aa, Zea mays
  misc_feature (1)..(119): Ceres CLONE ID no. 322573
  misc_feature: Utility: Useful for increasing chlorophyll and photosynthetic capacity
  misc_feature: Utility: Useful for making smaller plants
MSTKLFIGGLDWGVDDVKLREAFSSFGEVTEARVITDRETGRSRGFGFVNYSDSDAAKEAISAMDGKEIDGRQVRVNMANERPAGNRGGGGYGGGGYGGGGYGGGGGYGGGGLIYRFAL

SEQ ID NO: 1052 - protein, 122 aa, Zea mays
  misc_feature (1)..(122): Ceres CLONE ID no. 289956
  misc_feature: Utility: Useful for increasing chlorophyll and photosynthetic capacity
  misc_feature: Utility: Useful for making smaller plants
MSTKLFIGGLDWGVDDVKLREAFSSFGEVTEARVITDRETGRSRGFGFVNYSDSDAAKEAISAMDGKEIDGRQVRVNMANERPAGNRGGGGYGGGGYGGGGYGGGGGYGGGGYGGGSQSYDA

SEQ ID NO: 1053 - protein, 123 aa, Brassica napus; identical to SEQ ID NO: 680
  misc_feature (1)..(123): Ceres CLONE ID no. 972545
  misc_feature: Utility: Useful for increasing chlorophyll and photosynthetic capacity
  misc_feature: Utility: Useful for making smaller plants
  misc_feature (11)..(11): Xaa is any aa, unknown, or other
  misc_feature (27)..(27): Xaa is any aa, unknown, or other
  misc_feature (78)..(78): Xaa is any aa, unknown, or other
  misc_feature (80)..(80): Xaa is any aa, unknown, or other
  misc_feature (108)..(108): Xaa is any aa, unknown, or other
  misc_feature (120)..(120): Xaa is any aa, unknown, or other

SEQ ID NO: 1054 - protein, 136 aa, Brassica napus; identical to SEQ ID NO: 675
  misc_feature (1)..(136): Ceres CLONE ID no. 1091493
  misc_feature: Utility: Useful for increasing chlorophyll and photosynthetic capacity
  misc_feature: Utility: Useful for making smaller plants

SEQ ID NO: 1055 - protein, 134 aa, Brassica napus; identical to SEQ ID NO: 674
  misc_feature (1)..(134): Ceres CLONE ID no. 977670
  misc_feature: Utility: Useful for increasing chlorophyll and photosynthetic capacity
  misc_feature: Utility: Useful for making smaller plants

SEQ ID NO: 1056 - protein, 133 aa, Brassica napus; identical to SEQ ID NO: 679
  misc_feature (1)..(133): Ceres CLONE ID no. 963616
  misc_feature: Utility: Useful for increasing chlorophyll and photosynthetic capacity
  misc_feature: Utility: Useful for making smaller plants
  misc_feature (13)..(13): Xaa is any aa, unknown, or other

SEQ ID NO: 1057 - DNA, 1706 bp, Arabidopsis thaliana
  misc_feature (1)..(1706): Ceres CLONE ID no. 8254
  misc_feature (1)..(1706): Also known as  Ceres CDNA ID no. 23556816
aattaacaagttttaaactttttctccggagctctgactcttcttctctccggatccaaaaatgaatcgtctcttttctctcttctccatagctctgatcgctttcctctgcctccaccatcatgttctcgcttcttcctcttccgacttcgaaggtttcgatgctgaagacgacgatgtttcagaagattccactgagcttcaccactctctccgtcctcctcttctgactcagtctgagtcaacggttctggatctggacccatctcccgattctgattctactcctgcatctaaatctgatcctcccactcagaccgtgaagccttcgtcctccatctccttcgattactgggatgaagatgagttcgaaggattgccggaggatgagaaatctacggagtctccggttttttccgatgacgcctcctctcctgccgatccacagacgccggatcttgagtctgcttcagaaactccagatactgacattccgaagaagatgcaatcgtacactgtggagatcgtttgcgtctctatattgattggttacgctatcaattacttcactggtaaacgtgaaaatgagaacctcgctttggcttgggcttccaaatttggtcttaaagatacgatttttgagaagaacttcagtttgcttggagttggtgaaggagaagactctcctttgttgctgaaagaagcgacgaatgtgtttaagttctatgccagtgggcgtaggtattgccatgggcttttggcgactttggagcttaagagtagacacgatctgatctcaaggctattcaactctgtcgtgccttgtaaagatgagattagttttgaggtgtatatgaatgatgaagccatggatcacattgtgtttgctatggcgaggaagaaggcggctaaaacgatgcacaaggagctgggggatctgcagagatttggagggatggttcccagtcctggcgggaggaagtgggtaacggaggagttagctgtggtctctgagtctaaggaggtagctggagatatgatcaccgatgttgtacttgatcaggtttttggtgacaagtcttttgaaaagtttgggaagtatttcatctcaatgcatttctcggatcaacatcctggcaaacacaggaagatgctgcttttcaagtttgccttacctgatattaaacacatggatgatatggttcggttgatagcgctaattccgtattacattgacttaattgggcgctacaagctcagctctcaggcaaggaacaaaactgacggtgctaggcaaaaggcggctcaggaagcgtacaaggaacttgagaatgtgagacaagaggcattgcagagaaagaaagccgaaaagaagaaaatattggaggaggcacaggcaaagcttagctccgaggctctaaggaagaaagaagcaaaagaacgtgcacgccagatgaaaaagtcaatgccgaaagttaagatgagtcgtggtcactagaatcaagcataagggacacactgtcatgtcgtccattggaatagctactccctttttagtcctttcgattagatattttgaactttcatgaatctctctacttgcagttgatttttacttcattacgatttcccctatagtggcaccgaggccttacttccgataatcctccgggacctctttgaatcataagatgagttttgaagtc

SEQ ID NO: 1058 - protein, 478 aa, Arabidopsis thaliana
  misc_feature (144)..(472): Pfam Name: DUF1682; Pfam Description: Protein of unknown function (DUF1682)
  misc_feature: Utility: Useful for increasing chlorophyll and photosynthetic capacity
  misc_feature: Utility: Useful for making ornamental plants with modified leaves
  misc_feature: Utility: Useful for making plants with increased biomass and foliage
  misc_feature: Utility: Useful for making smaller plants
  misc_feature: Utility: Useful for making stronger plants
MNRLFSLFSIALIAFLCLHHHVLASSSSDFEGFDAEDDDVSEDSTELHHSLRPPLLTQSESTVLDLDPSPDSDSTPASKSDPPTQTVKPSSSISFDYWDEDEFEGLPEDEKSTESPVFSDDASSPADPQTPDLESASETPDTDIPKKMQSYTVEIVCVSILIGYAINYFTGKRENENLALAWASKFGLKDTIFEKNFSLLGVGEGEDSPLLLKEATNVFKFYASGRRYCHGLLATLELKSRHDLISRLFNSVVPCKDEISFEVYMNDEAMDHIVFAMARKKAAKTMHKELGDLQRFGGMVPSPGGRKWVTEELAVVSESKEVAGDMITDVVLDQVFGDKSFEKFGKYFISMHFSDQHPGKHRKMLLFKFALPDIKHMDDMVRLIALIPYYIDLIGRYKLSSQARNKTDGARQKAAQEAYKELENVRQEALQRKKAEKKKILEEAQAKLSSEALRKKEAKERARQMKKSMPKVKMSRGH

SEQ ID NO: 1059 - protein, 460 aa, Glycine max
  misc_feature (1)..(460): Ceres CLONE ID no. 635423
  misc_feature: Utility: Useful for increasing chlorophyll and photosynthetic capacity
  misc_feature: Utility: Useful for making ornamental plants with modified leaves
  misc_feature: Utility: Useful for making plants with increased biomass and foliage
  misc_feature: Utility: Useful for making smaller plants
  misc_feature: Utility: Useful for making stronger plants
MGNPSLSSLLLVLLCIISLILALAQADSDSHFEGFEAEDDDDDLEDSSIHPASLRSPPLSDPTPTPQPPPSDLPKFPPFDFWDDDEFEGVPVEHSSPEPPSDPKSPENATTTQTPPTPNPPRSFSVEIICGSFLIMFAINYFSGKRENENIALSWAAQFAAKDSIFEKNFSLLGIGDGVDEEEAPLLLKEGQTTFKFYASGRRYCQGLLATLELKSRHDLIARIYNMIVPCRDEIAFEVYMNDDAMDHVVFAMAKKKVAKAMHKDVTDLQRFGTLLSAPSATATATARKWVADDLAVISESKEVANDLITDAVIDQVFGEKAFEKFGKGLISLHFSDQHPGIHKKILLFKFVLPAAKDMADMTRLVALVPYYIDLIGRYKLSSQARSKTEAARQKAALEAQKELRNAQQEAMQRRKAERKKMVEEAEAKLSAESVRKKEAKERARQMKKAMPRMKMSRGA

SEQ ID NO: 1060 - protein, 515 aa, Zea mays
  misc_feature (1)..(515): Ceres CLONE ID no. 219727
  misc_feature: Utility: Useful for increasing chlorophyll and photosynthetic capacity
  misc_feature: Utility: Useful for making ornamental plants with modified leaves
  misc_feature: Utility: Useful for making plants with increased biomass and foliage
  misc_feature: Utility: Useful for making smaller plants
  misc_feature: Utility: Useful for making stronger plants
TSAVVASFPAPPRTIIPFVFPSTPSLPHPKAMAALSWIRLRPPRAAILILLLLALHISPSFAANFEGFDSDDLPVAAGGLDADDDEGLDGVYLPPPPPISLSTSAPSPPVTTTPAPNPNPATPTPRDPTPALDLWDEDEFEGIPVPEAIPSDDSAAPAEVDPSDPSTEAPVEVAPAAKRSPAELLRAFSFEIACASFLVCYVLNYFTGKRQNENIALAWATKFATRDSIFDKNFSLLGTGDGKDTPLLLKEGQDVFKFYASGRRFCQGLLATMEMRARYDLLSKFVELVFPRKDTITFEVVMNEEAMDHVVLAVARKKAAKTMHKEERDLQRFASVLTSAPAGRKWVSDELAVVAESKEVAGDMITEAVLDQVLGEKACEKFGKWFISLHFSDQLAGSYKKVLTFKFVLPDASNMSEMTRLVSLVPYYIDLVGRYKLSSHARSKTDGARTKAAQEAFRELQSARQEALQRKKAEKKKLMEETDAKLSAEALRRKDEKERARQMKKSGPKVKMLRS

SEQ ID NO: 1061 - protein, 490 aa, Zea mays
  misc_feature (1)..(490): Public GI no. 50931507
  misc_feature: Utility: Useful for increasing chlorophyll and photosynthetic capacity
  misc_feature: Utility: Useful for making ornamental plants with modified leaves
  misc_feature: Utility: Useful for making plants with increased biomass and foliage
  misc_feature: Utility: Useful for making smaller plants
  misc_feature: Utility: Useful for making stronger plants
MATASSIRPPRAALVLLLLALSFSLTLAAHFEGFGSDDLHSAHADAASADDEDDEGLDVELPPPPRISLSTSTPSPPVTTTTTTTSAPNPNPDPNPTLTPPNPTPTLDLWDEDEFEGIPVPEAASSDESSTPAEAAPSDPAADAAAEAAPAPPRRPAELLRAYTVEIACVSFLICFLLNYFTGKRQNEAIALAWATRFATRDSIFDKNFSLLGTGDGKDTPLLMKEGQDVFKFYASGRRYCQGMLATMEMRARHDLLSKLVELVFPRKDTITFEVVMNEEAMDHVMLAVARKKAAKTMQKEERDLQKFAGVLTSAPAGRRWVADELAVVAESKEVAGDMITEAVLDQVLGDKAFEKFGKWFISLHFSDQLAGSYKKVLSFKFVLPDASNMAEMTRLVALVPYYIDLVGRYKLSNHARSKTEAARTKASQEAFREQQGLRQEALQRKKAEKKKLMEEAEAKLSAEALRKKEEKERARQMKKSMPKVKMLRS

SEQ ID NO: 1062 - DNA, 1298 bp, Arabidopsis thaliana
  misc_feature (1)..(1298): Ceres CLONE ID no. 8877
  misc_feature (1)..(1298): Also known as  Ceres CDNA ID no. 23389932
tcactataaagccgatccatagataaacgaggaccggccagaaatcgcttcaccattcccaaatctctcttccattttctccacacaaatttctcttcaatctccgataatggaaggaaccggcgttgtggcggtgtacggtaacggtgcgataacggaggcgaagaaatctcccttctccgtgaaggtcggtttggctcagatgctccgtggtggtgttatcatggatgtcgtcaacgccgagcaagctcgtatcgccgaggaggctggtgcttgcgccgtcatggctttggagcgtgttcctgctgatatccgcgctcaaggaggcgtcgctcgtatgagcgatccacaaatgattaaagaaatcaaacaagccgttacgattccggtgatggctaaggctaggattggtcatttcgttgaagctcagatccttgaagcaattggaatcgattacatcgatgagagcgaggttttgactcttgctgatgaagatcatcacatcaacaagcataatttccggatcccgttcgtttgcggttgccggaatctcggcgaggctctgaggaggatccgtgaaggtgcggcgatgattaggaccaaaggtgaagctggaaccggtaacattattgaagctgtgaggcatgtgaggtctgttaatggtgacattagggttttgcgaaacatggatgatgatgaggttttcactttcgctaagaaattagccgctccgtacgatctcgtgatgcagactaagcagcttggtcgtcttcctgtagtccaatccgccgccggtggagtggctactccggctgatgcagctctcatgatgcagcttggatgtgatggtgtctttgttggttctggtatcttcaagagcggtgacccagctcgtcgtgcacgtgccattgttcaggctgtgactcattacagtgaccctgagatgcttgtggaggtgagctgtgggcttggagaagccatggttgggatcaatctcaacgatgagaaggttgagaggttcgctaatcgctccgagtgatcaaagaaataaaaggtaaaatttctcagacgaaatggtttcagaattttctcagaccattttgcagtaatctctttgaaaagaagaagatgatgatattgttggtagtttgtatcctttgtgttttccttataatctttgatagtcttttgttattgtaatctcgtaatccctttgcaagaacaagtttgtcagttataataatgtactactctcttgatcgatcagttggttttgaatctgatatattcttcgattc

SEQ ID NO: 1063 - protein, 309 aa, Arabidopsis thaliana
  misc_feature (23)..(228): Pfam Name: SOR_SNZ; Pfam Description: SOR/SNZ family
  misc_feature: Utility: Useful for increasing chlorophyll and photosynthetic capacity
  misc_feature: Utility: Useful for making ornamental plants with modified leaves
  misc_feature: Utility: Useful for making plants with altered leaf shape eg curled leaves
  misc_feature: Utility: Useful for making plants with enhanced tolerance to drought
  misc_feature: Utility: Useful for making plants with increased biomass and foliage
  misc_feature: Utility: Useful for making smaller plants
MEGTGVVAVYGNGAITEAKKSPFSVKVGLAQMLRGGVIMDVVNAEQARIAEEAGACAVMALERVPADIRAQGGVARMSDPQMIKEIKQAVTIPVMAKARIGHFVEAQILEAIGIDYIDESEVLTLADEDHHINKHNFRIPFVCGCRNLGEALRRIREGAAMIRTKGEAGTGNIIEAVRHVRSVNGDIRVLRNMDDDEVFTFAKKLAAPYDLVMQTKQLGRLPVVQSAAGGVATPADAALMMQLGCDGVFVGSGIFKSGDPARRARAIVQAVTHYSDPEMLVEVSCGLGEAMVGINLNDEKVERFANRSE

SEQ ID NO: 1064 - protein, 309 aa, Arabidopsis thaliana
  misc_feature (1)..(309): Public GI no. 2501578
  misc_feature: Utility: Useful for increasing chlorophyll and photosynthetic capacity
  misc_feature: Utility: Useful for making ornamental plants with modified leaves
  misc_feature: Utility: Useful for making plants with altered leaf shape eg curled leaves
  misc_feature: Utility: Useful for making plants with enhanced tolerance to drought
  misc_feature: Utility: Useful for making plants with increased biomass and foliage
  misc_feature: Utility: Useful for making smaller plants
MAGTGVVAVYGNGAITETKKSPFSVKVGLAQMLRGGVIMDVVNPEQARIAEEAGACAVMALERVPADIRAQGGVARMSDPQLIKEIKQSVTIPVMAKARIGHFVEAQILEAIGIDYVDESEVLTPADEENHINKHNFRIPFVCGCRNLGEALRRIREGAAMIRTKGEAGTGNVIEAVRHVRSVMGDIRLLRNMDDDEVFTFAKKIAAPYDLVMQTKQLGRLPVVQFAAGGVATPADAALMMQLGCDGVFVGSGVFKSGDPARRARAIVQAVTHYSDPDMLAEVSCGLGEAMVGINLNDKKVERFANRSE

SEQ ID NO: 1065 - protein, 311 aa, Glycine max
  misc_feature (1)..(311): Ceres CLONE ID no. 707209
  misc_feature: Utility: Useful for increasing chlorophyll and photosynthetic capacity
  misc_feature: Utility: Useful for making ornamental plants with modified leaves
  misc_feature: Utility: Useful for making plants with altered leaf shape eg curled leaves
  misc_feature: Utility: Useful for making plants with enhanced tolerance to drought
  misc_feature: Utility: Useful for making plants with increased biomass and foliage
  misc_feature: Utility: Useful for making smaller plants
MEGSGSGVVTVYGNGAITETKKSPFSVKVGLAQMLRGGVIMDVVNAEQTRIAEEAGACAVMALERVPADIRAQGGVARMSDPQLIKDIKRAVTIPVMAKARIGHFVEAQILEAIGIDYVDESEVLTLADDANHINKHNFRIPFVCGCRNLGEALRRIREGAAMIRTKGEAGTGNIIEAVRHVRSVMSDIRVLRNMDDDEVFTFAKSIAAPYDLVMQTKQLGRLPVVHFAAGGVATPADAALMMQLGCDGVFVGSGVFKSGDPAKRARAIVQAVTHYSDPEVLAEVSCGLGEAMVGINLTDDKVERFANRSE

SEQ ID NO: 1066 - protein, 309 aa, Glycine max
  misc_feature (1)..(309): Public GI no. 46399271
  misc_feature: Utility: Useful for increasing chlorophyll and photosynthetic capacity
  misc_feature: Utility: Useful for making ornamental plants with modified leaves
  misc_feature: Utility: Useful for making plants with altered leaf shape eg curled leaves
  misc_feature: Utility: Useful for making plants with enhanced tolerance to drought
  misc_feature: Utility: Useful for making plants with increased biomass and foliage
  misc_feature: Utility: Useful for making smaller plants
MAGSGVVTLYGNGALTETTKQSPFSVKVGLAQMLRGGVIMDVVNAEQARIAEEAGACAVMALERVPADIRAQGGVARMSDPQLIKEIKQAVTIPVMAKARIGHFVEAQILEAIGIDYVDESEVLTLADDENHINKHNFRIPFVCGCRNLGEALRRIREGAAMIRTKGEAGTGNIIEAVRHVRSVMGDIRVLRNMDDDEVFTFAKKLQAPYDLVMQTKQLGRLPVVHFAAGGVATPADAALMMQLGCDGVFVGSGIFKSGDPAKRGRAIVQAVTHYSDPGLLAEISCGLGEAMVGINLDDKVERYANRSE

SEQ ID NO: 1067 - protein, 312 aa, Glycine max
  misc_feature (1)..(312): Public GI no. 45477167
  misc_feature: Utility: Useful for increasing chlorophyll and photosynthetic capacity
  misc_feature: Utility: Useful for making ornamental plants with modified leaves
  misc_feature: Utility: Useful for making plants with altered leaf shape eg curled leaves
  misc_feature: Utility: Useful for making plants with enhanced tolerance to drought
  misc_feature: Utility: Useful for making plants with increased biomass and foliage
  misc_feature: Utility: Useful for making smaller plants
MEGEGSRVVALYDGNGAITETKKSPFSVKVGLAQMLRGGVIMDVVNADQARIAEEAGACAVMALERVPADIRAQGGVARMSDPQLIKEIKRAVTIPVMAKARIGHFVEAQILEAIGIDYVDESEVLTLADDANHINKHNFRIPFVCGCRNLGEALRRIREGAAMIRTKGEAGTGNIIEAVRHVRSVMSDIRVLRNMDDDEVFTFAKSIAAPYDLVMQTKQLGRLPVVHFAAGGVATPADAALMMQLGCDGVFVGSGVFKSGDPAKRARAIVQAVTHYSDPEILAEVSCGLGEAMVGINLSDTNVERFANRSE

SEQ ID NO: 1068 - protein, 309 aa, Glycine max
  misc_feature (1)..(309): Public GI no. 17104657
  misc_feature: Utility: Useful for increasing chlorophyll and photosynthetic capacity
  misc_feature: Utility: Useful for making ornamental plants with modified leaves
  misc_feature: Utility: Useful for making plants with altered leaf shape eg curled leaves
  misc_feature: Utility: Useful for making plants with enhanced tolerance to drought
  misc_feature: Utility: Useful for making plants with increased biomass and foliage
  misc_feature: Utility: Useful for making smaller plants
MAGTGVVAVYGEGAMTETKQKSPFSVKVGLAQMLRGGVIMDVVNAEQARIAEEAGACAVMALERVPADIRAQGGVARMSDPEMIKEIKNAVTIPVMAKARIGHFVEAQILEAIGVDYVDESEVLTLADEDNHINKHNFKIPFVCGCRNLGEALRRIREGAAMIRTKGEAGTGNVVEAVRHVRSVNGAIRLLRSMDDDEVFTYAKKIAAPYDLVVQTKELGRLPVVQFAAGGVATPADAALMMQLGCDGVFVGSGVFKSGDPVKRAKAIVQAVTNYRDAAVLAEVSCGLGEAMVGLNLDDKVERFASRSE

SEQ ID NO: 1069 - protein, 340 aa, Triticum aestivum
  misc_feature (1)..(340): Ceres CLONE ID no. 575584
  misc_feature: Utility: Useful for increasing chlorophyll and photosynthetic capacity
  misc_feature: Utility: Useful for making ornamental plants with modified leaves
  misc_feature: Utility: Useful for making plants with altered leaf shape eg curled leaves
  misc_feature: Utility: Useful for making plants with enhanced tolerance to drought
  misc_feature: Utility: Useful for making plants with increased biomass and foliage
  misc_feature: Utility: Useful for making smaller plants
  misc_feature (157)..(157): Xaa is any aa, unknown, or other
  misc_feature (167)..(167): Xaa is any aa, unknown, or other
IPHAPPLFRRLPSLFSSLPLAAEKMASDGSGVVTVYGSGNNGAGTQLEPKSSPFSVKVGLAQMLRGGVIMDVVNAEQARIAEEAGACAVMALERVPADIRAQGGVARMSDPGLIREIKRAVTIPVMAKARIGHFVEAQILESIGVDYVDESEVLTLXDDAHHINKHXFRVPFVCGCRNLGEALRRIREGAAMIRTKGEAGTGNVIEAVRHVRSVMGDVRALRSMDDDEVFTYAKSIAAPYDLVMQTKQLGRLPVVQFAAGGVATPADAALMMQLGCDGVFVGSGVFKSGDPARRARAIVQAVTHYSDPNVLAEVSCDLGEAMVGINLSDPKVERFAARSE

SEQ ID NO: 1070 - protein, 318 aa, Triticum aestivum
  misc_feature (1)..(318): Public GI no. 50933621
  misc_feature: Utility: Useful for increasing chlorophyll and photosynthetic capacity
  misc_feature: Utility: Useful for making ornamental plants with modified leaves
  misc_feature: Utility: Useful for making plants with altered leaf shape eg curled leaves
  misc_feature: Utility: Useful for making plants with enhanced tolerance to drought
  misc_feature: Utility: Useful for making plants with increased biomass and foliage
  misc_feature: Utility: Useful for making smaller plants
MATDGTGVVTVYGSGTNGAALLEPSNHKSATFSVKVGLAQMLRGGVIMDVVTPEQARIAEEAGACAVMALERVPADIRAQGGVARMSDPGLIRDIKRAVTIPVMAKARIGHFVEAQILEAIGVDYVDESEVLTLADDAHHINKHNFRVPFVCGCRDLGEALRRIREGAAMIRTKGEAGTGNVVEAVRHVRSVMGDIRALRNMDDDEVFSYAKRIAAPYDLVMQTKQLGRLPVVQFAAGGVATPADAALMMQLGCDGVFVGSGIFKSGDPARRARAIVQAVTHYSDPKILAEVSSGLGEAMVGINLSDPKVERFAARSE

SEQ ID NO: 1071 - protein, 309 aa, Triticum aestivum
  misc_feature (1)..(309): Public GI no. 45477162
  misc_feature: Utility: Useful for increasing chlorophyll and photosynthetic capacity
  misc_feature: Utility: Useful for making ornamental plants with modified leaves
  misc_feature: Utility: Useful for making plants with altered leaf shape eg curled leaves
  misc_feature: Utility: Useful for making plants with enhanced tolerance to drought
  misc_feature: Utility: Useful for making plants with increased biomass and foliage
  misc_feature: Utility: Useful for making smaller plants
  misc_feature (129)..(129): Xaa is any aa, unknown, or other
MASDGVVTVYGDGAITDTKVSSYAVKVGLAQMLRGGVIMDVVNAEQARIAEEAGATAVMALERVPADIRAQGGVARMSDPGLIKEIKSAVTIPVMAKARIGHFVEAQILEAIGIDYIDESEVLTPADDXHHINKHNFRIPFVCGCRNLGEALRRIAEGAAMIRTKGEAGTGNVIEAVRHVRSVLGDIRKLQSLDDDEVFAFAKQIAAPYELVRQTKQLGRLPVVNFAAGGVATPADAALMMQLGCDGVFVGSGVFKSGDPARRARAIVQAVTHYNDPHILAEVSCSLGEAMVGINLKDEKVERYAERSE

SEQ ID NO: 1072 - protein, 317 aa, Zea mays
  misc_feature (1)..(317): Ceres CLONE ID no. 1278155
  misc_feature: Utility: Useful for increasing chlorophyll and photosynthetic capacity
  misc_feature: Utility: Useful for making ornamental plants with modified leaves
  misc_feature: Utility: Useful for making plants with altered leaf shape eg curled leaves
  misc_feature: Utility: Useful for making plants with enhanced tolerance to drought
  misc_feature: Utility: Useful for making plants with increased biomass and foliage
  misc_feature: Utility: Useful for making smaller plants
MASDGSGVVTVYGSNGAELLEPSKQPKSATFSVKVGLAQMLRGGVIMDVVTPEQARLAEEAGACAVMALERVPADIRAQGGVARMSDPGLIRDIKRAVTIPVMAKARIGHFVEAQILEAVGVDYVDESEVLTPADDAHHINKHNFRVPFVCGCRDLGEALRRVREGAAMIRTKGEAGTGNVVEAVRHVRSVMGDVRALRSMDDDEVFAYAKRIAAPYDLVMQTKQLGRLPVVQFAAGGVATPADAALMMQLGCDGVFVGSGIFKSGDPARRARAIVQAVTHYSDPTILADVSTGLGEAMVGINLNDPKVERYAARSE

SEQ ID NO: 1073 - protein, 317 aa, Zea mays
  misc_feature (1)..(317): Ceres CLONE ID no. 1371669
  misc_feature: Utility: Useful for increasing chlorophyll and photosynthetic capacity
  misc_feature: Utility: Useful for making ornamental plants with modified leaves
  misc_feature: Utility: Useful for making plants with altered leaf shape eg curled leaves
  misc_feature: Utility: Useful for making plants with enhanced tolerance to drought
  misc_feature: Utility: Useful for making plants with increased biomass and foliage
  misc_feature: Utility: Useful for making smaller plants
MASDGSGVVTVYGNNGAALLEPPKQPKSSTFSVKVGLAQMLRGGVIMDVVTPEQARLAEEAGACAVMALERVPADIRAQGGVARMSDPGLIRDIKRAVTIPVMAKARIGHFVEAQILEAVGVDYVDESEVLTPADDAHHINKHNFRVPFVCGCRDLGEALRRVREGAAMIRTKGEAGTGNVVEAVRHVRSVAGAVRALRGMDDDEVFAYAKRIAAPYDLVMQTKQLGRLPVVQFAAGGVATPADAALMMQLGCDGVFVGSGIFKSGDPARRARAIVQAVTHYSDPTILTDVSAGLGEAMVGINLNDPKVERYAARSE

SEQ ID NO: 1074 - protein, 313 aa, Zea mays
  misc_feature (1)..(313): Public GI no. 31429734
  misc_feature: Utility: Useful for increasing chlorophyll and photosynthetic capacity
  misc_feature: Utility: Useful for making ornamental plants with modified leaves
  misc_feature: Utility: Useful for making plants with altered leaf shape eg curled leaves
  misc_feature: Utility: Useful for making plants with enhanced tolerance to drought
  misc_feature: Utility: Useful for making plants with increased biomass and foliage
  misc_feature: Utility: Useful for making smaller plants
MASDGTDVVALYGGANGLSHKSGSFSVKVGLAQMLRGGVIMDVVTPEQARIAEEAGACAVMALERVPADIRAQGGVARMSDPGLIRDIKRSVTIPVMAKARIGHLVEAQILEAIGVDYVDESEVLTLADDAHHINKNNFRVPFVCGCRDLGEALRRIREGAAMIRTKGEAGTGNVVEAVRHVRSVMGDIRALRSMDDDEVFSYAKRIAAPYDLVMQTKQLGRLPVVQFAAGGVATPADAALMMQLGCDGVFVGSGIFKSGDPALRARAIVQAVTHYSDPKILAEVSSGLGEAMVGINLSDPKIHVERFAARSD

SEQ ID NO: 1075 - DNA, 763 bp, Arabidopsis thaliana
  misc_feature (1)..(763): Ceres CLONE ID no. 8916
  misc_feature (1)..(763): Also known as  Ceres CDNA ID no. 23389970
aaaaaaacacaatccctcttagaaacagagagcttctcttctttctccattattcatcactttcttccccgaagatgcgtcctttagacgagaccgagacaaccgtcgtcttcgagaagctcttcaaattcgtcggcaacaacctcaagaagatcgtcgagaacccatcagacgaaggacccgaatctacacccggcagctactgcttccgcctccagaaaaacagagtctactacgtcagcgaagccctcgtgaagcgagccacaaacatctccaggaaaaacctagtctccttcggaacctgcatcgggaaatacactcacgccggtagtttccatctgacgattatgtcactcaatatcttggcggcgaatgctaaacacaaggtatggcttaaacccacttcggagatgtcgtttctttatgggaaccatgtcttgaaaggtggattagggaggattactgatagtattgttcctggagatggtgttgttgtgttctcgatgtctgatgttccgttagggtttgggattgctgcgaagagtacacaggattgtaggaaattggatcctaatggtattgttgtgcttcatcaggctgatattggagagtatttgaggggtgaagatgacctttgaaagtttaaaggttttgtctttgttgtgtcttagtttgattctgcttgttgctttgagttttaaagtatgtagctgttacaagtttcgtggaacttggttctggatctatgaaagtctcgattttt

SEQ ID NO: 1076 - protein, 96 aa, Arabidopsis thaliana
  misc_feature: Utility: Useful for increasing chlorophyll and photosynthetic capacity
  misc_feature: Utility: Useful for making plants sterile and for genetic confinement
  misc_feature: Utility: Useful for making smaller plants
MSLNILAANAKHKVWLKPTSEMSFLYGNHVLKGGLGRITDSIVPGDGVVVFSMSDVPLGFGIAAKSTQDCRKLDPNGIVVLHQADIGEYLRGEDDL

SEQ ID NO: 1077 - protein, 96 aa, Brassica napus
  misc_feature (1)..(96): Ceres CLONE ID no. 945362
  misc_feature: Utility: Useful for increasing chlorophyll and photosynthetic capacity
  misc_feature: Utility: Useful for making plants sterile and for genetic confinement
  misc_feature: Utility: Useful for making smaller plants
  misc_feature (90)..(90): Xaa is any aa, unknown, or other
  misc_feature (95)..(95): Xaa is any aa, unknown, or other
MSLNLLAANAKHKVWLKPTSEMSFLYGNHVLKGGLGRITDSIVPGDGVVVFSMSDVPLGFGIAAKSTQDCRKLDPNGIVVLHQADIGEYXRDEDXL

SEQ ID NO: 1078 - DNA, 1049 bp, Arabidopsis thaliana
  misc_feature (1)..(1049): Ceres CLONE ID no. 10879
  misc_feature (1)..(1049): Also known as  Ceres CDNA ID no. 23646526
aactgccaaaactcttcacttaattctccggcgtatacaagtcgccggcaaaaatgtcgatgtcgaaaagctccaagatgcttcagttcataaactacaggatgcgagtaacaatccaagacggaagacagctaatcggaaaattcatggcgttcgatcgccacatgaatcttgttcttggcgactgcgaagagtttcgaaaacttcctccggcgaaaggtaataagaagacgagcgaagaaagagaagagcgtcgtactctaggtttggttttacttagaggagaagaagtgatttcgatgactgtcgaaggtccaccgccaccggaagaatctcgcgccaaatctggatctgttaccgccgtggctggtcctggaatcggtcgtgctgctggacgcggagtacctactggtccgttagttcaagctcagcctggtttatctggtcctgttcgtggaattggtggacctgctcctggaatgatgcagcctcagatctctagaccaccacagattattcgtcctccgggacaaatgccaccacagcctccttttgctggtcaaggaggtcctcctccaccttatggtatgagaccaccgtatcctggtccaccaccgcctcagtatggtggacagcaaaggccaatgatgattcctccacctggtggtatgatgagaggacctcctccacctcatggtatgcaaggaccgcctccttctcgccctggaatacctccccccggtggtgctccgatgtttgctccgcctcatcctggcatgccacctgctccgccaaatcaccataatcagcaacattgattaggagtcacttcatctacaacgaaagcaacatccacatgattgagttacccctcggctagtcgtagcgtttttctccgtgaagctcagagaattgatgagttcatattggtgatttctcgtggaaaaagcaactgattttagaaatagtgaacttgtaggagttacaaccttgctccatgaacttgaatgtattacttgtaaaagaggctctcaatggttttgactggc

SEQ ID NO: 1079 - protein, 254 aa, Arabidopsis thaliana
  misc_feature (7)..(85): Pfam Name: LSM; Pfam Description: LSM domain
  misc_feature: Utility: Useful for increasing chlorophyll and photosynthetic capacity
  misc_feature: Utility: Useful for making ornamental plants with modified leaves
  misc_feature: Utility: Useful for making plants with increased biomass and foliage
  misc_feature: Utility: Useful for making smaller plants
  misc_feature: Utility: Useful for making stronger plants
MSMSKSSKMLQFINYRMRVTIQDGRQLIGKFMAFDRHMNLVLGDCEEFRKLPPAKGNKKTSEEREERRTLGLVLLRGEEVISMTVEGPPPPEESRAKSGSVTAVAGPGIGRAAGRGVPTGPLVQAQPGLSGPVRGIGGPAPGMMQPQISRPPQIIRPPGQMPPQPPFAGQGGPPPPYGMRPPYPGPPPPQYGGQQRPMMIPPPGGMMRGPPPPHGMQGPPPSRPGIPPPGGAPMFAPPHPGMPPAPPNHHNQQH

SEQ ID NO: 1080 - protein, 257 aa, Arabidopsis thaliana
  misc_feature (1)..(257): Ceres CLONE ID no. 205653
  misc_feature: Utility: Useful for increasing chlorophyll and photosynthetic capacity
  misc_feature: Utility: Useful for making ornamental plants with modified leaves
  misc_feature: Utility: Useful for making plants with increased biomass and foliage
  misc_feature: Utility: Useful for making smaller plants
  misc_feature: Utility: Useful for making stronger plants
MSMSKSSKMLQFINYRMRVTIQDGRQLVGKFMAFDRHMNLVLGDCEEFRKLPPAKGKKINEEREDRRTLGLVLLRGEEVISMTVEGPPPPEESRAKAGSAAAVAGPGIGRAAGRGVPTGPLVQAQPGLSGPVRGVGGPAPGMMQPQISRPPQLSAPPIIRPPGQMLPPPPFGGQGPPMGRGPPPPYGMRPPPQQFSGPPPPQYGQRPMIPPPGGMMRGPPPPLHGMQGPPPPRPGMPPAPGGFAPPRPGMPPHNQQQ

SEQ ID NO: 1081 - protein, 176 aa, Arabidopsis thaliana
  misc_feature (1)..(176): Ceres CLONE ID no. 36005
  misc_feature: Utility: Useful for increasing chlorophyll and photosynthetic capacity
  misc_feature: Utility: Useful for making ornamental plants with modified leaves
  misc_feature: Utility: Useful for making plants with increased biomass and foliage
  misc_feature: Utility: Useful for making smaller plants
  misc_feature: Utility: Useful for making stronger plants
MTVEGPPPPEESRAKAGSAAAVAGPGIGRAAGRGVPTGPLVQAQPGLSGPVRGVGGPAPGMMQPQISRPPQLSAPPIIRPPGQMLPPPPFGGQGPPMGRGPPPPYGMRPPPQQFSGPPPPQYGQRPMIPPPGGMMRGPPPPPHGMQGPPPPRPGMPPAPGGFAPPRPGMPPHNQQQ

SEQ ID NO: 1082 - protein, 251 aa, Zea mays
  misc_feature (1)..(251): Ceres CLONE ID no. 1375012
  misc_feature: Utility: Useful for increasing chlorophyll and photosynthetic capacity
  misc_feature: Utility: Useful for making ornamental plants with modified leaves
  misc_feature: Utility: Useful for making plants with increased biomass and foliage
  misc_feature: Utility: Useful for making smaller plants
  misc_feature: Utility: Useful for making stronger plants
MSMSKSSKMLQFINYRMRVTIQDGRQLVGKFMAFDRHMNLVLGDCEEFRKLPPGKGKKINEEREERRTLGLVLLRGEEVISMTVKGPPPPEESRAKAGSAAALAGPGVGRAAGRGVPTGPLVQAQPGLSGPVRGVGGPSPGMMQPQISRPPVMRPPGQMLPPPPAFGGQGPPMGRGPPPPAYGGMRPQFGGPPPPYGQRPMGPPPGGMMMRGPPPPPHGMQGPPPPRPPPGGFAPRPGMQGPPPPQHNQQQ

SEQ ID NO: 1083 - protein, 281 aa, Glycine max
  misc_feature (1)..(281): Ceres CLONE ID no. 519929
  misc_feature: Utility: Useful for increasing chlorophyll and photosynthetic capacity
  misc_feature: Utility: Useful for making ornamental plants with modified leaves
  misc_feature: Utility: Useful for making plants with increased biomass and foliage
  misc_feature: Utility: Useful for making smaller plants
  misc_feature: Utility: Useful for making stronger plants
  misc_feature (120)..(120): Xaa is any aa, unknown, or other
MSMSKSSKMLQYINYRMRVTIQDGRQLVGKFMAFDRHMNLVLGDCEEFRKLPPAKGKKPAEGGDREDRRTLGLVLLRGEEVISMTVEGPPPPEESRSKAVGAAALAGPGIGRAAGRGIPXAPVVQAQPGLAGPVRGMGGPAPGMMQPQISRPPQLNAPPVSYPGGGPPVMRPPGQMPGQFAPPPMARGPPPPMPPGQFAPQRPGGPPPQFQVPPQFGQRPMGPPPPGQMVRGPPAPPRPGMPAPPPPRPGMPPPPGSGVPVFGPPRPGMPPPPNPPNQQQQ

SEQ ID NO: 1084 - protein, 265 aa, Triticum aestivum
  misc_feature (1)..(265): Ceres CLONE ID no. 759040
  misc_feature: Utility: Useful for increasing chlorophyll and photosynthetic capacity
  misc_feature: Utility: Useful for making ornamental plants with modified leaves
  misc_feature: Utility: Useful for making plants with increased biomass and foliage
  misc_feature: Utility: Useful for making smaller plants
  misc_feature: Utility: Useful for making stronger plants
MSNPKGSKMLQFVNYRMRVTIQDGRQLVGKFMAFDRHMNLVLGDCEEFRKLPPSKSSKTTGEREERRTLGLLLLRGEEVVSMTVEGPPPPDESRAKASAGVAALSGTGVGRAAGRGVATGPLLQAQPGLSGPVRGVGGPAPGMMQPQISRPPMPNLSAPPVAYPQVVRPPPMGMPPMRPGGPPPMQMQFQRPPGPPPAPYPGAPPQQFMRGPPPMGPPPGRPGMPSMPPPPGMRPMPPTQFGQPPRHGMPPPPPGPQQPGQNPQQ

SEQ ID NO: 1085 - protein, 261 aa, Triticum aestivum
  misc_feature (1)..(261): Public GI no. 50934399
  misc_feature: Utility: Useful for increasing chlorophyll and photosynthetic capacity
  misc_feature: Utility: Useful for making ornamental plants with modified leaves
  misc_feature: Utility: Useful for making plants with increased biomass and foliage
  misc_feature: Utility: Useful for making smaller plants
  misc_feature: Utility: Useful for making stronger plants
MSNPKGSKMLQFVNYRMRVTIQDGRQLVGKFMAFDRHMNLVLGDCEEFRKLPPSKSSKTTGEREERRTLGLLLLRGEEVVSMTVEGPPPPDESRAKAAGAGAAMAGPGVGRAAGRGVPAGQMLQAQPGLAGPVRGVGGPAPGMMQPQISRPPMPNLSAPPVAYPQVVRPPPGQMPPPMRPPQMPIPFQRPPGVPPAFPGGPPPPPGPFMRGPPPMGPPQVRPGMPGGPPPGMRPGMPPPPFRPGMPPPPPGPQQPGQNPPQ

SEQ ID NO: 1086 - DNA, 1457 bp, Arabidopsis thaliana
  misc_feature (1)..(1457): Ceres CLONE ID no. 19116
  misc_feature (1)..(1457): Also known as  Ceres CDNA ID no. 23369541
gtggtaaattagtcagatttcgatttggaaccctaaaaaaattcaaaagacgatcctcttctcgaagaaactcgattcttgtggattcgatttcattaaggaattttgaattgttgcctgtgatgggtggtttggctatggaggaaatgcctttatcggtgctattcgagcaagctaggaaaattcatcttgctgcttcagagtctggtgttgatcaggatgttgtgaagaaaggatgtgagatgtttcagaagtgcgaagatatgatcgggaagctggcgctgttttcgtctaacgagactaaagaagatattagcaccaacaatctcaaatatcttttggtgccttattatcttgcggagttgacagagaaaatcatacaggaggaccggattcagattgtcaaagcctcgtatgctaagttgaaggagttcttttcgttctgtgaggcaatggagcttgttccggatgaggagttggaggcttcttcacgaggaggttctggtgcacctgctgatcgaagggctctcaagatagctcggttcaaacgtcaaaaggctgcagaggcaaagcttcttgaaattaaagagaggaaggagcgacgtggacgttccactaaagcatcagctttgtcgactccggttgaatctggagaagatgatattccagatgatgacagcgaagaagagagagaggcctggctctcctcaattaacttggctatttgtaaggctattgatctgttggaaatgctaaagagagaagaggaaatgctctctgcaataaaggaaagacagttgaaggatggagagggtggattttctcgggatgctcttgatgatcgtacaaagaaagctgaaacctggcacagagacgctgctgcaaggatacagtactctaaaccggcacaaccaatcacttgtgccacatttgcacaagatgtgttagaaggaagagcttcggtatcacaaggtcacgaacacaagaaccaacctcttatattcggtccagcaagcatcgtgggtggaccgctctctaccgagagagaaagaatgatagctcaggtcttccaaccaagtcacaggatgccaacaatgtgcatagaggatgctgggttaacagagatgaacataatgaatgattggcaagagcagacgaaaaaagccattgaagaagcaaccacctcatggtacaatgataaacctctaagaagaaaagaagaagacgaggaagatgatgatgaagacgacgaacctgtgatgaaagctagagctttcgatgattggaaggatgataatcctcgcggtgcaggtaacaagaaactcacaccttgtggctgagactagagaccgagacacacattatttaacactttctccctctcttttgtttcttatttccaaaacctcttcgttcacttattataatgtctgtaatgtaatcatctttctactctt

SEQ ID NO: 1087 - protein, 405 aa, Arabidopsis thaliana
  misc_feature (9)..(393): Pfam Name: TAP42; Pfam Description: TAP42-like family
  misc_feature: Utility: Useful for increasing chlorophyll and photosynthetic capacity
  misc_feature: Utility: Useful for making plants with increased biomass and foliage
  misc_feature: Utility: Useful for making shorter plants and plants with modified flowers
  misc_feature: Utility: Useful for making smaller plants
  misc_feature: Utility: Useful for making stronger plants
MGGLAMEEMPLSVLFEQARKIHLAASESGVDQDVVKKGCEMFQKCEDMIGKLALFSSNETKEDISTNNLKYLLVPYYLAELTEKIIQEDRIQIVKASYAKLKEFFSFCEAMELVPDEELEASSRGGSGAPADRRALKIARFKRQKAAEAKLLEIKERKERRGRSTKASALSTPVESGEDDIPDDDSEEEREAWLSSINLAICKAIDLLEMLKREEEMLSAIKERQLKDGEGGFSRDALDDRTKKAETWHRDAAARIQYSKPAQPITCATFAQDVLEGRASVSQGHEHKNQPLIFGPASIVGGPLSTERERMIAQVFQPSHRMPTMCIEDAGLTEMNIMNDWQEQTKKAIEEATTSWYNDKPLRRKEEDEEDDDEDDEPVMKARAFDDWKDDNPRGAGNKKLTPCG

SEQ ID NO: 1088 - protein, 413 aa, Arabidopsis thaliana
  misc_feature (1)..(413): Public GI no. 8809589
  misc_feature: Utility: Useful for increasing chlorophyll and photosynthetic capacity
  misc_feature: Utility: Useful for making plants with increased biomass and foliage
  misc_feature: Utility: Useful for making shorter plants and plants with modified flowers
  misc_feature: Utility: Useful for making smaller plants
  misc_feature: Utility: Useful for making stronger plants
MGGLAMEEMPLSVLFEQARKIHLAASESGVDQDVVKKGCEMFQKCEDMIGKLALFSSNETKEDISTNNLKYLLVPYYLAELTEKIIQEDRIQIVKASYAKLKEFFSFCEAMELVPDEELEASSRGGSGAPADRRALKIARFKRQKAAEAKLLEIKERKERRGRSTKASALSTPVESGEDDIPDDDSEEERELSCLIAFLCRPGSPQLTWLFAIDLLEMLKREEEMLSAIKERQLKDGEGGFSRDALDDRTKKAETWHRDAAARIQYSKPAQPITCATFAQDVLEGRASVSQGHEHKNQPLIFGPASIVGGPLSTERERMIAQVFQPSHRMPTMCIEDAGLTEMNIMNDWQEQTKKAIEEATTSWYNDKPLRRKEEDEEDDDEDEEAVMKARAFDDWKDDNPRGAGNKKLTPCG

SEQ ID NO: 1089 - protein, 418 aa, Arabidopsis thaliana
  misc_feature (1)..(418): Public GI no. 29367365
  misc_feature: Utility: Useful for increasing chlorophyll and photosynthetic capacity
  misc_feature: Utility: Useful for making plants with increased biomass and foliage
  misc_feature: Utility: Useful for making shorter plants and plants with modified flowers
  misc_feature: Utility: Useful for making smaller plants
  misc_feature: Utility: Useful for making stronger plants
MVEVEEVSNKMQAQMRLHPAAAAEEEDADLPLPALFDKASHLHSLASSSSLDQEGIRKGVDLLRRCDEMVSKLGLFSSNETKDDVSTANLKYLLVPYYLGEMTERVAQEDRIPVLKASQDHLKEFISICEALELISEDELELSRQKQPDTMANRRAQKAARFKRQKAAETKLLEIKERKERRRRSLRAAALSAPIEAGEEDAFEDDGEEEREAWLATISLALCKAFDLLDMLKKEEEMLLAVKERQAKDGNAFAREMLDERTKKAEAWHHNAANRAPYSKPADPITCATFAQDVIEGRASVSQAHEHKHQPLIFGPASLVGGGLTSERERMAAQVFQPSYRLPTMSIEEAGLREMKMMEKWQERTAKMIQESNSAWHKDGSRSAQEDEDAEEEKARAWDDWKDDNPRGAGNKKLTPCG

SEQ ID NO: 1090 - protein, 416 aa, Zea mays
  misc_feature (1)..(416): Ceres CLONE ID no. 325957
  misc_feature: Utility: Useful for increasing chlorophyll and photosynthetic capacity
  misc_feature: Utility: Useful for making plants with increased biomass and foliage
  misc_feature: Utility: Useful for making shorter plants and plants with modified flowers
  misc_feature: Utility: Useful for making smaller plants
  misc_feature: Utility: Useful for making stronger plants
MVDVEETGNKLQSQMRLHAEPEDDAADLPLPALFDRASRLHALASSSALDQDGIRTGVDLLRRCDDMVSKLGLFSPNETKEDVSTANLKYLLVPYYLAEMTEKIAQEDRIPVLKTSQDHLKEFIALCEVLELIPEDELELSRQKQPDTLTNRRAQKVARFKRQKAAETKLQEIRERKERRGRSLRAAALSAPIEAGEEDDLENDGEEEREAWLATISLALCKAFDLLDMLKKEEEMLQAVKERKAKDGNAFAREMLDERTKKAETWHHNAANRVAYSKPADPITCATFAQDVIEGRASVSQAHEHKHQPLIFGPASIVGGGLTSERERMTAQVFQPSYRMPTMSIEEAGLREMKMMEKWQERTAEVMKESTSAWHKDGSSSAQEDEDAEEEKARAWDDWKDDNPRGAGNKKLTPCG

SEQ ID NO: 1091 - protein, 379 aa, Zea mays
  misc_feature (1)..(379): Public GI no. 984756
  misc_feature: Utility: Useful for increasing chlorophyll and photosynthetic capacity
  misc_feature: Utility: Useful for making plants with increased biomass and foliage
  misc_feature: Utility: Useful for making shorter plants and plants with modified flowers
  misc_feature: Utility: Useful for making smaller plants
  misc_feature: Utility: Useful for making stronger plants
MVEVEEVSNKMQVQMRLHPAAAAEEEDADLPLPALFDKASHLHSLASSSSLDQEGIRKGVDLLRRCDEMVSKVGLFSSNETKDDISTANLKYLLVPYYLGEMTERVAQEDRIPVLKASQDHLKEFISICEALELISEDELEISRQKNLIPWQIEEHRRLHGSSAKRLQKQSSRIKERKERRRRHESSCLSAPIELGGDLLRMMEKEREGMVSYYLIGSIEGFDLLDMLKKEEEIVPAVKEGKRRMVMHLLVKCLMNVQKGLKHGTIMLPTVHHTPNQLIQSLVQLTSERERMAAQVFQPSYRLPTMSIEEAGLREMKMMEKWQERTAKMIQESNSAWHKDGSRSAQEDEDAEEEKARGWDDWKDDNPRGAGNKKLTPCG

SEQ ID NO: 1092 - DNA, 780 bp, Arabidopsis thaliana
  misc_feature (1)..(780): Ceres CLONE ID no. 19319
  misc_feature (1)..(780): Also known as  Ceres CDNA ID no. 23471366
atagttttatatcatatcaatcgacatggcgaatgtggaccgtgatcggcgtgtgcatgtagaccgtactgacaaacgtgttcatcagccaaactacgaagatgatgtcggttttggtggctatggcggttatggtgctggttctgattataagagtcgcggcccctccactaaccaaatcttggcacttatagcaggagttcccattggtggcacactgctaaccctagctggactcactctagccggttcggtgatcggcttgctagtctccatacccctcttcctcctcttcagtccggtgatagtcccggcggctctcactattgggcttgctgtgacgggaatcttggcttctggtttgtttgggttgacgggtctgagctcggtctcgtgggtcctcaactacctccgtgggacgagtgatacagtgccagagcaattggactacgctaaacggcgtatggctgatgcggtaagctatgctggtatgaagggaaaagagatgggtcagtatgtgcaagataaggcgcatgaggctcgtgagactgagttcatgactgagacccatgagccgggtaaggccaggagaggctcataagctaatataaattgcgggagtcagttggaaaggcgataaatgtagttttacttttatgttccagtttctttcctcttttaagaatatctttgtctatatgtgtacgttcgttttgtcttgtccaaataaaaatccttgttagtgaaataagaaatgaaataaatatgttttcttttttg

SEQ ID NO: 1093 - protein, 191 aa, Arabidopsis thaliana
  misc_feature (48)..(165): Pfam Name: Oleosin; Pfam Description: Oleosin
  misc_feature: Utility: Useful for increasing chlorophyll and photosynthetic capacity
  misc_feature: Utility: Useful for making plants with enhanced abiotic stress tolerance
  misc_feature: Utility: Useful for making smaller plants
  misc_feature (160)..(160): Xaa is any aa, unknown, or other
MANVDRDRRVHVDRTDKRVHQPNYEDDVGFGGYGGYGAGSDYKSRGPSTNQILALIAGVPIGGTLLTLAGLTLAGSVIGLLVSIPLFLLFSPVIVPAALTIGLAVTGILASGLFGLTGLSSVSWVLNYLRGTSDTVPEQLDYAKRRMADAVSYAGMKGKXMGQYVQDKAHEARETEFMTETHEPGKARRGS

SEQ ID NO: 1094 - protein, 140 aa, Glycine max
  misc_feature (1)..(140): Ceres CLONE ID no. 1171110
  misc_feature: Utility: Useful for increasing chlorophyll and photosynthetic capacity
  misc_feature: Utility: Useful for making plants with enhanced abiotic stress tolerance
  misc_feature: Utility: Useful for making smaller plants
MSLTGSQLLALLAGVPLGAMLLLLSGISLIASLLGLAVATPLFIFFSPLLVPAAFAIGMAVTAVLAAGACGLAGLVLFSWVVNYLRQMPRGTTMMTVLPEQAKRHVADMAEYVGQKTKEVGQDIQTRAHHAQGTTRMTVH

SEQ ID NO: 1095 - protein, 186 aa, Zea mays
  misc_feature (1)..(186): Ceres CLONE ID no. 1286956
  misc_feature: Utility: Useful for increasing chlorophyll and photosynthetic capacity
  misc_feature: Utility: Useful for making plants with enhanced abiotic stress tolerance
  misc_feature: Utility: Useful for making smaller plants
MADRDRSGIYGGAHATYGQQQQQGGGGRPMGEQVKGMLHDKGPTASQALTVATLFPLGGLLLVLSGLALTASVVGLAVATPVFLIFSPVLVPAALLIGTAVMGFLTSGALGLGGLSSLTCLANTARQAFQRTPDYVEEAHRRMAEAAAHAGHKTAQAGQAIQGRAQEAGAGGGAGAGAGGGGRASS

SEQ ID NO: 1096 - protein, 176 aa, Zea mays
  misc_feature (1)..(176): Ceres CLONE ID no. 290537
  misc_feature: Utility: Useful for increasing chlorophyll and photosynthetic capacity
  misc_feature: Utility: Useful for making plants with enhanced abiotic stress tolerance
  misc_feature: Utility: Useful for making smaller plants
MADRDRSGIYGGGAYGQQQGGGRPMGEQVKGMIHDKGPTASQALTVATLFPLGGLLLVLSGLALAASTVGLALATPVFLLFSPVLVPAALLIGTAVAGFLTSGALGLGGLSSLTCLANTARQAFQRTPDYVEEARRRMAEAAAHAGHKTAQAGHGIQSKAQEAGAGTGAGGGRTSS

SEQ ID NO: 1097 - protein, 176 aa, Zea mays; identical to SEQ ID NO: 1096
  misc_feature (1)..(176): Ceres CLONE ID no. 1283332
  misc_feature: Utility: Useful for increasing chlorophyll and photosynthetic capacity
  misc_feature: Utility: Useful for making plants with enhanced abiotic stress tolerance
  misc_feature: Utility: Useful for making smaller plants

SEQ ID NO: 1098 - protein, 176 aa, Zea mays
  misc_feature (1)..(176): Ceres CLONE ID no. 1277502
  misc_feature: Utility: Useful for increasing chlorophyll and photosynthetic capacity
  misc_feature: Utility: Useful for making plants with enhanced abiotic stress tolerance
  misc_feature: Utility: Useful for making smaller plants
MADRDRSGIYGGGAYGQQQGGGRPMGEQVKGMIHDKGPTASQALTVATLFPLGGLLLVLSGLALAASTVGLALATPVFLLFSPALVPAALLIGTAVAGFLTSGALGLGGLSSLTCLANTARQAFQRTPDYVEEARRRMAEAAAHAGHKTAQAGHGIQSKAQEAGAGTGAGGGRTSS

SEQ ID NO: 1099 - protein, 192 aa, Triticum aestivum
  misc_feature (1)..(192): Ceres CLONE ID no. 698804
  misc_feature: Utility: Useful for increasing chlorophyll and photosynthetic capacity
  misc_feature: Utility: Useful for making plants with enhanced abiotic stress tolerance
  misc_feature: Utility: Useful for making smaller plants
  misc_feature (144)..(144): Xaa is any aa, unknown, or other
MADRGGYVQVQHGQYGGGHHGGQQQHGRQMGEQMKGMFQEKALTVATLFPLGGLLLVLSGLALAGTVVGLAVATPVFLLFSPMLVPAALTIGLAVTGFLTSGALGLGGLSSLTVLANTARQAFQRTPDYVEEARQRMADAAAAXGHKDAAGRPRHPEPRGGRARRRRWPHRRHRRSGRRHRHRHQGVVVSWS

SEQ ID NO: 1100 - DNA, 1391 bp, Arabidopsis thaliana
  misc_feature (1)..(1391): Ceres CLONE ID no. 19486
  misc_feature (1)..(1391): Also known as  Ceres CDNA ID no. 23357765
atcaaataataatagtgtaattaagtcggaggaaaacaacaagaacccagaaagaggaacgaagaaactaattcaaaggatcaagttcaccgcttcattttagtcattaaacaaagatggtgatgggaggagaagcatccatggaactggaccagtgttttcagaagatgaagatggaaggaatctcgatcaaagagtggaaagatatccctgtggagcttctgatgaggatcctttcccttgttgatgatcgtaatgtcattgttgcttctggtgtttgcactggctggagagatgctatctcttttggcctcactcgtctccgtctctcttggtgcaacaacaacatgaacagcttggttctttctcttgttcccaagtttgtaaagctgcagactttaaatctaaggcaggacaaaccgcaactagaggacaatgcagtggaggccatagcaaatcactgccatgagttacaagaacttgatctcagcaaaagcttgaaaattacagaccgttcactttatgcacttgctcatggttgcccagacctcacaaaactcaaccttagtggctgcacttcattcagcgacactgctattgcgtatttgaccagattctgcagaaagcttaaagttttgaatctttgcggatgtgtcaaagctgtaactgacaatgccttggaggctattgggaataactgcaatcagatgcagtcactaaacttgggatggtgtgagaatatcagtgatgatggggtaatgagtttagcttatggctgtccagatctcaggacccttgacctctgcggctgtgttcttattacagatgagagtgtggtagctctagcagactggtgtgtccacttgaggtcactggggctatactattgcagaaacataacagacagagcaatatactcgctagctcaaagcggggtaaagaacaaaccgggatcgtggaaatcggttaagaaaggtaaatacgatgaagaaggactgagaagtctcaacattagccaatgcactgcccttacatcttcagcggttcaagctgtttgcgattcatttcccgcacttcacacatgctcaggaaggcattcgcttgtcatgagcggctgtctgaacttaacaactgtgcactgtgcttgtatccttcaggctcatcgtgcacacaatgcggttcctcatcctgctcattaagacagaggaatagttatgttgtatatataaacatcatgttgatggagattagtattataaacgaagtagcttttttaaggtttatgtgaaaccttagaagcttttgagttgttctttctttgtcttgaaagatcttttgtatattttggtgctatgttcataacttctttagtaagacctctcgttgttacc

SEQ ID NO: 1101 - protein, 360 aa, Arabidopsis thaliana
  misc_feature (293)..(321): Pfam Name: LRR_1; Pfam Description: Leucine Rich Repeat
  misc_feature (28)..(73): Pfam Name: F-box; Pfam Description: F-box domain
  misc_feature: Utility: Useful for increasing chlorophyll and photosynthetic capacity
  misc_feature: Utility: Useful for making larger plants
  misc_feature: Utility: Useful for making ornamental plants with modified leaves
  misc_feature: Utility: Useful for making plants with altered leaf shape eg curled leaves
  misc_feature: Utility: Useful for making plants with increased biomass and foliage
  misc_feature: Utility: Useful for making smaller plants
MVMGGEASMELDQCFQKMKMEGISIKEWKDIPVELLMRILSLVDDRNVIVASGVCTGWRDAISFGLTRLRLSWCNNNMNSLVLSLVPKFVKLQTLNLRQDKPQLEDNAVEAIANHCHELQELDLSKSLKITDRSLYALAHGCPDLTKLNLSGCTSFSDTAIAYLTRFCRKLKVLNLCGCVKAVTDNALEAIGNNCNQMQSLNLGWCENISDDGVMSLAYGCPDLRTLDLCGCVLITDESVVALADWCVHLRSLGLYYCRNITDRAIYSLAQSGVKNKPGSWKSVKKGKYDEEGLRSLNISQCTALTSSAVQAVCDSFPALHTCSGRHSLVMSGCLNLTTVHCACILQAHRAHNAVPHPAH

SEQ ID NO: 1102 - protein, 343 aa, Arabidopsis thaliana
  misc_feature (1)..(343): Ceres CLONE ID no. 3549
  misc_feature: Utility: Useful for increasing chlorophyll and photosynthetic capacity
  misc_feature: Utility: Useful for making larger plants
  misc_feature: Utility: Useful for making ornamental plants with modified leaves
  misc_feature: Utility: Useful for making plants with altered leaf shape eg curled leaves
  misc_feature: Utility: Useful for making plants with increased biomass and foliage
  misc_feature: Utility: Useful for making smaller plants
MKMEGVLISEWKDIPVELLMKILNLVDDRTVIIASCICSGWRDAVSLGLTRLSLSWCKKNMNSLVLSLAPKFVKLQTLVLRQDKPQLEDNAVEAIANHCHELQDLDLSKSSKITDHSLYSLARGCTNLTKLNLSGCTSFSDTALAHLTRFCRKLKILNLCGCVEAVSDNTLQAIGENCNQLQSLNLGWCENISDDGVMSLAYGCPDLRTLDLCSCVLITDESVVALANRCIHLRSLGLYYCRNITDRAMYSLAQSGVKNKHEMWRAVKKGKFDEEGLRSLNISQCTYLTPSAVQAVCDTFPALHTCSGRHSLVMSGCLNLQSVHCACILQAHRTHTVYPHPAH

SEQ ID NO: 1103 - protein, 352 aa, Glycine max
  misc_feature (1)..(352): Ceres CLONE ID no. 472861
  misc_feature: Utility: Useful for increasing chlorophyll and photosynthetic capacity
  misc_feature: Utility: Useful for making larger plants
  misc_feature: Utility: Useful for making ornamental plants with modified leaves
  misc_feature: Utility: Useful for making plants with altered leaf shape eg curled leaves
  misc_feature: Utility: Useful for making plants with increased biomass and foliage
  misc_feature: Utility: Useful for making smaller plants
MMVAGSGNGEKGVNSKVGVITEWKDIPVELLMQILSLVDDQTVITASGVCRGWRDAIYFGLARLSLSWCSKSMNNLVLSLVPKFVKLQTLILRQDKPQLEDNAVETIAKCCHELQILDLSKSFKLTDHSLYELALGCRDLTKLNISGCSAFSDNALAYLASFCRKLKVLNLCGCVRAASDTALQAIGQYCNQLQSLNLGWCDNVGDVGVTTLAYGCPDLRIVDLCGCVRITDDSVIALATRCPHLRSLGLYYCKNITDRAMYSLAHSKVNNRMWGSVKGGNDEDGLRTLNISQCTALTPSAVQAVCDSFPSLHTCSGRHSLIMSGCLNLTSVHCACAVHAHRAFTTFPHPAH

SEQ ID NO: 1104 - protein, 351 aa, Zea mays
  misc_feature (1)..(351): Ceres CLONE ID no. 1446800
  misc_feature: Utility: Useful for increasing chlorophyll and photosynthetic capacity
  misc_feature: Utility: Useful for making larger plants
  misc_feature: Utility: Useful for making ornamental plants with modified leaves
  misc_feature: Utility: Useful for making plants with altered leaf shape eg curled leaves
  misc_feature: Utility: Useful for making plants with increased biomass and foliage
  misc_feature: Utility: Useful for making smaller plants
MVTSSSERGQAGSGGPAPTLTGWKDLPMELLVRIISTVGDDRMVIVASGVCTGWRDALGWGVTNLSLTWCKLSMNNLMISLAHKFTKLQVLTLRQNKPQLEDSAVEAVANYCHDLRELDLSRSFRLSDRSLYALAHGCPRLTRLNISGCSSFSDTALIYLTCRCKNLKCLNLCGCVKAVTDRALQAIAQNCGQLQSLNLGWCDDVTDKGVTSLASGCPDLRAVDLCGCVLITDESVVALANGCPHLRSLGLYFCQNITDRAMYSLANSRVKSKRGRWDAVKDGLANLNISQCTALTPPAVQAVCDSFPALHTCPERHSLIISGCLSLTSVHCACALHPHRAGRALMANHAY

SEQ ID NO: 1105 - protein, 351 aa, Zea mays
  misc_feature (1)..(351): Ceres CLONE ID no. 239171
  misc_feature: Utility: Useful for increasing chlorophyll and photosynthetic capacity
  misc_feature: Utility: Useful for making larger plants
  misc_feature: Utility: Useful for making ornamental plants with modified leaves
  misc_feature: Utility: Useful for making plants with altered leaf shape eg curled leaves
  misc_feature: Utility: Useful for making plants with increased biomass and foliage
  misc_feature: Utility: Useful for making smaller plants
MVTSSSERGQAGSGGPAPTLTGWKDLPMELLVRIISTVGDDRMVIVASGVCTGWRDALGWGVTNLSLTWCKLSMNNLMISLAHKFTKLQVLTLRQNKPQLEDSAVEAVANYCHDLRELDLSRSFRLSDRSLYALAHGCPRLTRLNISGCSSFSDTALIYLTCRCKNLKCLNLCGCVKAVTDRALQAIAQNCGQLQSLNLGWCDDVTDKGVTSLASGCPDLRAVDSCGCVLITDESVVALANGCPHLRSLGLYFCQNITDRAMYSLANSRVKSKRGRWDAVKDGLANLNISQCTALTPPAVQAVCDSFPALHTCPERHSLIISGCLSLTSVHCACALHPHRAGRALMANHAY

SEQ ID NO: 1106 - DNA, 1166 bp, Arabidopsis thaliana
  misc_feature (1)..(1166): Ceres CLONE ID no. 19510
  misc_feature (1)..(1166): Also known as  Ceres CDNA ID no. 23377266
gtctcctctccaccaagtgaatctctttctctctctctttttctccgcggaaggaatctcttcttctggttgcgtttgagtccgtacgaaaacaaaagaaaagagagagatggcggaagagaagaaagctccaatcagtgtctggactaccgtgaagcccttcgtcaatggcggtgcctctggtatgctcgctacttgcgttatccagccgatcgacatgattaaggtgaggattcaacttggtcagggatctgcagcaagtataaccaccaacatgcttaagaatgagggcgttggtgccttctacaagggattatctgctgggttgctgaggcaagcaacttacacgacagcccgtcttggatcattcaagttgctgactgcaaaggcaattgagtctaatgatggaaagcctctaccgctgtatcagaaggcactatgtggtctgacagctggtgctattggtgcttgcgtcggtagtccagccgatctagcacttatcagaatgcaggccgataatactttgccgctagctcagcgcaggaattataccaatgctttccatgcgcttacccgtattagcgctgatgagggagttttagcactttggaaagggtgtgggcccactgtggtcagagctatggctttgaacatgggaatgcttgcatcttatgatcaaagtgctgaatacatgagagataatcttggtttcggggagatgtctacggtcgtaggagcaagtgctgtttctgggttctgcgctgcggcttgcagtctgccatttgactttgtcaaaactcagattcagaaaatgcaaccggatgctcaaggaaagtatccatacacaggttcgctcgattgtgcgatgaaaaccttaaaagaaggaggacctctgaaattttactcaggtttcccagtttactgtgtcaggattgcccctcacgtcatgatgacatggatcttcctaaaccagattacgaaatttcaaaagaagattggtatgtgaggaacgaagacagcagcaaaaaaataagatgagaagaacgaaaacacaattggaattgtgttcatttactttttaatcatatacataacctgccttaaaagcatattattgtagctgtttgaactttaattttttgtttcggtcggtgattggtccgggg

SEQ ID NO: 1107 - protein, 298 aa, Arabidopsis thaliana
  misc_feature (104)..(199): Pfam Name: Mito_carr; Pfam Description: Mitochondrial carrier protein
  misc_feature: Utility: Useful for increasing chlorophyll and photosynthetic capacity
  misc_feature: Utility: Useful for making ornamental plants with modified flowers
  misc_feature: Utility: Useful for making ornamental plants with modified leaves
  misc_feature: Utility: Useful for making plants with increased biomass and foliage
  misc_feature: Utility: Useful for making smaller plants
MAEEKKAPISVWTTVKPFVNGGASGMLATCVIQPIDMIKVRIQLGQGSAASITTNMLKNEGVGAFYKGLSAGLLRQATYTTARLGSFKLLTAKAIESNDGKPLPLYQKALCGLTAGAIGACVGSPADLALIRMQADNTLPLAQRRNYTNAFHALTRISADEGVLALWKGCGPTVVRAMALNMGMLASYDQSAEYMRDNLGFGEMSTVVGASAVSGFCAAACSLPFDFVKTQIQKMQPDAQGKYPYTGSLDCAMKTLKEGGPLKFYSGFPVYCVRIAPHVMMTWIFLNQITKFQKKIGM

SEQ ID NO: 1108 - protein, 347 aa, Glycine max
  misc_feature (1)..(347): Ceres CLONE ID no. 473358
  misc_feature: Utility: Useful for increasing chlorophyll and photosynthetic capacity
  misc_feature: Utility: Useful for making ornamental plants with modified flowers
  misc_feature: Utility: Useful for making ornamental plants with modified leaves
  misc_feature: Utility: Useful for making plants with increased biomass and foliage
  misc_feature: Utility: Useful for making smaller plants
LGFPHTYFQLLRARITVALLTRSPSFFSSSSSSLNPPFIFPISLTSMGDENKTKSPASGVWSTIKPFVNGGASGMLATCVIQPIDMIKVRIQLGQGSAAQVTSTMLKNEGVAAFYKGLSAGLLRQATYTTARLGSFKILTAKAIEANDGKPLPLYQKALCGLTAGAIGASVGSPADLALIRMQADATLPAAQRRNYTNAFHALYRITADEGVLALWKGAGPTVVRAMALNMGMLASYDQSVEFFRDSVGLGEGATVLGASSVSGFFAAACSLPFDYVKTQIQKMQPDADGKYPYTGSVDCAVKTFKAGGPFKFYTGFPVYCVRIAPHVMMTWIFLNQIQKLQKSYGL

SEQ ID NO: 1109 - protein, 297 aa, Glycine max
  misc_feature (1)..(297): Public GI no. 1486472
  misc_feature: Utility: Useful for increasing chlorophyll and photosynthetic capacity
  misc_feature: Utility: Useful for making ornamental plants with modified flowers
  misc_feature: Utility: Useful for making ornamental plants with modified leaves
  misc_feature: Utility: Useful for making plants with increased biomass and foliage
  misc_feature: Utility: Useful for making smaller plants
MGEKPVSGGVWPTVKPFINGGVSGMLATCVIQPIDMIKVRIQLGQGSAADVTKTMLKNEGFGAFYKGLSAGLLRQATYTTARLGSFRILTNKAIEANEGKPLPLYQKALCGLTAGAIGATVGSPADLALIRMQADATLPLAQRRNYTNAFHALSRIAVDEGVLALWKGAGPTVVRAMALNMGMLASYDQSVEFFRDNLGMGEAATVVGASSVSGFFAAACSLPFDYVKTQIQKMQPDAEGKLPYTGSFDCAMKTLKAGGPFKFYTGFPVYCIRIAPHVMMTWIFLNQIQKVEKKIGL

SEQ ID NO: 1110 - protein, 300 aa, Glycine max
  misc_feature (1)..(300): Public GI no. 19913109
  misc_feature: Utility: Useful for increasing chlorophyll and photosynthetic capacity
  misc_feature: Utility: Useful for making ornamental plants with modified flowers
  misc_feature: Utility: Useful for making ornamental plants with modified leaves
  misc_feature: Utility: Useful for making plants with increased biomass and foliage
  misc_feature: Utility: Useful for making smaller plants
MGDKAKSTSSAGAWPTVKPFANGGASGMLATCVIQPIDMIKVRIQLGQGSAGEVTRTMLKNEGFGAFYKGLSAGLLRQATYTTARLGSFRVLTNKAIEANDGKPLPLYQKALCGLTAGAIGACFGSPADLALIRMQADATLPVAQRRNYTNAFHALYRIVADEGVLSLWKGAGPTVVRAMALNMGMLASYDQSVEFFKDNLGMGEAATVVGASSVSGFFAAACSLPFDYVKTQIQKMQPDAQGKYPYTGSFDCAMKTLKSGGPFKFYTGFPVYCVRIAPHVMMTWIFLNQIQKVEKKIGL

SEQ ID NO: 1111 - protein, 297 aa, Glycine max
  misc_feature (1)..(297): Public GI no. 19913105
  misc_feature: Utility: Useful for increasing chlorophyll and photosynthetic capacity
  misc_feature: Utility: Useful for making ornamental plants with modified flowers
  misc_feature: Utility: Useful for making ornamental plants with modified leaves
  misc_feature: Utility: Useful for making plants with increased biomass and foliage
  misc_feature: Utility: Useful for making smaller plants
MGEKPKSGGVWPTVKPFVNGGASGMLATCVIQPIDMIKVRIQLGQGSAVDVTKTMLKNEGFGAFYKGLSAGLLRQATYTTARLGSFRSLTNKAIEANEGKPLPLYQKALCGLTAGAIGACVGSPADLALIRMQADATLPLAQRRHYTNAFHALSRIVADEGVLALWKGAGPTVVRAMALNMGMLASYDQSVEFCRDNLGMSEAATVVGASSVSGFFAAACSLPFDYVKTQIQKMQPDAEGKLPYSGSFDCAMKTLKAGGPFKFYTGFPVYCVRIAPHVMMTWIFLNQIQKAEKKLGL

SEQ ID NO: 1112 - protein, 295 aa, Glycine max
  misc_feature (1)..(295): Public GI no. 19913107
  misc_feature: Utility: Useful for increasing chlorophyll and photosynthetic capacity
  misc_feature: Utility: Useful for making ornamental plants with modified flowers
  misc_feature: Utility: Useful for making ornamental plants with modified leaves
  misc_feature: Utility: Useful for making plants with increased biomass and foliage
  misc_feature: Utility: Useful for making smaller plants
EKPKSGGVWPTVKPFVNGGASGMLATCVIQPIDMIKVRIQLGQGSAVDVTKTMLKNEGFGAFYKGLSAGLLRQATYTTARLGSFRILTNKAIEANEGKPLPLYQKALCGLTAGAIGACFGSPADLALIRMQADATLPLAQRRHYTNAFHALSRIVADEGVLALWKGAGPTVVRAMALNMGMLASYDQSVEFCRDNLGMSEAATVVGASSVSGFFAAACSLPFDYVKTQIQKMQPDAEGKLPYSGSFDCAMKTLKAGGPFKFYTGFPVYCVRIAPHVMMTWIFLNQIQKAEKKLGL

SEQ ID NO: 1113 - protein, 306 aa, Glycine max
  misc_feature (1)..(306): Public GI no. 53749331
  misc_feature: Utility: Useful for increasing chlorophyll and photosynthetic capacity
  misc_feature: Utility: Useful for making ornamental plants with modified flowers
  misc_feature: Utility: Useful for making ornamental plants with modified leaves
  misc_feature: Utility: Useful for making plants with increased biomass and foliage
  misc_feature: Utility: Useful for making smaller plants
MADAKQQQQQQTAAAATGVWKTVKPFVNGGASGMLATCVIQPIDMVKVKIQLGEGSAAQVTKNMLANEGIGSFYKGLSAGLLRQATYTTARLGSFRVLTNKAIEKNDGKPLPLVQKAFIGLTAGAIGACVGSPADLALIRMQADSTLPIAQRRNYKNAFHALYRIIADEGVLALWKGAGPTVVRAMALNMGMLASYDQSVELFRDKLGAGEVSTVLGASAVSGFFASACSLPFDYVKTQIQKMQPDASGKYPYTGSLDCAMKTFKSGGPFKFYTGFPVYCVRIAPHVMMTWIFLNQIQKFEKQIGI

SEQ ID NO: 1114 - protein, 297 aa, Glycine max
  misc_feature (1)..(297): Public GI no. 10798640
  misc_feature: Utility: Useful for increasing chlorophyll and photosynthetic capacity
  misc_feature: Utility: Useful for making ornamental plants with modified flowers
  misc_feature: Utility: Useful for making ornamental plants with modified leaves
  misc_feature: Utility: Useful for making plants with increased biomass and foliage
  misc_feature: Utility: Useful for making smaller plants
MVEKPKSGGVWPTVKPFVNGGASGMLATCVIQPIDMIKVRIQLGQGSAVDVTKTMLKNEGFGAFYKGLSAGLLRQATYTTARLGSFRILTNKAIEANEGKPLPLYQKALCGLTAGAIGACFGSPADLALIRMQADATLPLAQRRHYTNAFHALSRIVADEGVLALWKGAGPTVVRAMALNMGMLASYDQSVEFCRDNLGMSEAATVVGASSVSGFFAAACSLPFDYVKTQIQKMQPDAEGKLPYSGSFDCAMKTLKAGGPFKFYTGFPVYCVRIAPHVMMTWIFLNQIQKAEKKLGL

SEQ ID NO: 1115 - protein, 363 aa, Zea mays
  misc_feature (1)..(363): Ceres CLONE ID no. 234671
  misc_feature: Utility: Useful for increasing chlorophyll and photosynthetic capacity
  misc_feature: Utility: Useful for making ornamental plants with modified flowers
  misc_feature: Utility: Useful for making ornamental plants with modified leaves
  misc_feature: Utility: Useful for making plants with increased biomass and foliage
  misc_feature: Utility: Useful for making smaller plants
QPFLLPFSISRYVPTQRSRPPPLLLHLPRSRRLVRFASAPPRPEQSAALSGAGMADAKQQQQQQQPQQAAAAATGVWKTVKPFVNGGASGMLATCVIQPIDMVKVRIQLGEGSAGQVTRNMLANEGVRSFYKGLSAGLLRQATYTTARLGSFRVLTNKAVEKNEGKPLPLFQKAFIGLTAGAIGACVGSPADLALIRMQADSTLPVAQRRNYKNAFHALYRISGDEGVLALWKGAGPTVVRAMALNMGMLASYDQSVELFRDKFGAGEISTVVGASAVSGFFASACSLPFDYVKTQIQKMQPDANGKYPYTGSLDCAVKTFKSGGPFKFYTGFPVYCVRIAPHVMMTWIFLNQIQKFEKKIGI

SEQ ID NO: 1116 - protein, 308 aa, Zea mays
  misc_feature (1)..(308): Ceres CLONE ID no. 1396898
  misc_feature: Utility: Useful for increasing chlorophyll and photosynthetic capacity
  misc_feature: Utility: Useful for making ornamental plants with modified flowers
  misc_feature: Utility: Useful for making ornamental plants with modified leaves
  misc_feature: Utility: Useful for making plants with increased biomass and foliage
  misc_feature: Utility: Useful for making smaller plants
MADAKQQQQQPQQAAAAATGVWKTVKPFVNGGASGMLATCVIQPIDMVKVRIQLGEGSAGQVTRNMLANEGVRSFYKGLSAGLLRQATYTTARLGSFRVLTNKAVEKNEGKPLPLIQKAFIGLTAGAIGACFGSPADLALIRMQADSTLPAAQRRNYKNAFHALYRISADEGVLALWKGAGPTVVRAMALNMGMLASYDQSVELFRDKFGAGEISTVVGASAVSGFFASACSLPFDYVKTQIQKMQPDANGKYPYTGSLDCAVKTFKSGGPFKFYTGFPVYCVRIAPHVMMTWIFLNQIQKFEKKIGI

SEQ ID NO: 1117 - protein, 299 aa, Zea mays
  misc_feature (1)..(299): Public GI no. 37964368
  misc_feature: Utility: Useful for increasing chlorophyll and photosynthetic capacity
  misc_feature: Utility: Useful for making ornamental plants with modified flowers
  misc_feature: Utility: Useful for making ornamental plants with modified leaves
  misc_feature: Utility: Useful for making plants with increased biomass and foliage
  misc_feature: Utility: Useful for making smaller plants
MGEEKKPQSAGVWPTVKPFVNGGASGMLATCVIQPIDMIKVRIQLGQGSAGTVTKTMLKNEGFGAFYKGLSAGLLRQATYTTARLGSFRILTNKAIEANDGKPLPLYQKALCGLTAGAIGASVGSPADLALIRMQADATLPAAQRRHYTNAFQALYRIVTDEGVLALWKGAGPTVVRAMALNMGMLASYDQSVEFFRDACGLSELPTVIGASTVSGFFASACSLPFDYVKTQIQKMQPDAQGKYPYTGSMDCAMKTLKAGGPFKFYTGFPVYCVRIAPHVMMTWIFLNQIQKLEKKVGL

SEQ ID NO: 1118 - protein, 307 aa, Zea mays
  misc_feature (1)..(307): Public GI no. 51860703
  misc_feature: Utility: Useful for increasing chlorophyll and photosynthetic capacity
  misc_feature: Utility: Useful for making ornamental plants with modified flowers
  misc_feature: Utility: Useful for making ornamental plants with modified leaves
  misc_feature: Utility: Useful for making plants with increased biomass and foliage
  misc_feature: Utility: Useful for making smaller plants
MADAKQQPQQAAAAAATTGVWKTVKPFVNGGASGMLATCVIQPIDMVKVRIQLGEGSAGQVTRNMLANEGVRSFYKGLSAGLLRQATYTTARLGSFRVLTNKAVEKNEGKPLPLIQKAFIGLTAGAIGACVGSPADLALIRMQADSTLPAAQRRNYKNAFHALYRITADEGVLALWKGAGPTVVRAMALNMGMLASYDQSVELFRDKLGAGEISTVVGASAISGFFASACSLPFDYVKTQIQKMQPDANGKYPYTGSLDCAVKTFKSGGPFKFYTGFPVYCVRIAPHVMMTWIFLNQIQKIEKKIGI

SEQ ID NO: 1119 - protein, 302 aa, Triticum aestivum
  misc_feature (1)..(302): Ceres CLONE ID no. 702388
  misc_feature: Utility: Useful for increasing chlorophyll and photosynthetic capacity
  misc_feature: Utility: Useful for making ornamental plants with modified flowers
  misc_feature: Utility: Useful for making ornamental plants with modified leaves
  misc_feature: Utility: Useful for making plants with increased biomass and foliage
  misc_feature: Utility: Useful for making smaller plants
MADAKQQQAAAPTGVWKTIKPFVNGGASGMLATCVIQPIDMIKVKIQLGEGSAAQVAKTMYANEGLGSFYKGLSAGLLRQATYTTARLGSFRVLTNKAIEANDGKPLPLVQKAFIGLTAGAIGACVGSPADLALIRMQADSTLPAAQRRHYKNAFHALYRITADEGVLALWKGAGPTVVRAMSLNMGMLASYDQSVELFRDKLGAGEYQTVIGASAISGFCAAACSLPFDYVKTQIQKMQPDATGKYPYTGSLDCAMQTLKTGGPFKFYSGFPVYCVRIAPHVMMTWLFLNQIQKYQKKIGI

SEQ ID NO: 1120 - protein, 302 aa, n/a; identical to SEQ ID NO: 1119
  misc_feature (1)..(302): Ceres CLONE ID no. 1319106
  misc_feature: Utility: Useful for increasing chlorophyll and photosynthetic capacity
  misc_feature: Utility: Useful for making ornamental plants with modified flowers
  misc_feature: Utility: Useful for making ornamental plants with modified leaves
  misc_feature: Utility: Useful for making plants with increased biomass and foliage
  misc_feature: Utility: Useful for making smaller plants

SEQ ID NO: 1121 - protein, 309 aa, n/a
  misc_feature (1)..(309): Public GI no. 62701911
  misc_feature: Utility: Useful for increasing chlorophyll and photosynthetic capacity
  misc_feature: Utility: Useful for making ornamental plants with modified flowers
  misc_feature: Utility: Useful for making ornamental plants with modified leaves
  misc_feature: Utility: Useful for making plants with increased biomass and foliage
  misc_feature: Utility: Useful for making smaller plants
MAEAKQQQQQPQAATAAAASGVWKTVKPFANGGASGMLATCVIQPIDMVKVRIQLGEGSAASVTKKMLANEGISAFYKGLSAGLLRQATYTTARLGSFRVLTNKAVEANDGKPLPLVQKAGIGLTAGAIGACVGSPADLALIRMQADSTLPAAQSRNYKNAFHALYRIAADEGVLALWKGAGPTVVRAMSLNMGMLASYDQSVELFRDTLGAGEVTTVLGASAVSGLCASACSLPFDYVKTQIQKMQPDASGKYPYTGSLDCAMKTLKSGGPFKFYTGFPVYCVRIAPHAMMTWIFLNEIQKLEKRLGL

SEQ ID NO: 1122 - protein, 313 aa, n/a
  misc_feature (1)..(313): Public GI no. 61651612
  misc_feature: Utility: Useful for increasing chlorophyll and photosynthetic capacity
  misc_feature: Utility: Useful for making ornamental plants with modified flowers
  misc_feature: Utility: Useful for making ornamental plants with modified leaves
  misc_feature: Utility: Useful for making plants with increased biomass and foliage
  misc_feature: Utility: Useful for making smaller plants
MGEEEKGKSASNSSSNSNSNSNSSGVWRTIKPFVNGGASGMLATCVIQPIDMVKVRIQLGQGSALSITKNMLRDDGIRAFYKGLSAGLLRQATYTTARLGSFKILTNKALEANEGKPLPLYQKALCGLSAGAIGASVGSPADLALIRMQADATLPEAQRRHYKNAFHALYRIIADEGVLALWKGAAPTVVRAMALNMGMLASYDQSVEFFRDSLGYGEVATVLGASTVSGFFASACSLPFDYVKTQIQKMQPDAEGKYPYKGSLDCTIKTLKSGGPFKFYTGFPVYCVRIAPHAMMTLIFLHQIQKLESTIGV

SEQ ID NO: 1123 - protein, 302 aa, n/a
  misc_feature (1)..(302): Public GI no. 2130089
  misc_feature: Utility: Useful for increasing chlorophyll and photosynthetic capacity
  misc_feature: Utility: Useful for making ornamental plants with modified flowers
  misc_feature: Utility: Useful for making ornamental plants with modified leaves
  misc_feature: Utility: Useful for making plants with increased biomass and foliage
  misc_feature: Utility: Useful for making smaller plants
MADAKQQQAVAPSAAWMTVKPFVNGGASGMLATCVIQPIDMVKVKIQLGEGSAATVTKKMLANEGIGSFYKGLSAGLLRQATYTTARLGSFRVLTNKAVEANEGKPLPLLQKAVIGLTAGAIGASVGSPADLALIRMQADSTLPAAQRRNYKNAFHALYRIVADEGVLALWKGAGPTVVRAMSLNMGMLASYDQSVELFRDTLGAGELSTMLGASAVSGFCASACSLPFDYVKTQIQKMQPDANGKYPYTGSLDCVMKTLKSGGPFKFYTGFPVYCVRIAPHVMLTWIFLNQIQKFEKDIGL

SEQ ID NO: 1124 - protein, 302 aa, n/a
  misc_feature (1)..(302): Public GI no. 2130090
  misc_feature: Utility: Useful for increasing chlorophyll and photosynthetic capacity
  misc_feature: Utility: Useful for making ornamental plants with modified flowers
  misc_feature: Utility: Useful for making ornamental plants with modified leaves
  misc_feature: Utility: Useful for making plants with increased biomass and foliage
  misc_feature: Utility: Useful for making smaller plants
MADAKQQQAVAPSAAWMMVKPFVNGGASGMLATCVIQPIDMVKVKIQLGEGSAATVTKKMLANEGIGSFYKGLSAGLLRQATYTTARLGSFRVLTNKAVEANEGKPLPLLQKAVIGLTAGAIGASVGSPADLALIRMQADSTLPAAQRRNYKNAFHALYRIVADEGVLALWKGAGPTVVRAMSLNMGMLASYDQSVELFRDKLGAGELSTMLGASAVSGFCASACSLPFDYVKTQIQKMQPDANGKYPYTGSLDCVMKTLKSGGPFKFYTGFPVYCVRIGPHVMLTWIFLNQIQKFEKDMGL

SEQ ID NO: 1125 - DNA, 692 bp, Arabidopsis thaliana
  misc_feature (1)..(692): Ceres CLONE ID no. 23322
  misc_feature (1)..(692): Also known as  Ceres CDNA ID no. 23358139
gatcacaaattcagaagaaaagaacagagaaaacagaggaagaggtgagatggaggaacttgtagggcttctgagaatccgagtgaagagagggatcaatcttgctcagcgagacactctaagcagcgacccttttgttgtcataaccatgggatcacagaagctgaagactcgtgttgtggaaaataactgcaaccctgagtggaacgaggaattaacccttgcgttaagacatcccgatgaacctgtgaatctgatagtgtatgataaagatacattcacatcgcacgacaagatgggagatgcaaagatagatattaaaccatttctggaggttcacaaaatgggtttgcaagaacttccagatggaacagagatcaagagagttgtgcccaacagagaaaactgtttggctgaagcgagcagtatcgtctccaataatggcaaaatcgttcagaacatgattcttctgttgaggaatgtcgaatgcggtgaggtcgagattcagcttgaatggattgatattccaggttctagagggctttgaacatatctctttctgtgtgtaataaaaaaaaaactcagttcgttttgggtttttagacaaaagtcacaataagtagaacagagtactactctgttttgtaattgaaatatttggttttagcacctaacctaaatcgttttggttt

SEQ ID NO: 1126 - protein, 165 aa, Arabidopsis thaliana
  misc_feature (8)..(87): Pfam Name: C2; Pfam Description: C2 domain
  misc_feature: Utility: Useful for increasing chlorophyll and photosynthetic capacity
  misc_feature: Utility: Useful for increasing seed/fruit yield or modifying fruit content
  misc_feature: Utility: Useful for making ornamental plants with modified flowers
  misc_feature: Utility: Useful for making smaller plants
  misc_feature: Utility: Useful for making stronger plants
  misc_feature: Utility: Useful for making taller plants and plants with longer inflorescences
MEELVGLLRIRVKRGINLAQRDTLSSDPFVVITMGSQKLKTRVVENNCNPEWNEELTLALRHPDEPVNLIVYDKDTFTSHDKMGDAKIDIKPFLEVHKMGLQELPDGTEIKRVVPNRENCLAEASSIVSNNGKIVQNMILLLRNVECGEVEIQLEWIDIPGSRGL

SEQ ID NO: 1127 - protein, 191 aa, Brassica napus
  misc_feature (1)..(191): Ceres CLONE ID no. 950968
  misc_feature: Utility: Useful for increasing chlorophyll and photosynthetic capacity
  misc_feature: Utility: Useful for increasing seed/fruit yield or modifying fruit content
  misc_feature: Utility: Useful for making ornamental plants with modified flowers
  misc_feature: Utility: Useful for making smaller plants
  misc_feature: Utility: Useful for making stronger plants
  misc_feature: Utility: Useful for making taller plants and plants with longer inflorescences
DIDRCLFSQEKTQRNFVWREQRKRLKMEELAGLLRIRVKKGINLARRDSLSSDPFVVITMGTQKLKGRTVENNCNPEWNEELTLALKHPNEPVTLIVYDKDTFTSHDKMGDAKIDIKPFLEVHKLGLQELPDGTVIKRVLPTKENCLSEESRIVYHNGKIVQDMILVLRNVECGEVEIQLEWIEIPGGRGL

SEQ ID NO: 1128 - protein, 165 aa, Glycine max
  misc_feature (1)..(165): Ceres CLONE ID no. 513057
  misc_feature: Utility: Useful for increasing chlorophyll and photosynthetic capacity
  misc_feature: Utility: Useful for increasing seed/fruit yield or modifying fruit content
  misc_feature: Utility: Useful for making ornamental plants with modified flowers
  misc_feature: Utility: Useful for making smaller plants
  misc_feature: Utility: Useful for making stronger plants
  misc_feature: Utility: Useful for making taller plants and plants with longer inflorescences
MENLLGLLRIHVEKGVNLAIRDVVSSDPYVVIKMGKQKLKTRVVNKNLNPEWNDDLTLSISDPHAPIHLHVYDKDTFSMDDKMGDAEFFIGPFIEAVKMRLSSLPNNTIVTKVLPSRQNSLAEESHIVWKDGKVVQNMVLRLRNVETGEVELQLHWIDIPGSRHL

SEQ ID NO: 1129 - protein, 207 aa, Triticum aestivum
  misc_feature (1)..(207): Ceres CLONE ID no. 568719
  misc_feature: Utility: Useful for increasing chlorophyll and photosynthetic capacity
  misc_feature: Utility: Useful for increasing seed/fruit yield or modifying fruit content
  misc_feature: Utility: Useful for making ornamental plants with modified flowers
  misc_feature: Utility: Useful for making smaller plants
  misc_feature: Utility: Useful for making stronger plants
  misc_feature: Utility: Useful for making taller plants and plants with longer inflorescences
EKGTAAVPCLQPQLNQSVAITLVSHHPPRARSRRSSTMLGHLVGLVKVRVTRGVNLAIRDLRSSDPYVVVRMGKQKLKTRVVRKSINPEWNDELTLSIEDPTIPVKLDVFDKDTFFDDPMGNAELDIGPLVEAARMRVQLQGVADNTVVKKLVPNRQNCLAEQSAIYLSEGTVKQDVVLRLRNVECGEVELQLQWIDIPGSKGVSGF

SEQ ID NO: 1130 - protein, 165 aa, Triticum aestivum
  misc_feature (1)..(165): Public GI no. 50907613
  misc_feature: Utility: Useful for increasing chlorophyll and photosynthetic capacity
  misc_feature: Utility: Useful for increasing seed/fruit yield or modifying fruit content
  misc_feature: Utility: Useful for making ornamental plants with modified flowers
  misc_feature: Utility: Useful for making smaller plants
  misc_feature: Utility: Useful for making stronger plants
  misc_feature: Utility: Useful for making taller plants and plants with longer inflorescences
MLGHLVGLVKVRVVRGVNLAVRDLRSSDPYVIVRMGKQKLKTRVIKKTTNPEWNDELTLSIEDPAVPVRLEVYDKDTFIDDAMGNAELDIRPLVEVVKMKIEGVADNTVVKKVVPNRQNCLAEESTIYISEGKVKQDVVLRLRDVECGEIELQLQWVDIPGSKGV

SEQ ID NO: 1131 - protein, 165 aa, Zea mays
  misc_feature (1)..(165): Ceres CLONE ID no. 302545
  misc_feature: Utility: Useful for increasing chlorophyll and photosynthetic capacity
  misc_feature: Utility: Useful for increasing seed/fruit yield or modifying fruit content
  misc_feature: Utility: Useful for making ornamental plants with modified flowers
  misc_feature: Utility: Useful for making smaller plants
  misc_feature: Utility: Useful for making stronger plants
  misc_feature: Utility: Useful for making taller plants and plants with longer inflorescences
MLDHLVGLLKLRVVRGVNLAVRDLRSSDPYVVVRIGKQKLKTRVVKKSVNPEWDDELTLSIEDPAVPIRLEVFDKDTFVDDTMGNAEVDIRPLVEIVKMKLQDVADRTVVKKLVPNRQNCLAEESSIYISEGKVKQDMVVRLRNVESGEIELQLQWIDLPGSKGV

SEQ ID NO: 1132 - protein, 165 aa, Zea mays; identical to SEQ ID NO: 1131
  misc_feature (1)..(165): Ceres CLONE ID no. 242695
  misc_feature: Utility: Useful for increasing chlorophyll and photosynthetic capacity
  misc_feature: Utility: Useful for increasing seed/fruit yield or modifying fruit content
  misc_feature: Utility: Useful for making ornamental plants with modified flowers
  misc_feature: Utility: Useful for making smaller plants
  misc_feature: Utility: Useful for making stronger plants
  misc_feature: Utility: Useful for making taller plants and plants with longer inflorescences

SEQ ID NO: 1133 - protein, 176 aa, Zea mays
  misc_feature (1)..(176): Ceres CLONE ID no. 399010
  misc_feature: Utility: Useful for increasing chlorophyll and photosynthetic capacity
  misc_feature: Utility: Useful for increasing seed/fruit yield or modifying fruit content
  misc_feature: Utility: Useful for making ornamental plants with modified flowers
  misc_feature: Utility: Useful for making smaller plants
  misc_feature: Utility: Useful for making stronger plants
  misc_feature: Utility: Useful for making taller plants and plants with longer inflorescences
MVGKKRGVISPLDHLAGLLEVRVVRGVDLAIRDLRSSDPYVVLRIGKAQKVKTRVVKKSINPEWNEKLTLSIEDPAVPIRLEVFDKDTFVDDAMGNAELDIRPLVEIVKMKLQGVADKTVVKKLVPNRQNCLAEESSIYISEGKVKQDLVVRLRNVECGEIELQLQWVHLPGSKGV

SEQ ID NO: 1134 - protein, 168 aa, Parthenium argentatum
  misc_feature (1)..(168): Ceres CLONE ID no. 1605876
  misc_feature: Utility: Useful for increasing chlorophyll and photosynthetic capacity
  misc_feature: Utility: Useful for increasing seed/fruit yield or modifying fruit content
  misc_feature: Utility: Useful for making ornamental plants with modified flowers
  misc_feature: Utility: Useful for making smaller plants
  misc_feature: Utility: Useful for making stronger plants
  misc_feature: Utility: Useful for making taller plants and plants with longer inflorescences
MEGVVGLWKLRVKRGINLVARDTKSSDAYIVATLDDQKTKAKVTKGSCNPVWNDELTLTMRDPKAPIHIAVYDKDRFSNDDNMGEAEIDVKPYIECLRMGLNMADTPNGTTLSCVQPTEHNCLANESSIIWENGKIVQDMHLRLRGVERGEVVIQIELVLLPGHNLDV

SEQ ID NO: 1135 - protein, 171 aa, Parthenium argentatum
  misc_feature (1)..(171): Public GI no. 1808694
  misc_feature: Utility: Useful for increasing chlorophyll and photosynthetic capacity
  misc_feature: Utility: Useful for increasing seed/fruit yield or modifying fruit content
  misc_feature: Utility: Useful for making ornamental plants with modified flowers
  misc_feature: Utility: Useful for making smaller plants
  misc_feature: Utility: Useful for making stronger plants
  misc_feature: Utility: Useful for making taller plants and plants with longer inflorescences
MASASKEEVIGKLNVRVVRGSNLAICDPLTHTSDPYVVLHYGAQKVKTSVQKKNPNPVWNEVLQLSVTNPTKPVHLEVFDEDKFTADDSMGVAEINLTDIYDAAKLDLKHAADGTRIKTIYPVGVNYLGGESHVMWKDGKVVQDLILKLTKTDSGLITLQLEWVHVPGVKL

SEQ ID NO: 1136 - DNA, 1062 bp, Arabidopsis thaliana
  misc_feature (1)..(1062): Ceres CLONE ID no. 25538
  misc_feature (1)..(1062): Also known as  Ceres CDNA ID no. 23368230
agaacaattagggttaatctcttccgttgcttttttttttcaatccgccgccacttttcgtttctcgtagcgttaaaatggcggtatcgtacaatgcattagctcagtctttagcgagaagtagctgcttcatccccaaaccttattcctttagagatactaagctgagaagcagatccaatgtcgtattcgcgtgcaatgataataagaacattgctcttcaagctaaggtagataacttgttggaccgcattaaatgggatgacaaaggattagctgtggcaatagcacaaaacgttgatacgggagcagtattgatgcaaggctttgttaatagggaggccctctccacaaccatcagttctcggaaagctacattctttagtcgatcaagatctaccttatggactaagggagagacatccaataacttcatcaatattcttgatgtgtatgttgattgtgatcgtgattcgattatttaccttggaacacctgatggacctacctgtcacacaggggaagagacttgttactacacatcggtttttgatcaattaaacaatgatgaggcttcaggaaacaagctagcattaacaacattgtactcgctagaatcaatcatttccaagcggaaagaagaatcaacagttcctcaagaaggtaaaccatcatggactcgacggttgttgacggatgacgctctgctttgctcaaagatcagggaagaagctgacgagttatgcagaacactggaggataatgaggaagtttcaagaacaccatcagagatggctgatgttttataccacgcaatggtgcttctatctaaaaggggtgtgaagatggaagatgttcttgaagttcttaggaaacgcttctctcaatctggaatcgaggagaagcaaaaccgtacaaagtaaccattttcttcgattgtctgtttagtatttgcgagaatttttttagttactcggaacttatactgttgttcattgtgcaactttgtattgtataaatagatatcctttgtgataaaagaaataaatgagtcctttttcc

SEQ ID NO: 1137 - protein, 281 aa, Arabidopsis thaliana
  misc_feature (176)..(269): Pfam Name: PRA-PH; Pfam Description: Phosphoribosyl-ATP pyrophosphohydrolase
  misc_feature (81)..(155): Pfam Name: PRA-CH; Pfam Description: Phosphoribosyl-AMP cyclohydrolase
  misc_feature: Utility: Useful for increasing chlorophyll and photosynthetic capacity
  misc_feature: Utility: Useful for making lethal plants for genetic confinement systems
  misc_feature: Utility: Useful for making ornamental plants with modified flowers
  misc_feature: Utility: Useful for making ornamental plants with modified leaves
  misc_feature: Utility: Useful for making plants with altered leaf shape eg curled leaves
  misc_feature: Utility: Useful for making plants with increased biomass
  misc_feature: Utility: Useful for making smaller plants
MAVSYNALAQSLARSSCFIPKPYSFRDTKLRSRSNVVFACNDNKNIALQAKVDNLLDRIKWDDKGLAVAIAQNVDTGAVLMQGFVNREALSTTISSRKATFFSRSRSTLWTKGETSNNFINILDVYVDCDRDSIIYLGTPDGPTCHTGEETCYYTSVFDQLNNDEASGNKLALTTLYSLESIISKRKEESTVPQEGKPSWTRRLLTDDALLCSKIREEADELCRTLEDNEEVSRTPSEMADVLYHAMVLLSKRGVKMEDVLEVLRKRFSQSGIEEKQNRTK

SEQ ID NO: 1138 - protein, 179 aa, Arabidopsis thaliana
  misc_feature (1)..(179): Public GI no. 50313439
  misc_feature: Utility: Useful for increasing chlorophyll and photosynthetic capacity
  misc_feature: Utility: Useful for making lethal plants for genetic confinement systems
  misc_feature: Utility: Useful for making ornamental plants with modified flowers
  misc_feature: Utility: Useful for making ornamental plants with modified leaves
  misc_feature: Utility: Useful for making plants with altered leaf shape eg curled leaves
  misc_feature: Utility: Useful for making plants with increased biomass
  misc_feature: Utility: Useful for making smaller plants
GFVNREALATTISSRKATFFSRSRSSLWIKGETSNNFINILDVYIDCDRDSIIYLGTPDGPTCHTGAETCYYTSVFDQLNDEEPIGNKLALTTLYSLESIISKRKEESTVPQEGKPSWTRRLLTDDTLLCSKIREEADELCRTLEDNEEVSNTASEMADVLYHSMVLLSKRDVEIEDVL

SEQ ID NO: 1139 - protein, 279 aa, Brassica napus
  misc_feature (1)..(279): Ceres CLONE ID no. 947207
  misc_feature: Utility: Useful for increasing chlorophyll and photosynthetic capacity
  misc_feature: Utility: Useful for making lethal plants for genetic confinement systems
  misc_feature: Utility: Useful for making ornamental plants with modified flowers
  misc_feature: Utility: Useful for making ornamental plants with modified leaves
  misc_feature: Utility: Useful for making plants with altered leaf shape eg curled leaves
  misc_feature: Utility: Useful for making plants with increased biomass
  misc_feature: Utility: Useful for making smaller plants
  misc_feature (127)..(127): Xaa is any aa, unknown, or other
  misc_feature (129)..(129): Xaa is any aa, unknown, or other
  misc_feature (160)..(160): Xaa is any aa, unknown, or other
  misc_feature (165)..(165): Xaa is any aa, unknown, or other
  misc_feature (189)..(189): Xaa is any aa, unknown, or other
  misc_feature (262)..(262): Xaa is any aa, unknown, or other
MAISYNALAQSLPGRSSFFVPKALCIKQRSRSTVVFASNDKNIIALQAKVDTLLDRIKWDEKGLAVAIAQNVDTGAVLMQGFANREALSTTLTSRKATFFSRSRSTLWTKGETSNNFINVLDVYLDXDXDSIIYLGTPDGPTCHTGAETCYYTSVLDQLXNDEAXGEKLASTTLYSLESIISKRKEESXVPQEGKPSWTRRLLTDDALLCSKIREEADELCRTLEDKEEVSRTASEMADMLYHAMVLLSKRDVKFEDVLEVXRKRFSQSGIEEKQSRSK

SEQ ID NO: 1140 - protein, 281 aa, Glycine max
  misc_feature (1)..(281): Ceres CLONE ID no. 463846
  misc_feature: Utility: Useful for increasing chlorophyll and photosynthetic capacity
  misc_feature: Utility: Useful for making lethal plants for genetic confinement systems
  misc_feature: Utility: Useful for making ornamental plants with modified flowers
  misc_feature: Utility: Useful for making ornamental plants with modified leaves
  misc_feature: Utility: Useful for making plants with altered leaf shape eg curled leaves
  misc_feature: Utility: Useful for making plants with increased biomass
  misc_feature: Utility: Useful for making smaller plants
MAVSYVHMLQCNRGFHKGNLSYPNCSYKARRSHRLVFASMHTPEPKVDSLLDSVKWDTKGLVVAIAQNVDTGAILMQGFANREAIATTISSRKATFYSRSRSTLWTKGETSNNFINVHDVFIDCDRDSIIYLGKPDGPTCHTGAETCYYTSVFDLLKQQEAEENKLALTSLYALESTISQRKTELIGENEKPSWTKRLLLNDKLLCSKIREEANELCQTLENNEDEKRTASEMADVLYHAMVLLAKKGVKIEDVLQVLRLRFSQSGIEEKKSRVSQKSVDD

SEQ ID NO: 1141 - protein, 298 aa, Triticum aestivum
  misc_feature (1)..(298): Ceres CLONE ID no. 788296
  misc_feature: Utility: Useful for increasing chlorophyll and photosynthetic capacity
  misc_feature: Utility: Useful for making lethal plants for genetic confinement systems
  misc_feature: Utility: Useful for making ornamental plants with modified flowers
  misc_feature: Utility: Useful for making ornamental plants with modified leaves
  misc_feature: Utility: Useful for making plants with altered leaf shape eg curled leaves
  misc_feature: Utility: Useful for making plants with increased biomass
  misc_feature: Utility: Useful for making smaller plants
MAAPLPRAPVSSPASRAALCPARSNPCTAAAPSSGALGWRRRQPCPMLSIAPGSARSTPAALAVDPKVEALLDSVKWDVKGLAVAIAQNVDTGAILMQGFANKEALAATISTRKATFYSRSRSSLWTKGETSMNFINVHDIFLDCDRDSIIYLGTPDGPTCHTGAETCYYSSVYDALQGSKSNQERQVTTTLYSLEDTISRRKEEIVTEGSGKPSWTKKLLLDNQLLCSKIREEAGELIQTLLENEEKSRTASEMADLLYHAMVLLSVRDVKMEEVLEVLRKRFSQSGVEEKASRKKS

SEQ ID NO: 1142 - protein, 310 aa, Zea mays
  misc_feature (1)..(310): Ceres CLONE ID no. 303545
  misc_feature: Utility: Useful for increasing chlorophyll and photosynthetic capacity
  misc_feature: Utility: Useful for making lethal plants for genetic confinement systems
  misc_feature: Utility: Useful for making ornamental plants with modified flowers
  misc_feature: Utility: Useful for making ornamental plants with modified leaves
  misc_feature: Utility: Useful for making plants with altered leaf shape eg curled leaves
  misc_feature: Utility: Useful for making plants with increased biomass
  misc_feature: Utility: Useful for making smaller plants
EERNTHTLGFPMAAAAPTHAPVSSSACRSGFSSSDVSFPNFRSAAASAPGWRRREPYPAVSVVSSSPQSVPGAITVDTEVDTLLDSVKWDSKGLAVAIAQNVDTGAILMQGFANKEALAKTISTRKATFFSRSRSSLWTKGETSMNFINVHDIFLDCDHDSIIYLGKPDGPTCHTGAETCYYTSVYDALQSSKPNEGRQVMTTLYSLEDTISRRHEEKVTDGGGKPSWTKKLLLDNQLLCSKIREEAGELIQTLLENEDQSRAASEMADLLYHAMVLLRVKDVKMEQVLEVLRKRFSQSGIEEKASRNKS

SEQ ID NO: 1143 - protein, 202 aa, Zea mays
  misc_feature (1)..(202): Public GI no. 34903270
  misc_feature: Utility: Useful for increasing chlorophyll and photosynthetic capacity
  misc_feature: Utility: Useful for making lethal plants for genetic confinement systems
  misc_feature: Utility: Useful for making ornamental plants with modified flowers
  misc_feature: Utility: Useful for making ornamental plants with modified leaves
  misc_feature: Utility: Useful for making plants with altered leaf shape eg curled leaves
  misc_feature: Utility: Useful for making plants with increased biomass
  misc_feature: Utility: Useful for making smaller plants
MQGFANKEALATTISTRKATFYSRSRSSLWTKGETSMNFINVHDIFLDCDRDSIIYLGKPDGPTCHTGAETCYYTSVYDALQGSKPNQDRQVVSTLYSLEDTISRRKEEIVTEGSGKPSWTKKLILDNRLLCSKISEEAGELNQTLLENEDESRTISEMGDLLYHAMVLLRVKGVRMEQVLEVLRKRFSQSGIEEKASRNKS

SEQ ID NO: 1144 - protein, 306 aa, Zea mays
  misc_feature (1)..(306): Public GI no. 56783703
  misc_feature: Utility: Useful for increasing chlorophyll and photosynthetic capacity
  misc_feature: Utility: Useful for making lethal plants for genetic confinement systems
  misc_feature: Utility: Useful for making ornamental plants with modified flowers
  misc_feature: Utility: Useful for making ornamental plants with modified leaves
  misc_feature: Utility: Useful for making plants with altered leaf shape eg curled leaves
  misc_feature: Utility: Useful for making plants with increased biomass
  misc_feature: Utility: Useful for making smaller plants
MAAPPLPRAPVSSSAAAASPGGRALLLLRVGGGGSGRCAGVAAAAAPGWRRPFPAASVAARSAGTTPGEVAVDPKVEAILDSVKWDSKGLAVAIAQNVDTGAILMQGFANKEALATTISTRKATFYSRSRSSLWTKGETSMNFINVHDIFLDCDRDSIIYLGKPDGPTCHTGAETCYYTSVYDALQGSKPNQDRQVVSTLYSLEDTISRRKEEIVTEGSGKPSWTKKLILDNRLLCSKISEEAGELNQTLLENEDESRTISEMGDLLYHAMVLLRVKGVRMEQVLEVLRKRFSQSGIEEKASRNKS

SEQ ID NO: 1145 - DNA, 1191 bp, Arabidopsis thaliana
  misc_feature (1)..(1191): Ceres CLONE ID no. 25607
  misc_feature (1)..(1191): Also known as  Ceres CDNA ID no. 23427539
aagacaaaaggagcggtttggtgaagttagttaaaagagttgggtttcttcgtaagcatcgaaatcagatttctttaccaaagaaaaaataaagaaaagaaaaatatagcaagtacactgcatttcaacactctcatatctctccttcctacttcctcggtttcatcgtccactgtctcaacaatggcgtcattgtcggtaccttgcgtcaagatctgtgctctgaacaggcgggtcggatctctccctggaatctctactcaaagatggcagccgcaacccaatgggatctcctttccctccgatgtttctcagaatcattctgcattctggaggttgcgtgcaacaactaatgaggttgtttctaactccactccaatgactaatggtgggtatatgaacggaaaagcgaaaaccaatgttcctgaacccgccgagctctctgaatttatggctaaagtctctggtcttcttaagcttgtggattcaaaagacatagtggaacttgaactaaagcagctcgactgtgagatcgttattcgaaagaaggaagctttacagcaagctgtaccaccagctccagtttatcactcaatgcctcctgtaatggcagacttttcaatgcctccagctcaaccagtggctcttcctccttctcctactcctacctcaacgcctgcaacagcaaaaccaacatccgccccatcctcgtctcatcctccactcaagagtcccatggctggtactttctatagatctcctggacccggtgaacccccttttgtaaaggttggagataaggtacagaagggtcaaattgtttgtattatcgaagctatgaaactgatgaacgagattgaggctgagaagtcaggaaccatcatggaactactggctgaagatggaaaaccagtcagcgttgacacgcctctttttgtcatcgcaccttgaaacgaagaaggatccttttagctgcttcaaaacatcttcaaagtctcggttaagctatagcaacgtgctaaaactcatcaagtaattatttcagcttaagttggttggtttcggatttctgcttgtcgcttcaataattgacccatcttttgggatttcacgtaacgtactacactttgctttttagttttctgcgaaactaatgtattttgtagcctctcaatcctggctctctgtccc

SEQ ID NO: 1146 - protein, 255 aa, Arabidopsis thaliana
  misc_feature (179)..(253): Pfam Name: Biotin_lipoyl; Pfam Description: Biotin-requiring enzyme
  misc_feature: Utility: Useful for increasing chlorophyll and photosynthetic capacity
  misc_feature: Utility: Useful for making larger plants
  misc_feature: Utility: Useful for making plants sterile and for genetic confinement
  misc_feature: Utility: Useful for making plants with increased biomass and foliage
MASLSVPCVKICALNRRVGSLPGISTQRWQPQPNGISFPSDVSQNHSAFWRLRATTNEVVSNSTPMTNGGYMNGKAKTNVPEPAELSEFMAKVSGLLKLVDSKDIVELELKQLDCEIVIRKKEALQQAVPPAPVYHSMPPVMADFSMPPAQPVALPPSPTPTSTPATAKPTSAPSSSHPPLKSPMAGTFYRSPGPGEPPFVKVGDKVQKGQIVCIIEAMKLMNEIEAEKSGTIMELLAEDGKPVSVDTPLFVIAP

SEQ ID NO: 1147 - protein, 260 aa, Arabidopsis thaliana
  misc_feature (1)..(260): Public GI no. 44190488
  misc_feature: Utility: Useful for increasing chlorophyll and photosynthetic capacity
  misc_feature: Utility: Useful for making larger plants
  misc_feature: Utility: Useful for making plants sterile and for genetic confinement
  misc_feature: Utility: Useful for making plants with increased biomass and foliage
MASLSIVPYAKISAPSRRVGSIPGIRRQLKPSGISFHVSHVSQTQSTIWRLHATTNEKVVSNSTPVTNGGCLNGNVKTNVPEPAAELSDFMSKVSSLLKLVDSRDIVELELKQLDCEIVIRKKEALQQQATQPPAPVYHSMMPPPPMAGLPMPPSPPVSPPPSPAPSSAAETAKPATAPSSSHPPLKSPMAGTFYRSPGPGEPPFVKVGDKVRKGQVVCIIEAMKLMNEIEAEKSGTITELLAEDGKPVSVDTPLFTIAP

SEQ ID NO: 1148 - protein, 251 aa, Arabidopsis thaliana
  misc_feature (1)..(251): Public GI no. 1070008
  misc_feature: Utility: Useful for increasing chlorophyll and photosynthetic capacity
  misc_feature: Utility: Useful for making larger plants
  misc_feature: Utility: Useful for making plants sterile and for genetic confinement
  misc_feature: Utility: Useful for making plants with increased biomass and foliage
MASLSVPYAKISAPNRRVESIPGIRRQPQPSGISFHVSHVSQTQSTIWRLRATTNEVVSNSTPVTNGGCLNGNVKTNVPPEPAAELSDFISKVSGLLKLVDSRDIVELELKQLDCEIVIRKRKLTAATAPVYHSMMPPPPMEGLPMPPSPPVSPPAPSSAPATANTATAPSSSHPPLKSPMAGTFYRSPGPGEPPFVKVGDKVQKGQVVCIIEAMKLMNEIEAEKSGTITELLAEDGKPVSVDTPLFTIAP

SEQ ID NO: 1149 - protein, 256 aa, Arabidopsis thaliana
  misc_feature (1)..(256): Public GI no. 1070006
  misc_feature: Utility: Useful for increasing chlorophyll and photosynthetic capacity
  misc_feature: Utility: Useful for making larger plants
  misc_feature: Utility: Useful for making plants sterile and for genetic confinement
  misc_feature: Utility: Useful for making plants with increased biomass and foliage
MASLSVPYAKISAPNRRVGSIPGRTRWQPQLNGVSFPSDVSQNQSTIWRLRATTNEVVSNSTPVTNGGCLNGNVKSNVPESAKLSNFMAKVSGLLKLVDSRDIVELELKQLDCEIVIRKKEALQQQPTPPPAPVYHSMASPMAGLQMAPSQPVAPPPFSLVLSAPETAKPVTPPSSFTSSTQESYGLGTFYRSPGPGEPPFVKVGDKVQKGQVVCIIEAMKLMNEIEAEKSGTITELLAEDGKPVSVDTPLFTIVP

SEQ ID NO: 1150 - protein, 284 aa, Arabidopsis thaliana
  misc_feature (1)..(284): Public GI no. 12006165
  misc_feature: Utility: Useful for increasing chlorophyll and photosynthetic capacity
  misc_feature: Utility: Useful for making larger plants
  misc_feature: Utility: Useful for making plants sterile and for genetic confinement
  misc_feature: Utility: Useful for making plants with increased biomass and foliage
MASFTIPCPKCVVVPFAHLGLNSQTQQRNALGLKKSLSFGSLSSDSAPNGIQCLNKKQSSVWKLQAQPKEAVTVENSAPVQVNGPKIAPPEEKDDHNGKPSGPSTSADASSISAFMNQVSDLVKLVDSKDIMELQLKQANCELVIRKKEALLPPPATFVAPVSQPFPYPTNSLPAAPPPVATSTPASSPSSKAAPALPPAKASKSSHPALKCPMAGTFYRSPAPGEPPFVKVGDKVQKGQVICIIEAMKLMNEIEADQSGTVAEVVAEDGKPVSVDTPLFVIVP

SEQ ID NO: 1151 - protein, 280 aa, Glycine max
  misc_feature (1)..(280): Ceres CLONE ID no. 1243020
  misc_feature: Utility: Useful for increasing chlorophyll and photosynthetic capacity
  misc_feature: Utility: Useful for making larger plants
  misc_feature: Utility: Useful for making plants sterile and for genetic confinement
  misc_feature: Utility: Useful for making plants with increased biomass and foliage
MASFSVPCPKCPTTSSSSSLPLGLNSQKVSFQSGLILKPSLSFGSLSAESAASRIQCLNRKQFSVLKATKVENSNSAPVTVNGPTVASSKENQVHNGKLSDTTIPDEASIIAFMSQVSDLVKLVDSRDIVELQLKQSDCELMIRKKEALQPPPIIAPAPPPMHYATFPSPSSPLPAEAAPASSAPPKAAPALPSPGKASTSSHPPLKCPMAGTFYRSPAPGEPAFVKVGDKVKKGQVICIIEAMKLMNEIEADQSGTIAEVLAEDGKPVSVDMPLFVIVP

SEQ ID NO: 1152 - protein, 262 aa, Glycine max
  misc_feature (1)..(262): Public GI no. 1143319
  misc_feature: Utility: Useful for increasing chlorophyll and photosynthetic capacity
  misc_feature: Utility: Useful for making larger plants
  misc_feature: Utility: Useful for making plants sterile and for genetic confinement
  misc_feature: Utility: Useful for making plants with increased biomass and foliage
MASSLAPATKAATNLRLTHSLRFSPKPNNLRFATKPGNTLLCTRVKAQLNEVALDSSSNATSPPMKAKSKEEPPAKPLAEPSSSVLATQESVSQFITQVASLVKLVDSRDIVELKLKQHDVEVTIRKKEAMPQPPPAPQPSVVYSPPPPALPPPPVPASTPAPTLARATPTPTSAPAVKSAKSSLPPLKSPMAGTFYRSPAPGEPSFVKVGDKVKKGQVVCIIEAMKLMNEIEADQSGTIVEIVAEDAKSVSVDTPLFVIQP

SEQ ID NO: 1153 - protein, 276 aa, Glycine max
  misc_feature (1)..(276): Ceres CLONE ID no. 625652
  misc_feature: Utility: Useful for increasing chlorophyll and photosynthetic capacity
  misc_feature: Utility: Useful for making larger plants
  misc_feature: Utility: Useful for making plants sterile and for genetic confinement
  misc_feature: Utility: Useful for making plants with increased biomass and foliage
MASFSVPCPKCPTTSSSPPLGLKSLNVSFQRVLSLKPSLSFGSLSAESAASRIQCLNRKQFSVLKATKVENSNSAPVMVNGPNVASSKEKEVHNGKLSGGTIPDDASIIAFMSQVSDLVKLVDSRDIVELQLKQSDCELMIRKKEALQPPPVIAPTSPPMHYATVPSPPPPPAAAPASSAPPKAVPALPSPAKAGTSSHPTLKCPMAGTFYRSPAPGEPAFVKVGDKVQKGQVICIIEAMKLMNEIEADQSGTIAEVLAEDGKPVSVDTPLFVIVP

SEQ ID NO: 1154 - protein, 261 aa, Glycine max
  misc_feature (1)..(261): Ceres CLONE ID no. 626132
  misc_feature: Utility: Useful for increasing chlorophyll and photosynthetic capacity
  misc_feature: Utility: Useful for making larger plants
  misc_feature: Utility: Useful for making plants sterile and for genetic confinement
  misc_feature: Utility: Useful for making plants with increased biomass and foliage
MASSLAPATKAATNLRLTHSLRFSPKPNNLRFATKPGNTLLCARVKAQLDEVALDSSSNATPPIKAKSKEEPPAKPLAEPSSSVLATQESVSQFITQVASLVKLVDSRDIVELKLKQHDVEVTIRKKEAMPQPPPPPQPAVVYSSPPPVLPPPSVPASTPAPTLARATPSPTSAPAVKSAKSSLPPLKSPMAGTFYRSPAPGEPPFVKVGDKVKKGQVVCIIEAMKLMNEIEADQSGTIVEIVAEDAKSVSVDTPLFVIQP

SEQ ID NO: 1155 - DNA, 1167 bp, Arabidopsis thaliana
  misc_feature (1)..(1167): Ceres CLONE ID no. 25758
  misc_feature (1)..(1167): Also known as  Ceres CDNA ID no. 23369666
atatcaatcaatcgaaaaacctttctctcttctttcggagccgtcgcttgtgaaactttccggcgatttaacagagtcatgatggaaatacgaactccgaagactggcaaagccaagcgtgttctcgaaagccgagctcctaagttggttgaaactgggaagaagacgttgatacttcatggaacaaagacgagtgctacacttagctctgtaatgacggaactctaccgtttgaagaagggaggtgccatcagatattcaaggaggaatgagaatattaggcctttcgagagtggaggtgaaacttcattagagttcttctctcagaaaacagattgtagcatttttgtgtatggttctcacacgaagaaacgacctgacaatcttgtacttgggagaatgtatgatcaccaagtctatgatcttatagaagttgggattgagaactttaaatccttgcgggcgttttcgtattacaagaaattcgcacctcatgaaggaacaaagcctttcatttgctttattggtgaaggttttgagaatgtatcagagcttaagcatctcaaagaagtcctcactgatctttttcgtggcgaggttgtggataatctaaatcttactggtttagaccgcgcttacgtatgttcagctatatccccaacaaaggttttccttactcattgcgcattgaagcttaaaaagtcaggatccattgttccgagaatggagcttgttgaagtcagtccatccatggacttggttatcaggcgtaatcgtcttcctaacgatagcttaatgaaagaagcaatgagaacatccaaggataagcctaagaagaaggagaaaaacgttgatcaagatgcagtactagggaagactgggaagatttatatgcctgatcagaagctgaaagaaatgaaactgttcgataaatctaagggatcgaagagagagcggaaagacgctaagcttaagcataaggaagagactgttgccaaaaagatgaaggtgtcttctgagtgactcaacagaccactcttggctctgcatcaacagctttcaatatgtggaagatgaaatgattttgtagtgtaatgagcttggcttttatttttccattagaatctataactgaatgttttctatacgctaatattttattaaggc

SEQ ID NO: 1156 - protein, 314 aa, Arabidopsis thaliana
  misc_feature (31)..(233): Pfam Name: Brix; Pfam Description: Brix domain
  misc_feature: Utility: Useful for increasing chlorophyll and photosynthetic capacity
  misc_feature: Utility: Useful for making ornamental plants with modified flowers
  misc_feature: Utility: Useful for making shorter plants and plants with modified flowers
  misc_feature: Utility: Useful for making smaller plants
MMEIRTPKTGKAKRVLESRAPKLVETGKKTLILHGTKTSATLSSVMTELYRLKKGGAIRYSRRNENIRPFESGGETSLEFFSQKTDCSIFVYGSHTKKRPDNLVLGRMYDHQVYDLIEVGIENFKSLRAFSYYKKFAPHEGTKPFICFIGEGFENVSELKHLKEVLTDLFRGEVVDNLNLTGLDRAYVCSAISPTKVFLTHCALKLKKSGSIVPRMELVEVSPSMDLVIRRNRLPNDSLMKEAMRTSKDKPKKKEKNVDQDAVLGKTGKIYMPDQKLKEMKLFDKSKGSKRERKDAKLKHKEETVAKKMKVSSE

SEQ ID NO: 1157 - protein, 314 aa, Glycine max
  misc_feature (1)..(314): Ceres CLONE ID no. 598129
  misc_feature: Utility: Useful for increasing chlorophyll and photosynthetic capacity
  misc_feature: Utility: Useful for making ornamental plants with modified flowers
  misc_feature: Utility: Useful for making shorter plants and plants with modified flowers
  misc_feature: Utility: Useful for making smaller plants
MLEIKTAKTRKGKRELEKRAPKLVESGKKTLILHGTKTSGVLNAVLAQIYHLKKDCAVKYSRRNENVKPFEAGGETSLEFFSLKTDCSIFVYGSHSKKRPDNLVIGRTYDHHIYDLVEVGVENFKPMESFSYDKKLAPKEGSKPFIVFIGEGFEAVEELKHLKEVLLDLLRGEVVENLNLAGVDRAYVCAALSPNRVFFTHCALRLKKSGTVVPRMELEEVGPSMDFVLRRHRPPNESLRKEALKTSREKPKKKEKNVKKDELQGKIGSIYIPDQKVGETPLPYKAKGVKRERRESKRKNESDGSASKRKKEDS

SEQ ID NO: 1158 - protein, 314 aa, Glycine max; identical to SEQ ID NO: 1157
  misc_feature (1)..(314): Ceres CLONE ID no. 1045071
  misc_feature: Utility: Useful for increasing chlorophyll and photosynthetic capacity
  misc_feature: Utility: Useful for making ornamental plants with modified flowers
  misc_feature: Utility: Useful for making shorter plants and plants with modified flowers
  misc_feature: Utility: Useful for making smaller plants

SEQ ID NO: 1159 - protein, 310 aa, Glycine max
  misc_feature (1)..(310): Public GI no. 34914658
  misc_feature: Utility: Useful for increasing chlorophyll and photosynthetic capacity
  misc_feature: Utility: Useful for making ornamental plants with modified flowers
  misc_feature: Utility: Useful for making shorter plants and plants with modified flowers
  misc_feature: Utility: Useful for making smaller plants
MVAAIRVPRSQRAKRELLKHAPKLVETGKKTLILHGTKTSAVLNSVLADLFHLKRDNAVKYSKKNDNIRPFESGGETSLEFFSLKTDCSLIVYGSHSKKRPNNLVLGRTYDHHIYDLVEVGVENYKSIESYVYDKKLAPKLGSKPFFAFIGEHFESVEELKHLKEVLLDLFKGEVVENLNLAGVDRVFVCTAISPTTVYMMHCALRLKRSGTSIPRIELVEVGPSMDLVVRRHRYPVESLKKEAMKTADHAKKMKNVTKDPVHGKLGKVYIPDQQIAKMSLSNDVKGLKRERREAKKNKDHSKKQKINPE

SEQ ID NO: 1160 - protein, 309 aa, Zea mays
  misc_feature (1)..(309): Ceres CLONE ID no. 246177
  misc_feature: Utility: Useful for increasing chlorophyll and photosynthetic capacity
  misc_feature: Utility: Useful for making ornamental plants with modified flowers
  misc_feature: Utility: Useful for making shorter plants and plants with modified flowers
  misc_feature: Utility: Useful for making smaller plants
MVASIRVPKTQRARRELLKHAPKLVETSKKTLILHGTKTSAVLNSVLSDIYHLKRDNAVKYTKKNDNIRPFESGGESSLEFFSLKADCSLIVYGSHSKKRPNNLILGRTYDHHIYDLVEVGVENYKSMESYVYDKKLAPLLGSKPFFAFIGEHFESAEELKHLKEVLLDLFRGEVVENLNLAGVDRIYVCTAISPTTVYMMHCALRLKRSGTSIPRMELVEVGPSMDLVVRRHRLPAESLKKEAMKTAEHAKKMKNVTKDPVQGKLGKVYMPDQQVGKLTLSNDIKGLKRERREAKKNQDSKKQKVNPE

SEQ ID NO: 1161 - protein, 310 aa, Triticum aestivum
  misc_feature (1)..(310): Ceres CLONE ID no. 616734
  misc_feature: Utility: Useful for increasing chlorophyll and photosynthetic capacity
  misc_feature: Utility: Useful for making ornamental plants with modified flowers
  misc_feature: Utility: Useful for making shorter plants and plants with modified flowers
  misc_feature: Utility: Useful for making smaller plants
MAIRVPKSMRAKRELLKHAPKLVENGKKMLILHGTKTSAVLNSVLADLFHLKRDHAVKYTKKNDSIRPFESGGETSLEFFSLKSDCSLLVYGSHSKKRPNNLVLGRTYDHHIYDLVEVGVENYKSIESYAYDKKLAPKLGTKPFFAFIGEHFESVEGLKHLKEMLLDHFKGEVVENLNLAGVDRIFVCTAISPTTVYMMHCALRLKRSGTSIPRMELVEVGPSVDLVLRRHRQAAESLQKEAMKAPGHAKKVKNVTNNPVEGKQGRIYIPDQEVSKLTVTSNIKGLKRERRDAKKNKEHSKKQKVAENPE

SEQ ID NO: 1162 - DNA, 755 bp, Arabidopsis thaliana
  misc_feature (1)..(755): Ceres CLONE ID no. 25886
  misc_feature (1)..(755): Also known as  Ceres CDNA ID no. 23556709
aagtctacaaaccaaaaacacgctacagaagaagaggaagaagaagaagaagcagagacaagaagaagaagaagaaacagtctcatctcgccggagaagaagaaagatgtcgtggcaatcatacgtcgatgaccatctcatgtgcgaggtcgaaggcaaccacctcacacacgccgccatcttcggccaagacggcagtgtctgggctcagagctcagctttccctcagttgaagcctgcagagatagcaggaatcaacaaagactttgaagaagccggacatcttgccccaaccgggctattccttggcggtgagaagtacatggttgtccaaggtgaggctggagccgtcatccgagggaaaaagggacctggtggagtcactatcaagaagactactcaagctctagtctttggtatctatgatgaacgatgaccggagggcaatgcaacttggtcgtggagaggctcggcgattaccttatcgagtctggtctctaagttcactcaaagtgcttcaaacaaatttcatttttcgggttctttcttcactagagaagcacccttctgccatgtattgtgatttgattgttgttgtgcatcaaacaaagttattatactcttaaaaagaacaaagaaacaatcatatttgttatggttttgatcctctcctatgatggctcttatgtttttctcttgtactgtatttcgtaatgtataattacgctttggaataaaaatttgagtttgtgacc

SEQ ID NO: 1163 - protein, 109 aa, Arabidopsis thaliana
  misc_feature (2)..(108): Pfam Name: Profilin; Pfam Description: Profilin
  misc_feature: Utility: Useful for increasing chlorophyll and photosynthetic capacity
  misc_feature: Utility: Useful for making ornamental plants with modified flowers
  misc_feature: Utility: Useful for making plants sterile and for genetic confinement
  misc_feature: Utility: Useful for making smaller plants
  misc_feature: Utility: Useful for making stronger plants
  misc_feature (87)..(87): Xaa is any aa, unknown, or other
MSWQSYVDDHLMCEVEGNHLTHAAIFGQDGSVWAQSSAFPQLKPAEIAGINKDFEEAGHLAPTGLFLGGEKYMVVQGEAGAVIRGKXGPGGVTIKKTTQALVFGIYDER

SEQ ID NO: 1164 - protein, 131 aa, Brassica napus
  misc_feature (1)..(131): Ceres CLONE ID no. 1068409
  misc_feature: Utility: Useful for increasing chlorophyll and photosynthetic capacity
  misc_feature: Utility: Useful for making ornamental plants with modified flowers
  misc_feature: Utility: Useful for making plants sterile and for genetic confinement
  misc_feature: Utility: Useful for making smaller plants
  misc_feature: Utility: Useful for making stronger plants
MSWQSYVDDHLMCDVEGNHLTSAAILGQDGSVWAQSTNFPQLKPAEIEGIKKDFEEPGHLAPTGLFLGGEKYMVVQGEGGAVIRGKKGPGGVTIKKTNQAFVFGIYDEPMTGGQCNLVVERLGDYLIESDL

SEQ ID NO: 1165 - protein, 131 aa, Zea mays; identical to SEQ ID NO: 1164
  misc_feature (1)..(131): Ceres CLONE ID no. 1374642
  misc_feature: Utility: Useful for increasing chlorophyll and photosynthetic capacity
  misc_feature: Utility: Useful for making ornamental plants with modified flowers
  misc_feature: Utility: Useful for making plants sterile and for genetic confinement
  misc_feature: Utility: Useful for making smaller plants
  misc_feature: Utility: Useful for making stronger plants

SEQ ID NO: 1166 - protein, 113 aa, Triticum aestivum
  misc_feature (1)..(113): Ceres CLONE ID no. 1048933
  misc_feature: Utility: Useful for increasing chlorophyll and photosynthetic capacity
  misc_feature: Utility: Useful for making ornamental plants with modified flowers
  misc_feature: Utility: Useful for making plants sterile and for genetic confinement
  misc_feature: Utility: Useful for making smaller plants
  misc_feature: Utility: Useful for making stronger plants
MTILMCDVEGNHLTSAAILGQDGSVWAQSTNFPQLKPAEIEGIKKDFEEPGHLAPTGLFLGGEKYMVVQGEGGAVIRGKKGPGGVTIKKTNQAFVFGIYDEPMTGGQCNLVVE

SEQ ID NO: 1167 - protein, 113 aa, Brassica napus
  misc_feature (1)..(113): Ceres CLONE ID no. 1065662
  misc_feature: Utility: Useful for increasing chlorophyll and photosynthetic capacity
  misc_feature: Utility: Useful for making ornamental plants with modified flowers
  misc_feature: Utility: Useful for making plants sterile and for genetic confinement
  misc_feature: Utility: Useful for making smaller plants
  misc_feature: Utility: Useful for making stronger plants
  misc_feature (20)..(20): Xaa is any aa, unknown, or other
MCDVEGNHLTSAAILGQDGXVWAQSTNFPQLKPAEIEGIKKDFEEPGHLAPTGLFLGGEKYMVVQGEGGAVIRGKKGPGGVTIKKTNQAFVFGIYDEPMTGGQCNLVVERLGD

SEQ ID NO: 1168 - protein, 131 aa, Arabidopsis thaliana
  misc_feature (1)..(131): Ceres CLONE ID no. 1350261
  misc_feature: Utility: Useful for increasing chlorophyll and photosynthetic capacity
  misc_feature: Utility: Useful for making ornamental plants with modified flowers
  misc_feature: Utility: Useful for making plants sterile and for genetic confinement
  misc_feature: Utility: Useful for making smaller plants
  misc_feature: Utility: Useful for making stronger plants
MSWQSYVDDHLMCDVEGNHLTAAAILGQDGSVWAQSAKFPQLKPQEIDGIKKDFEEPGFLAPTGLFLGGEKYMVIQGEQGAVIRGKKGPGGVTIKKTNQALVFGFYDEPMTGGQCNLVVERLGDYLIESEL

SEQ ID NO: 1169 - protein, 131 aa, Arabidopsis thaliana; identical to SEQ ID NO: 1168
  misc_feature (1)..(131): Ceres CLONE ID no. 1356804
  misc_feature: Utility: Useful for increasing chlorophyll and photosynthetic capacity
  misc_feature: Utility: Useful for making ornamental plants with modified flowers
  misc_feature: Utility: Useful for making plants sterile and for genetic confinement
  misc_feature: Utility: Useful for making smaller plants
  misc_feature: Utility: Useful for making stronger plants

SEQ ID NO: 1170 - protein, 134 aa, Brassica napus
  misc_feature (1)..(134): Ceres CLONE ID no. 1125290
  misc_feature: Utility: Useful for increasing chlorophyll and photosynthetic capacity
  misc_feature: Utility: Useful for making ornamental plants with modified flowers
  misc_feature: Utility: Useful for making plants sterile and for genetic confinement
  misc_feature: Utility: Useful for making smaller plants
  misc_feature: Utility: Useful for making stronger plants
MSWQSYVDDHLMCDVEGNHLTAAAILGQDGSVWAQSANFPQLKTEEINGITKDFEEPGFLAPTGLFLGGAKYMVIQGEPGAVIRGKKGPGGVTIKKAQPSAHDIFVGNWKPTKNDTLSKRGPTFGTTMNVLYGE

SEQ ID NO: 1171 - protein, 123 aa, Triticum aestivum
  misc_feature (1)..(123): Ceres CLONE ID no. 1030509
  misc_feature: Utility: Useful for increasing chlorophyll and photosynthetic capacity
  misc_feature: Utility: Useful for making ornamental plants with modified flowers
  misc_feature: Utility: Useful for making plants sterile and for genetic confinement
  misc_feature: Utility: Useful for making smaller plants
  misc_feature: Utility: Useful for making stronger plants
  misc_feature (120)..(120): Xaa is any aa, unknown, or other
MSWQSYVDDHLMCDVEGNHLTAAAILGQDGSVWAQSANFPQLKTEEINGITKDFEEPGFLAPTGLFLGGAKYMVIQGEPGAVIRGKKGPGGVTIKKTTQALVIGIYEEPMTGGQCNLVVXRLG

SEQ ID NO: 1172 - protein, 131 aa, Brassica napus
  misc_feature (1)..(131): Ceres CLONE ID no. 1128260
  misc_feature: Utility: Useful for increasing chlorophyll and photosynthetic capacity
  misc_feature: Utility: Useful for making ornamental plants with modified flowers
  misc_feature: Utility: Useful for making plants sterile and for genetic confinement
  misc_feature: Utility: Useful for making smaller plants
  misc_feature: Utility: Useful for making stronger plants
  misc_feature (109)..(109): Xaa is any aa, unknown, or other
MSWQSYVDDHLMCDVEGNHLTAAAILGQDGSVWAQSANFPQLKTEEINGITKDFEEPGFLAPTGLFLGGAKYMVIQGEPGAVIRGKKGPGGVTIKKTTQALVIGIYEEXMTGGQCNLVVERLGDYLIESDL

SEQ ID NO: 1173 - protein, 131 aa, Zea mays
  misc_feature (1)..(131): Ceres CLONE ID no. 1377743
  misc_feature: Utility: Useful for increasing chlorophyll and photosynthetic capacity
  misc_feature: Utility: Useful for making ornamental plants with modified flowers
  misc_feature: Utility: Useful for making plants sterile and for genetic confinement
  misc_feature: Utility: Useful for making smaller plants
  misc_feature: Utility: Useful for making stronger plants
  misc_feature (30)..(30): Xaa is any aa, unknown, or other
  misc_feature (34)..(34): Xaa is any aa, unknown, or other
  misc_feature (85)..(85): Xaa is any aa, unknown, or other
  misc_feature (123)..(123): Xaa is any aa, unknown, or other
MSWQSYVDDHLMCDVEGNHLTAAAILGQDXSVWXQSADFPQLKPEEIKGITTDFEEPGFLAPTGLFLGGAKYMVIQGEPGAVIRXKKGPGGVTIKKTTQALVIGIYEEPMTGGQCNLVVERLXDYLIESDL

SEQ ID NO: 1174 - protein, 131 aa, Glycine max
  misc_feature (1)..(131): Ceres CLONE ID no. 1066115
  misc_feature: Utility: Useful for increasing chlorophyll and photosynthetic capacity
  misc_feature: Utility: Useful for making ornamental plants with modified flowers
  misc_feature: Utility: Useful for making plants sterile and for genetic confinement
  misc_feature: Utility: Useful for making smaller plants
  misc_feature: Utility: Useful for making stronger plants
MSWQTYVDDHLMCDVEGNRLTAAAILGQDGSVWAQSANFPQLKPEEINGINKDFNEPGTLAPTGLFIGGTKYMVIQGEPNAVIRGKKGAGGVTIKKTTQAMVFGIYEEPMTPGQCNMVVERLGDYLIESGL

SEQ ID NO: 1175 - protein, 130 aa, Brassica napus
  misc_feature (1)..(130): Ceres CLONE ID no. 953102
  misc_feature: Utility: Useful for increasing chlorophyll and photosynthetic capacity
  misc_feature: Utility: Useful for making ornamental plants with modified flowers
  misc_feature: Utility: Useful for making plants sterile and for genetic confinement
  misc_feature: Utility: Useful for making smaller plants
  misc_feature: Utility: Useful for making stronger plants
  misc_feature (129)..(129): Xaa is any aa, unknown, or other
MPLLHLDAISGTFRLSTEEAEPRKMSWQTYVDDHLMCDVEGNRLTAAAILGQDGSVWAQSANFPQPEEINGINKDFNEPGTLAPTGLFIGGTKYMVIQGEPNAVIRGKKGAGGVTIKKTTQAMVFGIYXE

SEQ ID NO: 1176 - protein, 120 aa, Brassica napus
  misc_feature (1)..(120): Ceres CLONE ID no. 971131
  misc_feature: Utility: Useful for increasing chlorophyll and photosynthetic capacity
  misc_feature: Utility: Useful for making ornamental plants with modified flowers
  misc_feature: Utility: Useful for making plants sterile and for genetic confinement
  misc_feature: Utility: Useful for making smaller plants
  misc_feature: Utility: Useful for making stronger plants
  misc_feature (82)..(82): Xaa is any aa, unknown, or other
MSWQTYVDDHLMCDVEGNRLTAAAILGQDGSVWAQSANFPQLKPEEISGINKDFNEPGTLAPTGLFIGGTKYMVIQGEPNTXIRGKKGAGGVTIKKTTQAMVFGIYEEPMTPGQCNMVVE

SEQ ID NO: 1177 - protein, 131 aa, Parthenium argentatum
  misc_feature (1)..(131): Ceres CLONE ID no. 1609975
  misc_feature: Utility: Useful for increasing chlorophyll and photosynthetic capacity
  misc_feature: Utility: Useful for making ornamental plants with modified flowers
  misc_feature: Utility: Useful for making plants sterile and for genetic confinement
  misc_feature: Utility: Useful for making smaller plants
  misc_feature: Utility: Useful for making stronger plants
MSWQAYVDDHLMCEIEGNHLTAAAIIGHDGSVWAQSSNFPQVKPEEITAIMNDFNEPGSLAPTGLHLGGTKYMVIQGEAGAVIRGKKGPGGVTVKKTGMAIIIGIYDEPMTPGQCNMIVERLGDYLLDQGF

SEQ ID NO: 1178 - protein, 131 aa, Zea mays
  misc_feature (1)..(131): Ceres CLONE ID no. 1274796
  misc_feature: Utility: Useful for increasing chlorophyll and photosynthetic capacity
  misc_feature: Utility: Useful for making ornamental plants with modified flowers
  misc_feature: Utility: Useful for making plants sterile and for genetic confinement
  misc_feature: Utility: Useful for making smaller plants
  misc_feature: Utility: Useful for making stronger plants
MSWQTYVDDHLCCEIDGQHLTSAAILGHDGSVWAESPNFPKFKPEEIAGIVKDFEEPGHLAPTGLFLGGTKYMVIQGEPGVVIRGKKGTGGITIKKTGMALILGIYDEPMTPGQCNLVVERLGDYLVEQGF

SEQ ID NO: 1179 - protein, 131 aa, Glycine max; identical to SEQ ID NO: 1178
  misc_feature (1)..(131): Ceres CLONE ID no. 1016548
  misc_feature: Utility: Useful for increasing chlorophyll and photosynthetic capacity
  misc_feature: Utility: Useful for making ornamental plants with modified flowers
  misc_feature: Utility: Useful for making plants sterile and for genetic confinement
  misc_feature: Utility: Useful for making smaller plants
  misc_feature: Utility: Useful for making stronger plants

SEQ ID NO: 1180 - protein, 131 aa, Parthenium argentatum
  misc_feature (1)..(131): Ceres CLONE ID no. 1610119
  misc_feature: Utility: Useful for increasing chlorophyll and photosynthetic capacity
  misc_feature: Utility: Useful for making ornamental plants with modified flowers
  misc_feature: Utility: Useful for making plants sterile and for genetic confinement
  misc_feature: Utility: Useful for making smaller plants
  misc_feature: Utility: Useful for making stronger plants
MSWQAYVDDHLMCEIEGNHLSAAAIIGHDGTVLAQSATFPQVKPEEITAIMNDFNEPGSLAPTGLYLGGTKYMVIQGEAGAVIRGKKGPGGVTIKKTAMSLIIGIYDEPMAPGQCNMIVERLGDYLLEQGF

SEQ ID NO: 1181 - DNA, 799 bp, Arabidopsis thaliana
  misc_feature (1)..(799): Ceres CLONE ID no. 27464
  misc_feature (1)..(799): Also known as  Ceres CDNA ID no. 23388780
acactcctaatccctcccatttttcaaaccactctctctttctctttctctaagtctttaacaatggcgcgccttctcttccgtcttctccaagaagccaattctacatctccggctgaagcttctccgcctttcaactccgacctcgtcctcatccttgcggttcttctttgtgcactgacatgtatcatcggcttaatagccgtctctcgatgcgcttggctccgccgtatcgcctcaagaaacagatcggatcaaactcatccaccgccggtagctgcagccaacaaaggattgaaaaagaaagtcctccggtcgttaccgaaactcacctactcgccggattctccgccggcggagaaactcgtggagtgtgctatctgtttaacggaattcgccgccggagacgagcttagggtgttgccgcagtgtggacatggtttccacgtatcgtgtatcgacacgtggcttggatcacactcttcttgtccttcttgccgtcaaatcttggtggttaccaggtgtcataaatgtggcgggttacccggtagctcaagttcaggacccgaacccgatacccgaatcaaacaacgtgaagatggtcctgataacttcttaccttgattcttttctttagacatatcccattttattttttataaagggaattcgattaaacaaagatataatattaattaaaaagtgttctttatcattttaaaggataatgttactctgtcatgtatatatttaattatctattgtaaatctatcatggaatggaaactttatgtcattc

SEQ ID NO: 1182 - protein, 186 aa, Arabidopsis thaliana
  misc_feature (104)..(145): Pfam Name: zf-C3HC4; Pfam Description: Zinc finger, C3HC4 type (RING finger)
  misc_feature: Utility: Useful for increasing chlorophyll and photosynthetic capacity
  misc_feature: Utility: Useful for making larger plants
  misc_feature: Utility: Useful for making ornamental plants with modified color
  misc_feature: Utility: Useful for making smaller plants
MARLLFRLLQEANSTSPAEASPPFNSDLVLILAVLLCALTCIIGLIAVSRCAWLRRIASRNRSDQTHPPPVAAANKGLKKKVLRSLPKLTYSPDSPPAEKLVECAICLTEFAAGDELRVLPQCGHGFHVSCIDTWLGSHSSCPSCRQILVVTRCHKCGGLPGSSSSGPEPDTRIKQREDGPDNFLP

SEQ ID NO: 1183 - protein, 197 aa, Arabidopsis thaliana
  misc_feature (1)..(197): Public GI no. 15027985
  misc_feature: Utility: Useful for increasing chlorophyll and photosynthetic capacity
  misc_feature: Utility: Useful for making larger plants
  misc_feature: Utility: Useful for making ornamental plants with modified color
  misc_feature: Utility: Useful for making smaller plants
MARLLFRLLVESNTPSPAIDNSTAALNSDLVVILAALLCALICVLGLIAVSRCVWLRRLAAGNRTVSGSQTQSPQPPVAAANKGLKKKVLQSLPKLTFSPESPESEKFAECAICLAEFSAGDELRVLPQCGHGFHVACIDTWLGSHSSCPSCRQILVVARCHKCGGLPGSSSSGLESEPEIEIRIKQGEDDPNSFLP

SEQ ID NO: 1184 - protein, 188 aa, Brassica napus
  misc_feature (1)..(188): Ceres CLONE ID no. 957229
  misc_feature: Utility: Useful for increasing chlorophyll and photosynthetic capacity
  misc_feature: Utility: Useful for making larger plants
  misc_feature: Utility: Useful for making ornamental plants with modified color
  misc_feature: Utility: Useful for making smaller plants
  misc_feature (184)..(184): Xaa is any aa, unknown, or other
  misc_feature (186)..(186): Xaa is any aa, unknown, or other
MARLLFRLLQETNSPTPATPSPALYSDLVVVIAALLCALICVLGLLAVSRCVWLRRIANRSATNSDQPPANKGLKKKVLKSLPKLTYSPDSPPAEKFAECAICLMEFAAGDELRVLSQCGHGFHVSCIDTWLGSHSSCPSCRQILVGIARCQKCGGLPGSSSSGPEPDTRIKQDDPNSNNNDNXSXLN

SEQ ID NO: 1185 - protein, 184 aa, Glycine max
  misc_feature (1)..(184): Ceres CLONE ID no. 1120324
  misc_feature: Utility: Useful for increasing chlorophyll and photosynthetic capacity
  misc_feature: Utility: Useful for making larger plants
  misc_feature: Utility: Useful for making ornamental plants with modified color
  misc_feature: Utility: Useful for making smaller plants
MTRALRYLGERNSSTDSAVVDSDFVVILAALLCALICVLGLVAVARCGCLRRLRLSSSATTPQSPTSAANKGVKKKVLRSLPKLTATAESAVKFADCAICLTEFAAGDEIRVLPQCGHGFHVSCIDAWLRSHSSCPSCRQILVVSRCDKCGGIPAPASSSSDPPPPDSEARFKGREDDANRFLP

SEQ ID NO: 1186 - protein, 203 aa, Glycine max
  misc_feature (1)..(203): Ceres CLONE ID no. 476765
  misc_feature: Utility: Useful for increasing chlorophyll and photosynthetic capacity
  misc_feature: Utility: Useful for making larger plants
  misc_feature: Utility: Useful for making ornamental plants with modified color
  misc_feature: Utility: Useful for making smaller plants
MTRGLRLLQSAAAPPPEAVAAAVESDFVVILAALLCALICVVGLVAIARCAWLRRGTAGSSAAGAVSSPATANKGLKKKVVNSLPKFTYADDGDRRKWSECAICLTEFGAGDEVRVLPQCGHGFHVACVDTWLASHSSCPSCRAPFAVVARCQKCGHFPAVASASAASESKAVGCDNAAVSAANANRNNVIITNGFSNYGFLP

SEQ ID NO: 1187 - protein, 186 aa, Zea mays
  misc_feature (1)..(186): Ceres CLONE ID no. 1509889
  misc_feature: Utility: Useful for increasing chlorophyll and photosynthetic capacity
  misc_feature: Utility: Useful for making larger plants
  misc_feature: Utility: Useful for making ornamental plants with modified color
  misc_feature: Utility: Useful for making smaller plants
MARILLEAAAGSGPPTDSINSDMILILAGLLCALVCVLGLGLVARCACSWRWAAASRSQPAADATKAANRGVKKEVLRSLPTVTYVPDSGKAKAAAGADECAICLAEFEEGQAMRVLPQCGHAFHAACVDTWLRAHSSCPSCRRVLAAPADLPPGEPCRRCGARPGFRALWKAPAPCSAEGPTFLA

SEQ ID NO: 1188 - protein, 169 aa, Glycine max
  misc_feature (1)..(169): Ceres CLONE ID no. 1369486
  misc_feature: Utility: Useful for increasing chlorophyll and photosynthetic capacity
  misc_feature: Utility: Useful for making larger plants
  misc_feature: Utility: Useful for making ornamental plants with modified color
  misc_feature: Utility: Useful for making smaller plants
MAARRLLEEAVAAGAQQDSLNSDLVLILAGLLCALVCVLGLGLVARCACSRHWARAADAPPGANRGVKKEVLRALPTVRYVADGGEASESDECAICLAEFEDGQDMRVLPQCSHAFHTACVDAWLRSHSSCPSCRRVLVAELPRGERSGRCGARPGGLDALLKAVPLCR

SEQ ID NO: 1189 - protein, 184 aa, Glycine max
  misc_feature (1)..(184): Public GI no. 50916178
  misc_feature: Utility: Useful for increasing chlorophyll and photosynthetic capacity
  misc_feature: Utility: Useful for making larger plants
  misc_feature: Utility: Useful for making ornamental plants with modified color
  misc_feature: Utility: Useful for making smaller plants
MRVLVHSAESPATPAAAISIDSDMVVILASLLCALICVAGLALVARCACRRRGAATTTTTTTTTPAATSPAPKGLKKKAIDALPTVSFALKQQQQQAECAICLAEFAGGEELRLLPHCGHAFHVSCIDTWLGTHATCPSCRATVGTSTLFLPLPGRCRRCGEVDLPTLHDFSTATATAHHNTPP

SEQ ID NO: 1190 - DNA, 808 bp, Arabidopsis thaliana
  misc_feature (1)..(808): Ceres CLONE ID no. 28602
  misc_feature (1)..(808): Also known as  Ceres CDNA ID no. 23388764
aatcttttcatcgttttcgtgtgaagtttaaagaagtttgggacccgtaaattctagaagctctggagatttcttgttcaccactataaatacatcatccgagtcaccagctttgctcagaagtagaaatcgaactcgccggaaaatcgtaattagctatctcagcattccaaacatctctttcgctttcgaaatcaaatcgagaatgtcgcttattccaagcttcttcggcaacaacaggcgaagcaacagcatcttcgacccgttctcactcgacgtttgggatccattcaaggaactgcaattcccgtcgtcgctctccggagaaacatcggcgataacgaacgcacgtgtggactggaaagagacggcggaggcgcacgtgttcaaggccgatctgccggggatgaagaaagaggaggttaaagtggagatagaggacgacagtgtgctcaagatcagtggagagagacacgtggagaaagaggagaagcaggacacgtggcatcgtgtggagaggtcgagcgggcaattctcgaggaagtttaagctgccggagaatgtgaagatggatcaagtcaaggcttccatggagaacggagttctgactgtgacggtgcctaaagtggaagaggctaagaagaaggctcaagttaagtctattgatatctctggctaaagccaattagcttatgggtttcatgtttatgcgtaaagactcttctgattatggctcttgatttgaatatggctctgtgttttggtaatgatgtattataactgttaatcctaataattaagcaaggcc

SEQ ID NO: 1191 - protein, 157 aa, Arabidopsis thaliana
  misc_feature (51)..(156): Pfam Name: HSP20; Pfam Description: Hsp20/alpha crystallin family
  misc_feature: Utility: Useful for increasing chlorophyll and photosynthetic capacity
  misc_feature: Utility: Useful for making ornamental plants with modified leaves
  misc_feature: Utility: Useful for making plants with altered leaf shape eg curled leaves
  misc_feature: Utility: Useful for making plants with increased biomass and foliage
  misc_feature: Utility: Useful for making smaller plants
  misc_feature: Utility: Useful for making taller plants
MSLIPSFFGNNRRSNSIFDPFSLDVWDPFKELQFPSSLSGETSAITNARVDWKETAEAHVFKADLPGMKKEEVKVEIEDDSVLKISGERHVEKEEKQDTWHRVERSSGQFSRKFKLPENVKMDQVKASMENGVLTVTVPKVEEAKKKAQVKSIDISG

SEQ ID NO: 1192 - protein, 154 aa, Brassica napus
  misc_feature (1)..(154): Ceres CLONE ID no. 969510
  misc_feature: Utility: Useful for increasing chlorophyll and photosynthetic capacity
  misc_feature: Utility: Useful for making ornamental plants with modified leaves
  misc_feature: Utility: Useful for making plants with altered leaf shape eg curled leaves
  misc_feature: Utility: Useful for making plants with increased biomass and foliage
  misc_feature: Utility: Useful for making smaller plants
  misc_feature: Utility: Useful for making taller plants
MIPSFFGNNRRGGSSFFDPFSLDVWDPFKDFPSSSSFSRENSAIVNARVDWRETPDAHVFKADLPGMKKEEVKVEIEDDSVLKISGERHVEKEDKNDTWHRVERSSGQFTRKFRLPENVKMDQVKAAMENGVLTVTVPKAEMKKPDVKSIQISG

SEQ ID NO: 1193 - protein, 157 aa, Parthenium argentatum
  misc_feature (1)..(157): Ceres CLONE ID no. 1608016
  misc_feature: Utility: Useful for increasing chlorophyll and photosynthetic capacity
  misc_feature: Utility: Useful for making ornamental plants with modified leaves
  misc_feature: Utility: Useful for making plants with altered leaf shape eg curled leaves
  misc_feature: Utility: Useful for making plants with increased biomass and foliage
  misc_feature: Utility: Useful for making smaller plants
  misc_feature: Utility: Useful for making taller plants
  misc_feature (117)..(117): Xaa is any aa, unknown, or other
MSIIPSAFTGRRSNIFDPFSLDVWDPFQGISNTLSDFPDTSRETAAIANARIDWRETPEAHVFKADLPGMKKEEVKVEVEEGRVLQITGERSREHEEKNDTWHRVERSSGKFFRRFXLPENAKMEHVKASMGDGVLTVTVPKEEEKKPAVKAIDISG

SEQ ID NO: 1194 - protein, 157 aa, Parthenium argentatum
  misc_feature (1)..(157): Ceres CLONE ID no. 1607887
  misc_feature: Utility: Useful for increasing chlorophyll and photosynthetic capacity
  misc_feature: Utility: Useful for making ornamental plants with modified leaves
  misc_feature: Utility: Useful for making plants with altered leaf shape eg curled leaves
  misc_feature: Utility: Useful for making plants with increased biomass and foliage
  misc_feature: Utility: Useful for making smaller plants
  misc_feature: Utility: Useful for making taller plants
MSIIPSFFTGSRSNIFDPFSSEIWDPFQGLSSVINNFPESSRETTAIANARVDWRETPEAHVFKADLPGLKKEEVKVEVEEGRVLQISGESSRENEEKNDKWHRVERSSGRFMRRFRLPENAKMDQVKAAMENGVLTVTVPKAEVKNPAVKAIDISG

SEQ ID NO: 1195 - protein, 131 aa, Zea mays
  misc_feature (1)..(131): Ceres CLONE ID no. 227031
  misc_feature: Utility: Useful for increasing chlorophyll and photosynthetic capacity
  misc_feature: Utility: Useful for making ornamental plants with modified leaves
  misc_feature: Utility: Useful for making plants with altered leaf shape eg curled leaves
  misc_feature: Utility: Useful for making plants with increased biomass and foliage
  misc_feature: Utility: Useful for making smaller plants
  misc_feature: Utility: Useful for making taller plants
MFRSIVPSAASSGGGSETAAFANARVDWKETPEAHVFKADLPGIKKEEVKVEVEDGNVLVISGKRSREEEDKNDKWHRVERSSGQFMRRFRLPENAKVDEVKAGLENGVLTVTVPKTEVKKPEVKAIEISG

SEQ ID NO: 1196 - protein, 132 aa, Glycine max
  misc_feature (1)..(132): Ceres CLONE ID no. 1069458
  misc_feature: Utility: Useful for increasing chlorophyll and photosynthetic capacity
  misc_feature: Utility: Useful for making ornamental plants with modified leaves
  misc_feature: Utility: Useful for making plants with altered leaf shape eg curled leaves
  misc_feature: Utility: Useful for making plants with increased biomass and foliage
  misc_feature: Utility: Useful for making smaller plants
  misc_feature: Utility: Useful for making taller plants
MWDPFKDFHVPTSSVSAENSAFVNTRVDWKETQEAHVLKADIPGLKKEEVKVQIEDDRVLQISGERNVEKEDKNDTWHRVDRSSGKFMRRFRLPENAKVEQVKACMENGVLTVTIPKEEVKKSDVKPIEISG

SEQ ID NO: 1197 - protein, 131 aa, Zea mays
  misc_feature (1)..(131): Ceres CLONE ID no. 212187
  misc_feature: Utility: Useful for increasing chlorophyll and photosynthetic capacity
  misc_feature: Utility: Useful for making ornamental plants with modified leaves
  misc_feature: Utility: Useful for making plants with altered leaf shape eg curled leaves
  misc_feature: Utility: Useful for making plants with increased biomass and foliage
  misc_feature: Utility: Useful for making smaller plants
  misc_feature: Utility: Useful for making taller plants
MFRSIVPPSLSSSAASETAAFASARIDWKETPEAHVFKADLPGVKKEEVKVEVEDGNVLLISGQRSREKEDKGDKWHRVERSSGQFVRRFRLPENAKTEEVRAALENGVLTVTVPKAEVKKPEVKSIQISV

SEQ ID NO: 1198 - protein, 138 aa, Zea mays
  misc_feature (1)..(138): Ceres CLONE ID no. 317418
  misc_feature: Utility: Useful for increasing chlorophyll and photosynthetic capacity
  misc_feature: Utility: Useful for making ornamental plants with modified leaves
  misc_feature: Utility: Useful for making plants with altered leaf shape eg curled leaves
  misc_feature: Utility: Useful for making plants with increased biomass and foliage
  misc_feature: Utility: Useful for making smaller plants
  misc_feature: Utility: Useful for making taller plants
MDLWDPFDTMFRSIVPSAASTNSETAVFASARIDWKETPEAHVFKADLPGVKKEEIKVEVEDGNVLVISGQRSREKEDKDDKWHRVERSSGQFVRRFRLPENAKVDQVKAGLENGVLTVTVPKAEEKKPEVKAIEISG

SEQ ID NO: 1199 - protein, 151 aa, Triticum aestivum
  misc_feature (1)..(151): Ceres CLONE ID no. 1321295
  misc_feature: Utility: Useful for increasing chlorophyll and photosynthetic capacity
  misc_feature: Utility: Useful for making ornamental plants with modified leaves
  misc_feature: Utility: Useful for making plants with altered leaf shape eg curled leaves
  misc_feature: Utility: Useful for making plants with increased biomass and foliage
  misc_feature: Utility: Useful for making smaller plants
  misc_feature: Utility: Useful for making taller plants
MSIVRRSNVFDPFADLWADPFDTFRSIVPAISGGTSETAAFANARVDWKETPEAHVFKADLPGVKKEEVKVEVEDGNVLVVSGERTKEKEDKNDKWHRVERSSGKFVRRFRLPEDAKVEEVKAGLENGVLTVTVPKAEVKKPEVKAIEISG

SEQ ID NO: 1200 - protein, 152 aa, Zea mays
  misc_feature (1)..(152): Ceres CLONE ID no. 1555466
  misc_feature: Utility: Useful for increasing chlorophyll and photosynthetic capacity
  misc_feature: Utility: Useful for making ornamental plants with modified leaves
  misc_feature: Utility: Useful for making plants with altered leaf shape eg curled leaves
  misc_feature: Utility: Useful for making plants with increased biomass and foliage
  misc_feature: Utility: Useful for making smaller plants
  misc_feature: Utility: Useful for making taller plants
  misc_feature (88)..(88): Xaa is any aa, unknown, or other
  misc_feature (104)..(104): Xaa is any aa, unknown, or other
  misc_feature (117)..(117): Xaa is any aa, unknown, or other
  misc_feature (122)..(122): Xaa is any aa, unknown, or other
  misc_feature (126)..(126): Xaa is any aa, unknown, or other
  misc_feature (128)..(128): Xaa is any aa, unknown, or other
  misc_feature (150)..(150): Xaa is any aa, unknown, or other
MSLVRRSNVFDPFSMDLWDPFDTMFRSIVPSATSTNSETAAFASARIDWKETPEAHVFKADLPGVKKEEVKVEVEDGNMLVISGQRSXEKEDKDDKWHRVERSXGQFVRRFRLPENXKVDQXKAGXEXGVLTVTVPKAEEKKPEVKAIEXSG

SEQ ID NO: 1201 - protein, 152 aa, Zea mays
  misc_feature (1)..(152): Ceres CLONE ID no. 276371
  misc_feature: Utility: Useful for increasing chlorophyll and photosynthetic capacity
  misc_feature: Utility: Useful for making ornamental plants with modified leaves
  misc_feature: Utility: Useful for making plants with altered leaf shape eg curled leaves
  misc_feature: Utility: Useful for making plants with increased biomass and foliage
  misc_feature: Utility: Useful for making smaller plants
  misc_feature: Utility: Useful for making taller plants
MSLVRRSSVFDPFSVDLFDPFDSMFRSIVPSSSSSGSETAAFASARIDWKETPEAHVFKADLPGVKKEEVKVEVEDGNVLLISGQRSREKEDKGDKWHRVERSSGQFVRRFRLPENAKTEEVRAALENGVLTVTVPKAEVKKPEVKSIQISG

SEQ ID NO: 1202 - protein, 151 aa, Triticum aestivum
  misc_feature (1)..(151): Ceres CLONE ID no. 840867
  misc_feature: Utility: Useful for increasing chlorophyll and photosynthetic capacity
  misc_feature: Utility: Useful for making ornamental plants with modified leaves
  misc_feature: Utility: Useful for making plants with altered leaf shape eg curled leaves
  misc_feature: Utility: Useful for making plants with increased biomass and foliage
  misc_feature: Utility: Useful for making smaller plants
  misc_feature: Utility: Useful for making taller plants
MSIVRRSNVFDPFADLWADPFDTFRSIVPAISGGSSETAAFANARVDWKETPEAHVFKVDLPGVKKEEVKVEVEDGNVLVVSGERSREKEDKNDKWHRVERSSGKFVRRFRLPEDAKVEEVKAGLENGVLTVTVPKAEVKKPEVKAIEISG

SEQ ID NO: 1203 - protein, 154 aa, Zea mays
  misc_feature (1)..(154): Ceres CLONE ID no. 996541
  misc_feature: Utility: Useful for increasing chlorophyll and photosynthetic capacity
  misc_feature: Utility: Useful for making ornamental plants with modified leaves
  misc_feature: Utility: Useful for making plants with altered leaf shape eg curled leaves
  misc_feature: Utility: Useful for making plants with increased biomass and foliage
  misc_feature: Utility: Useful for making smaller plants
  misc_feature: Utility: Useful for making taller plants
MSLVRRSSVFDPFSVDLFDPFDSMFRSIVPSPSSAAAASETAAFASARIDWKETPEAHVFKADLPGVKKEEVKVEVEDGNVLLISGQRSREKEDKGDKWHRVERSSGQFVRRFRLPENAKTEEVRAALENGVLTVTVPKAEVKKPEVKSIQISG

SEQ ID NO: 1204 - DNA, 1541 bp, Arabidopsis thaliana
  misc_feature (1)..(1541): Ceres CLONE ID no. 35493
  misc_feature (1)..(1541): Also known as  Ceres CDNA ID no. 23360414
ctctttcgaactctccgtcacttccatttcatttctatttgaatcttctcaaagctacacagatctctggaatcgaaaaagcttgagctgtgttaatggcggaggagaaatgggtggtgatggtgacggcgcagactccaacgaatatcgccgtgattaagtattggggaaagagagatgaggttcggattcttcccattaatgatagcattagcgtcacgcttgatcctgatcacctctgtactctcaccaccgtcgctgttagtccttcctttgatcgagatcgaatgtggctcaatggcaaggaaatctcgctttctggaagtaggtaccagaattgcttgagggaaattcgaagtcgtgctgatgatgtagaagataaagaaaagggtatcaagattgcgaagaaagattgggagaagctgcatctgcacattgcttctcataacaacttccctactgctgctggcttagcatcttctgctgctggttttgcttgcttagtttttgctcttgccaagttgatgaatgtaaatgaagatccaagccaactttctgctatagcaaggcaaggttcaggaagtgcttgccgtagtttatttgggggatttgtcaagtggaatatgggaaacaaagaagatggaagtgacagtgttgcagttcaactggtagatgataagcactgggatgatcttgttatcattattgctgtggttagttcacgacagaaggaaacaagcagcacctcgggaatgcgtgagagtgttgagacaagtttgcttttacagcatagagcaaaggaagttgtcccagtacggattttgcaaatggaagaagctataaagaatcgagatttcacatcttttacaaaattgacgtgttcagacagtaatcagtttcatgctgtttgtatggatacatctccacccatattctacatgaatgacacctcccacaggataatcagcttagttgaaaagtggaaccgttctgccggtacaccagagattgcttatacatttgatgctggcccaaatgcagtcatgattgcaagaaacaggaaagtagcagttgaattgctgcaggggctgctctactgcttccctcctaagcctgacacagacatgaagagttacgtactgggggatacatcgatagtaaaagaggcaggcttggaaggagagcttccacaaggaattaaagacaaaattggaagtcaggatcaaaaaggtgaagtgagttattttatatgcagcagacctggaagaggtcctgtggtgcttcaagaccaaactcaagctcttctccatcctcaaactggcctccccaaataaccatttctatgtcttgttgttacttcaactctgagatttgcaacagcttcatcttttgctttgccagctccaactcttgtcctaagagagcactcttctgaatcttttcccaattatttgtgtttacgtacaattcttctgcatcgggtgcaaaaaacaaaacaatcaatattgcaaacgaataagatcttgatgctaaatctgagt

SEQ ID NO: 1205 - protein, 412 aa, Arabidopsis thaliana
  misc_feature (111)..(323): Pfam Name: GHMP_kinases; Pfam Description: GHMP kinases putative ATP- binding protein
  misc_feature: Utility: Useful for increasing chlorophyll and photosynthetic capacity
  misc_feature: Utility: Useful for making plants with increased biomass and foliage
MAEEKWVVMVTAQTPTNIAVIKYWGKRDEVRILPINDSISVTLDPDHLCTLTTVAVSPSFDRDRMWLNGKEISLSGSRYQNCLREIRSRADDVEDKEKGIKIAKKDWEKLHLHIASHNNFPTAAGLASSAAGFACLVFALAKLMNVNEDPSQLSAIARQGSGSACRSLFGGFVKWNMGNKEDGSDSVAVQLVDDKHWDDLVIIIAVVSSRQKETSSTSGMRESVETSLLLQHRAKEVVPVRILQMEEAIKNRDFTSFTKLTCSDSNQFHAVCMDTSPPIFYMNDTSHRIISLVEKWNRSAGTPEIAYTFDAGPNAVMIARNRKVAVELLQGLLYCFPPKPDTDMKSYVLGDTSIVKEAGLEGELPQGIKDKIGSQDQKGEVSYFICSRPGRGPVVLQDQTQALLHPQTGLPK

SEQ ID NO: 1206 - protein, 419 aa, Arabidopsis thaliana
  misc_feature (1)..(419): Public GI no. 18410026
  misc_feature: Utility: Useful for increasing chlorophyll and photosynthetic capacity
  misc_feature: Utility: Useful for making plants with increased biomass and foliage
MATEKWVFMVTAQTPTNIAVIKYWGKRDEVRILPVNDSISVTLDPDHLCTVTTVAVSPAFDRDRMWLNGKEISLSGSRYQNCLREIRGRAGDVEDMEKGIKIRKKDWEKLNLHIASHNNFPTAAGLASSAAGFACLVFSLAKLMNVDEDPSHLSAIARQGSGSACRSLFGGFVKWTMGSKEDGSDSVAVQLADEKHWDDLVIIIAVVSSRQKETSSTSGMRESVETSLLLQHRAKEVVPKRILQMEEAIKNRDFASFTQLTCTDSNQFHAVCLDTSPPIFYMNDTSHRIISLVEKWNRSEGTPQVAYTFDAGPNAVLIARNRKVAVQLLQGLLYYFPPKSDTDMKSYVVGDNSILKEAGLDGASGVENLQPPPEIKDNIGSQDQKGEVSYFICTRPGKGPIVLHDQTQALLDPETGLPK

SEQ ID NO: 1207 - protein, 413 aa, Arabidopsis thaliana
  misc_feature (1)..(413): Public GI no. 6822071
  misc_feature: Utility: Useful for increasing chlorophyll and photosynthetic capacity
  misc_feature: Utility: Useful for making plants with increased biomass and foliage
MATEKWVFMVTAQTPTNIAVIKYWGKRDEVRILPVNDSISVTLDPDHLCTVTTVAVSPAFDRDRMWLNGKEISLSGSRYQNCLREIRGRAGDVEDMEKGIKIRKKDWEKLNLHIASHNNFPTAAGLASSAAGFACLVFSLAKLMNVDEDPSHLSAIARQGSGSACRSLFGGFVKWTMGSKEDGSDSVAVQLADEKHWDDLVIIIAVETSSTSGMRESVETSLLLQHRAKEVVPKRILQMEEAIKNRDFASFTQLTCTDSNQFHAVCLDTSPPIFYMNDTSHRIISLVEKWNRSEGTPQVAYTFDAGPNAVLIARNRKVAVQLLQGLLYYFPPKSDTDMKSYVVGDNSILKEAGLDGASGVENLQPPPEIKDNIGSQDQKGEVSYFICTRPGKGPIVLHDQTQALLDPETGLPK

SEQ ID NO: 1208 - protein, 419 aa, Arabidopsis thaliana
  misc_feature (1)..(419): Public GI no. 21593243
  misc_feature: Utility: Useful for increasing chlorophyll and photosynthetic capacity
  misc_feature: Utility: Useful for making plants with increased biomass and foliage
MATEKWVFMVTAQTPTNIAVIKYWGKRHEVRILPVNDSISVTLDPDHLCTVTTVAVSPAFDRDRMWLNGKEISLSGSRYQNCLREIRGRAGDVEDMEKGIKIRKKDWEKLNLHIASHNNFPTAAGLASSAAGFACLVFSLAKLMNVDEDPSHLSAIARQGSGSACRSLFGGFVKWTMGSKEDGSDSVAVQLADEKHWDDLVIIIAVVSSRQKETSSTSGMRESVETSLLLQHRAKEVVPKRILQMEEAIKNRDFASFTQLTCTDSNQFHAVCLDTSPPIFYMNDTSHRIISLVEKWNRSEGTPQVAYTFDAGPNAVLIARNRKVAVQLLQGLLYYFPPKSDTDMKSYVVGDNSILKEAGLDGASGVENLQPPPEIKDNIGSQDQKGEVSYFICTRPGKGPIVLHDQTQALLDPETGLPK

SEQ ID NO: 1209 - protein, 324 aa, Arabidopsis thaliana
  misc_feature (1)..(324): Ceres CLONE ID no. 37377
  misc_feature: Utility: Useful for increasing chlorophyll and photosynthetic capacity
  misc_feature: Utility: Useful for making plants with increased biomass and foliage
  misc_feature (191)..(191): Xaa is any aa, unknown, or other
MEKGIKIRKKDWEKLNLHIASHNNFPTAAGLASSAAGFACLVFSLAKLMNVDEDPSHLSAIARQGSGSACRSLFGGFVKWTMGSKEDGSDSVAVQLADEKHWDDLVIIIAVVSSRQKETSSTSGMRESVETSLLLQHRAKEVVPKRILQMEEAIKNRDFASFTQLTCTDSNQFHAVCLDTSPPIFYMNDTXHRIISLVEKWNRSEGTPQVAYTFDAGPNAVLIARNRKVAVQLLQGLLYYFPPKSDTDMKSYVVGDNSILKEAGLDGASGVENLQPPPEIKDNIGSQDQKGEVSYFICTRPGKGPIVLHDQTQALLDPETGLPK

SEQ ID NO: 1210 - protein, 415 aa, Arabidopsis thaliana
  misc_feature (1)..(415): Public GI no. 16417950
  misc_feature: Utility: Useful for increasing chlorophyll and photosynthetic capacity
  misc_feature: Utility: Useful for making plants with increased biomass and foliage
MAESWVIMVTAQTPTNIAVIKYWGKRDEKLILPVNDSISVTLDPAHLCTTTTVAVSPSFAQDRMWLNGKEISLSGGRYQNCLREIRARACDVEDKERGIKISKKDWEKLYVHIASYNNFPTAAGLASSAAGFACLVFALAKLMNAKEDNSELSAIARQGSGSACRSLFGGFVKWKMGKVEDGSDSLAVQVVDEKHWDDLVIIIAVVSSRQKETSSTTGMRETVETSLLLQHRAKEIVPKRIVQMEESIKNRNFASFAHLTCADSNQFHAVCMDTCPPIFYMNDTSHRIISCVEKWNRSVGTPQVAYTFDAGPNAVLIAHNRKAAAQLLQKLLFYFPPNSDTELNSYVLGDKSILKDAGIEDLKDVEALPPPPEIKDAPRYKGDVSYFICTRPGQGPVLLSDESQALLSPETGLPK

SEQ ID NO: 1211 - protein, 421 aa, Glycine max
  misc_feature (1)..(421): Ceres CLONE ID no. 464546
  misc_feature: Utility: Useful for increasing chlorophyll and photosynthetic capacity
  misc_feature: Utility: Useful for making plants with increased biomass and foliage
MMASESQNWVFMVTAQTPTNIAVIKYWGKRDETLILPVNDSISVTLDPSHLCTTTTAAVSPAFHQDRMWLNGKEISLSGGRFQSCLREIRARACDVEDETKGIKITKEDWGKLHVHIASYNNFPTAAGLASSAAGFACLAYALGKLMNVKEDESQLSAIARQGSGSACRSLFGGFVKWIMGKEDNGSDSLAVQLTDEKHWDDLVIVIAVVSSRQKETSSTTGMRESVETSLLLQHRAKEIVPKRILQMEEAIKNRDFASFSQLTCADSNQFHAVCLDTCPPIFYMNDTSHRIISIVEKWNRSEEAPQVAYTFDAGPNAVLIARNRKAATSLIQRLLYYFPPNSDDLSSYIIGDKSIAKDAGINGIQDVEALPPPPEIKDNIPSQKYKGDVSYFICTRPGRGPVLLSDSIQALLNDETGLPK

SEQ ID NO: 1212 - protein, 420 aa, Zea mays
  misc_feature (1)..(420): Ceres CLONE ID no. 244285
  misc_feature: Utility: Useful for increasing chlorophyll and photosynthetic capacity
  misc_feature: Utility: Useful for making plants with increased biomass and foliage
MAAAEGQWVLMATGRTPTNIAVIKYWGKRDEALILPINDSISVTLDPDHLSATTTVAVSPSFPSDRMWLNGKEISLLGGRFQSCLREIRKRARDFEDKEKGVKIKKEDWDKLHVHIASYNNFPTAAGLASSAAGLACFVFTLGKLMNAKEDYGELSSIARQGSGSACRSIYGGFVKWCMGEKDDGSDSIAVQLADETHWNDLVIIIAVVSSKQKETSSTSGMRDSVETSPLLQYRAQTVVPGRVLKMEEAIKNRDFESFAKLTCADSNQFHAVCLDTSPPIFYMNDTSHRIISLVEKWNHSEGTPQVAYTFDAGPNAVLIAQNRKTAAHLLQKLLYYFPPQDNDLSSYLVGDKSILGVAGLHSMKDVEALPAPPETKIPDQKFKGDVSYFICSRLGAGPKVVSDEGQALIDSVTGLPKGV

SEQ ID NO: 1213 - protein, 420 aa, Triticum aestivum
  misc_feature (1)..(420): Ceres CLONE ID no. 696587
  misc_feature: Utility: Useful for increasing chlorophyll and photosynthetic capacity
  misc_feature: Utility: Useful for making plants with increased biomass and foliage
MGATEPQWVLMATGRSPTNIAVIKYWGKRDETLILPVNDSISVTLDPDHLSATTTVAASPSFPSDRMWLNGKEIALSGGRFQSCLREIRKRARDVEDEKKGIKIKKEDWEKLHVHIASYNNFPTAAGLASSAAGLACLVFTLGKLMNVNEDYGELSSIARQGSGSACRSIYGGFVKWCMGKNDDGSDSMAVQLADESHWDDLVIIIAVVSSKQKETSSTSGMRDTVETSPLLQYRAQTVVPSRILKMEDAIKNRDFESFARLTCADSNQFHAVCLDTSPPIFYMNDTSHRIISLVEKWNHSEGTPQVAYTFDAGPNAVLIARNRKTATLLLQRLLYTFPPQKNDLDSYMLGDKSILSDAGLQSIADVEALPAPPEMKAPNQKFKGDVSYFICSRPGAGPKVLTDESHALIDSATGLAKGV

SEQ ID NO: 1214 - protein, 421 aa, Triticum aestivum
  misc_feature (1)..(421): Public GI no. 50252009
  misc_feature: Utility: Useful for increasing chlorophyll and photosynthetic capacity
  misc_feature: Utility: Useful for making plants with increased biomass and foliage
MAAAEEGQWVLMATGRSPTNIAVIKYWGKRDEALILPVNDSISVTLDPDHLSATTTVAVSPSFPSDRMWLNGKEISLSGGRFQSCLREIRKRAQDVEDEKKGIRIKKEDWGKLHVHIASFNNFPTAAGLASSAAGLACFVFTLGKLMNVKEDHGELSSIARQGSGSACRSIYGGFVKWCMGKNNDGSDSIAVQLADEAHWNDLVIIIAVVSSKQKETSSTSGMRDSVETSPLLQYRAQTVVPERVLKMEEAIKSRNFESFARLTCADSNQFHAVCLDTSPPIFYMNDTSHRIISLVEKWNQSEGTPQVAYTFDAGPNAVLIAPNRKNATILLQKLLYYFPPQDNDLSSYMVGDKSILSDAGLKSIEDVEALPAPAETKMPSQKFKGDVSYFICSRLGAGPKVVTDESLALIDSVTGLPKGV

SEQ ID NO: 1215 - protein, 351 aa, Zea mays
  misc_feature (1)..(351): Ceres CLONE ID no. 224503
  misc_feature: Utility: Useful for increasing chlorophyll and photosynthetic capacity
  misc_feature: Utility: Useful for making plants with increased biomass and foliage
MARRFSLLGGRFQSCLREIRKRARDFEDKEKGVKIKKEDWDKLHVHIASYNNFPTAAGLASSAAGLACFVFTLGKLMNVKEDYGELSSIARQGSGSACRSIYGGFVKWCMGEKDDGSDSIAVQLADETHWNDLVIIIAVVSSKQKETSSTSGMRDSVETSPLLQYRAQTVVPGRVLKMEEAIKNRDFESFAKLTCADSNQFHAVCLDTSPPIFYMNDTSHRIISLVEKWNHSEGTPQVAYTFDAGPNAVLIAQNRKTAAHFLQKLLYYFPPQDNDLSSYLVGDKSILGDAGLHSMKDVEALPAPPDTKIPDQKFKGDVSYFICSRLGAGPKVVVDEGQALIDSVTGLPKGV

SEQ ID NO: 1216 - protein, 430 aa, Zea mays
  misc_feature (1)..(430): Public GI no. 54292590
  misc_feature: Utility: Useful for increasing chlorophyll and photosynthetic capacity
  misc_feature: Utility: Useful for making plants with increased biomass and foliage
MSGEQRELNSWVFMVTARAPTNIAVIKYWGKRDEKLILPINDSISVTLDPDHLSATTTVAVSPSFSSDRMWLNGKEVSLGGERYQNCLREIRSRGRDVVDEKSGTLIKKEDWQTLHLHIASHNNFPTAAGLASSAAGFACLVYALAKLMDIEERYAGELSAIARQGSGSACRSLYGGFVKWDMGKERDGSDSIAVQLATEEHWEELVILVAVVSSRQKETSSTTGMRESVETSELLHHRAQEVVPKRIVQMQEAIANHDFASFARITCVDSNQFHAVCLDASPPIFYMNDTSHRIINCIEKWNRFEGTPQVSYTFDAGPNAVICAPSRKVAGLLLQRLLYYFPPDSSKELSSYVIGDTSILGEIGLKSMKDVESLIAPPEFRSQNSSSIHPGEVDYFICTRPGKGPIILRNEDQAFFNNKTGFPFRISET

SEQ ID NO: 1217 - DNA, 1273 bp, Arabidopsis thaliana
  misc_feature (1)..(1273): Ceres CLONE ID no. 37229
  misc_feature (1)..(1273): Also known as  Ceres CDNA ID no. 23389130
aaagatcaggtttcgatttcaccaaaaaccgaacactgtgtcttccgtcctaaagattgtaaagggaaaccgttttcgattttcagagaagatcacacatctttcgtcccttcactgccatacgtgtcgataaagatggcggctatggcggcgaagcttcagttatcggcgaaatctgatcaaagcagtgtgcgattaccgagagtgatcaacctctcccgcgatccaacgactagagtctcgtttccgcgaaatggatcagtttgttccctccacaccaatttctcttctccacatctcgcgaaaccttgcgccggaggtggtggtggtggaagcaccggtaataacggcggcggaagcggaagcggaggaggaggtggtggttttggaggttcagggggtgaagcaagtgaagaatcatctccatggggaccaatagggttattcatccaaggatggagatcaagagttgcagctgatcctcagttcccttttaaggtactaatggaagagatcgtaggacttagcgcttgtgttctcggtgacatggcttcacgacctaatttcggattaaacgagctagatttcgtcttctccacgctcgttgtaggttcgattctcaatttcgtactcatgtacatgttagctcctactgcagcaactcttggctcctctcagactttgcctggaatctttagaaactgtccatcaagccatatgtttgaacagggtagcttcaccgttatgaaccgtttcgggactcttgtgtacaaaggaatggtttttgctagtgtaggattagctgcaggtcttgtaggtactgccatttctaatggggttgattatgctgaggaagaagatggacccgagcttcgaaacgccaaacaaaccgccaccgactgtgcttaattctttaacttgggcaactcatatgggagtgagtgcgaatgcaaggtaccaaacgttgaatgggattgagttcttgctggcaaaggtgttgcccccattggtgtttaagacaagtgtgatagttttgaggtgtgcaaacaatgttgctggaggaatgtcgtttgttttgttggcaaggatgacgggatcacagtcggtggaggagaagacagagatgtcagagatttcagagaaagagaaggatgattgaatctcatcctagtctttcaaggtttttgttcctgtgtgtttttcgccagttcataggcttcttgagttgaaaccatttgtgttggaataaataagatgaatcccttcttaggcc

SEQ ID NO: 1218 - protein, 340 aa, Arabidopsis thaliana
  misc_feature: Utility: Useful for increasing chlorophyll and photosynthetic capacity
  misc_feature: Utility: Useful for making smaller plants
MAAMAAKLQLSAKSDQSSVRLPRVINLSRDPTTRVSFPRNGSVCSLHTNFSSPHLAKPCAGGGGGGSTGNNGGGSGSGGGGGGFGGSGGEASEESSPWGPIGLFIQGWRSRVAADPQFPFKVLMEEIVGLSACVLGDMASRPNFGLNELDFVFSTLVVGSILNFVLMYMLAPTAATLGSSQTLPGIFRNCPSSHMFEQGSFTVMNRFGTLVYKGMVFASVGLAAGLVGTAISNGLIMLRKKMDPSFETPNKPPPTVLNSLTWATHMGVSANARYQTLNGIEFLLAKVLPPLVFKTSVIVLRCANNVAGGMSFVLLARMTGSQSVEEKTEMSEISEKEKDD

SEQ ID NO: 1219 - protein, 339 aa, Arabidopsis thaliana
  misc_feature (1)..(339): Public GI no. 46402460
  misc_feature: Utility: Useful for increasing chlorophyll and photosynthetic capacity
  misc_feature: Utility: Useful for making smaller plants
MAAMAAKLHISTKSDQSNVRLPRLINLSRDPTARVLFPRNGSVSSLHTNFSSPNIMVPCAGGGGGGSIGNHGGGSGSGGGGGGYGGSEEEESSPWGPLGLFIQGWRSRVAADSQFPFKVLMEMLVGVSANVLGDMASRPNFGLNELDFVFSTLVVGSILNFTLMYLLAPSAISHGSSNLLPGIFRSCPSSHMFEQGNFTLMNRFGTLVYKGMVFATVGLAAGLVGTAISNGLIMLRKKIDPSFETPNKPPPTLLNSLTWATHMGVSANVRYQTLNGAEFLLEKSLPPLVFKTSVIALRVVNNVLGGMSFVTLARMTGSQSVEEEKKIEMSEISEKEKED

SEQ ID NO: 1220 - protein, 336 aa, Arabidopsis thaliana
  misc_feature (1)..(336): Ceres CLONE ID no. 1190836
  misc_feature: Utility: Useful for increasing chlorophyll and photosynthetic capacity
  misc_feature: Utility: Useful for making smaller plants
MAAKLHISTKSDQSNVRLPRLINLSRDPTARVLFPRNGSVSSLHTNFSSPNIMVPCAGGGGGGSIGNHGGGSGSGGGGGGYGGSEEEESSPWGPLGLFIQGWRSRVAADSQFPFKVLMEMLVGVSANVLGDMASRPNFGLNELDFVFSTLVVGSILNFTLMYLLAPSAISHGSSNLLPGIFRSCPSSHMFEQGNFTLMNRFGTLVYKGMVFATVGLAAGLVGTAISNGLIMLRKKIDPSFETPNKPPPTLLNSLTWATHMGVSANVRYQTLNGAEFLLEKSLPPLVFKTSVIALRVVNNVLGGMSFVTLARMTGSQSVEEEKKIEMSEISEKEKED

SEQ ID NO: 1221 - protein, 346 aa, Glycine max
  misc_feature (1)..(346): Ceres CLONE ID no. 565532
  misc_feature: Utility: Useful for increasing chlorophyll and photosynthetic capacity
  misc_feature: Utility: Useful for making smaller plants
MAMLRLSPLSGQNHVLSFPSSPSPPPPKLQNRPLYLTNLPHLPQRLKLSFAGGAGGDGVGRGGGSGGGGGGGESWGDDEGKSKDSSLGILGLFLNGWRSRVAADPQFPFKVLMEELVGVSACVLGDMASRPNFGLNELDFVFSTLVVGAILNFTLMYLLAPTMTSSASNLPALFASCPKSHMFEPGAFSLLDRLGTLVYKGTIFSVVGFGAGLVGTTLSNGLIKMRKKMDPTFETPNKPPPTILNALTWAAHMGISSNLRYQTLNGVEFMLERVLNPLAFKSSVLVLRCVNNVLGGMSFVVLARLTGAQSVGGEQKENEVALIAEKEKVVESEREEGLQNNQSTAP

SEQ ID NO: 1222 - protein, 343 aa, Zea mays
  misc_feature (1)..(343): Ceres CLONE ID no. 285684
  misc_feature: Utility: Useful for increasing chlorophyll and photosynthetic capacity
  misc_feature: Utility: Useful for making smaller plants
PPQTKNRRQVLPRAPRLLPAHRAPPRRAHREPLLLPALRQPVVPAPPPVPLPVRPGGQAAPAPAASAPVSHAQHRTRAIPSRPDRHGRRGGGILGLFLAGWAARVAADPQFPFKVLMEELVGVTACVLGDMASRPNFGLNELDFVFSTLVVGSILNFVLMYLLAPTAAASSAASALPSHMFEPGAFSLGSRVATLVSKGATFAVVGFAAGLAGTALSNGLMAMRKRMDPAFETPNKPPPTLLNAATWALHMAGSSNLRYQTLNGVEYMLGKVAPAPVFKASVVVLRCLNNVLGGVSFVLLARLTGAQKSDKPATVAEEKERLIAVGNAAADAIGEARDGEEGK

SEQ ID NO: 1223 - protein, 347 aa, Glycine max
  misc_feature (1)..(347): Ceres CLONE ID no. 513688
  misc_feature: Utility: Useful for increasing chlorophyll and photosynthetic capacity
  misc_feature: Utility: Useful for making smaller plants
MAAMAMLRLSPLSGQNHALSFPSSPSPPPKLQNRPLYLTNLPHLPQRLKLSFAGGDGGDGVGRGGGGGGGGESWGDEGKPKDSSFGILGLFLNGWRSRVAADPQFPFKVLMEELVGVSACVLGDMASRPNFGLNELDFVFSTLVVGAILNFTLMYLLAPTMTSSAASNLPALFASCPKSHMFEPGAFSLLDRLGTLVYKGTIFSVVGFGAGLVGTTLSNGLIKMRKKMDPTFETPNKPPPTFLNALTWAGHMGVSSNLRYQTLNGVEFMLERVLNPLAFKSSVLVLRCVNNVIGGMSFVVLARLTGAQSVGGEQKKENEVALIAEKEKLESEREEGLQNNQSTAPSK

SEQ ID NO: 1224 - protein, 349 aa, Triticum aestivum
  misc_feature (1)..(349): Ceres CLONE ID no. 928014
  misc_feature: Utility: Useful for increasing chlorophyll and photosynthetic capacity
  misc_feature: Utility: Useful for making smaller plants
MAAPTAFAAARFLPSAHLDSSARLAPLRAAPTSNLAFSPLPASSSALLALRSASPSPSGPGGRLPPPPPPRSYGGGGGGSGDAADSGGAGDGAGGRAGILGMFLAGWAARVAADPQFPFKVLMEELVGVTACVLGDMSSRPNFGLNELDFVFSTLVVGSILNFVLMYMLAPTAGVSAAAAAAVSSLPSHMFEPGPYSLGSRFATLLSKGTTFAVVGFGAGLMGTAISNGLIAMRKRMDPAFETPNKAPPTLLNAGTWALHMGISSNLRYQTLNGVEFLLGNVMPPPVFKVAVIALRCMNNVLGGMSFVLLARLTGAQKSDKPASSDSEAKERLIAEGDAIAANVSTEDK

SEQ ID NO: 1225 - protein, 341 aa, Zea mays
  misc_feature (1)..(341): Ceres CLONE ID no. 279840
  misc_feature: Utility: Useful for increasing chlorophyll and photosynthetic capacity
  misc_feature: Utility: Useful for making smaller plants
  misc_feature (113)..(113): Xaa is any aa, unknown, or other
MASTAFAAAKYFPAHLDSSPRIAPRRAAPTASLSFSPLSASPSSLLRLRSPCPSGPGGRLPPPPPPRSYGGGGGSGGDAADSGGGRRGGGILGLFLAGWAARVAADPQFPFKXLMEELVGVTACVLGDMASRPNFGLNELDFVFSTLVVGSILNFVLMYLLAPTAAASSAASALPSHMFEPGAFSLGSRVATLVSKGATFAVVGFAAGLAGTALSNGLMAMRKRMDPAFETPNKPPPTLLNAATWALHMAGSSNLRYQTLNGVEYMLGKVAPAPVFKASVVVLRCLNNVLGGVSFVLLARLTGAQKSDKPATVAEEKERLIAVGNAVADAIGEARDGEEGK

SEQ ID NO: 1226 - protein, 348 aa, Zea mays
  misc_feature (1)..(348): Public GI no. 56785038
  misc_feature: Utility: Useful for increasing chlorophyll and photosynthetic capacity
  misc_feature: Utility: Useful for making smaller plants
MASMAFTAAKFLPATAPTHLDSSPRLSPPRAGSLSFSPLSSSSSALLLRLRSPSPSGPSGPGGRLPPPPRSYGGGGGSGDAADSGGSSGGILGIFLAGWAARVAADPQFPFKVLMEELVGVSACVLGDMASRPNFGLNELDFVFSTLVVGSILNFVLMYLLAPTAGASAAASAAASGLPSHMFEAGAYSLGSRVATLLSKGATFAAVGFAAGLAGTAISNGLISLRKRMDPAFETPNKAPPTLLNAATWAIHMGVSSNLRYQTLNGVEYLLANAAPPSVFKVSVVALRCINNVLGGMSFVLLARLTGSQKSDAPAASATAEEEKERLIAVGNDIAADAVGAGRDGEGK

SEQ ID NO: 1227 - DNA, 1211 bp, Arabidopsis thaliana
  misc_feature (1)..(1211): Ceres CLONE ID no. 37493
  misc_feature (1)..(1211): Also known as  Ceres CDNA ID no. 23370172
aaaaagagaatgggttctaagggagacaacgttgctgtatgtaacatgaagctcgagagacttctcagcatgaaaggtggcaaaggacaagacagctacgccaataactctcaagctcaggcaatgcatgcacggtccatgcttcacctcctagaggaaacacttgaaaatgttcacctcaactcctccgccagtccgccaccgttcacgacggttgatcttggctgttcctccggcgcaaatactgtccacataatcgatttcatagtcaaacatatctctaagaggtttgatgctgccggaatcgaccctccggagttcacagctttcttctccgatctcccaagcaacgacttcaacacgcttttccagcttcttccaccacttgtctctaacacttgcatggaggagtgtcttgctgccgacgggaaccgctcctacttcgtcgctggtgttcccggatcgttttaccggcgactttttccagcgagaaccattgactttttccactctgccttctccttgcattggctctctcaggtgccggaaagtgtgacggataggagatcggcggcgtacaatagagggagagttttcatacacggtgccggagagaagacaacaacggcatacaaacggcagtttcaggccgacttagcggagtttttgagggcaagagcggcagaggttaagagaggtggggccatgttcctggtctgtcttggtcgtacctctgtggatcccaccgaccagggtggtgccggtctactcttcggcactcattttcaggacgcttgggacgaccttgtccgcgagggtttggtagcagcagagaaacgagatggattcaatatcccggtgtacgcaccaagcttgcaagatttcaaggaagtagttgacgccaacggctcatttgcaattgataagctggtagtatacaaaggagggagtccacttgtggtgaatgagccagacgatgcatcagaagttggtcgtgcctttgctagtagttgtcggagtgtggccggagtgctcgtggaagctcacataggcgaagagctaagcaataaactgttctcacgagttgaaagccgagccactagccatgccaaagatgtcttggtgaatttgcagttcttccacattgtcgcttctttgtcttttacttaattagtaccaaataatatgaaaaagaaatatgttcgtgtgcc

SEQ ID NO: 1228 - protein, 386 aa, Arabidopsis thaliana
  misc_feature (48)..(386): Pfam Name: Methyltransf_7; Pfam Description: SAM dependent carboxyl methyltransferase
  misc_feature: Utility: Useful for increasing chlorophyll and photosynthetic capacity
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with altered leaf shape eg curled leaves
  misc_feature: Utility: Useful for making plants with increased biomass and foliage
  misc_feature: Utility: Useful for making smaller plants
MGSKGDNVAVCNMKLERLLSMKGGKGQDSYANNSQAQAMHARSMLHLLEETLENVHLNSSASPPPFTTVDLGCSSGANTVHIIDFIVKHISKRFDAAGIDPPEFTAFFSDLPSNDFNTLFQLLPPLVSNTCMEECLAADGNRSYFVAGVPGSFYRRLFPARTIDFFHSAFSLHWLSQVPESVTDRRSAAYNRGRVFIHGAGEKTTTAYKRQFQADLAEFLRARAAEVKRGGAMFLVCLGRTSVDPTDQGGAGLLFGTHFQDAWDDLVREGLVAAEKRDGFNIPVYAPSLQDFKEVVDANGSFAIDKLVVYKGGSPLVVNEPDDASEVGRAFASSCRSVAGVLVEAHIGEELSNKLFSRVESRATSHAKDVLVNLQFFHIVASLSFT

SEQ ID NO: 1229 - protein, 400 aa, Arabidopsis thaliana
  misc_feature (1)..(400): Public GI no. 50929439
  misc_feature: Utility: Useful for increasing chlorophyll and photosynthetic capacity
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with altered leaf shape eg curled leaves
  misc_feature: Utility: Useful for making plants with increased biomass and foliage
  misc_feature: Utility: Useful for making smaller plants
MASMKGENVTVSAAAAPRMKKLASMLCMKGGNGDGSYLNNSQAQALHARRMLHFLEETLDAMMERSSSDKLFTAADLGCSCGSNSLFIVDVIVRRVSEAYESRGRDAPEFQVFFSDLPSNDFNTLFQLLPPLLAPVAGSLEECLAAGEGAATATRPYHAAGVPGTFYGRLFPGESIDVFTSTFSLHWLSQVPEEVGDSASPAYNGGRVFVHRATEAVAAAYKRQFQADLARFLRSRAREMKRGGAMFLACLGRSSGDPADQGGAGLLFGTHFQDAWDDLVQEGVVEGEKRDSFNIPVYAPSLQEFRDVVRADGAFAIDRLELVRGGSPLVVDRPDDAAEVGRAMANSCKAVAGVLVDAHIGERRGAQLFERLERRAARHARELVEKMHFFHVVCSLSLAP

SEQ ID NO: 1230 - protein, 349 aa, Arabidopsis thaliana
  misc_feature (1)..(349): Public GI no. 54290518
  misc_feature: Utility: Useful for increasing chlorophyll and photosynthetic capacity
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with altered leaf shape eg curled leaves
  misc_feature: Utility: Useful for making plants with increased biomass and foliage
  misc_feature: Utility: Useful for making smaller plants
MMLYALEETLDKIAIPPRGPGRLLLTAADLGCSCGRSSLVVADAIVQHMTKLCRGRGKHVDAVAAADPEFWFYFSDLPSNDFNTLFSLLPPHAASSGDGSGRRYFAAAVPGSFHDRLFPERSIDVFTSTFCLHWLSQVPDEVADTRSPAYNKGKVFVQGSSEETGTAYRRQFQSDMARFLRCRAAELKPGGAMFLVFVGRPSSAGPTDQGRSLNLLGTMFEESWRDLVDEGLIDGGRMDSFNIPSYAATLEEFRESVDADGSFAVNRLEHVMGGRLAVDDDPHDDRCAVGRRVANNQRSIFGPLVEAHIGRALADELFVRMERRAEELSDELVDEMGVRFHILCSLSLV

SEQ ID NO: 1231 - protein, 383 aa, Arabidopsis thaliana
  misc_feature (1)..(383): Public GI no. 50929461
  misc_feature: Utility: Useful for increasing chlorophyll and photosynthetic capacity
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with altered leaf shape eg curled leaves
  misc_feature: Utility: Useful for making plants with increased biomass and foliage
  misc_feature: Utility: Useful for making smaller plants
MKNVFCMKGGQGESSYLKNSKVQFRNLQMMLRALEETLDKVVLPHHGPGRLLLTAADLGCSCGRNTLVVADAIVQHMTKLCRRRGKGEHGDDAAADPEFCFYFSDLPSNDFNTLFGLLPHRGAASSGEGGRGRRHYFAAAVPGSFHDRLFPERSIDVFTSTFCLHWLSQVPEEVADKWSPAYNKEKVFVHGGSEETGAAYRRQFQSDMARFLRCRAAELKPGGAMFLVFLGRPSSAGPTDQGRSLSQFGAMFEESWRDLVGEGLIDGERMDSFNVPSYAATLEEFREVVDADGSFEVNRLELVMGSPLAVDDDDDDSHDRRAVGRTVANNQRSVFGPLVEAHIGKELADELFVRVQSRAEALDDELVDEMRVHIHIVCSLSLV

SEQ ID NO: 1232 - protein, 378 aa, Arabidopsis thaliana
  misc_feature (1)..(378): Public GI no. 50929459
  misc_feature: Utility: Useful for increasing chlorophyll and photosynthetic capacity
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with altered leaf shape eg curled leaves
  misc_feature: Utility: Useful for making plants with increased biomass and foliage
  misc_feature: Utility: Useful for making smaller plants
MQKVLMKDVFCMEGGQGESSYIKNSQVQSRNLQMMLPTLKEILDKVQLPRRPGKHLLTAADLGCSCGHNTLIVADAIVEHMTRKLRSCIFDDQDDGDAADPEFCFYFSDLPSNDFNTLFHLLPQHATAAAGDGSERRYFAAAVPGSFHDRLFPKRSINVFTSTFSLHWLSQVPEGVADKRSAAYNKDKVFVHGASQATGAAYRRQFQSDMARFLRCRATELKAGGVMFLVCLGRPSLHACPTNQGRVQLLYGAMFEESWGDLVEEGTIGRETMGSFNVPVYAATLEEFGEAVGADGLFEINRLELVITSPLAVDDPIRDRRAVANYVRSLLGPLVDAHVGRAVADEIFVRMQRRAEARAEELVDEMRFPHIVCSLSLA

SEQ ID NO: 1233 - protein, 379 aa, Arabidopsis thaliana
  misc_feature (1)..(379): Public GI no. 50929453
  misc_feature: Utility: Useful for increasing chlorophyll and photosynthetic capacity
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with altered leaf shape eg curled leaves
  misc_feature: Utility: Useful for making plants with increased biomass and foliage
  misc_feature: Utility: Useful for making smaller plants
MQEQQQDFKNVFCMEGGQGESSYINNSQSQSRNLKMMLYALEETLDKIQLPRHRPGNKPLLTAADLGCSCGQNTLLIADVIVDHMTDKSFGSKDDDGLEFCFYFSDLPSNDFNTLFHLLPQQAAAAGRDGRQSRRYFAAAVPGSFHDRLFPERSINVFTSTFSLHWLSQVPKRVVDKQSPAYNKGKVFVHGASEETGTAYQRQFRSDMMRFLHCRAAEMKPGGAIFIVSLGRLSSTRGPTEQGYIYEVYCSMFEDSLRDLIEEEMVDGEKMDNFNVPLYAATVEEFKEAVDADGSFKINQLELVMGSPPVVDDPANRGVVGRMVANYMRALFGPLVNTHIGGAMADELFIRMQCRAEIRAEELVDEMCFAHILCSLSLV

SEQ ID NO: 1234 - protein, 380 aa, Arabidopsis thaliana
  misc_feature (1)..(380): Public GI no. 10177828
  misc_feature: Utility: Useful for increasing chlorophyll and photosynthetic capacity
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with altered leaf shape eg curled leaves
  misc_feature: Utility: Useful for making plants with increased biomass and foliage
  misc_feature: Utility: Useful for making smaller plants
MTAKDWTTTSLHRVFAMQGGEDDLSYVNNSDSQALAITLSKPILISSLQSIKLFSDQTPIKITDLGCATGSNTFTTVDTVVETLQRRYTARCGGGGSPEFEAFFCDLPSNDFNMLFKLLAEKQKVDSPAKYFAGGVAGSFYDRLFPRGTIHVAVSLSALHWLSQIPEKVLEKESRTWNKGKTWIEGAKKEVVEAYAEQSDKDLDDFMSCRKEEMVKGGVLFVLMAGRPSGSSSQFGDQDTRAKHPFTTTMEQAWQDLIEEGLIDEETRDGFNIPAYMRSPEEVTAGIDRCGGFKIGKMDFLKIVEYSDEKQEEWKKDPVSYGRARTNLVQAAIRPMVDAYLGPDLSHELFKRYENRVSTNQEFLHITCFYGVVVFSAIRV

SEQ ID NO: 1235 - DNA, 1228 bp, Arabidopsis thaliana
  misc_feature (1)..(1228): Ceres CLONE ID no. 38105
  misc_feature (1)..(1228): Also known as  Ceres CDNA ID no. 23357010
aaaatttccctatcaaagtgaatgactttcttctccaaaatcgatttctgaaacatcccatttcttgatttccctctttgtcgcaaacccaacaaagtagagcaaaaccctaaaacggaaaccttccatggcgattatctctgaggtagaagaagaaagcagtagcagccgacccatgatatttccctttaggggcaacactcagttctgcaaacccattagggtttttggagaaagttttcgactttctcggagaacagagcgattttctcaagaaaccctccgcggaggacgagatcgtcgtcgcggttagggcggcgaaggagaagttgaaaaaggctgagaagaagaaagctgagaaggagagtgtgaagcctgtggagaagaaagccgagaaggaaattgttaagcttgtggagaagaaggtagagaaggagagtgtcaagccaactatggctgcttcaagtgctgagcctatagaagtggagaagcctaaggacgaagaggagaagaaggaatctggtcccattgttcctaacaaaggtaatggaactgatcttgagaactactcatggatccagaatctccaggaggttacagttaacattccagtgcctactgggactaaagcacggactgttgtatgtgagattaagaaaaaccgtctcaaggttggtctcaaaggccaggatccaatcgtcgatggggagctctaccgatctgtgaagcctgatgactgctactggaatatcgaggatcaaaaggtgatttcgattctcttgactaagtctgatcagatggagtggtggaaatgctgtgtgaaaggtgaacctgaaatcgatactcagaaagttgaaccagagactagtaaattaggtgaccttgatccagaaactcgctcgactgttgagaaaatgatgtttgatcaaaggcaaaagcagatgggtcttccaacaagcgaggagctacagaagcaagagatccttaagaaattcatgtctgagcatccggagatggacttctcaaatgcaaagtttaactgatgctcgtatcgtccagtctctctgccaaaaaagaaaaaccagtttttgcatcttcaccagtttttaaaagcttgttacttttgtttagtttctcatttctgaatacatagttcggtttatgtccctagctttatgattctctggtttttattgaaactttttctgaaaaaaaaactgttttctcc

SEQ ID NO: 1236 - protein, 304 aa, Arabidopsis thaliana
  misc_feature (137)..(288): Pfam Name: Nuclear_move; Pfam Description: Nuclear movement protein
  misc_feature (137)..(288): Pfam Name: Nuclear_move; Pfam Description: Nuclear movement protein
  misc_feature: Utility: Useful for increasing chlorophyll and photosynthetic capacity
  misc_feature: Utility: Useful for making ornamental plants with modified leaves
  misc_feature: Utility: Useful for making smaller plants
MAIISEVEEESSSSRPMIFPFRATLSSANPLGFLEKVFDFLGEQSDFLKKPSAEDEIVVAVRAAKEKLKKAEKKKAEKESVKPVEKKAEKEIVKLVEKKVEKESVKPTMAASSAEPIEVEKPKDEEEKKESGPIVPNKGNGTDLENYSWIQNLQEVTVNIPVPTGTKARTVVCEIKKNRLKVGLKGQDPIVDGELYRSVKPDDCYWNIEDQKVISILLTKSDQMEWWKCCVKGEPEIDTQKVEPETSKLGDLDPETRSTVEKMMFDQRQKQMGLPTSEELQKQEILKKFMSEHPEMDFSNAKFN

SEQ ID NO: 1237 - protein, 161 aa, Triticum aestivum
  misc_feature (1)..(161): Ceres CLONE ID no. 703932
  misc_feature: Utility: Useful for increasing chlorophyll and photosynthetic capacity
  misc_feature: Utility: Useful for making ornamental plants with modified leaves
  misc_feature: Utility: Useful for making smaller plants
MEKYSWTQQLPEVNVNVPVPEGTKSRFVVCEIKKDHLKVGLKGQPPIIDGELHKPVKVDDCFWSIEDGKALSILLTKHNQMEWWKSVIKGDPEVDTQKAEPETSKLSDLDPETRQTVEKMMFDQRQKQMGLPTSDEMQKQDMLKKFMSQHPEMDFSRAKIA

SEQ ID NO: 1238 - protein, 293 aa, Triticum aestivum
  misc_feature (1)..(293): Public GI no. 23296480
  misc_feature: Utility: Useful for increasing chlorophyll and photosynthetic capacity
  misc_feature: Utility: Useful for making ornamental plants with modified leaves
  misc_feature: Utility: Useful for making smaller plants
MAIISEMEEARPSMVPFTASFDPSNPIAFLEKVLDVIGKESNFLKKDTAEKEIVAAVMAAKQRLREAEKKKLEKESVKSMEVEKPKKDSLKPTELEKPKEESLMATDPMEIEKPKEEKESGPIVPNKGNGLDFEKYSWGQNLQEVTINIPMPEGTKSRSVTCEIKKNRLKVGLKGQDLIVDGEFFNSVKPDDCFWNIEDQKMISVLLTKQDQMEWWKYCVKGEPEIDTQKVEPETSKLGDLDPETRASVEKMMFDQRQKQMGLPRSDEIEKKDMLKKFMAQNPGMDFSNAKFN

SEQ ID NO: 1239 - protein, 299 aa, Glycine max
  misc_feature (1)..(299): Ceres CLONE ID no. 474785
  misc_feature: Utility: Useful for increasing chlorophyll and photosynthetic capacity
  misc_feature: Utility: Useful for making ornamental plants with modified leaves
  misc_feature: Utility: Useful for making smaller plants
MAIISDFNEEEPKPAHSSPPQPQSSSSSSSFSATFDRSNPIAFLERVFEFVSEQSDFLATQSAEKEIVSLVHAAGKKKRELLKAERENADKKKREDLKVTEERQKVEKRLNEEKELKAEDTNKNESASRVPNKGNGLDLEKYSWTQSLQEVNVNVPVPNGTKSRFVTVEIKKNHLKVGLKGQPPIIEGEFHKSVKPDDCYWSIEDQNSISILLTKHDQMEWWKCLVKGDPEIDTQKVEPENSKLGDLDPETRQTVEKMMFDQRQKSMGLPTSEELQKQEMLKKFMSEHPEMDFSRAKIS

SEQ ID NO: 1240 - protein, 295 aa, Glycine max
  misc_feature (1)..(295): Public GI no. 30524691
  misc_feature: Utility: Useful for increasing chlorophyll and photosynthetic capacity
  misc_feature: Utility: Useful for making ornamental plants with modified leaves
  misc_feature: Utility: Useful for making smaller plants
MAILSDYEEEEHQPQPEKKQPSKKFSATFDPSNPLGFLQSTLEFVSKESDFFAKESSAKDVVSLVQKVKEKYIEEVENKKKKLLDESAAAAAAAAAAAASSSSSDLEKKVDDNESAEETEKSKYKAPNSGNGQDLENYSWIQSLQEVTVNVPVPPGTKSRFIDCQIKKNHLKVGLKGQPPIIDGELFKPVKPDDCFWSLEDQKSISMLLTKHDQMEWWRSLVKGEPEIDTQKVEPESSKLSDLDPETRSTVEKMMFDQRQKSMGLPTSDDMQKQDMLKKFMSEHPEMDFSNAKFN

SEQ ID NO: 1241 - protein, 308 aa, Glycine max
  misc_feature (1)..(308): Public GI no. 51535412
  misc_feature: Utility: Useful for increasing chlorophyll and photosynthetic capacity
  misc_feature: Utility: Useful for making ornamental plants with modified leaves
  misc_feature: Utility: Useful for making smaller plants
MAIISDFQEEEAPPRQQQQPASVAAAAGSGDEVLAAELERRGGAIPFLQAAIDVARRRSDLFRDPSAVSRVTSMASAARAVVEAEERKAREAKRKAEEAERKAAEAERKAKAPAEPKPESSAGKDSMEVDKKEEGNVRKPNAGNGLDLEKYSWIQQLPEVTITVPVPQGTKSRFVVCDIKKNHLKVGLKGQPPIIDGELFKPVKVDDCFWSIEDGKSLSILLTKQNQMEWWKSVVKGDPEVDTQKVEPENSKLADLDPETRQTVEKMMFDQRQKQMGLPTSDEMQKQDMLKKFMAQHPEMDFSNAKIA

SEQ ID NO: 1242 - DNA, 1606 bp, Arabidopsis thaliana
  misc_feature (1)..(1606): Ceres CLONE ID no. 38214
  misc_feature (1)..(1606): Also known as  Ceres CDNA ID no. 23373803
aaaaacaaataatatctaacaaaaaaccattcacaaaaaaaatagagagaatcatctgagagactagtagtgatgagatgagcttcttctcctacaatctcagaaacctccgatcactgttttagataatctctacaacggatacaatggaaagcaccgattcttccggtggtccaccaccgccacaacctaaccttcctccaggcttccggtttcaccctaccgacgaagagcttgttgttcactacctcaaacgcaaagcagcctctgctcctttacctgtcgccatcatcgccgaagtcgatctctataaatttgatccatgggaacttcccgctaaagcatcgtttggagaacaagaatggtacttctttagtccacgagatcggaagtatccaaacggagcaagaccaaacagagcggcgacttcaggttattggaaagcgaccggtacagataaaccggtacttgcttccgacggtaaccaaaaggtgggcgtgaagaaggcactagtcttctacagtggtaaaccaccaaaaggcgttaaaagtgattggatcatgcatgagtatcgtctcatcgaaaacaaaccaaacaatcgacctcctggctgtgatttcggcaacaagaaaaactcactcagacttgatgattgggtgttatgtagaatctacaagaagaacaacgcaagtcgacatgttgataacgataaggatcatgatatgatcgattacattttcaggaagattcctccatctttatcaatggcggctgcttctacaggacttcaccatcatcatcataatgtctcaagatcaatgaatttcttccctggcaaattctccggtggtggttacgggattttctctgacggtggtaacacgagtatatacgacggcggtggcatgatcaacaatattggtactgactcagtggatcacgacaataacgcagacgtcgttggtttaaatcatgcttcgtcgtctggtcctatgatgatggcgaatttgaaacgaactctcccggtgccgtattggcctgtagcagaggaggagcaagatgcatctccgagcaaacggtttcacggtgtaggaggaggaggaggagattgttcgaacatgtcttcttcgatgatggaagagacacctccactaatgcaacaacaaggtggtgtattaggagatggattattcagaacgacatcgtaccaattacccggtttaaattggtactcttcttaatcaaatgtgtttcgccgccggtgtgaagaattttccggtgacagtgaagattttttccgattggtggggtcatttgcatgcattatataatttgagatttgtgtatatgttttgggttaattaattggtcataggggttaggggaagaagattatttagagagcggagaagatcagaagtgaggcaacatatagaaaacataggtttaaaaaatattactgtttgttaagtttaatgattaaatgtataaatcttatacttagatgtttatatatagtttgtatagatgcatatagtttctctcaatgctattttgagattgtattttcttgttaaggaaatgattaaaaaaaaaatagttgtgc

SEQ ID NO: 1243 - protein, 364 aa, Arabidopsis thaliana
  misc_feature (17)..(145): Pfam Name: NAM; Pfam Description: No apical meristem (NAM) protein
  misc_feature (17)..(145): Pfam Name: NAM; Pfam Description: No apical meristem (NAM) protein
  misc_feature: Utility: Useful for increasing chlorophyll and photosynthetic capacity
  misc_feature: Utility: Useful for making ornamental plants with modified flowers
  misc_feature: Utility: Useful for making plants sterile and for genetic confinement
  misc_feature: Utility: Useful for making plants with increased biomass and foliage
  misc_feature: Utility: Useful for making smaller plants
MESTDSSGGPPPPQPNLPPGFRFHPTDEELVVHYLKRKAASAPLPVAIIAEVDLYKFDPWELPAKASFGEQEWYFFSPRDRKYPNGARPNRAATSGYWKATGTDKPVLASDGNQKVGVKKALVFYSGKPPKGVKSDWIMHEYRLIENKPNNRPPGCDFGNKKNSLRLDDWVLCRIYKKNNASRHVDNDKDHDMIDYIFRKIPPSLSMAAASTGLHHHHHNVSRSMNFFPGKFSGGGYGIFSDGGNTSIYDGGGMINNIGTDSVDHDNNADVVGLNHASSSGPMMMANLKRTLPVPYWPVAEEEQDASPSKRFHGVGGGGGDCSNMSSSMMEETPPLMQQQGGVLGDGLFRTTSYQLPGLNWYSS

SEQ ID NO: 1244 - protein, 318 aa, Arabidopsis thaliana
  misc_feature (1)..(318): Public GI no. 62530909
  misc_feature: Utility: Useful for increasing chlorophyll and photosynthetic capacity
  misc_feature: Utility: Useful for making ornamental plants with modified flowers
  misc_feature: Utility: Useful for making plants sterile and for genetic confinement
  misc_feature: Utility: Useful for making plants with increased biomass and foliage
  misc_feature: Utility: Useful for making smaller plants
MEMAAAVGGSGRRDAEAELNLPPGFRFHPTDEELVVHYLCRKVARQPLPVPIIAEVDLYKLDPWDLPEKALFGRKEWYFFTPRDRKYPNGSRPNRAAGRGYWKATGADKPVAPKGSARTVGIKKALVFYSGKAPRGVKTDWIMHEYRLADADRAPGGKKGSQKLDEWVLCRLYNKKNNWEKVKLEQQDVASVAAAAPRNHHHQNGEVMDAAAADTMSDSFQTHDSDIDNASAGLRHGGCGGGGFGDVAPPRNGFVTVKEDNDWFTGLNFDELQPPYMMNLQHMQMQMVNPAAPGHDGGYLQSISSPQMKMWQTILPPF

SEQ ID NO: 1245 - protein, 316 aa, Arabidopsis thaliana
  misc_feature (1)..(316): Public GI no. 56785066
  misc_feature: Utility: Useful for increasing chlorophyll and photosynthetic capacity
  misc_feature: Utility: Useful for making ornamental plants with modified flowers
  misc_feature: Utility: Useful for making plants sterile and for genetic confinement
  misc_feature: Utility: Useful for making plants with increased biomass and foliage
  misc_feature: Utility: Useful for making smaller plants
MAAAVGGSGRRDAEAELNLPPGFRFHPTDEELVVHYLCRKVARQPLPVPIIAEVDLYKLDPWDLPEKALFGRKEWYFFTPRDRKYPNGSRPNRAAGRGYWKATGADKPVAPKGSARTVGIKKALVFYSGKAPRGVKTDWIMHEYRLADADRAPGGKKGSQKLDEWVLCRLYNKKNNWEKVKLEQQDVASVAAAAPRNHHHQNGEVMDAAAADTMSDSFQTHDSDIDNASAGLRHGGCGGGGFGDVAPPRNGFVTVKEDNDWFTGLNFDELQPPYMMNLQHMQMQMVNPAAPGHDGGYLQSISSPQMKMWQTILPPF

SEQ ID NO: 1246 - protein, 306 aa, Zea mays
  misc_feature (1)..(306): Ceres CLONE ID no. 1452029
  misc_feature: Utility: Useful for increasing chlorophyll and photosynthetic capacity
  misc_feature: Utility: Useful for making ornamental plants with modified flowers
  misc_feature: Utility: Useful for making plants sterile and for genetic confinement
  misc_feature: Utility: Useful for making plants with increased biomass and foliage
  misc_feature: Utility: Useful for making smaller plants
MVASQGGGRRDAEAELNLPPGFRFHPTDEELVVHYLCRKVACQQLPVPIIAEVDLYKFDPWDLPEKALFGRKEWYFFTPRDRKYPNGSRPNRAAGRGYWKATGADKPIAPKGGGGAAGIKKALVFYSGKAPRGFKTDWIMHEYRLADADRAPGKKGSRKLDEWVLCRLYNKKNNWEKVKAEEPEAAAPLRNQQGAAEDSMSDSFQTHDSDIDNNAFGVQNGFGNMVHGQAMTMRNGIGSVARTVKEDSYWFTDLNLDDLQAPYNVTHVLNPNPVQTMNLAAGQGHGYLQSMSSPSTKMWQTILPPF

SEQ ID NO: 1247 - protein, 285 aa, Brassica napus
  misc_feature (1)..(285): Ceres CLONE ID no. 1114366
  misc_feature: Utility: Useful for increasing chlorophyll and photosynthetic capacity
  misc_feature: Utility: Useful for making ornamental plants with modified flowers
  misc_feature: Utility: Useful for making plants sterile and for genetic confinement
  misc_feature: Utility: Useful for making plants with increased biomass and foliage
  misc_feature: Utility: Useful for making smaller plants
MSELQLPPGFRFHPTDEELVMHYLCRKCASQSIAVPIIAEIDLYKYDPWELPGLALYGEKEWYFFSPRDRKYPNGSRPNRSAGSGYWKATGADKPIGLPKPVGIKKALVFYAGKAPKGEKTNWIMHEYRLADVDRSSAARKKKNSLRLDDWVLCRIYNKKGAIEKRGPPPTPVVYGDEVVEEKPRLSEMGMPPPPVMPNDFVYFDTSDSVPKLHTTESSCSEQVVSPEFTSEVQSEPKWKDWSGEKSSLDFGFNYIDATAFGGGGGSNQLFPLQDMFMYNMPKPY

SEQ ID NO: 1248 - protein, 281 aa, Brassica napus
  misc_feature (1)..(281): Public GI no. 53749460
  misc_feature: Utility: Useful for increasing chlorophyll and photosynthetic capacity
  misc_feature: Utility: Useful for making ornamental plants with modified flowers
  misc_feature: Utility: Useful for making plants sterile and for genetic confinement
  misc_feature: Utility: Useful for making plants with increased biomass and foliage
  misc_feature: Utility: Useful for making smaller plants
MVGKISSDLPPGFRFHPTDEELIMYYLRYQATSRPCPVSIIPEIDVYKFDPWELPEKAEFGENEWYFFTPRDRKYPNGVRPNRAAVSGYWKATGTDKAIYSANKYVGIKKALVFYKGKPPKGVKTDWIMHEYRLSDSKSQTYSKQSGSMRLDDWVLCRIYKKKNLGKTIEMMKVEEEELEAQNVSINNAIEVGGPQTMKLPRICSLSHLLELDYFGSIPQLLSDNLLYDDQSYTMNNVSNTSNVDQVSSQQQNTNNITSNNCNIFFNYQQPLFVNPTFQSQ

SEQ ID NO: 1249 - protein, 354 aa, Brassica napus
  misc_feature (1)..(354): Public GI no. 51702424
  misc_feature: Utility: Useful for increasing chlorophyll and photosynthetic capacity
  misc_feature: Utility: Useful for making ornamental plants with modified flowers
  misc_feature: Utility: Useful for making plants sterile and for genetic confinement
  misc_feature: Utility: Useful for making plants with increased biomass and foliage
  misc_feature: Utility: Useful for making smaller plants
MPMGSSAAMPALPPGFRFHPTDEELIVHYLRRQAASMPSPVPIIAEVNIYKCNPWDLPGKALFGENEWYFFSPRDRKYPNGARPNRAAGSGYWKATGTDKAILSTPANESIGVKKALVFYRGKPPKGVKTDWIMHEYRLTAADNRTTKRRGSSMRLDDWVLCRIHKKCGNLPNFSSSDQEQEHEQESSTVEDSQNNHTVSSPKSEAFDGDGDDHLQLQQFRPMAIAKSCSLTDLLNTVDYAALSHLLLDGAGASSSDAGADYQLPPENPLIYSQPPWQQTLHYNNNNGYVNNETIDVPQLPEARVDDYGMNGDKYNGMKRKRSSGSLYCSQLQLPADQYSGMLIHPFLSQQLHM

SEQ ID NO: 1250 - protein, 355 aa, Brassica napus
  misc_feature (1)..(355): Public GI no. 52353038
  misc_feature: Utility: Useful for increasing chlorophyll and photosynthetic capacity
  misc_feature: Utility: Useful for making ornamental plants with modified flowers
  misc_feature: Utility: Useful for making plants sterile and for genetic confinement
  misc_feature: Utility: Useful for making plants with increased biomass and foliage
  misc_feature: Utility: Useful for making smaller plants
MESTDSSTGTRHQPQLPPGFRFHPTDEELIVHYLKKRVAGAPIPVDIIGEIDLYKFDPWELPAKAIFGEQEWFFFSPRDRKYPNGARPNRAATSGYWKATGTDKPVFTSGGTQKVGVKKALVFYGGKPPKGVKTNWIMHEYRVVENKTNNKPLGCDNIVANKKGSLRLDDWVLCRIYKKNNTQRSIDDLHDMLGSIPQNVPNSILQGIKPSNYGTILLENESNMYDGIMNNTNDIINNNNRSIPQISSKRTMHGGLYWNNDEATTTTTTIDRNHSPNTKRFLVENNEDDGLNMNNISRITNHEQSSSIANFLSQFPQNPSIQQQQQQQEEVLGSLNDGVVFRQPYNQVTGMNWYS

SEQ ID NO: 1251 - protein, 362 aa, Glycine max
  misc_feature (1)..(362): Ceres CLONE ID no. 533917
  misc_feature: Utility: Useful for increasing chlorophyll and photosynthetic capacity
  misc_feature: Utility: Useful for making ornamental plants with modified flowers
  misc_feature: Utility: Useful for making plants sterile and for genetic confinement
  misc_feature: Utility: Useful for making plants with increased biomass and foliage
  misc_feature: Utility: Useful for making smaller plants
MDSRDSSSGSQHPHLPPGFRFHPTDEELVVHYLKRKAASAPLPVAIIADVDLYKFDPWELPSKATFGEQEWYFFSPRDRKYPNGARPNRAATSGYWKATGTDKPILTTYGHHKVGVKKALVFYGGKPPKGVKTNWIMHEYRLVDDSFNSSSKPPPLVPHNKKNSLRLDDWVLCRIYKKSNNTTLPRPPMMEHEEELSMDNMLPTMSTLSMANNKMQNPKPPSRSTSYGPLGLENDDNFFEGVLAVDQSMQNGSDSHIFSPNSKGDNNNNNNNNASNFPIKRALITSQLWNETGSPGSSSSCKRFHGDLNCGCSNAEDNNDSFISLLSQFPQNATFQPNAIHGSVEDDGAPRQQFHLHGINWN

SEQ ID NO: 1252 - DNA, 1361 bp, Arabidopsis thaliana
  misc_feature (1)..(1361): Ceres CLONE ID no. 41320
  misc_feature (1)..(1361): Also known as  Ceres CDNA ID no. 23370232
cccattttctctcttttacttgttcgttcccaaactcttctccctcgatcgtctccgtcgccgatctcgtttcttcattttccgcgtgttgattggtacaaaggtttaatcaaatggttggaggaggagttatccagcaaattcttaggaggaagcttcactcccaatcacttgcaactccggttttgtcttggttttcttcgaagaaagctcatgaggatgctggttcttctggtgtaagagcacttgccttgttgggtgctggtgtttcaggactgttgagtttttctacagtagcatctgctgatgaggctgaacatggattggagagtccagagtacccttggcctcatgatggcattcttagctcatatgaccatgcttcgatccgtcgtgggcatcaagtttatcagcaagtctgtgcatcatgccattcaatgtctctgatctcataccgagacttggtgggtgtcgcctacacagaggaagaggcaaaggcaatggcagctgaaatcgaggtagtagatggacctaatgatgagggtgagatgttcacccgccctggtaaactcagtgaccggtttcctcagccatatgcaaatgaatcagctgcaaggtttgctaatggtggagcgtatcctcctgatctaagtcttatcactaaggcacgtcacaatggtccaaactatgtctttgcgcttctgactggttaccgtgatccccctgctggcatatcgattagagaggggttacactacaatccttatttccctgggggagcaattgctatgccgaaaatgctcaatgatgaagctgttgagtatgaagatggtgtccccgccacagaggcacagatgggtaaagatattgtatcattcttggcctgggcagctgaaccagaaatggaagagaggaaactgatgggtttcaaatggatattcctactctctctcgctcttctccaagctgcttactacaggcgactgaaatggycggttctcaagtcccgcaagctggttcttgacgtggttaactaaagcgccgctgaaaagcttttgcattggcctggccacacacagtcgtattttcaacaaaggatgttaaatagagaagagcctttctctgggtaataacgtatcatcatttttatgtgtcataaaaatctttgatgagaccagttctcacctgaaggtgaaaagacctcatcgttcttctttttccttcgattattactagagagttttatgaggataatcacgaaaacttgtttttttcgcctcataataatcacacatgattttgagattatatcatttgttatgtttttcctcttgtctcaataaaaaataactttgtactcc

SEQ ID NO: 1253 - protein, 307 aa, Arabidopsis thaliana
  misc_feature (72)..(297): Pfam Name: Cytochrom_C1; Pfam Description: Cytochrome C1 family
  misc_feature (72)..(297): Pfam Name: Cytochrom_C1; Pfam Description: Cytochrome C1 family
  misc_feature: Utility: Useful for increasing chlorophyll and photosynthetic capacity
  misc_feature: Utility: Useful for making plants sterile and for genetic confinement
  misc_feature: Utility: Useful for making smaller plants
MVGGGVIQQILRRKLHSQSLATPVLSWFSSKKAHEDAGSSGVRALALLGAGVSGLLSFSTVASADEAEHGLESPEYPWPHDGILSSYDHASIRRGHQVYQQVCASCHSMSLISYRDLVGVAYTEEEAKAMAAEIEVVDGPNDEGEMFTRPGKLSDRFPQPYANESAARFANGGAYPPDLSLITKARHNGPNYVFALLTGYRDPPAGISIREGLHYNPYFPGGAIAMPKMLNDEAVEYEDGVPATEAQMGKDIVSFLAWAAEPEMEERKLMGFKWIFLLSLALLQAAYYRRLKWSVLKSRKLVLDVVN

SEQ ID NO: 1254 - protein, 224 aa, Zea mays
  misc_feature (1)..(224): Ceres CLONE ID no. 399596
  misc_feature: Utility: Useful for increasing chlorophyll and photosynthetic capacity
  misc_feature: Utility: Useful for making plants sterile and for genetic confinement
  misc_feature: Utility: Useful for making smaller plants
MSSYDHASIRRGHQVYTQVCASCHSMSLISYRDLVGVAYTEEETKAMAAEIEVVDGPNDEGEMFTRPGKLSDRFPQPYANEQAARFANGGAYPPDLSLITKARHNGQNYVFALLTGYHDPPAGVQIREGLHYNPYFPGGAIAMPKMLNDGAVEYEDGTPATEAQMGKDVVSFLSWAAEPEMEERKLMGVKWIFLLSLALLQAAYYRRMRWSVLKSRKLVLDVVN

SEQ ID NO: 1255 - protein, 307 aa, Arabidopsis thaliana
  misc_feature (1)..(307): Ceres CLONE ID no. 112937
  misc_feature: Utility: Useful for increasing chlorophyll and photosynthetic capacity
  misc_feature: Utility: Useful for making plants sterile and for genetic confinement
  misc_feature: Utility: Useful for making smaller plants
MVGGGVIRQLLRRKLHSQSVATPVLSWLSSKKANEDAGSAGLRAFALMGAGITGLLSFSTVASADEAEHGLECPNYPWPHEGILSSYDHASIRRGHQVYQQVCASCHSMSLISYRDLVGVAYTEEEAKAMAAEIEVVDGPNDEGEMFTRPGKLSDRLPEPYSNESAARFANGGAYPPDLSLVTKARHNGQNYVFALLTGYRDPPAGISIREGLHYNPYFPGGAIAMPKMLNDEAVEYEDGTPATEAQMGKDVVSFLSWAAEPEMEERKLMGFKWIFLLSLALLQAAYYRRLKWSVLKSRKLVLDVVN

SEQ ID NO: 1256 - protein, 307 aa, Arabidopsis thaliana; identical to SEQ ID NO: 1255
  misc_feature (1)..(307): Ceres CLONE ID no. 30054
  misc_feature: Utility: Useful for increasing chlorophyll and photosynthetic capacity
  misc_feature: Utility: Useful for making plants sterile and for genetic confinement
  misc_feature: Utility: Useful for making smaller plants

SEQ ID NO: 1257 - protein, 307 aa, Glycine max
  misc_feature (1)..(307): Ceres CLONE ID no. 621235
  misc_feature: Utility: Useful for increasing chlorophyll and photosynthetic capacity
  misc_feature: Utility: Useful for making plants sterile and for genetic confinement
  misc_feature: Utility: Useful for making smaller plants
MAGGVIQQILRRKLHPRFTNSPLLSPIVAKKDDAGSTGSQSLRALALIGAGLSGLFSFSTMAAADEAEHGLACPSYPWPHKGILSSYDHASIRRGHQVYTEVCASCHSMSLISYRDLVGVAYTEEEVKAMAAEIEVVDGPNDEGEMFTRPGKLSDRFPQPYANEAAARFANGGAYPPDLSLVTKARHNGQNYVFALLTGYRDPPAGVSIREGLHYNPYFPGGAIAMPKMLNDGAVEYEDGTPATEAQMGKDVVSFLTWAAEPEMEERKLMGFKWIFVLSLALLQAAYYRRLRWSVLKSRKLVLDVVN

SEQ ID NO: 1258 - protein, 307 aa, Glycine max; identical to SEQ ID NO: 1257
  misc_feature (1)..(307): Ceres CLONE ID no. 516928
  misc_feature: Utility: Useful for increasing chlorophyll and photosynthetic capacity
  misc_feature: Utility: Useful for making plants sterile and for genetic confinement
  misc_feature: Utility: Useful for making smaller plants

SEQ ID NO: 1259 - protein, 304 aa, Zea mays
  misc_feature (1)..(304): Ceres CLONE ID no. 1556600
  misc_feature: Utility: Useful for increasing chlorophyll and photosynthetic capacity
  misc_feature: Utility: Useful for making plants sterile and for genetic confinement
  misc_feature: Utility: Useful for making smaller plants
MAAARGINQLLKRILHNQSAGPWLLSSFRGNHEESSAGLRALALLGVGASGLLSFATIASADEAEHGLAAPDYPWPHAGIMSSYDHASIRRGHQVYTQVCASCHSMSLISYRDLVGVAYTEEETKAMAAEIEVVDGPNDEGEMFTRPGKLSDRFPQPYANEQAARFANGGAYPPDLSLITKARHNGQNYVFALLTGYRDPPAGVQIREGLHYNPYFPGGAIAMPKMLNDGAVEYEDGTPATEAQMGKDVVSFLSWAAEPEMEERKLMGVKWIFLLSLALLQAAYYRRMRWSVLKSRKLVLDVVN

SEQ ID NO: 1260 - protein, 304 aa, Zea mays
  misc_feature (1)..(304): Ceres CLONE ID no. 287422
  misc_feature: Utility: Useful for increasing chlorophyll and photosynthetic capacity
  misc_feature: Utility: Useful for making plants sterile and for genetic confinement
  misc_feature: Utility: Useful for making smaller plants
MAAARGINQLLKRTLYNQSVGSSPLFSFRGKHEESSAGLRALALLGVGASGLLSFATIASADEAEHGLAAPDYPWPHAGIMSSYDHASIRRGHQVYTQVCASCHSMSLISYRDLVGVAYTEEETKAMAAEIEVVDGPNDEGEMFTRPGKLSDRFPQPYANEQAARFANGGAYPPDLSLITKARHNAQNYVFALLTGYHDPPAGVQIREGLHYNPYFPGGAIAMPKMLNDGAVEYEDGTPATEAQMGKDVVSFPSWAAEPEMEERKLMGVKWIFLLSLALLQAAYYRRMRWSVLKSRKLVLDVVN

SEQ ID NO: 1261 - protein, 134 aa, Glycine max
  misc_feature (1)..(134): Ceres CLONE ID no. 1245439
  misc_feature: Utility: Useful for increasing chlorophyll and photosynthetic capacity
  misc_feature: Utility: Useful for making plants sterile and for genetic confinement
  misc_feature: Utility: Useful for making smaller plants
  misc_feature (103)..(103): Xaa is any aa, unknown, or other
  misc_feature (110)..(110): Xaa is any aa, unknown, or other
  misc_feature (115)..(115): Xaa is any aa, unknown, or other
  misc_feature (125)..(125): Xaa is any aa, unknown, or other
MAGGVIQQILRRKLHPRFTNSPLLSPIVAKKDDAGSTGSQSLRALALIGAGLSGLFSFSTMAAADEAEHGLACPSYPWPHKGILSSYDHASIRRGHQVYTEVXASWHSMXLISYXDLGGGWLIQXKKERLWQLK

SEQ ID NO: 1262 - DNA, 1077 bp, Arabidopsis thaliana
  misc_feature (1)..(1077): Ceres CLONE ID no. 42533
  misc_feature (1)..(1077): Also known as  Ceres CDNA ID no. 23357962
atcttctatctctcaaaagaaaagcagacaactttatttgcaaaacagagtttttttttcttttcttgagaaagttcaacagaagatgatgttggagaaagacgatctgggtctaagcttaggcttgaattttccaaagaaacagatcaatctcaaatcaaatccatctgtttctgttactccttcttcttcttcttttggattattcagaagatcttcatggaacgagagttttacttcttcagttccaaactcagattcgtcacaaaaagaaacaagaactttcatccgaggaatcgacgtgaacagaccaccgtctacagcggaatacggcgacgaagacgctggagtatcttcacctaacagtacaatctcaagctctacagggaaaagaagcgagagagaagaagacacagatccacaaggctcaagaggaatcagtgacgatgaagatggtgataactccaggaaaaagcttagactttccaaagatcaatctgctattcttgaagagaccttcaaagatcacagtactctcaatccgaagcagaagcaagcattggctaaacaattagggttaagagcaagacaagtggaagtttggtttcagaacagacgagcaagaacaaagctgaagcaaacggaggtagactgtgagttcttacggagatgctgcgagaatctaacggaagaaaaccgtcggctacaaaaagaagtaacggagttgagagcacttaagctctctcctcagttctacatgcacatgagcccacccactactttgaccatgtgcccttcatgtgaacacgtgtcggtcccgccaccacaacctcaggctgctacgtcagcacaccaccggacgttgccggtcaatgcgtgggctcctgcgacgaggatatctcacggcttgacttttgacgctcttcgtcctaggtcctaagtctttttacttacaatcaaagggcattgtggtcgttttattaagtttcagggaccagatatgcatgtagttgttaacatgtatgtattttttttagaaagaaagaaaaacagattaatatttttctagcttaaatc

SEQ ID NO: 1263 - protein, 284 aa, Arabidopsis thaliana
  misc_feature (1)..(109): Pfam Name: HD-ZIP_N; Pfam Description: HD-ZIP protein N terminus
  misc_feature (129)..(183): Pfam Name: Homeobox; Pfam Description: Homeobox domain
  misc_feature (184)..(228): Pfam Name: HALZ; Pfam Description: Homeobox associated leucine zipper
  misc_feature: Utility: Useful for increasing chlorophyll and photosynthetic capacity
  misc_feature: Utility: Useful for making plants with increased biomass and foliage
MMFEKDDLGLSLGLNFPKKQINLKSNPSVSVTPSSSSFGLFRRSSWNESFTSSVPNSDSSQKETRTFIRGIDVNRPPSTAEYGDEDAGVSSPNSTVSSSTGKRSEREEDTDPQGSRGISDDEDGDNSRKKLRLSKDQSAILEETFKDHSTLNPKQKQALAKQLGLRARQVEVWFQNRRARTKLKQTEVDCEFLRRCCENLTEENRRLQKEVTELRALKLSPQFYMHMSPPTTLTMCPSCEHVSVPPPQPQAATSAHHRSLPVNAWAPATRISHGLTFDALRPRS

SEQ ID NO: 1264 - protein, 289 aa, Arabidopsis thaliana; identical to SEQ ID NO: 428
  misc_feature (1)..(289): Public GI no. 8919876
  misc_feature: Utility: Useful for increasing chlorophyll and photosynthetic capacity
  misc_feature: Utility: Useful for making plants with increased biomass and foliage

SEQ ID NO: 1265 - protein, 284 aa, Glycine max
  misc_feature (1)..(284): Ceres CLONE ID no. 1044452
  misc_feature: Utility: Useful for increasing chlorophyll and photosynthetic capacity
  misc_feature: Utility: Useful for making plants with increased biomass and foliage
  misc_feature (72)..(72): Xaa is any aa, unknown, or other
MTVQKEDLGLSLSLSFPLLSSSPSSHNPQKPSWNDPIFTSSGEAGSFLRGIDVNRLPSVVDCEEEAGVSSPXSTVSSVSGKRSERETNGEENDTDRACSRGIISDEEDAETSRKKLRLSKDQSIVLEESFKEHNTLNPKQKLALAKQLGLRARQVEVWFQNRRARTKLKQTEVDCEFLKRCCENLTEENRRLQKEVQELRALKLSPQFYMHMTPPTTLTMCPSCERVAFPPPLPLILPRVTITCLHLTPGPFPLAHGQALRCPPSQILDSRKQNDKIEKKDRKP

SEQ ID NO: 1266 - protein, 284 aa, Glycine max
  misc_feature (1)..(284): Public GI no. 1234900
  misc_feature: Utility: Useful for increasing chlorophyll and photosynthetic capacity
  misc_feature: Utility: Useful for making plants with increased biomass and foliage
MTVQKEDLGLSLSLSFPLLSSSPSSHNPQKPSWNDPIFTSSGEAGSFLRGIDVNRLPSVVDCEEEAGVSSPNSTVSSVSGKRSERETNGEENDTDRACSRGIISDEEDAETSRKKLRLSKDQSIVLEESFKEHNTLNPKQKLALAKQLGLRARQVEVWFQNRRARTKLKQTEVDCEFLKRCCENLTEENRRLQKEVQELRALKLSPQFYMHMTPPTTLTMCPSCERVAVPPSSAVDPATRHHHVPPSHPRAFPIGHGQALRCPPSQILDSRKQNDKIEKKDRKP

SEQ ID NO: 1267 - protein, 285 aa, Glycine max; identical to SEQ ID NO: 427
  misc_feature (1)..(285): Ceres CLONE ID no. 514259
  misc_feature: Utility: Useful for increasing chlorophyll and photosynthetic capacity
  misc_feature: Utility: Useful for making plants with increased biomass and foliage

SEQ ID NO: 1268 - protein, 297 aa, Glycine max; identical to SEQ ID NO: 426
  misc_feature (1)..(297): Ceres CLONE ID no. 527278
  misc_feature: Utility: Useful for increasing chlorophyll and photosynthetic capacity
  misc_feature: Utility: Useful for making plants with increased biomass and foliage
  misc_feature (253)..(253): Xaa is any aa, unknown, or other
  misc_feature (257)..(257): Xaa is any aa, unknown, or other

SEQ ID NO: 1269 - protein, 302 aa, Glycine max
  misc_feature (1)..(302): Public GI no. 1149535
  misc_feature: Utility: Useful for increasing chlorophyll and photosynthetic capacity
  misc_feature: Utility: Useful for making plants with increased biomass and foliage
MMIHQREDHLGLSLSLSSPAHRPSSSSSPLQLNLAPSMPTPSTPPFNLFHKKETSDGYILDACRVETRSFLKGIDVNRLPATTVDMEEEAGVSSPNSTISSVSGKRSLERSENGNGDDLLDCSRGLINSDEEDGDNSRKKLRLSKDQSAILEDSFKEHNTLNPKQKLALAKRLGLRPRQVEVWFQNRRARTKLKQTEVDCEFLKRCCENLTDENRRLMKEVQELRALKLSPQFYMQMTPPTTLTMCPSCERVSAPPSSSTGPSSTPVETPRPHHSGSSHHRVAFNPWAIAPAGHRSFDAVPH

SEQ ID NO: 1270 - protein, 282 aa, Glycine max
  misc_feature (1)..(282): Public GI no. 18034437
  misc_feature: Utility: Useful for increasing chlorophyll and photosynthetic capacity
  misc_feature: Utility: Useful for making plants with increased biomass and foliage
LGLSLGSFGPSSSGGSHPPPALPLPSNLFRPSLQEIDRTQRSIGAFLQAPTAAAVCREPASAFRGIDVNRPPTIVDCGEENNNPIASPSPNSTVCSSSGKRTSGEREEKEDGDRAASSSFEVEDDDGGGGDASARKKLRLSKEQAVVLEETFKEHSTLNPKEKIALAKQLNLMPRQVEVWFQNRRARTKLKQTEVDCEYLRRCCENLTEENRRLQKEVNELRALKLSPQFYMSPPTTLTMCPQCERVAAQPSSAAAIRPPSHHQRPAAGMNSWAAMISPRPS

SEQ ID NO: 1271 - DNA, 639 bp, Arabidopsis thaliana
  misc_feature (1)..(639): Ceres CLONE ID no. 42925
  misc_feature (1)..(639): Also known as  Ceres CDNA ID no. 23374505
aactaccaccaattcaatccattgctcaaactctcttatcatctctaacacacccaccctacctacctccatctctctctctgcaacagagcacaaaaatggattctgcatcgtccaacaccaaagctatagaccctccacttcacatgttgggtttcgagttcgatgaattatctccgacacgtatcacaggtcgccttcctgtttctcccgtctgctgccagcctttcaaggtgttacacggtggtgtatctgctttgatagccgagtctttagcaagtatgggagctcacatggcttctggtttcaaaagggtcgctggaattcaactctcaatcaaccatttgaagagtgctgatcttggagaccttgtcttcgccgaagcaactcctgtaagcacagggaagactattcaggtttgggaagtcaagttatggaaaacaacacagaaagataaagctaacaaaatcttaatatcttcctctagagttacacttatctgtaatctacctatccctgataacgccaaagatgcagcaaacatgctcaaaatggtcgcaaagttgtagatttcttcaggcttttttgttttacttgtattgtatgtaatgacccatcttctcgaaattgataataagc

SEQ ID NO: 1272 - protein, 156 aa, Arabidopsis thaliana
  misc_feature (44)..(121): Pfam Name: 4HBT; Pfam Description: Thioesterase superfamily
  misc_feature: Utility: Useful for increasing chlorophyll and photosynthetic capacity
  misc_feature: Utility: Useful for increasing increasing anthocyanin content
  misc_feature: Utility: Useful for making lethal plants for genetic confinement systems
  misc_feature: Utility: Useful for making ornamental plants with modified flowers
  misc_feature: Utility: Useful for making ornamental plants with modified leaves
  misc_feature: Utility: Useful for making plants with increased biomass
  misc_feature: Utility: Useful for making plants with increased biomass and foliage
  misc_feature: Utility: Useful for making smaller plants
  misc_feature: Utility: Useful for modifying plant structure, ie increased branching
MDSASSNTKAIDPPLHMLGFEFDELSPTRITGRLPVSPVCCQPFKVLHGGVSALIAESLASMGAHMASGFKRVAGIQLSINHLKSADLGDLVFAEATPVSTGKTIQVWEVKLWKTTQKDKANKILISSSRVTLICNLPIPDNAKDAANMLKMVAKL

SEQ ID NO: 1273 - protein, 157 aa, Arabidopsis thaliana
  misc_feature (1)..(157): Ceres CLONE ID no. 13121
  misc_feature: Utility: Useful for increasing chlorophyll and photosynthetic capacity
  misc_feature: Utility: Useful for increasing increasing anthocyanin content
  misc_feature: Utility: Useful for making lethal plants for genetic confinement systems
  misc_feature: Utility: Useful for making ornamental plants with modified flowers
  misc_feature: Utility: Useful for making ornamental plants with modified leaves
  misc_feature: Utility: Useful for making plants with increased biomass
  misc_feature: Utility: Useful for making plants with increased biomass and foliage
  misc_feature: Utility: Useful for making smaller plants
  misc_feature: Utility: Useful for modifying plant structure, ie increased branching
MDPKSPEFIIDQPLKILGFVFDELSATRVSGHLTLTEKCCQPFKVLHGGVSALIAEALASLGAGIASGFKRVAGIHLSIHHLRPAALGEIVFAESFPVSVGKNIQVWEVRLWKAKKTETPDNKIMVSTSRVTLFCGLPIPDHVKDAPDELKKVISKL

SEQ ID NO: 1274 - protein, 157 aa, Arabidopsis thaliana; identical to SEQ ID NO: 1273
  misc_feature (1)..(157): Public GI no. 10177184
  misc_feature: Utility: Useful for increasing chlorophyll and photosynthetic capacity
  misc_feature: Utility: Useful for increasing increasing anthocyanin content
  misc_feature: Utility: Useful for making lethal plants for genetic confinement systems
  misc_feature: Utility: Useful for making ornamental plants with modified flowers
  misc_feature: Utility: Useful for making ornamental plants with modified leaves
  misc_feature: Utility: Useful for making plants with increased biomass
  misc_feature: Utility: Useful for making plants with increased biomass and foliage
  misc_feature: Utility: Useful for making smaller plants
  misc_feature: Utility: Useful for modifying plant structure, ie increased branching

SEQ ID NO: 1275 - protein, 154 aa, Brassica napus
  misc_feature (1)..(154): Ceres CLONE ID no. 980268
  misc_feature: Utility: Useful for increasing chlorophyll and photosynthetic capacity
  misc_feature: Utility: Useful for increasing increasing anthocyanin content
  misc_feature: Utility: Useful for making lethal plants for genetic confinement systems
  misc_feature: Utility: Useful for making ornamental plants with modified flowers
  misc_feature: Utility: Useful for making ornamental plants with modified leaves
  misc_feature: Utility: Useful for making plants with increased biomass
  misc_feature: Utility: Useful for making plants with increased biomass and foliage
  misc_feature: Utility: Useful for making smaller plants
  misc_feature: Utility: Useful for modifying plant structure, ie increased branching
MDPKSAEFTADNPLHILGFVFEELSATRVSGRLAVTDKCCQPFKVLHGGVSALIAEGLASLGAGIASGYKRVAGVHLSIHHIRPAALGESVFAESFPVSVGKNIQVWEVRLWKTKETEKRKMISTSRVTLLSGLPVPDHAKDSLDQLKKFVSKL

SEQ ID NO: 1276 - protein, 160 aa, Triticum aestivum
  misc_feature (1)..(160): Ceres CLONE ID no. 761821
  misc_feature: Utility: Useful for increasing chlorophyll and photosynthetic capacity
  misc_feature: Utility: Useful for increasing increasing anthocyanin content
  misc_feature: Utility: Useful for making lethal plants for genetic confinement systems
  misc_feature: Utility: Useful for making ornamental plants with modified flowers
  misc_feature: Utility: Useful for making ornamental plants with modified leaves
  misc_feature: Utility: Useful for making plants with increased biomass
  misc_feature: Utility: Useful for making plants with increased biomass and foliage
  misc_feature: Utility: Useful for making smaller plants
  misc_feature: Utility: Useful for modifying plant structure, ie increased branching
MAELDPVLHGVGFEMQEVSPSLLSGRLPVTERCCQPFKVLHGGVSALVAEGLASMGAHMASGYRRVAGVHLAINHFRSAALGDVVLARAVPVHLGRSTQVWEVKLWKMDPSEEGKKGPQISESRVTLLCNLPVPDNLHHAGDALKKYAAAATTPTPTSKL

SEQ ID NO: 1277 - protein, 164 aa, Triticum aestivum
  misc_feature (1)..(164): Public GI no. 50428638
  misc_feature: Utility: Useful for increasing chlorophyll and photosynthetic capacity
  misc_feature: Utility: Useful for increasing increasing anthocyanin content
  misc_feature: Utility: Useful for making lethal plants for genetic confinement systems
  misc_feature: Utility: Useful for making ornamental plants with modified flowers
  misc_feature: Utility: Useful for making ornamental plants with modified leaves
  misc_feature: Utility: Useful for making plants with increased biomass
  misc_feature: Utility: Useful for making plants with increased biomass and foliage
  misc_feature: Utility: Useful for making smaller plants
  misc_feature: Utility: Useful for modifying plant structure, ie increased branching
MDDATSSSSRAPRPKTEELDAALHAMGFEIERVSPAEVTGRLLVTPTCCQPFKVLHGGVSALIAEGLASMGAHMASGYSRVAGVQLSINHFRSAALGDTVLVRAAPLHVGRSTQVWAVKLWKLDPSTKEKGAQISESRVTLLCNLPVPESVKNAGEALKKYSKL

SEQ ID NO: 1278 - protein, 167 aa, Zea mays
  misc_feature (1)..(167): Ceres CLONE ID no. 1464627
  misc_feature: Utility: Useful for increasing chlorophyll and photosynthetic capacity
  misc_feature: Utility: Useful for increasing increasing anthocyanin content
  misc_feature: Utility: Useful for making lethal plants for genetic confinement systems
  misc_feature: Utility: Useful for making ornamental plants with modified flowers
  misc_feature: Utility: Useful for making ornamental plants with modified leaves
  misc_feature: Utility: Useful for making plants with increased biomass
  misc_feature: Utility: Useful for making plants with increased biomass and foliage
  misc_feature: Utility: Useful for making smaller plants
  misc_feature: Utility: Useful for modifying plant structure, ie increased branching
MGGGSGNPLPPPQAAAAAFRVDRPLQALGFEFTRVTAEEVVGRLPVTETCCQPFDWLNGGVSALMAETTASIGGYVASGYRRLAGVQLSINHVGPARLGDLVQARATPVQLGRKIQVWEVQIWRIDPSTSESKDLVSTARVTLLTNLPTPEKMKSFEQGLKKFSSKL

SEQ ID NO: 1279 - protein, 173 aa, Triticum aestivum
  misc_feature (1)..(173): Ceres CLONE ID no. 567431
  misc_feature: Utility: Useful for increasing chlorophyll and photosynthetic capacity
  misc_feature: Utility: Useful for increasing increasing anthocyanin content
  misc_feature: Utility: Useful for making lethal plants for genetic confinement systems
  misc_feature: Utility: Useful for making ornamental plants with modified flowers
  misc_feature: Utility: Useful for making ornamental plants with modified leaves
  misc_feature: Utility: Useful for making plants with increased biomass
  misc_feature: Utility: Useful for making plants with increased biomass and foliage
  misc_feature: Utility: Useful for making smaller plants
  misc_feature: Utility: Useful for modifying plant structure, ie increased branching
MAGSGESARTTAASPPGPPPGFGEGAPPDNALHALGFEYTRITGSEVLGRLAVTETCCQPFKILNGGVSALMAESTASIGGYMASGYRRVAGVQLSINHLKPARLGDRIEAKANPIQVGRNVQVWEVQIWLLDPATSEHKDLVSSARVTLLTNLSTPEEMKIYEKGIKKYAKL

SEQ ID NO: 1280 - DNA, 517 bp, Arabidopsis thaliana
  misc_feature (1)..(517): Ceres CLONE ID no. 94110
  misc_feature (1)..(517): Also known as  Ceres CDNA ID no. 23361789
gccatcttcttcattatcatcatctccatctctctctctctctcattttcttgaaaaagatgagaaccttaaagactcagaccacaaggggaaggagaagagcaaatgtgtcgttacgtacgagagttttacacacgtgctgtggaaatggtagtagcgacggagggaagacggtgatggagaagcttcttgcgttaaagagccttcttcctccaccggtgaatgtcggtggtggagagacggaggagctgtttcaagagacggcggagtatatcgtgaagcttagaacacaagtcgtggtgttgaagaaactgattgagatttacgataactcttctgatcagaagaaagatgttgttttataatgttcatttatattttctttaatttaaattatttcaggtttttctgttttttttttgttataaacttataattattatattgtgatccgtaattgttttaggttgtcgatgtctttaatgtattggttaaaaggaaaaagtattgatgattg

SEQ ID NO: 1281 - protein, 101 aa, Arabidopsis thaliana
  misc_feature: Utility: Useful for increasing chlorophyll and photosynthetic capacity
  misc_feature: Utility: Useful for increasing seed/fruit yield or modifying fruit content
  misc_feature: Utility: Useful for making plants sterile and for genetic confinement
  misc_feature: Utility: Useful for making plants with altered leaf shape eg curled leaves
  misc_feature: Utility: Useful for making plants with increased biomass and foliage
  misc_feature: Utility: Useful for making smaller plants
MRTLKTQTTRGRRRANVSLRTRVLHTCCGNGSSDGGKTVMEKLLALKSLLPPPVNVGGGETEELFQETAEYIVKLRTQVVVLKKLIEIYDNSSDQKKDVVL

SEQ ID NO: 1282 - DNA, 716 bp, Arabidopsis thaliana
  misc_feature (1)..(716): Ceres CLONE ID no. 95453
  misc_feature (1)..(716): Also known as  Ceres CDNA ID no. 23380898
aacacatctcactgctcactactctcactgtaatcccttagatcttcttttcaaatttcaatggcgtccggtgatgttgagtatcggtgcttcgttggaggtctagcatgggccactgatgacagagctcttgagactgccttcgctcaatacggcgacgttattgattccaagatcattaacgatcgtgagactggaagatcaaggggattcggattcgtcaccttcaaggatgagaaagccatgaaggatgcgattgagggaatgaacggacaagatctcgatggccgtagcatcactgttaacgaggctcagtcacgaggaagcggtggcggcggaggccaccgtggaggtggtggcggtggtggaggttactccggtggaggtggtagctacggaggtggcggcggtagacgcgagggtggaggaggatacagcggcggcggcggttactcctcaagaggtggtggtggcggaagctacggtggtggaagacgtgagggaggaggaggatacggtggtggtgaaggaggaggttacggaggaagcggtggtggtggaggatggtaattctgttyratyaggtttgggattaccaatgaatgttctctctctcgcttgttatgcttctactttgttttgtgtgttctctattttgttctggttctgctttagatttgatgtaacagttcgtgattaggtattttggtatctgg

SEQ ID NO: 1283 - protein, 169 aa, Arabidopsis thaliana
  misc_feature (10)..(81): Pfam Name: RRM_1; Pfam Description: RNA recognition motif. (a.k.a. RRM, RBD, or RNP domain)
  misc_feature (48)..(164): Pfam Name: GRP; Pfam Description: Glycine rich protein family
  misc_feature: Utility: Useful for increasing chlorophyll and photosynthetic capacity
  misc_feature: Utility: Useful for making ornamental plants with modified flowers
  misc_feature: Utility: Useful for making plants sterile and for genetic confinement
  misc_feature: Utility: Useful for making plants with increased biomass and foliage
  misc_feature: Utility: Useful for making smaller plants
  misc_feature: Utility: Useful for making stronger plants
  misc_feature (118)..(118): Xaa is any aa, unknown, or other
MASGDVEYRCFVGGLAWATDDRALETAFAQYGDVIDSKIINDRETGRSRGFGFVTFKDEKAMKDAIEGMNGQDLDGRSITVNEAQSRGSGGGGGHRGGGGGGGGYSGGGGSYGGGGGXREGGGGYSGGGGYSSRGGGGGSYGGGRREGGGGYGGGEGGGYGGSGGGGGW

SEQ ID NO: 1284 - protein, 136 aa, Brassica napus; identical to SEQ ID NO: 675
  misc_feature (1)..(136): Ceres CLONE ID no. 1091493
  misc_feature: Utility: Useful for increasing chlorophyll and photosynthetic capacity
  misc_feature: Utility: Useful for making ornamental plants with modified flowers
  misc_feature: Utility: Useful for making plants sterile and for genetic confinement
  misc_feature: Utility: Useful for making plants with increased biomass and foliage
  misc_feature: Utility: Useful for making smaller plants
  misc_feature: Utility: Useful for making stronger plants

SEQ ID NO: 1285 - protein, 134 aa, Brassica napus; identical to SEQ ID NO: 674
  misc_feature (1)..(134): Ceres CLONE ID no. 977670
  misc_feature: Utility: Useful for increasing chlorophyll and photosynthetic capacity
  misc_feature: Utility: Useful for making ornamental plants with modified flowers
  misc_feature: Utility: Useful for making plants sterile and for genetic confinement
  misc_feature: Utility: Useful for making plants with increased biomass and foliage
  misc_feature: Utility: Useful for making smaller plants
  misc_feature: Utility: Useful for making stronger plants

SEQ ID NO: 1286 - protein, 151 aa, Brassica napus; identical to SEQ ID NO: 676
  misc_feature (1)..(151): Ceres CLONE ID no. 945779
  misc_feature: Utility: Useful for increasing chlorophyll and photosynthetic capacity
  misc_feature: Utility: Useful for making ornamental plants with modified flowers
  misc_feature: Utility: Useful for making plants sterile and for genetic confinement
  misc_feature: Utility: Useful for making plants with increased biomass and foliage
  misc_feature: Utility: Useful for making smaller plants
  misc_feature: Utility: Useful for making stronger plants

SEQ ID NO: 1287 - protein, 146 aa, Brassica napus; identical to SEQ ID NO: 678
  misc_feature (1)..(146): Ceres CLONE ID no. 965777
  misc_feature: Utility: Useful for increasing chlorophyll and photosynthetic capacity
  misc_feature: Utility: Useful for making ornamental plants with modified flowers
  misc_feature: Utility: Useful for making plants sterile and for genetic confinement
  misc_feature: Utility: Useful for making plants with increased biomass and foliage
  misc_feature: Utility: Useful for making smaller plants
  misc_feature: Utility: Useful for making stronger plants

SEQ ID NO: 1288 - protein, 153 aa, Brassica napus; identical to SEQ ID NO: 677
  misc_feature (1)..(153): Ceres CLONE ID no. 1092319
  misc_feature: Utility: Useful for increasing chlorophyll and photosynthetic capacity
  misc_feature: Utility: Useful for making ornamental plants with modified flowers
  misc_feature: Utility: Useful for making plants sterile and for genetic confinement
  misc_feature: Utility: Useful for making plants with increased biomass and foliage
  misc_feature: Utility: Useful for making smaller plants
  misc_feature: Utility: Useful for making stronger plants

SEQ ID NO: 1289 - protein, 133 aa, Brassica napus; identical to SEQ ID NO: 679
  misc_feature (1)..(133): Ceres CLONE ID no. 963616
  misc_feature: Utility: Useful for increasing chlorophyll and photosynthetic capacity
  misc_feature: Utility: Useful for making ornamental plants with modified flowers
  misc_feature: Utility: Useful for making plants sterile and for genetic confinement
  misc_feature: Utility: Useful for making plants with increased biomass and foliage
  misc_feature: Utility: Useful for making smaller plants
  misc_feature: Utility: Useful for making stronger plants
  misc_feature (13)..(13): Xaa is any aa, unknown, or other

SEQ ID NO: 1290 - protein, 109 aa, Triticum aestivum
  misc_feature (1)..(109): Ceres CLONE ID no. 942159
  misc_feature: Utility: Useful for increasing chlorophyll and photosynthetic capacity
  misc_feature: Utility: Useful for making ornamental plants with modified flowers
  misc_feature: Utility: Useful for making plants sterile and for genetic confinement
  misc_feature: Utility: Useful for making plants with increased biomass and foliage
  misc_feature: Utility: Useful for making smaller plants
  misc_feature: Utility: Useful for making stronger plants
  misc_feature (12)..(12): Xaa is any aa, unknown, or other
MADVEYRCFVGXLAWATDDQSLQNAFSKYGDVIDSKIITDRETGRSRGFGFVTFASDEAMRQAIEAMNGQDLDGRNITVNEAQSRRSGGGGGGFGGGGGGGGYGGQRRE

SEQ ID NO: 1291 - protein, 189 aa, Glycine max
  misc_feature (1)..(189): Ceres CLONE ID no. 583672
  misc_feature: Utility: Useful for increasing chlorophyll and photosynthetic capacity
  misc_feature: Utility: Useful for making ornamental plants with modified flowers
  misc_feature: Utility: Useful for making plants sterile and for genetic confinement
  misc_feature: Utility: Useful for making plants with increased biomass and foliage
  misc_feature: Utility: Useful for making smaller plants
  misc_feature: Utility: Useful for making stronger plants
SASLTPLNTNFLGFIQFSMASSDVEYRCFVGGLAWATDDQALERAFSQYGEIVETKIINDRETGRSRGFGFVTFASEQSMKDAIEGMNGQNLDGRNITVNEAQSRGGGGGGGGGGGGYGGGRGGGYGGGGRGGGGGYNRSGGGGGYGGGGGYGGGGGGGYGGGRDRGYGGGGDRGYSRGGDGGDGGWRN

SEQ ID NO: 1292 - protein, 193 aa, Zea mays
  misc_feature (1)..(193): Ceres CLONE ID no. 258380
  misc_feature: Utility: Useful for increasing chlorophyll and photosynthetic capacity
  misc_feature: Utility: Useful for making ornamental plants with modified flowers
  misc_feature: Utility: Useful for making plants sterile and for genetic confinement
  misc_feature: Utility: Useful for making plants with increased biomass and foliage
  misc_feature: Utility: Useful for making smaller plants
  misc_feature: Utility: Useful for making stronger plants
MGYEDEPPEPEIEEGAEEEPENNEDAGWLLLPHRFVFRFWFVGEREEMAASDVEYRCFVGGLAWATDDHSLNNAFSTYGEVLESKIILDRETQRSRGFGFVTFSTEDAMRSAIEGMNGKELDGRNITVNEAQSRGGRGGGGGGYGGGRRDGGGYGGGGGGYGGGRGGYGGGGGGYGGGNRGGGYGNNDGNWRN

SEQ ID NO: 1293 - protein, 123 aa, Brassica napus; identical to SEQ ID NO: 680
  misc_feature (1)..(123): Ceres CLONE ID no. 972545
  misc_feature: Utility: Useful for increasing chlorophyll and photosynthetic capacity
  misc_feature: Utility: Useful for making ornamental plants with modified flowers
  misc_feature: Utility: Useful for making plants sterile and for genetic confinement
  misc_feature: Utility: Useful for making plants with increased biomass and foliage
  misc_feature: Utility: Useful for making smaller plants
  misc_feature: Utility: Useful for making stronger plants
  misc_feature (11)..(11): Xaa is any aa, unknown, or other
  misc_feature (27)..(27): Xaa is any aa, unknown, or other
  misc_feature (78)..(78): Xaa is any aa, unknown, or other
  misc_feature (80)..(80): Xaa is any aa, unknown, or other
  misc_feature (108)..(108): Xaa is any aa, unknown, or other
  misc_feature (120)..(120): Xaa is any aa, unknown, or other

SEQ ID NO: 1294 - protein, 147 aa, Glycine max
  misc_feature (1)..(147): Ceres CLONE ID no. 1101112
  misc_feature: Utility: Useful for increasing chlorophyll and photosynthetic capacity
  misc_feature: Utility: Useful for making ornamental plants with modified flowers
  misc_feature: Utility: Useful for making plants sterile and for genetic confinement
  misc_feature: Utility: Useful for making plants with increased biomass and foliage
  misc_feature: Utility: Useful for making smaller plants
  misc_feature: Utility: Useful for making stronger plants
MASADVEYRCFVGGLAWATDNYDLEKAFSQYGDVVESKIINDRETGRSRGFGFVTFASEDSMRDAIEGMNGQNLDGRNITVNEAQSRGSRGGGGGGYGSGGGYNRSGGAGGYGGRREGAYNRNGGGYGGDRDHRYGPYGDGGSRYSR

SEQ ID NO: 1295 - DNA, 1645 bp, Arabidopsis thaliana
  misc_feature (1)..(1645): Ceres CLONE ID no. 96020
  misc_feature (1)..(1645): Also known as  Ceres CDNA ID no. 23556777
agtgttactgtaacagtcgcacacctaacaaaaatcctccagccatggcggcagttactcaatttctctcccaaccttcatcaatccgcggaaccctaaatcagtaccaattgaatcagacttcactctcaagaatcccatttttgtctctcaagtcaacattgaagccactcaaacgcctctccgtcaaagccgccgtttcccaaaactccaccaaaaccctcacgaaagaatctgcttcctctttcgaccactgtttcaagaaatcatcagatgggtttctctattgcgaaggaaccaaggttcaagatatcatggaaacagtcgagaaacgacccttttacttatatagcaaacctcagatcacgagaaaccttgaggcttataaagaggctttggaaggagtgagatctgttattggttacgctattaaagctaataacaatctcaagattttggagtatttgaggagtttgggctgtggtgctgtgttggttagtggaaatgagctcaggcttgctcttcttgctggtttcgatcccacaaagtgtattttcaatggaaatggaaagtctttggaagatttagttctagctgctcaagaaggtgttttcgtaaatgttgatagtgagtttgacttgaataacattgtggaagcttcaagaatttctggtaagcaggtcaatgtattgttgcgtatcaatcctgatgttgatcctcaggtgcatccatatgtagctactgggaacaagaactcgaagtttggtattaggaacgagaagcttcaatggtttctggatgaagtgaaggcacatcccaaagagctgaagcttgttggagctcattgtcatcttggttctaccattacaaaggtggatatattcagagatgctgcggttctcatgattgaatacattgatgaaatccggcgtcaaggctttgaggttagctacttgaacattggtggtggtttagggatagattattatcatgccggcgctgtccttcctacacccatggatcttatcaacaccgtaagagagctggttctttcacgagacctgaatctaataatcgagccagggagatcactgattgcaaacacatgttgtttcgtcaactatgtaactggtgtgaagacgaatggaactaaaaacttcatagtgattgatggaagtatggctgagcttatccgtcccagtctttatgatgcctatcagcatattgagttggtctctcctacaccgcctgaagcagaggttaccaaattcgatgtagtgggtcctgtttgtgaatctgctgatttcttgggcaaagacagagagcttcccactcctccacagggagctggtctctggttcatgacgctggtgcatactgtatgagtatggcttccacttacaatctcaagatgcgtcccccggaatactgggttgaagaagatgggtcgatcactaagatcaggcatgctgagacattcgatgaccatttacgtttctttgaaggactatgaactccgagatttactcatcattgttgctattttagatgaattgtatgattacgtttctataatgctattgctgtcttggatttttccacattctgtgctatgatttaaagtcctcaataaagtgatcatatg

SEQ ID NO: 1296 - protein, 446 aa, Arabidopsis thaliana
  misc_feature (103)..(353): Pfam Name: Orn_Arg_deC_N; Pfam Description: Pyridoxal-dependent decarboxylase, pyridoxal binding domain
  misc_feature (361)..(440): Pfam Name: Orn_DAP_Arg_deC; Pfam Description: Pyridoxal-dependent decarboxylase, C-terminal sheet domain
  misc_feature: Utility: Useful for increasing chlorophyll and photosynthetic capacity
  misc_feature: Utility: Useful for making larger plants
  misc_feature: Utility: Useful for making ornamental plants with modified flowers
  misc_feature: Utility: Useful for making plants sterile and for genetic confinement
  misc_feature: Utility: Useful for making plants with altered leaf shape eg curled leaves
  misc_feature: Utility: Useful for making plants with increased biomass and foliage
  misc_feature: Utility: Useful for making smaller plants
  misc_feature: Utility: Useful for modifying plant structure, ie increased branching
MAAVTQFLSQPSSIRGTLNQYQLNQTSLSRIPFLSLKSTLKPLKRLSVKAAVSQNSTKTLTKESASSFDHCFKKSSDGFLYCEGTKVQDIMETVEKRPFYLYSKPQITRNLEAYKEALEGVRSVIGYAIKANNNLKILEYLRSLGCGAVLVSGNELRLALLAGFDPTKCIFNGNGKSLEDLVLAAQEGVFVNVDSEFDLNNIVEASRISGKQVNVLLRINPDVDPQVHPYVATGNKNSKFGIRNEKLQWFLDEVKAHPKELKLVGAHCHLGSTITKVDIFRDAAVLMIEYIDEIRRQGFEVSYLNIGGGLGIDYYHAGAVLPTPMDLINTVRELVLSRDLNLIIEPGRSLIANTCCFVNYVTGVKTNGTKNFIVIDGSMAELIRPSLYDAYQHIELVSPTPPEAEVTKFDVVGPVCESADFLGKDRELPTPPQGAGLWFMTLVHTV

SEQ ID NO: 1297 - protein, 484 aa, Arabidopsis thaliana
  misc_feature (1)..(484): Ceres CLONE ID no. 6579
  misc_feature: Utility: Useful for increasing chlorophyll and photosynthetic capacity
  misc_feature: Utility: Useful for making larger plants
  misc_feature: Utility: Useful for making ornamental plants with modified flowers
  misc_feature: Utility: Useful for making plants sterile and for genetic confinement
  misc_feature: Utility: Useful for making plants with altered leaf shape eg curled leaves
  misc_feature: Utility: Useful for making plants with increased biomass and foliage
  misc_feature: Utility: Useful for making smaller plants
  misc_feature: Utility: Useful for modifying plant structure, ie increased branching
MAAATQFLSQPSSLNPHQLKNQTSQRSRSIPVLSLKSTLKPLKRLSVKAAVVSQNSSKTVTKFDHCFKKSSDGFLYCEGTKVEDIMESVERRPFYLYSKPQITRNLEAYKEALEGVSSVIGYAIKANNNLKILEHLRSLGCGAVLVSGNELRLALRAGFDPTKCIFNGNGKSLEDLVLAAQEGVFVNVDSEFDLNNIVEASRISGKQVNVLLRINPDVDPQVHPYVATGNKNSKFGIRNEKLQWFLDQVKAHPKELKLVGAHCHLGSTITKVDIFRDAAVLMIEYIDEIRRQGFEVSYLNIGGGLGIDYYHAGAVLPTPMDLINTVRELVLSRDLNLIIEPGRSLIANTCCFVNHVTGVKTNGTKNFIVIDGSMAELIRPSLYDAYQHIELVSPPPAEAEVTKFDVVGPVCESADFLGKDRELPTPPQGAGLVVHDAGAYCMSMASTYNLKMRPPEYWVEEDGSITKIRHAETFDDHLRFFEGL

SEQ ID NO: 1298 - protein, 488 aa, Glycine max
  misc_feature (1)..(488): Ceres CLONE ID no. 593648
  misc_feature: Utility: Useful for increasing chlorophyll and photosynthetic capacity
  misc_feature: Utility: Useful for making larger plants
  misc_feature: Utility: Useful for making ornamental plants with modified flowers
  misc_feature: Utility: Useful for making plants sterile and for genetic confinement
  misc_feature: Utility: Useful for making plants with altered leaf shape eg curled leaves
  misc_feature: Utility: Useful for making plants with increased biomass and foliage
  misc_feature: Utility: Useful for making smaller plants
  misc_feature: Utility: Useful for modifying plant structure, ie increased branching
MAGSHLLSHSPSLPKTYNYSLNQNPLSQNLFFPPLKFKSTTKPRVLRAVLSQNAAKTAVEDTKNAHFQHCFTKSEDGYLYCEGLKVHDIMESVERRPFYLYSKPQITRNVEAYKDALEGLSSIIGYAIKANNNLKILEHLRHLGCGAVLVSGNELRLALRAGFDPTRCIFNGNGKILEDLVLAAQEGVFVNIDSEFDLENITEAAKRAGKKVNVLLRINPDVDPQVHPYVATGNKNSKFGIRNEKLQWFLDAVKELPNELKLVGAHCHLGSTITKVDIFRDAATIMINYIDQIRDQGFEVDYLNIGGGLGIDYYHSGAILPTPRDLIDTVRDLVISRGLNLIIEPGRSLIANTCCLVNRVTGVKSNGSKNFIVIDGSMAELIRPSLYDAYQHIELVSPAPSNAETTTFDVVGPVCESADFLGKGRELPTPAKGTGLVVHDAGAYCMSMASTYNLKMRPPEYWVEDDGSVSKIRHGETFEDHIRFFEGL

SEQ ID NO: 1299 - protein, 488 aa, Zea mays
  misc_feature (1)..(488): Ceres CLONE ID no. 218466
  misc_feature: Utility: Useful for increasing chlorophyll and photosynthetic capacity
  misc_feature: Utility: Useful for making larger plants
  misc_feature: Utility: Useful for making ornamental plants with modified flowers
  misc_feature: Utility: Useful for making plants sterile and for genetic confinement
  misc_feature: Utility: Useful for making plants with altered leaf shape eg curled leaves
  misc_feature: Utility: Useful for making plants with increased biomass and foliage
  misc_feature: Utility: Useful for making smaller plants
  misc_feature: Utility: Useful for modifying plant structure, ie increased branching
MASASMLARSLLRTPDPTQTSHPNRRSAAVVSFPRRHRRLSVRASVSTACPSPPPQPAAAAAGVPKHCFRRGADGYLYCEGVRVEDAMTAAERSPFYLYSKPQILRNFAAYRDALQGLRSIIGYAVKANNNLPVLRVLRELGCGAVLVSGNELRLALQAGFDPARCIFNGNGKTLEDLKLAAESGVFVNVDSEFDLENIVRAARATGKKVPVLLRINPDVDPQVHPYVATGNKTSKFGIRNEKLQWFLDSIKSYPNEIKLVGVHCHLGSTITKVDIFRDAAVLMVNYVDEIRAQGFKLEYLNIGGGLGIDYHHTDAVLPTPMDLINTVRELVLSQDLTLIIEPGRSLIANTCCFVNRVTGVKSNGTKNFIVVDGSMAELIRPSLYGAYQHIELVSPPTPGAEVATFDIVGPVCESADFLGKDRELPTPDEGAGLVVHDAGAYCMSMASTYNLKLRPPEYWVEADGSIVKIRHGEKLDDYMKFFDGLPA

SEQ ID NO: 1300 - protein, 490 aa, Zea mays
  misc_feature (1)..(490): Public GI no. 50907773
  misc_feature: Utility: Useful for increasing chlorophyll and photosynthetic capacity
  misc_feature: Utility: Useful for making larger plants
  misc_feature: Utility: Useful for making ornamental plants with modified flowers
  misc_feature: Utility: Useful for making plants sterile and for genetic confinement
  misc_feature: Utility: Useful for making plants with altered leaf shape eg curled leaves
  misc_feature: Utility: Useful for making plants with increased biomass and foliage
  misc_feature: Utility: Useful for making smaller plants
  misc_feature: Utility: Useful for modifying plant structure, ie increased branching
MAAANLLSRALLPALNPNPSSHSNRVSPSAVSLRCRHGLTASVRASLSTAAPSPPPRPAAAAADGRAPKRCFRRGADGHLYCEGVRVEDAMGAAERTPFYLYSKPQVVRNFTAYRDALEGLRSIVGYAVKANNNLRVLQLLRELGCGAVLVSGNELRLALRAGFDPTRCIFNGNGKTLEDLVLAAESGVFVNIDSEFDLENIVTAARVAGKKVPVLLRINPDVDPQVHPYVATGNKTSKFGIRNEKLQWFLDSIKSYSNDITLVGVHCHLGSTITKVDIFRDAAGLMVNYVDEIRAQGFELEYLNIGGGLGIDYHHTDAVLPTPMDLINTVRELVLSRDLTLIIEPGRSLIANTCCFVNRVTGVKSNGTKNFIVVDGSMAELIRPSLYGAYQHIELVSPSPDAEVATFDIVGPVCESADFLGKDRELPTPDKGAGLVVHDAGAYCMSMASTYNLKLRPPEYWVEDDGSIAKIRRGESFDDYMKFFDNLSA

SEQ ID NO: 1301 - protein, 484 aa, Triticum aestivum
  misc_feature (1)..(484): Ceres CLONE ID no. 697349
  misc_feature: Utility: Useful for increasing chlorophyll and photosynthetic capacity
  misc_feature: Utility: Useful for making larger plants
  misc_feature: Utility: Useful for making ornamental plants with modified flowers
  misc_feature: Utility: Useful for making plants sterile and for genetic confinement
  misc_feature: Utility: Useful for making plants with altered leaf shape eg curled leaves
  misc_feature: Utility: Useful for making plants with increased biomass and foliage
  misc_feature: Utility: Useful for making smaller plants
  misc_feature: Utility: Useful for modifying plant structure, ie increased branching
MAAANLLSRSLVPSLTPNPGSQPSRSRAASVSLRRRHGPAAPLRASLSTASPSTRVAMGEAPKHCFQRGADGHLYCEGVRVEDTMAAADRTPFYLYSKPQVVRNFTAYDKALQGLRSIVGYAVKANNNLSVLQLLRGLGCGAVLVSGNELRLALRAGFDPTRCIFNGNGKTLEDLVLAAESGVFVNIDSEFDLENIVTAARVAGRQVPVLLRINPDVDPQVHPYVATGNKTSKFGIRNEKLQWFLDSIKSYSNDIKLVGVHCHLGSTITKVDIFRDAANLMVNFVDEIRAQGFELEYLNIGGGLGIDYHHTGAVLPTPMDLINTVRELVLSRDLTLIIEPGRSLIANTCCFVNKVTGVKSNGTKNFIVVDGSMAELIRPSLYGAYQHIELVSPSPGAEVATFDIVGPVCESADFLGKDRELPTPEKGAGLVVHDAGAYCMSMASTYNLKMRPAEYWVEDDGSIVKIRHGETFDDYMKFFDGLPA

SEQ ID NO: 1302 - DNA, 675 bp, Arabidopsis thaliana
  misc_feature (1)..(675): Ceres CLONE ID no. 97415
  misc_feature (1)..(675): Also known as  Ceres CDNA ID no. 23361863
atactatcaaattgaagaagaggaagatccaattggaaagggttatcctaattcccagtcattgatcggagaagatgagtgctgttgcgattaaccacttttttggcttaccggagacgatcgagaagctaattctcccgatttctcgttccggcgaaagtaataacgagagtcgtggaagaggaagtagcaataatatcccaatagacattttggaatctcccaaaaaatacatattttatctcgatatccccggaatttcaaaatcagatatccaggttacagtggaggaagagaggactttagtgataaagagtaatgggaagaggaagagagatgatgatgagagtgaagaagggtctaagtatattagactcgagaggagacttgctcagaatttggttaagaagttccggttaccagaagatgctgatatggcttctgtaacggctaaatatcaagaaggtattttgacagttgttatcaagaagctaccgccacagccgccgaaacctaagactgttcaaatcgctgtttcttgagtagtttctgtgttttgtttttgtgtgtgtttgttttctagtawwgtaatttttctgtttttggataaaaagactctgtttcttttatgtgttctctagtcgaaattttgaaattgaagaaataaataggttt

SEQ ID NO: 1303 - protein, 155 aa, Arabidopsis thaliana
  misc_feature (45)..(153): Pfam Name: HSP20; Pfam Description: Hsp20/alpha crystallin family
  misc_feature (45)..(153): Pfam Name: HSP20; Pfam Description: Hsp20/alpha crystallin family
  misc_feature: Utility: Useful for increasing chlorophyll and photosynthetic capacity
  misc_feature: Utility: Useful for increasing seed/fruit yield or modifying fruit content
  misc_feature: Utility: Useful for making ornamental plants with modified leaves
  misc_feature: Utility: Useful for making plants sterile and for genetic confinement
  misc_feature: Utility: Useful for making plants with altered leaf shape eg curled leaves
  misc_feature: Utility: Useful for making plants with increased biomass and foliage
MSAVAINHFFGLPETIEKLILPISRSGESNNESRGRGSSNNIPIDILESPKKYIFYLDIPGISKSDIQVTVEEERTLVIKSNGKRKRDDDESEEGSKYIRLERRLAQNLVKKFRLPEDADMASVTAKYQEGILTVVIKKLPPQPPKPKTVQIAVS

SEQ ID NO: 1304 - protein, 154 aa, Brassica napus
  misc_feature (1)..(154): Ceres CLONE ID no. 940194
  misc_feature: Utility: Useful for increasing chlorophyll and photosynthetic capacity
  misc_feature: Utility: Useful for increasing seed/fruit yield or modifying fruit content
  misc_feature: Utility: Useful for making ornamental plants with modified leaves
  misc_feature: Utility: Useful for making plants sterile and for genetic confinement
  misc_feature: Utility: Useful for making plants with altered leaf shape eg curled leaves
  misc_feature: Utility: Useful for making plants with increased biomass and foliage
  misc_feature (146)..(146): Xaa is any aa, unknown, or other
MNAVAINHLFGLPETIEKLIFPTSRSSEGNETRGGSNNNIPIDILESPKEYIFYVDIPGISKSDIQVTVEEERTLVIKSNGKRKREDHDESEEGCKYIRLERRLPQNLVKKFRLPEDADVEAVAAKYQDGVLTVTVGKVPPQPPKXKTVQIAVS

SEQ ID NO: 1305 - protein, 132 aa, Glycine max
  misc_feature (1)..(132): Ceres CLONE ID no. 637786
  misc_feature: Utility: Useful for increasing chlorophyll and photosynthetic capacity
  misc_feature: Utility: Useful for increasing seed/fruit yield or modifying fruit content
  misc_feature: Utility: Useful for making ornamental plants with modified leaves
  misc_feature: Utility: Useful for making plants sterile and for genetic confinement
  misc_feature: Utility: Useful for making plants with altered leaf shape eg curled leaves
  misc_feature: Utility: Useful for making plants with increased biomass and foliage
MFPSSRAHDHHHETRGVSSIIPVDILDTPKEYTFFMDVPGLSKSEIQVTVEDENTLVIRSNGKRKRQDGEDEGCKYLRLERRGPQNLQRKFRLPENANVSAITAKCENGVLTVVVEKHPPPQKSKTVEVAIA

SEQ ID NO: 1306 - protein, 144 aa, Glycine max
  misc_feature (1)..(144): Public GI no. 15148884
  misc_feature: Utility: Useful for increasing chlorophyll and photosynthetic capacity
  misc_feature: Utility: Useful for increasing seed/fruit yield or modifying fruit content
  misc_feature: Utility: Useful for making ornamental plants with modified leaves
  misc_feature: Utility: Useful for making plants sterile and for genetic confinement
  misc_feature: Utility: Useful for making plants with altered leaf shape eg curled leaves
  misc_feature: Utility: Useful for making plants with increased biomass and foliage
MSTVVDVVSQLLFPESIERLVSPSRSNESKGTIPVDILDTPKEYIFYMDVPGLSKSDLQVSVEDEKTLVIRSNGKRKREESEEEGCKYVRLERNPPLKLMRKFKLPDYCNVSAITAKCENGVLTVVVEKMPPPSKAKTVKVAVS

SEQ ID NO: 1307 - protein, 160 aa, Glycine max
  misc_feature (1)..(160): Public GI no. 472940
  misc_feature: Utility: Useful for increasing chlorophyll and photosynthetic capacity
  misc_feature: Utility: Useful for increasing seed/fruit yield or modifying fruit content
  misc_feature: Utility: Useful for making ornamental plants with modified leaves
  misc_feature: Utility: Useful for making plants sterile and for genetic confinement
  misc_feature: Utility: Useful for making plants with altered leaf shape eg curled leaves
  misc_feature: Utility: Useful for making plants with increased biomass and foliage
MDIDSLMGFDPLLRNLHYILEATDDNTTGNKSNNSGPSRAYVRDARAMAATPADVKECPNSYVFIVDMPGLKSGDIKVQVERDNVLVISGKRNREEEKEGVKYVRMERRMGKFMKKFALPEDANTDKISAICQDGVLTVTVEKLPPPEPKKPKTIQVQVA

SEQ ID NO: 1308 - protein, 178 aa, Triticum aestivum
  misc_feature (1)..(178): Ceres CLONE ID no. 923131
  misc_feature: Utility: Useful for increasing chlorophyll and photosynthetic capacity
  misc_feature: Utility: Useful for increasing seed/fruit yield or modifying fruit content
  misc_feature: Utility: Useful for making ornamental plants with modified leaves
  misc_feature: Utility: Useful for making plants sterile and for genetic confinement
  misc_feature: Utility: Useful for making plants with altered leaf shape eg curled leaves
  misc_feature: Utility: Useful for making plants with increased biomass and foliage
MAELLFAPAVAGLVHLPEVLERLAAADADHRDRAHHHAAHGHGHGHPGAQIGAGGVGGGAPVDIVETPGEYAFLLDVPGLSKSDIQVTLEEDNVLVMKSASNGGANGKRKREDEEADCRYIRLERRASPRSFVRKFRLPEDADAGAVAARCENGVLTVTVKKQPPPEKKTKSVQVAIA

SEQ ID NO: 1309 - protein, 174 aa, Zea mays
  misc_feature (1)..(174): Ceres CLONE ID no. 355400
  misc_feature: Utility: Useful for increasing chlorophyll and photosynthetic capacity
  misc_feature: Utility: Useful for increasing seed/fruit yield or modifying fruit content
  misc_feature: Utility: Useful for making ornamental plants with modified leaves
  misc_feature: Utility: Useful for making plants sterile and for genetic confinement
  misc_feature: Utility: Useful for making plants with altered leaf shape eg curled leaves
  misc_feature: Utility: Useful for making plants with increased biomass and foliage
MTELFDTALTSLLHLPEVLDRLAAADGDRRSAGHHAAHGHGHGHGHGRVHGLGGGGAPVDIVESPREYAFVLDVPGLSKSDIQVTLEEDRVLVMKGGSGKRKRDEEEDMNGEGCRYIRLERGAAPRSFVRKFRLPEDADTGGVAARCENGVLTVTVKKLPPPEKKAKTVQVTIA

SEQ ID NO: 1310 - protein, 172 aa, Zea mays
  misc_feature (1)..(172): Public GI no. 50915316
  misc_feature: Utility: Useful for increasing chlorophyll and photosynthetic capacity
  misc_feature: Utility: Useful for increasing seed/fruit yield or modifying fruit content
  misc_feature: Utility: Useful for making ornamental plants with modified leaves
  misc_feature: Utility: Useful for making plants sterile and for genetic confinement
  misc_feature: Utility: Useful for making plants with altered leaf shape eg curled leaves
  misc_feature: Utility: Useful for making plants with increased biomass and foliage
MTELFDTAVTSLLHLPEVLDRLGAAAGDRRSAGDHAHHAAHGHGQHRISGIGGGAPVDIMETPGEYAFVLDVPGLSKSDIQVTLEEDRVLVMKSSNGAGNGKRKREEEEGECKYIRLERRASPRAFARKFRLPEDADTGGISARCENGVLTVTVKKRPPPEKKTKSVQVTIA

SEQ ID NO: 1311 - DNA, 884 bp, Arabidopsis thaliana
  misc_feature (1)..(884): Ceres CLONE ID no. 98340
  misc_feature (1)..(884): Also known as  Ceres CDNA ID no. 23386113
aacaacataaaagacgatcaatataatctagaaaaaaaaagagaagagagaagagagaaatgtcgagagctttgtcagtcgtttgtgtcttgctcgccatatccttcgtctgtgcacgtgctcgtcaggtgccgggagagtctgatgagggaaaaacgacgggacatgacgatacaacaacaatgcccatgcatgcaaaagcagctgatcagttaccaccaaagagcgtcggcgacaaaaaatgcatcggaggagttgctggagtcggtggattcgccggaggttggtggtgttgccggcgtgggaggtctagggatgccactcatcggtggtcttgggcggggatcggtaagtatggtggcataggcggtgcagctggaatcggtggatttcatagtataggcggtgttggcgttctaggcggtgtcggaggaggtgttrrcaggtctaggcggtgttggagggggtsytggtggtctaggtggcgttggcggtctaggtggagctggtttaggcggtgtaggtggtgttggcggtggtattggtaaagccggtggtattggcggtttaggtggtctaggcggagccggaggtggtttaggtggagttggtggtctcggtaaggctggtggtattggtgttggtggtggtatcggtggtggacacggcgtggtcggtggtgtgatcgatccacatccttaatagagagtatttgttggttagggttttaattaaggaataattaattagtttcgatgttattgttggtcttttaattctgtgatcattagggtgacttttgatctattttctagtttgggcttttgtaacgtttgctttgatttcggccgtggtgttatgaaatgtgcgactctctatgtttg

SEQ ID NO: 1312 - protein, 161 aa, Arabidopsis thaliana
  misc_feature: Utility: Useful for increasing chlorophyll and photosynthetic capacity
  misc_feature: Utility: Useful for increasing seed/fruit yield or modifying fruit content
  misc_feature: Utility: Useful for making smaller plants
  misc_feature (143)..(143): Xaa is any aa, unknown, or other
MSRALSVVCVLLAISFVCARARQVPGESDEGKTTGHDDTTTMPMHAKAADQLPPKSVGDKKCIGGVAGVGGFAGVGGVAGVGGLGMPLIGGLGGIGKYGGIGGAAGIGGFHSIGGVGVLGGVGGGVGRSRRCWRGCWWSRWRXRSRWSWFRRCRWCWRWYW

SEQ ID NO: 1313 - DNA, 1536 bp, Arabidopsis thaliana
  misc_feature (1)..(1536): Ceres CLONE ID no. 101255
  misc_feature (1)..(1536): Also known as  Ceres CDNA ID no. 23385118
aaaaagctttgccggagatttagcaaacacaaacacaaaaaacaaaaccaactcagacgaatgtgattttttcttcttgagtgaattgttgtaaaaaaatgatgatcggagaatctcatcgtggttttaatccaacggttcatattcctccatggccactttctgaagatctaacggtgtctgatatttacggaagtccagacggaggaagtagtatgatggaagctttggctgagttacaacgttatcttccgtcaaacgaaccggatccggattcagatccggatctctcgggtccggattcaccaatcgatgcttatacatgcgatcattttcggatgtatgagtttaaagtgagacgttgtgctcgtggccggagccatgattggacggagtgtccttacgctcatcccggagaaaaagctcgccgtcgtgatccgaggaagtttcattactccggtacggcgtgtcctgagtttcgtaaaggttgttgcaagagaggagacgcatgtgagttttctcatggtgtttttgagtgttggcttcacccggcgcgttaccggactcagccgtgtaaagacggwrgtaactgtcgccgtcgtgtttgttyctttgctcattcgccggatcagattagggttttgcctaatcaaagccctgatcgtgttgattcgttcgacgttttgtctcctacgattcgtagagcgtttcagttttcgatttctccgtcgtctaactcgccgccggtgagtccacgaggtgactcggactcgtcgtgttcgttactgagtcgttcactcgggtctaatctgggaaacgacgtcgttgcgtctctcaggaatctgcaacttaataaagtgaagtcttctctttcgtcgtcatacaacaatcaaatcggaggatacggatccggattcgggtcgcctcgtggatcggttttgggtcctggtttccgtagcttaccaactacaccgacccgacctggttttatgaacatttgggagaatggcttggaggaagaaccggcgatggaacgggtcgagtcgggtcgtgaactgcgagcgcagctgttcgagaagctgagcaaagagaattgcatgggtcggattgaaccggatccggatcagggagcgggtgatactcctgatgtcgggtgggtctctgacttggttatgtgattggaaccggattcgtaaaccggastgcctgaaatttcgttgataaagattaattaaaggattattatcggcatgggaggttttttaatggatctcttcttaggaaaagaggagatttctctgcamstttttttttttgtatatttattatttcctaatttcgtataatctctgttccataatcgatgattcgagggagattcctcagtgtataggagttgcttaggatttttcattatgatggattcactaatattgatattgttggttattgtttttttatatattatgatgtaagatgcaagtcgcaatgtaattattaaatatcttatgaatgaaatgagaatgtaaattattt

SEQ ID NO: 1314 - protein, 216 aa, Arabidopsis thaliana
  misc_feature: Utility: Useful for increasing chlorophyll and photosynthetic capacity
  misc_feature: Utility: Useful for making ornamental plants with modified leaves
  misc_feature: Utility: Useful for making plants tolerant to low nitrogen
MMIGESHRGFNPTVHIPPWPLSEDLTVSDIYGSPDGGSSMMEALAELQRYLPSNEPDPDSDPDLSGPDSPIDAYTCDHFRMYEFKVRRCARGRSHDWTECPYAHPGEKARRRDPRKFHYSGTRVLSFVKVVAREETHVSFLMVFLSVGFTRRVTGLSRVKTVVTVAVVFVSLLIRRIRLGFCLIKALIVLIRSTFCLLRFVERFSFRFLRRLTRRR

SEQ ID NO: 1315 - protein, 359 aa, Arabidopsis thaliana
  misc_feature (1)..(359): Public GI no. 22531114
  misc_feature: Utility: Useful for increasing chlorophyll and photosynthetic capacity
  misc_feature: Utility: Useful for making ornamental plants with modified leaves
  misc_feature: Utility: Useful for making plants tolerant to low nitrogen
MMIGESHRGFNPTVHIPPWPLSEDLTVSDIYGSPDGGSSMMEALAELQRYLPSNEPDPDSDPDLSGPDSPIDAYTCDHFRMYEFKVRRCARGRSHDWTECPYAHPGEKARRRDPRKFHYSGTACPEFRKGCCKRGDACEFSHGVFECWLHPARYRTQPCKDGGNCRRRVCFFAHSPDQIRVLPNQSPDRVDSFDVLSPTIRRAFQFSISPSSNSPPVSPRGDSDSSCSLLSRSLGSNLGNDVVASLRNLQLNKVKSSLSSSYNNQIGGYGSGFGSPRGSVLGPGFRSLPTTPTRPGFMNIWENGLEEEPAMERVESGRELRAQLFEKLSKENCMGRIEPDPDQGAGDTPDVGWVSDLVM

SEQ ID NO: 1316 - protein, 339 aa, Arabidopsis thaliana
  misc_feature (1)..(339): Public GI no. 60460512
  misc_feature: Utility: Useful for increasing chlorophyll and photosynthetic capacity
  misc_feature: Utility: Useful for making ornamental plants with modified leaves
  misc_feature: Utility: Useful for making plants tolerant to low nitrogen
MTTVYDPSHHLTSKKLCFKDLEIPPRKKQLHCCHNAAAMELPHHEARLHKYLPSNEDDDGTDDPYGTDHFRMYEFKVRRCTRSRSHDWTDCPFAHPGEKARRRDPTRYQYSSTICSDFRRGGGCPRGDDCEFAHGVFECWLHPTRYRTEACKDGKNCKRKVCFFAHSSRELRLLPESQPPYKNSDKNYNHCCLFCRSVTSSSSLSPTSTLLGLSHFSRSPSLSPPLSPLKHQQRTPRYGGDRISKFGTEMTSSYDDVLLKEVMSYLGTMNLSEVSSPMATTANTNIPWFDVSFKGAPSTVSPSGSGEYFNGGGDDEKNNGNGVVLDHDLDLGWVNELLM

SEQ ID NO: 1317 - protein, 349 aa, Glycine max
  misc_feature (1)..(349): Ceres CLONE ID no. 673872
  misc_feature: Utility: Useful for increasing chlorophyll and photosynthetic capacity
  misc_feature: Utility: Useful for making ornamental plants with modified leaves
  misc_feature: Utility: Useful for making plants tolerant to low nitrogen
MLGEHHRGNPTVLVPPWPAHDDPTAEMYSAFLTNDVNAGEYSPYHLQEALTALQRFLPSNETDADSDSSEAAQPDAAVDAYTCDHFRMYEFKVRRCARGRSHDWTECPYAHPGEKARRRDPRRFHYSGVACPEFRKGNCRKGDACEFAHGVFECWLHPARYRTQPCKDGTSCRRRVCFFAHTPEQLRVLPMQSPRSVANSSESYDGSPMRQVSLSSAAAAAFMSSPAASLSPPESPPSVNEMVASLRNLQLGKMKSMPHNRNVSVGSPRGSVLRPGFLSLPTTPTQQPVRSGVKCFDVWDESFEEEPVMERVESGRGIRAKMFEKLSKENSLDASASPPDLGWVSELVK

SEQ ID NO: 1318 - protein, 386 aa, Glycine max
  misc_feature (1)..(386): Public GI no. 34906436
  misc_feature: Utility: Useful for increasing chlorophyll and photosynthetic capacity
  misc_feature: Utility: Useful for making ornamental plants with modified leaves
  misc_feature: Utility: Useful for making plants tolerant to low nitrogen
MMMMGEGVSSVPPWSHLPVSGVDVLGGGGGGGDEMTPYVIAALRDYLPANDVGVGADEEEEAAAMAAAVDAYACDEFRMYEFKVRRCARGRSHDWTECPFAHPGEKARRRDPRKYHYSGTACPDFRKGGCKRGDACEYAHGVFECWLHPARYRTQPCKDGTACRRRVCFFAHTPDQLRVLPAQQSSPRSVASSPLAESYDGSPLRRQAFESYLTKTIMSSSPTSTLMSPPKSPPSESPPLSPDGAAAIRRGSWPGVGSPVNDVLASFRQLRLNKVKSSPSGGWSYPSSSAVYGSPKAATGLYSLPTTPLASTATVTTASSFMPNLEPLDLGLIGDEEPVQRVESGRALREKVFERLSRDGAISGDATAFATAGVGLDVDWVSDLIN

SEQ ID NO: 1319 - protein, 307 aa, Glycine max
  misc_feature (1)..(307): Public GI no. 56605376
  misc_feature: Utility: Useful for increasing chlorophyll and photosynthetic capacity
  misc_feature: Utility: Useful for making ornamental plants with modified leaves
  misc_feature: Utility: Useful for making plants tolerant to low nitrogen
MIAESMLLNPTSHISTWDSLDDPSPAISSYFSTAHVSPLDSPTAALMDFDSSLWEDPDLPAPVDAYSCDQFRMYEFKVRSCARGRSHDWTKCPYAHTGEKARRRDPRKFNYSGAECPDLRHGCCKKGDACEYAHGTFEIWLHPDRYRTQPCRDGTGCRRRVCFFAHTSEQLRIPGKQSVRSPRAREMAIPAVSSPTSILLSPSSDSPPLSPISPVISGGESLSRLVALMHSLRLDELKTNPGVSSFSPNLRRSSGAAFDLWDRGNEEEPAMERVESGRNLRAQMYAKLMRENSVDRVRPMISAGSLN

SEQ ID NO: 1320 - protein, 246 aa, Glycine max
  misc_feature (1)..(246): Public GI no. 38260609
  misc_feature: Utility: Useful for increasing chlorophyll and photosynthetic capacity
  misc_feature: Utility: Useful for making ornamental plants with modified leaves
  misc_feature: Utility: Useful for making plants tolerant to low nitrogen
MLKSVNPMAFYELGEQQFPTLGYIVSKPGNAGAYEIDPPIPSVDDAIYGSDEFRMYAYKIKRCPRTRSHDWTECPYAHRGEKATRRDPRRYSYCAVACPAFRNGACHRGDTCEFAHGVFEYWLHPARYRTRACNAGNLCQRKVCFFAHAPEQLRQSEGKHRCRYAYRPVRTTAARGRNGDGVGMRLDGDDFDTWQSPVKSGKSDLDINEERVLKCWSGISIVDDHYEPSDLDLDLSHIDWISELVD

SEQ ID NO: 1321 - DNA, 935 bp, Arabidopsis thaliana
  misc_feature (1)..(935): Ceres CLONE ID no. 103581
  misc_feature (1)..(935): Also known as  Ceres CDNA ID no. 23462890
ctctttcgctttctctcttctctcccattaccctctctctcgttttctcatactctcaactaaatatgccgtcggaaccaaaccaaacccgacccaccagagttcagccctcaacggcggcttacccaccgccaaatctggctgagccacttccttgtcctcgctgcaactccaccaccaccaagttctgttactacaacaactacaacctcgctcagcctcgttactactgcaaatcttgccgccgttactggactcaaggtggtacactccgtgacgtccccgtcggtggtggaactcgtcgtagctcctcaaaacgtcaccgctctttctccaccaccgtaacttcctcttcctcatcttcttccgtcatcacctccacgacacaagaaccagccacgactgaagcgagtcagattaaggttagtaatgtaacttcaggtcatggaagctttgcttctctgttgggtttaggaagtggaaatggtgggctggattacgggtttgggtacgggtacgggcttgaggatatgagtattgggtatcttggagattcttccgtaggagagattccggtggttgatggttgtggttgacacgtggcagattggggagattgaaggtaaaagtggaggagacagtttgatatggcctggtcttgagatctcaatgcaaaccaacgatgttaagtgaaaatgaaaccgtttctgatttcttgcctttgtcttcttttgttggtgtctttttggaaatttctgtttgttttcttttttgtcctagaaagaagagcaaaagaaaccaaattgaagcaagaatgtttttatttattttagtttttgaggtccaacaattctggtgtataaatcctctgtttatgtgacgaacatattggaatggatttatgagtaaaaatgtaaaaacatttctttcttttc

SEQ ID NO: 1322 - protein, 176 aa, Arabidopsis thaliana
  misc_feature (24)..(86): Pfam Name: zf-Dof; Pfam Description: Dof domain, zinc finger
  misc_feature: Utility: Useful for increasing chlorophyll and photosynthetic capacity
  misc_feature: Utility: Useful for increasing seed/fruit yield or modifying fruit content
  misc_feature: Utility: Useful for making plants sterile and for genetic confinement
  misc_feature: Utility: Useful for making plants with altered leaf shape eg curled leaves
  misc_feature: Utility: Useful for making plants with increased biomass and foliage
  misc_feature: Utility: Useful for making smaller plants
MPSEPNQTRPTRVQPSTAAYPPPNLAEPLPCPRCNSTTTKFCYYNNYNLAQPRYYCKSCRRYWTQGGTLRDVPVGGGTRRSSSKRHRSFSTTVTSSSSSSSVITSTTQEPATTEASQIKVSNVTSGHGSFASLLGLGSGNGGLDYGFGYGYGLEDMSIGYLGDSSVGEIPVVDGCG

SEQ ID NO: 1323 - protein, 209 aa, Arabidopsis thaliana
  misc_feature (1)..(209): Public GI no. 5668794
  misc_feature: Utility: Useful for increasing chlorophyll and photosynthetic capacity
  misc_feature: Utility: Useful for increasing seed/fruit yield or modifying fruit content
  misc_feature: Utility: Useful for making plants sterile and for genetic confinement
  misc_feature: Utility: Useful for making plants with altered leaf shape eg curled leaves
  misc_feature: Utility: Useful for making plants with increased biomass and foliage
  misc_feature: Utility: Useful for making smaller plants
MPSEPNQTRPTRVQPSTAAYPPPNLAEPLPCPRCNSTTTKFCYYNNYNLAQPRYYCKSCRRYWTQGGTLRDVPVGGGTRRSSSKRHRSFSTTATSSSSSSSVITTTTQEPATTEASQTKVTNLISGHGSFASLLGLGSGNGGLDYGFGYGYGLEEMSIGYLGDSSVGEIPVVDGCGGDTWQIGEIEGKSGGDSLIWPGLEISMQTNDVK

SEQ ID NO: 1324 - protein, 99 aa, Brassica napus
  misc_feature (1)..(99): Ceres CLONE ID no. 978708
  misc_feature: Utility: Useful for increasing chlorophyll and photosynthetic capacity
  misc_feature: Utility: Useful for increasing seed/fruit yield or modifying fruit content
  misc_feature: Utility: Useful for making plants sterile and for genetic confinement
  misc_feature: Utility: Useful for making plants with altered leaf shape eg curled leaves
  misc_feature: Utility: Useful for making plants with increased biomass and foliage
  misc_feature: Utility: Useful for making smaller plants
MIMTAKQQQQPELPEQEQLNCPRCASPNTKFCYYNNYNLSQPRHFCKNCRRYWTKGGSLRNIPVGGGTRKNSSKRSSVGSSSSAPSSSSPKSKTVAVSD

SEQ ID NO: 1325 - protein, 118 aa, Triticum aestivum
  misc_feature (1)..(118): Ceres CLONE ID no. 678544
  misc_feature: Utility: Useful for increasing chlorophyll and photosynthetic capacity
  misc_feature: Utility: Useful for increasing seed/fruit yield or modifying fruit content
  misc_feature: Utility: Useful for making plants sterile and for genetic confinement
  misc_feature: Utility: Useful for making plants with altered leaf shape eg curled leaves
  misc_feature: Utility: Useful for making plants with increased biomass and foliage
  misc_feature: Utility: Useful for making smaller plants
  misc_feature (96)..(96): Xaa is any aa, unknown, or other
MLMGAPSANQQVQGSNPNPPAQAPSSAPGAGGPMRGGTPAMAVAGSGAGAGSTERRPRPQKEKAINCPRCNSTNTKFCYYNNYSLQQPRYFCKTCXRYWTEGGSLRNVPVGGGSRKNK

SEQ ID NO: 1326 - protein, 301 aa, Zea mays
  misc_feature (1)..(301): Ceres CLONE ID no. 324937
  misc_feature: Utility: Useful for increasing chlorophyll and photosynthetic capacity
  misc_feature: Utility: Useful for increasing seed/fruit yield or modifying fruit content
  misc_feature: Utility: Useful for making plants sterile and for genetic confinement
  misc_feature: Utility: Useful for making plants with altered leaf shape eg curled leaves
  misc_feature: Utility: Useful for making plants with increased biomass and foliage
  misc_feature: Utility: Useful for making smaller plants
  misc_feature (288)..(288): Xaa is any aa, unknown, or other
MEEMLMAGNANPNPPPAAAPSAPGAQTQSQRGGGAPPPAAGAAAPSAGATVGAAGTERRARPHKEKALNCPRCNSTNTKFCYYNNYSLQQPRYFCKTCRRYWTEGGSLRNVPVGGGSRKNKRSSSSAASTSAAMSGTVSVKNPKLVHEGAHHDLNLAFPHHNNGRALQPPEFPSSFPNLESSSVCYPGAAMLGNGAAGRGMGALSAMELLRSTGCYVPLQHVQLGMPAEYAAPAGFTLGEFRIPPPPQSQSVLGFSLDTHGTGGYSAGGLQESAVGRMLFPFEDLKPXGERSWRRCKQRRS

SEQ ID NO: 1327 - protein, 250 aa, Zea mays
  misc_feature (1)..(250): Ceres CLONE ID no. 300623
  misc_feature: Utility: Useful for increasing chlorophyll and photosynthetic capacity
  misc_feature: Utility: Useful for increasing seed/fruit yield or modifying fruit content
  misc_feature: Utility: Useful for making plants sterile and for genetic confinement
  misc_feature: Utility: Useful for making plants with altered leaf shape eg curled leaves
  misc_feature: Utility: Useful for making plants with increased biomass and foliage
  misc_feature: Utility: Useful for making smaller plants
MPSSFLTSSSSSASSHLSYLIPARAAAPPPFAMGQGYGATSGGGVANATSAAAAPPPPRQGASRNAGAGHPPLPRPPPRQCPRCRSANTKFCYYNNYSREQPRYLCKACRRHWTEGGTLRDVPVGGGRKNRRGAKGGADAKGSASAAAAAPAQQGGNVVLGADTFPGDLLRQLVQFQPDAAVGGGGYAIDLSAWHQMVAATVPPPPPPGTGGDVSSLGLGAAGAGAGAEANCVALQYWSEDGMPGLDGPC

SEQ ID NO: 1328 - protein, 106 aa, Brassica napus
  misc_feature (1)..(106): Ceres CLONE ID no. 1068780
  misc_feature: Utility: Useful for increasing chlorophyll and photosynthetic capacity
  misc_feature: Utility: Useful for increasing seed/fruit yield or modifying fruit content
  misc_feature: Utility: Useful for making plants sterile and for genetic confinement
  misc_feature: Utility: Useful for making plants with altered leaf shape eg curled leaves
  misc_feature: Utility: Useful for making plants with increased biomass and foliage
  misc_feature: Utility: Useful for making smaller plants
MLMMAAKQQQQPELPEQQQLKCPRCDSPNTKFCYYNNYNLSQPRHYCKNCRRYWTKGGSLRNIPVGGGSRKNTKRSSSSSPSSSNLKDKTVAVPDQKPNSEEESRP

SEQ ID NO: 1329 - protein, 378 aa, Brassica napus
  misc_feature (1)..(378): Public GI no. 4996640
  misc_feature: Utility: Useful for increasing chlorophyll and photosynthetic capacity
  misc_feature: Utility: Useful for increasing seed/fruit yield or modifying fruit content
  misc_feature: Utility: Useful for making plants sterile and for genetic confinement
  misc_feature: Utility: Useful for making plants with altered leaf shape eg curled leaves
  misc_feature: Utility: Useful for making plants with increased biomass and foliage
  misc_feature: Utility: Useful for making smaller plants
MDAAHWHQGLGLVKPMEEMLMAANAAAGANPNPAATAPSSVTGGALRGGGGGGAPPVAGGAGAGSTERRARPQKEKALNCPRCNSTNTKFCYYNNYSLQQPRYFCKTCRRYWTEGGSLRNVPVGGGSRKNKRSSSSAASASPASASTANSVVTSASMSMSMASTGGGASKNPKLVHEGAQDLNLAFPHHGGLQAPGEFPAFPSLESSSVCNPGGPMGTNGRGGGALSAMELLRSTGCYMPLQVPMQMPAEYATPGFALGEFRAPPPPPQSSQSLLGFSLDAHGSVGGPSAAGFGSSAGLQGVPESTGRLLFPFEDLKPTVSSGTGGGGASGGGAGVDGGHQFDHGKEQQAGGGGGGPGGHDTPGFWNGMIGGGSGTSW

SEQ ID NO: 1330 - protein, 360 aa, Brassica napus
  misc_feature (1)..(360): Public GI no. 50928017
  misc_feature: Utility: Useful for increasing chlorophyll and photosynthetic capacity
  misc_feature: Utility: Useful for increasing seed/fruit yield or modifying fruit content
  misc_feature: Utility: Useful for making plants sterile and for genetic confinement
  misc_feature: Utility: Useful for making plants with altered leaf shape eg curled leaves
  misc_feature: Utility: Useful for making plants with increased biomass and foliage
  misc_feature: Utility: Useful for making smaller plants
MLMAANAAAGANPNPAATAPSSVTGGALRGGGGGGAPPVAGGAGAGSTERRARPQKEKALNCPRCNSTNTKFCYYNNYSLQQPRYFCKTCRRYWTEGGSLRNVPVGGGSRKNKRSSSSAASASPASASTANSVVTSASMSMSMASTGGGASKNPKLVHEGAQDLNLAFPHHGGLQAPGEFPAFPSLESSSVCNPGGPMGTNGRGGGALSAMELLRSTGCYMPLQVPMQMPAEYATPGFALGEFRAPPPPPQSSQSLLGFSLDAHGSVGGPSAAGFGSSAGLQGVPESTGRLLFPFEDLKPTVSSGTGGGGASGGGAGVDGGHQFDHGKEQQAGGGGGGPGGHDTPGFWNGMIGGGSGTSW

SEQ ID NO: 1331 - protein, 262 aa, Brassica napus
  misc_feature (1)..(262): Public GI no. 3341468
  misc_feature: Utility: Useful for increasing chlorophyll and photosynthetic capacity
  misc_feature: Utility: Useful for increasing seed/fruit yield or modifying fruit content
  misc_feature: Utility: Useful for making plants sterile and for genetic confinement
  misc_feature: Utility: Useful for making plants with altered leaf shape eg curled leaves
  misc_feature: Utility: Useful for making plants with increased biomass and foliage
  misc_feature: Utility: Useful for making smaller plants
  misc_feature (218)..(218): Xaa is any aa, unknown, or other
MDTSHWPQGIGLVKAVEPSKPVPTERKPRPQKEQAINCPRCNSTNTKFCYYNNYSLSQPRYFCKTCRRYWTEGGSLRNVPVGGGSRKNKRSSSSSNNSSSSTSSSYKKIPDLTIPTSSQNPKIINEPHDLNLAFNPSATSNFSNISEFMALPLMNPNSTTSFMSSIMPQLSDSNNIMYSSSSTGLPNLHDLKPTLNFSLDGFDNNNGYGSLQGETAGXKLFFPLDDLKNVSTPNDDHEFDEQNRGQAAESHGFWNGMLGGGS

SEQ ID NO: 1332 - protein, 234 aa, Brassica napus
  misc_feature (1)..(234): Public GI no. 1360078
  misc_feature: Utility: Useful for increasing chlorophyll and photosynthetic capacity
  misc_feature: Utility: Useful for increasing seed/fruit yield or modifying fruit content
  misc_feature: Utility: Useful for making plants sterile and for genetic confinement
  misc_feature: Utility: Useful for making plants with altered leaf shape eg curled leaves
  misc_feature: Utility: Useful for making plants with increased biomass and foliage
  misc_feature: Utility: Useful for making smaller plants
LPLPFFNMDTSHWPQGIGLAKAVEPSKPVPVTERKPRPQKEQAINCPRCNSTNTKFCYYNNYSLSQPRYFCKTCRRYWTDGGSLRNVPVGGGSRKNKRSNSSSNNSSSSTSSSYKKIPDLTIPTSSSTQNPKIINEPHDLNLTFNPSTTSNFSNISEFMALPLMNPNSTTSFMSSIMPQISDSNNIMYSSSSTGLPNLHDLKPTLNFSLDGFDNNNGYGSLQGETAGAKLFFPL

SEQ ID NO: 1333 - protein, 234 aa, Brassica napus
  misc_feature (1)..(234): Public GI no. 37051131
  misc_feature: Utility: Useful for increasing chlorophyll and photosynthetic capacity
  misc_feature: Utility: Useful for increasing seed/fruit yield or modifying fruit content
  misc_feature: Utility: Useful for making plants sterile and for genetic confinement
  misc_feature: Utility: Useful for making plants with altered leaf shape eg curled leaves
  misc_feature: Utility: Useful for making plants with increased biomass and foliage
  misc_feature: Utility: Useful for making smaller plants
MPSSDSGESRRSIKPQNRPGAPAPEQENLPCPRCDSTNTKFCYYNNYNYSQPRHLCKACRRYWTHGGTLRDIPVGGGTRKNAKRSRTHHVAVTSSSSSSAVTSAPEQNYPSMTPIQGGSFPYGGVDGEGKQNMSVCGSFTSLLNNNPQQNSGFLALGGFGLGLGHGLGDMGFGIGREWSFPGMMDGSNMGVPVVSSGIGNSWQLEGGETGFVGGGGDCFSWPGLAISTPGNGLK

SEQ ID NO: 1334 - protein, 236 aa, Glycine max
  misc_feature (1)..(236): Ceres CLONE ID no. 666382
  misc_feature: Utility: Useful for increasing chlorophyll and photosynthetic capacity
  misc_feature: Utility: Useful for increasing seed/fruit yield or modifying fruit content
  misc_feature: Utility: Useful for making plants sterile and for genetic confinement
  misc_feature: Utility: Useful for making plants with altered leaf shape eg curled leaves
  misc_feature: Utility: Useful for making plants with increased biomass and foliage
  misc_feature: Utility: Useful for making smaller plants
MPSSNSGESRRASKPHRSVAAPPVEPENLPCPRCDSANTKFCYYNNYNYSQPRHFCKSCRRYWTHGGTLRDIPVGGGSRKNAKRSRTHHAAAATSSSSSTSSATTSAHEHHNAHTLTALAPVTAATHFGHDGDVKQTNGNACGSYTSLLNNTQGSGFFALGGFGLGLGHGFDDMGFGIGRSGWAFPGMVDNGNIGGAIASSGVNTWQLESGEGGFVGGDCFSWPGLAISTPGNGLK

SEQ ID NO: 1335 - protein, 378 aa, Triticum aestivum
  misc_feature (1)..(378): Ceres CLONE ID no. 738478
  misc_feature: Utility: Useful for increasing chlorophyll and photosynthetic capacity
  misc_feature: Utility: Useful for increasing seed/fruit yield or modifying fruit content
  misc_feature: Utility: Useful for making plants sterile and for genetic confinement
  misc_feature: Utility: Useful for making plants with altered leaf shape eg curled leaves
  misc_feature: Utility: Useful for making plants with increased biomass and foliage
  misc_feature: Utility: Useful for making smaller plants
MDAAHWPQGLGLVKPMEEMLMGAPSSNQQVQGSNPNPPAQAPSSAPGAGGPMRGGTPAMAVAASGVGAGSTERRPRPQKEKAINCPRCNSTNTKFCYYNNYSLQQPRYFCKTCRRYWTEGGSLRNVPVGGGSRKNKRSSSSSASASASAAASATASVANSSMLGAAPNKNPKLAHEGAAHDLNLAFPHHQGGMQAQADYMAFPSLESSSMCNPGGGGMAANGARAGGALSAMELLRSTGCYMPLQMPMQMPGEYGAAGFSLGEFRAPAPPQSQSLLGFSLDAHGSVGGASMAGYGSGAGMQGMQDRSGRLLFAFEDLKPTANSGAGGGESGGGSGAGVDGGDHQFEQGNKEQQGNGTPVGQPDTPGFWNGMIGGGGTW

SEQ ID NO: 1336 - DNA, 693 bp, Arabidopsis thaliana
  misc_feature (1)..(693): Ceres CLONE ID no. 109514
  misc_feature (1)..(693): Also known as  Ceres CDNA ID no. 23358577
acacaaactaaaaaaccgatcatagaaaggaaaaaaaaaatcaaaaccctagaagtcactaagtcgattcaaaatggttgcgagaagtgaggaaattgtgatagtggaagaagatacgactgcgaaatgtttgatgttgttatcaagagtcggagaatgcggcggcggctgcgggggagatgaacgtgttttccgatgcaagacttgtcttaaagagttctcatcgtttcaagctttgggaggtcatcgtgcaagccacaagaaacttatcaacagtgacaatccatcacttcttggatccttgtccaacaagaagactaaaacgtctcatccttgtccgatatgtggcgtgaaatttccgatgggacaagctcttggtggtcacatgaggagacataggaacgagaaagcctcaagcatgttggttacacgttcttttctaccggagacgacgacggtgacggctttgaagaaatttagtagtgggaagagagtggcttgtttggatttcgacttagattcggtggagtgtttggtcaattggaagttggagttgggaagaacgatttcttggtgttaggtttcttggttttatagatttacatattgtatacagtttcacatgattttgtaatctctgttgatccaattatcgtaccgatcgatgtgaatattattttgatacaatatccg

SEQ ID NO: 1337 - protein, 168 aa, Arabidopsis thaliana
  misc_feature (86)..(108): Pfam Name: zf-C2H2; Pfam Description: Zinc finger, C2H2 type
  misc_feature: Utility: Useful for increasing chlorophyll and photosynthetic capacity
  misc_feature: Utility: Useful for making ornamental plants with modified leaves
  misc_feature: Utility: Useful for making plants with altered leaf shape eg curled leaves
  misc_feature: Utility: Useful for modifying fruit shape, composition and seed yield
MVARSEEIVIVEEDTTAKCLMLLSRVGECGGGCGGDERVFRCKTCLKEFSSFQALGGHRASHKKLINSDNPSLLGSLSNKKTKTSHPCPICGVKFPMGQALGGHMRRHRNEKASSMLVTRSFLPETTTVTALKKFSSGKRVACLDFDLDSVECLVNWKLELGRTISWC

SEQ ID NO: 1338 - protein, 164 aa, Arabidopsis thaliana
  misc_feature (1)..(164): Public GI no. 7798996
  misc_feature: Utility: Useful for increasing chlorophyll and photosynthetic capacity
  misc_feature: Utility: Useful for making ornamental plants with modified leaves
  misc_feature: Utility: Useful for making plants with altered leaf shape eg curled leaves
  misc_feature: Utility: Useful for modifying fruit shape, composition and seed yield
MVARSEEVEIVEDTAAKCLMLLSRVGECGGGGEKRVFRCKTCLKEFSSFQALGGHRASHKKLINSSDPSLLGSLSNKKTKTATSHPCPICGVEFPMGQALGGHMRRHRSEKASPGTLVTRSFLPETTTVTTLKKSSSGKRVACLDLDSMESLVNWKLELGRTIS

SEQ ID NO: 1339 - protein, 153 aa, Parthenium argentatum
  misc_feature (1)..(153): Ceres CLONE ID no. 1608104
  misc_feature: Utility: Useful for increasing chlorophyll and photosynthetic capacity
  misc_feature: Utility: Useful for making ornamental plants with modified leaves
  misc_feature: Utility: Useful for making plants with altered leaf shape eg curled leaves
  misc_feature: Utility: Useful for modifying fruit shape, composition and seed yield
MTIKRSWEDDREVENLAMANCLMLLSRVGQSGSTPDRVFHCKTCDKEFKSFQALGGHRASHKRPKTSDGSEARTPPKPKTHECPVCGLEFAIGQALGGHMRRHRDVGNEKSGRPVAARPESVTKRGLFMDLNLTPLENDLKLWSNTVNTALAM

SEQ ID NO: 1340 - protein, 174 aa, Parthenium argentatum
  misc_feature (1)..(174): Public GI no. 2346974
  misc_feature: Utility: Useful for increasing chlorophyll and photosynthetic capacity
  misc_feature: Utility: Useful for making ornamental plants with modified leaves
  misc_feature: Utility: Useful for making plants with altered leaf shape eg curled leaves
  misc_feature: Utility: Useful for modifying fruit shape, composition and seed yield
MSAMKRSREDRQVEAAAMANCLMLLSKLNDKSTSTTTTNQDHHNDFECKTCNKRFSSFQALGGHRASHKRPKLLIGAGEFLVQPSSKKMHECSICGMEFSLGQALGGHMRRHRAAIDEKSKAATKAMMIPVLKKSNSSKRIFCLDLNLTPRNEDVDLKLWPTAPISSPVLRIFI

SEQ ID NO: 1341 - protein, 159 aa, Parthenium argentatum
  misc_feature (1)..(159): Public GI no. 34908122
  misc_feature: Utility: Useful for increasing chlorophyll and photosynthetic capacity
  misc_feature: Utility: Useful for making ornamental plants with modified leaves
  misc_feature: Utility: Useful for making plants with altered leaf shape eg curled leaves
  misc_feature: Utility: Useful for modifying fruit shape, composition and seed yield
MESLRVHASALLSLSSPAASASQPTSSSSTTEGVFECKTCSKRFPSFQALGGHRTSHTRLQAKLLSDPAAAAAAAAERDRARVHECAVCGVEFSMGQALGGHMRRHRGETGTTTVVLADADDSGGATVPQPPEPMPDLNYPPLEDAGDGSEPELLNLLV

SEQ ID NO: 1342 - protein, 178 aa, Parthenium argentatum
  misc_feature (1)..(178): Public GI no. 55734104
  misc_feature: Utility: Useful for increasing chlorophyll and photosynthetic capacity
  misc_feature: Utility: Useful for making ornamental plants with modified leaves
  misc_feature: Utility: Useful for making plants with altered leaf shape eg curled leaves
  misc_feature: Utility: Useful for modifying fruit shape, composition and seed yield
MGVKRFREEQSANCLMLLSKVGLLSEMEKSAVPALKPGAGGRIYECKTCKKQFLTFQALGGHRASHKKLRLMAADLLHQSLAVTKPKTHACSICGLEFPLGQALGGHMRRHRGAALDGEKPVVVSDKPVAKAVPFLMRSNSSKRIFGFEVDGLDLNLTPEDNDPDERDKFPPLLEFFV

SEQ ID NO: 1343 - protein, 214 aa, Triticum aestivum
  misc_feature (1)..(214): Ceres CLONE ID no. 569852
  misc_feature: Utility: Useful for increasing chlorophyll and photosynthetic capacity
  misc_feature: Utility: Useful for making ornamental plants with modified leaves
  misc_feature: Utility: Useful for making plants with altered leaf shape eg curled leaves
  misc_feature: Utility: Useful for modifying fruit shape, composition and seed yield
IQTHPSQKHLAISVPSPSFVSVVFRSSALLFGLMAHGKRSRQQAESTSVSLLDLDSGDMARILLLFSGHHQHHAHYGPSSPERVFECKTCNRRFPSFQALGGHRASHKKPRLADGAGAEPPKPKVHGCSICGLEFAVGQALGGHMRRHRAVAAAGPGVGLGLSLGLGLGPNEDGNKKAAAAAELALDLNEPALEEEPADRAMLGLAVGFRPRGG

SEQ ID NO: 1344 - protein, 175 aa, Triticum aestivum
  misc_feature (1)..(175): Public GI no. 2346976
  misc_feature: Utility: Useful for increasing chlorophyll and photosynthetic capacity
  misc_feature: Utility: Useful for making ornamental plants with modified leaves
  misc_feature: Utility: Useful for making plants with altered leaf shape eg curled leaves
  misc_feature: Utility: Useful for modifying fruit shape, composition and seed yield
MSSIKRSRSEEYGQVEAEAMANCLMLLSKLNDHNTSKNQDHHNEFECKTCNKRFPSFQALGGHRASHKRTKVLTGAGEFLAQQAKKNKMHECSICGMEFSLGQALGGHMRRHRDENNKTLKVARKTTTMIPVLKKSNSSKRIFCLDLNLTPRNEDVDLKLWPTAPISSPVLRIFI

SEQ ID NO: 1345 - protein, 215 aa, Glycine max
  misc_feature (1)..(215): Ceres CLONE ID no. 603406
  misc_feature: Utility: Useful for increasing chlorophyll and photosynthetic capacity
  misc_feature: Utility: Useful for making ornamental plants with modified leaves
  misc_feature: Utility: Useful for making plants with altered leaf shape eg curled leaves
  misc_feature: Utility: Useful for modifying fruit shape, composition and seed yield
SNNFVPFQSLCPFSYIHIFILPHLKTKHPAIFQFLFWLVVMKREREVDSLTMANCLMLLSRGSEFEATYSSTSMSNRVFECKTCNRQFPSFQALGGHRASHKKPRLMAGDIEGQLLHDSPPKPKTHECSICGLEFAIGQALGGHMRRHRAANLNGNVHNSTATSSSSGGSSFDSSPKKKADNKRVLVLDLNLTPFENDLEFLKIGKPTTFVDYLY

SEQ ID NO: 1346 - DNA, 1999 bp, Arabidopsis thaliana
  misc_feature (1)..(1999): Ceres CLONE ID no. 115946
  misc_feature (1)..(1999): Also known as  Ceres CDNA ID no. 23363175
agcaaggttactgcaaggttaaagcgggaagtgagcaacgagaggcagcggcggccgtcatggattcatcggcgaacataaacaaagctctaacggagacgcgtttctccgacctcgaacctccactctccggagatatcattgaggctcttaatcagtctgatttcgagttctgcactccggttcaagccgcgacgatccctttactctgtagttacaaggatgttgccgtcgacgctgccactggttctggaaaaaccctagctttcgtcgttcccctcgtagaaatcctccgtcgatccacctcattccctccgaagcctcaccaggtcatgggggtgattatatcgccaacgagagagctatcaacgcagatatataatgtcgcacaaccatttgtttcgactttggcaaatgtgaactctgtgttgcttgttggaggccgagaggtgaaagctgacatgaagattattgaagaagaaggatgcaatgtcttgattggtacacctggaagactttctgatattatggaacgaatggagattctggattttcgaaatcttgagattcttattctagatgaggcagataggcttttggagatggggttccaaaggcaggtgaattacattatctcacgcttgccaaagcagaggaggactggcctcttttcagctacacaaacagagggcgttgaagagctcgccaaggctgggcttaggaaccctgtgagagttgaagttcgagctaagtcgaagtcggaatcatcccagcaattgacaaactcgaaaaccccttctggtcttcatcttgagtatatggaatgcgaagcagataaaaaatcatcacaactagttgatctcctcatcaagaacagtgataaaaagcttatagtattcttcatgacctgtgcttctgttgactactggggactcgtactttcaaaaattcctgccctgaagtccatatctttaattcctatccatggggatatgaagcagaatgcaagagacaaggcattagcttcgtttactaaagcatcaagtggtgcccttctgtgcacagacgttgctgcacgtggacttgatattccaggcattgattatgttgttcagtatgatcccccacaagacccaaatatgttcaaccacagggccggcagaactgcaagattaggaagacaagggagggccattgtgtttttactgcccaaggaagaagcctatgtagagtttatgcgcataagaagagtccctttggaagagagaaaatgctctgaggacgcatccgatgtcatcccgattatacgttcagctgccatgaaggaccgagcagtgatggagaagggattaaaggcatttgtttcctttgtccgtgcttataaggagcatcactgctctttcattttcagatggaaagaccttgagattggaaagttagccatgggatatggcctcttgtatcttccttcaatgtctgaagttaaacaacacagactttccagtgagggtttcacaccagttgaaggtgtcaagtttgaagaaataaaattcaaggacaaatatcgggagaaacaaagacagcaaaacttacaagtaaggaaagagaaacggcaagaagagaaaaaagagaaaggcaagagaaaaagggttgatgcttctgctagtaatgatcctaagaaagcgtcgagaaagttaacggggaaacaaagacaaactattcaaactgctgaagatgaagaagtgatggatcgagattataagttgatgataaaagtaaagaaagggttaattaaagaagatgaatatgaaagacttacaggagatgatgatttattctgatgagaagaaacaaaacctgcatgctgagattggactaagcttagtgtctttctactctcatatcatatgtgattctgttaattttttttttttttttgggtgagaattaatatcggatcatgttatgtcctttttcgttctacgagtctcacttttat

SEQ ID NO: 1347 - protein, 612 aa, Arabidopsis thaliana
  misc_feature (58)..(234): Pfam Name: DEAD; Pfam Description: DEAD/DEAH box helicase
  misc_feature (316)..(392): Pfam Name: Helicase_C; Pfam Description: Helicase conserved C-terminal domain
  misc_feature: Utility: Useful for increasing chlorophyll and photosynthetic capacity
  misc_feature: Utility: Useful for making plants with increased biomass and foliage
  misc_feature: Utility: Useful for making shorter plants and plants with modified flowers
  misc_feature: Utility: Useful for modifying plant structure, ie increased branching
QGYCKVKAGSEQREAAAAVMDSSANINKALTETRFSDLEPPLSGDIIEALNQSDFEFCTPVQAATIPLLCSYKDVAVDAATGSGKTLAFVVPLVEILRRSTSFPPKPHQVMGVIISPTRELSTQIYNVAQPFVSTLANVNSVLLVGGREVKADMKIIEEEGCNVLIGTPGRLSDIMERMEILDFRNLEILILDEADRLLEMGFQRQVNYIISRLPKQRRTGLFSATQTEGVEELAKAGLRNPVRVEVRAKSKSESSQQLTNSKTPSGLHLEYMECEADKKSSQLVDLLIKNSDKKLIVFFMTCASVDYWGLVLSKIPALKSISLIPIHGDMKQNARDKALASFTKASSGALLCTDVAARGLDIPGIDYVVQYDPPQDPNMFNHRAGRTARLGRQGRAIVFLLPKEEAYVEFMRIRRVPLEERKCSEDASDVIPIIRSAAMKDRAVMEKGLKAFVSFVRAYKEHHCSFIFRWKDLEIGKLAMGYGLLYLPSMSEVKQHRLSSEGFTPVEGVKFEEIKFKDKYREKQRQQNLQVRKEKRQEEKKEKGKRKRVDASASNDPKKASRKLTGKQRQTIQTAEDEEVMDRDYKLMIKVKKGLIKEDEYERLTGDDDLF

SEQ ID NO: 1348 - protein, 138 aa, Triticum aestivum
  misc_feature (1)..(138): Ceres CLONE ID no. 919325
  misc_feature: Utility: Useful for increasing chlorophyll and photosynthetic capacity
  misc_feature: Utility: Useful for making plants with increased biomass and foliage
  misc_feature: Utility: Useful for making shorter plants and plants with modified flowers
  misc_feature: Utility: Useful for modifying plant structure, ie increased branching
SPSPATAAARKRALTEQRFSELTPALSLEVVEALDRGGFRRCTPVQAATIPLLLTHKDVAVDAATGSGKTLAFVVPVVEMLRRLPSPPKPHQVLAIIISPTRELSSQIYNVAQPFFATLKGVSSILLVGGLDIKVELE

SEQ ID NO: 1349 - protein, 647 aa, Triticum aestivum
  misc_feature (1)..(647): Public GI no. 34896098
  misc_feature: Utility: Useful for increasing chlorophyll and photosynthetic capacity
  misc_feature: Utility: Useful for making plants with increased biomass and foliage
  misc_feature: Utility: Useful for making shorter plants and plants with modified flowers
  misc_feature: Utility: Useful for modifying plant structure, ie increased branching
MSSSSSSLAAAAARKRALTEQRFSELSPALSPEVVKALKGGGFRRCTPVQAAAIPLLLSHKDVAVDAATGSGKTLAFVVPVVEILRRRPSPPKPHEVLGIIISPTRELSSQIYNVAQPFFATLKGVSSMLLVGGFDIKAELKKLEEEGANILVGTPGKLFDVMERLDTLNYKNLEILILDEADRLLDLGFQKQITSIISKLPKLRRTGLFSATQTEAVKELAKAGLRNPVRVEVKTEVKPTGKDGAQQELGPSKTPLGLRLEYMICEASNKSSQLVDFLVQNNGKKIMVYFATCACVDYWAIVLPLLDSLKGSPIIPYHGKMKQGPREKALASFSALSSGILVCTDVAARGLDIPHVDLIVQYDPPQDPNVFIHRAGRTARYDQEGDAIVFLLPKEDTYVEFLKRRGVPLTERECSTNAVDIVPQIRSAALEDRNVMEKGLTAFVSFVRAYKEHHCSYIFSWKDLEIGRLGMEYGLLQIPSMPEVKHHSLSLEGFTPVKDVDVTKIKYKDKAREKQRQKTLKRKAEELALRPEIEKRRKAPEKPEKPKRKKTGKQRQAVQTKEDMDELANEYRLLKKLKRGVIDEDEYEKLTGFGESDDDDSSDGGDSDLDERKERGNKVLKKIKQKGKAKGSRRFEGRSKQKTRRR

SEQ ID NO: 1350 - protein, 486 aa, Zea mays
  misc_feature (1)..(486): Ceres CLONE ID no. 644693
  misc_feature: Utility: Useful for increasing chlorophyll and photosynthetic capacity
  misc_feature: Utility: Useful for making plants with increased biomass and foliage
  misc_feature: Utility: Useful for making shorter plants and plants with modified flowers
  misc_feature: Utility: Useful for modifying plant structure, ie increased branching
MPDIVVATPGRIIDHLRNSLSVGLEDLAVVILDEADRLLELGFSAEIQELIRMCPKRRQTMLFSATMTEEIDELIKLSLNKPVRLEADPSLKRPATLTEEVVRIRRARESNQEAVLLALCLKTFKRSVIIFSGTKQSAHRLKIIFGLSGMKAAELHGNLTQAQRLEALELFKKKEVDFLIATDVAARGIDIVGVQTVINFACPRDVKTYLHRVGRTARAGREGYAVTFVTDDDRCLLKAIAKKAGSQLKSRIVAEKPVAECARLIEQLEGQISIIIREERVEREARKAEMEIAKAENMIAHKDEIYSRPKRTWFATEREKKLLAAAAKESLDHGKSTSGVISAKKAEDLRLKEKRRREHEKNLPRKKRRRLEAQREMLEDEDDEKTKENDRGKQPMKGQSLVDAAYRKAKSLKAASKRAPGARKGKKEKNERQHSEKAPNRHEEMRDLFQNDMSEWKQGRSSKKNNKFAPKKSRNSFKSKARYKRK

SEQ ID NO: 1351 - DNA, 1244 bp, Arabidopsis thaliana
  misc_feature (1)..(1244): Ceres CLONE ID no. 115975
  misc_feature (1)..(1244): Also known as  Ceres CDNA ID no. 23371428
tcccaaacctatcttcttcttcctctcttgtctctctcgctctctctcttctacattgtttcttgaggtcaatccattaaaaatgggattatattcactaatcacaggaagaaaaggaccaagtggatttggttcagcttcaacagctgaagaggttactcaagggattgatgcaactaatctcactgcaattatcacaggagggacaggaggaatagggatggagacagcgagagtgctgtcgaagagaggtgctcatgtggtgatcggtgcccgaaacatgggagctgcagaaaacgccaaaacagagattctcagacaaaacgcaaacgcacgtgtcactcttcttcaattagatctctcttccatcaaatccatcaaagcctttgttcgtgaatttcatgccctccatcttcctctcaatctcctcataaacaatgcaggagtaatgttctgtccataccaactctctgaagatggaatcgaattgcagtttgctacaaatcacattggtcactttctgttgacaaacttgctcttggacacaatgaagaacacagctaaaaccagtggtgttgaaggaagaattttgaatgtatcatctgtagctcatatctatacttaccaagaaggaatccaattcgacagcatcaatgacatttgcagttactcggataagcgagcttacggacaatcgaaactagccaatatattgcatgctaatgagctctcccgtcagcttcaggaagaaggagtaaacataacagcaaattcagttcaccctggtcttattctcaccaatctcttccaacacactgctcttttaatgaggttcttgaagttcttcagcttctacttgtggaaaaatatacctcagggagcagcaacaacatgttatgttgctctgcatccaagtgtgaagggagtaacaggaaggtactttgctgattgcaacgaagtcactccaagcaaacttgctagagatgagactttggcacagaaactctgggatttcagtgttaagctcattaactcggtttctaaaaagaactacctcggtttcgatgacaccacttgaatctctacggtgttcttgttgaatgttacctaaagagtgaaaaaaaagtaagaacaagtagagattgtgatgtttctttccacattatcgtatggtaactcatgagatgcattgktgtatgcttaaatattttatcgagtgaatatgtaaccgcgtcaatcttttc

SEQ ID NO: 1352 - protein, 331 aa, Arabidopsis thaliana
  misc_feature (36)..(108): Pfam Name: Saccharop_dh; Pfam Description: Saccharopine dehydrogenase
  misc_feature (34)..(185): Pfam Name: adh_short; Pfam Description: short chain dehydrogenase
  misc_feature (36)..(208): Pfam Name: Epimerase; Pfam Description: NAD dependent epimerase/dehydratase family
  misc_feature: Utility: Useful for increasing chlorophyll and photosynthetic capacity
  misc_feature: Utility: Useful for making plants sterile and for genetic confinement
  misc_feature: Utility: Useful for making plants with altered leaf shape eg curled leaves
  misc_feature: Utility: Useful for making plants with increased biomass
  misc_feature: Utility: Useful for making smaller plants
MGLYSLITGRKGPSGFGSASTAEEVTQGIDATNLTAIITGGTGGIGMETARVLSKRGAHVVIGARNMGAAENAKTEILRQNANARVTLLQLDLSSIKSIKAFVREFHALHLPLNLLINNAGVMFCPYQLSEDGIELQFATNHIGHFLLTNLLLDTMKNTAKTSGVEGRILNVSSVAHIYTYQEGIQFDSINDICSYSDKRAYGQSKLANILHANELSRQLQEEGVNITANSVHPGLILTNLFQHTALLMRFLKFFSFYLWKNIPQGAATTCYVALHPSVKGVTGRYFADCNEVTPSKLARDETLAQKLWDFSVKLINSVSKKNYLGFDDTT

SEQ ID NO: 1353 - protein, 313 aa, Glycine max
  misc_feature (1)..(313): Ceres CLONE ID no. 463901
  misc_feature: Utility: Useful for increasing chlorophyll and photosynthetic capacity
  misc_feature: Utility: Useful for making plants sterile and for genetic confinement
  misc_feature: Utility: Useful for making plants with altered leaf shape eg curled leaves
  misc_feature: Utility: Useful for making plants with increased biomass
  misc_feature: Utility: Useful for making smaller plants
MAGPSGFGSASTAEQVTEGVDASNLTAIITGGASGIGLETARVLALRKVHVIIAVRNMVSAKEAKQQILEENESARVDIMKLDLCSVNSIRSFVDNFIALDLPLNILINNAGVMFCPFKLSEDGIEMQFATNHIGHFHLSNLLLDKMKQTAKATGIEGRIINLSSIAHNYTYRKGIRFNKINERKGYGNKRAYGQSKLANILHTNELSRRLQEEGVNITANSVHPGVIMTPLMRHSSYLMHFLKVFTFYIWKNVPQGAATTCYVALHPSVKGVTGKYFVDCNQCKPSSHAKNKQLAKKLWDFSNDLIKSISKA

SEQ ID NO: 1354 - protein, 313 aa, Glycine max
  misc_feature (1)..(313): Ceres CLONE ID no. 559449
  misc_feature: Utility: Useful for increasing chlorophyll and photosynthetic capacity
  misc_feature: Utility: Useful for making plants sterile and for genetic confinement
  misc_feature: Utility: Useful for making plants with altered leaf shape eg curled leaves
  misc_feature: Utility: Useful for making plants with increased biomass
  misc_feature: Utility: Useful for making smaller plants
MAGPSGFGSASTAEQVTDGIDASNLTAIITGGASGIGLETARVLALRKVHVIIAVRNMVSAKEAKQQILEENESARVDVMKLDLCSVNSITSFVDNFIALDLPLNILINNAGVMFCPFKLSEDGIEMQFATNHLGHFHLTNLLLDKMQQTAKATGIEGRIINLSSIAHNYTYRKGIRFNKINERKGYGNKKAYGQSKLANILHTNELSRRLQEEGVNITANSVHPGVIMTPLMRHSSYLMHFLKVFTFYIWKNVPQGAATTCYVALHPSVKGVTGKYFVDCNQCKPSSHAKNKQLAKKLWDFSNDLIKSISKA

SEQ ID NO: 1355 - protein, 349 aa, Glycine max
  misc_feature (1)..(349): Ceres CLONE ID no. 477913
  misc_feature: Utility: Useful for increasing chlorophyll and photosynthetic capacity
  misc_feature: Utility: Useful for making plants sterile and for genetic confinement
  misc_feature: Utility: Useful for making plants with altered leaf shape eg curled leaves
  misc_feature: Utility: Useful for making plants with increased biomass
  misc_feature: Utility: Useful for making smaller plants
MLLANVLGISVIRLSGGGASLSCVRVRKRECVCVQKMWPFSRKGASGFSSSSTAEQVTEGIDGTGLTAIVTGASSGIGTETTRVLSLRGVHVIMGVRNMLAAKDVKETLLKEIPSAKVDAMELDLSSLESVKKFASEFKSSGLPLNMLINNAGIMACPFKLSKDKIELQFATNHLGHFLLTNLLLDTMKKTSRETKKEGRIVNVSSEAHRFTYSEGIRFDKINDESSYSNWRAYGQSKLANILHANELTRRLKEDGVDISANSLHPGVIATNLSRHISPVNGLTKAIARLVLKNVQQGAATTCYVALHPQVKGTSGKYFSASNVAKTTSQGTDADLAKNLWDFSMDLTK

SEQ ID NO: 1356 - protein, 315 aa, Zea mays
  misc_feature (1)..(315): Ceres CLONE ID no. 277275
  misc_feature: Utility: Useful for increasing chlorophyll and photosynthetic capacity
  misc_feature: Utility: Useful for making plants sterile and for genetic confinement
  misc_feature: Utility: Useful for making plants with altered leaf shape eg curled leaves
  misc_feature: Utility: Useful for making plants with increased biomass
  misc_feature: Utility: Useful for making smaller plants
MTSWLLGRRGPSGFSWSSTADQVTQGISAAGLTAIVTGASSGIGAETARTLALRGAHVIMAVRSLPAAQAVKDAVLAQAPGAKLDVMELDLSSMASVRAFASQFIDRGLPLNILINNAGVMAIPFALSKDGIEMQFATNHVGHFLLTHLLLDTMKRTSHESNLEGRIVNVSSEGHRLAYREGIRFDKINDESVYSSIGAYGQSKLANILHANELARRFEEDNVNITANSLHPGSIITNLLRYHSILDVLHRTLGKLVLKNAEQGAATTCYLALHPHVKGVSGKYFCDCNLYEPSANAKDMELAKRLWDFGVELIT

SEQ ID NO: 1357 - protein, 315 aa, Zea mays; identical to SEQ ID NO: 1356
  misc_feature (1)..(315): Ceres CLONE ID no. 1283429
  misc_feature: Utility: Useful for increasing chlorophyll and photosynthetic capacity
  misc_feature: Utility: Useful for making plants sterile and for genetic confinement
  misc_feature: Utility: Useful for making plants with altered leaf shape eg curled leaves
  misc_feature: Utility: Useful for making plants with increased biomass
  misc_feature: Utility: Useful for making smaller plants

SEQ ID NO: 1358 - protein, 367 aa, Zea mays
  misc_feature (1)..(367): Ceres CLONE ID no. 239740
  misc_feature: Utility: Useful for increasing chlorophyll and photosynthetic capacity
  misc_feature: Utility: Useful for making plants sterile and for genetic confinement
  misc_feature: Utility: Useful for making plants with altered leaf shape eg curled leaves
  misc_feature: Utility: Useful for making plants with increased biomass
  misc_feature: Utility: Useful for making smaller plants
MFEQAVADFCWHAREVVSSGMGLWGWPWGRRGPSGFGSASTAEEVTAGVDASNITAIVTGATNGIGKETARVLALRGAKVIIPARTLESGLKLKESLADEVPSSKVHVMEMDLSCLSSVRDFARSFNSSHKHLNLLINNAGIMACPYQLSKDGIELQFATNHVGHFLLTSLLLDKMKSTAAETGVQGRIINVSSVAHKRSDGTCFELNKLNDKARYQPFIAYAHSKLANVLHTNELSRRFQEEGCNLTANSLHPGVIVTNIIRYVAGNSALISALSPVANLVLKSVPRGAATTCYLALHPNVKGVSGKYFADCNEATPTAVARDSELAKRLWSFSEELVKIYADMSQTTQASEEEETTVTKDVFQDK

SEQ ID NO: 1359 - DNA, 817 bp, Arabidopsis thaliana
  misc_feature (1)..(817): Ceres CLONE ID no. 117369
  misc_feature (1)..(817): Also known as  Ceres CDNA ID no. 23360906
gggacagtggacggatttgctcgctagttttctcttcgaattttccacaaacaaattttctcagccaaagttcgatcggatctgggttttatatttttttgaagaacccgtgtccgtcttcgatcagttcgcgttcaatagccaaatcttatctcttcagctggaatctgacgaacattattatcatcggtagtgttctatagaaagaccgaaagttttcttcaatttcaaagtcagtggcgatgtcgtgggctggtcctgaagaaatttatctttcaacatcactcgctagttatctcgatagaaaactacttgtgcttcttagagatggtagaaagctaatgggaacactccgttcctttgatcaattcgccaatgcggttctagaaggtgcgtgtgagagggtaattgttggtgaacaatactgtgacattcctttaggcctctatgtaatccgtggagagaatgttgttttgattggtgagctggacacggagagagaagagcttcctccacatatgattcgcgtctcagaggcagagattaaaagggcacaaaaggtggagagggaagcgagtgagctgagaggaacaatgaggaagagaatggagtttcttgactttgattaaaccagattgtatccccattcattattggcttgatgctctgctttggctcgcaagttttatgatgagcctttttggtgtgttgacttaggggatcgacgcaattcttgtgtttcattttggatgaatatgacaataaatctgtgtacttttgtctttggatctatttacctttttaagaaaaaaatgtt

SEQ ID NO: 1360 - protein, 128 aa, Arabidopsis thaliana
  misc_feature (13)..(81): Pfam Name: LSM; Pfam Description: LSM domain
  misc_feature: Utility: Useful for increasing chlorophyll and photosynthetic capacity
  misc_feature: Utility: Useful for increasing seed/fruit yield or modifying fruit content
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with altered leaf shape eg curled leaves
  misc_feature: Utility: Useful for making plants with increased biomass
  misc_feature: Utility: Useful for making plants with increased biomass and foliage
MSWAGPEEIYLSTSLASYLDRKLLVLLRDGRKLMGTLRSFDQFANAVLEGACERVIVGEQYCDIPLGLYVIRGENVVLIGELDTEREELPPHMIRVSEAEIKRAQKVEREASELRGTMRKRMEFLDFD

SEQ ID NO: 1361 - protein, 95 aa, Brassica napus
  misc_feature (1)..(95): Ceres CLONE ID no. 968213
  misc_feature: Utility: Useful for increasing chlorophyll and photosynthetic capacity
  misc_feature: Utility: Useful for increasing seed/fruit yield or modifying fruit content
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with altered leaf shape eg curled leaves
  misc_feature: Utility: Useful for making plants with increased biomass
  misc_feature: Utility: Useful for making plants with increased biomass and foliage
  misc_feature (39)..(39): Xaa is any aa, unknown, or other
MGTLRSFDQFANAVLEGACERVIVGEQYCDIPLGLYVIXGENVVLIGEMDTEREELPPHMIRVSETEIKRAQKVEREAGELRGTMRKRMEFLDFD

SEQ ID NO: 1362 - protein, 128 aa, Brassica napus
  misc_feature (1)..(128): Ceres CLONE ID no. 952177
  misc_feature: Utility: Useful for increasing chlorophyll and photosynthetic capacity
  misc_feature: Utility: Useful for increasing seed/fruit yield or modifying fruit content
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with altered leaf shape eg curled leaves
  misc_feature: Utility: Useful for making plants with increased biomass
  misc_feature: Utility: Useful for making plants with increased biomass and foliage
  misc_feature (84)..(84): Xaa is any aa, unknown, or other
MSWAGPEDMYLSTSLASYLDRKILVLLRDGRKLMGTLRSFDQFANAVLEGACERVIVGEQYCDIPLGLYVIRGENVVLIGDLDXEREELPPHMIRVSETEIKRAQKVEREASELRGTMRKRMEFLDFD

SEQ ID NO: 1363 - protein, 95 aa, Glycine max
  misc_feature (1)..(95): Ceres CLONE ID no. 716576
  misc_feature: Utility: Useful for increasing chlorophyll and photosynthetic capacity
  misc_feature: Utility: Useful for increasing seed/fruit yield or modifying fruit content
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with altered leaf shape eg curled leaves
  misc_feature: Utility: Useful for making plants with increased biomass
  misc_feature: Utility: Useful for making plants with increased biomass and foliage
  misc_feature (24)..(24): Xaa is any aa, unknown, or other
MGTLRSFDQFANAVLEGACERVIXGDLYCDIPLGLYVIRGENVVLIGELDLEREELPEHMTRVSTAEIKRAQKAEREASDLKGTMRKRMEFLDFD

SEQ ID NO: 1364 - protein, 136 aa, Glycine max
  misc_feature (1)..(136): Public GI no. 50924582
  misc_feature: Utility: Useful for increasing chlorophyll and photosynthetic capacity
  misc_feature: Utility: Useful for increasing seed/fruit yield or modifying fruit content
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with altered leaf shape eg curled leaves
  misc_feature: Utility: Useful for making plants with increased biomass
  misc_feature: Utility: Useful for making plants with increased biomass and foliage
MSSWAGPDEIFLSTSLAGFLDKKLIVLLRDGRKLLGTLCSFDQFANVVLQGACERVIVGELYCDVPLGLYVIRGENVVLIGELVWFWIEQDREKDELPAHMTCVSEAEIRKAEKAEREARDLKGSMRKRMEFLDFD

SEQ ID NO: 1365 - protein, 128 aa, Zea mays
  misc_feature (1)..(128): Ceres CLONE ID no. 218224
  misc_feature: Utility: Useful for increasing chlorophyll and photosynthetic capacity
  misc_feature: Utility: Useful for increasing seed/fruit yield or modifying fruit content
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with altered leaf shape eg curled leaves
  misc_feature: Utility: Useful for making plants with increased biomass
  misc_feature: Utility: Useful for making plants with increased biomass and foliage
MSWSAPDDILLSTSLAGFLDKKLIVLLRDGRKLLGTLCSFDQFANVVLQGACERVIVGEQYCDVPLGLYVIRGENVVLIGELDREKDELPAHMTCVSEAEIRKAEKAEREARDLKGTMRKRMEFLDFD

SEQ ID NO: 1366 - protein, 128 aa, Zea mays; identical to SEQ ID NO: 1365
  misc_feature (1)..(128): Ceres CLONE ID no. 1283561
  misc_feature: Utility: Useful for increasing chlorophyll and photosynthetic capacity
  misc_feature: Utility: Useful for increasing seed/fruit yield or modifying fruit content
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with altered leaf shape eg curled leaves
  misc_feature: Utility: Useful for making plants with increased biomass
  misc_feature: Utility: Useful for making plants with increased biomass and foliage

SEQ ID NO: 1367 - protein, 128 aa, Triticum aestivum
  misc_feature (1)..(128): Ceres CLONE ID no. 639565
  misc_feature: Utility: Useful for increasing chlorophyll and photosynthetic capacity
  misc_feature: Utility: Useful for increasing seed/fruit yield or modifying fruit content
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with altered leaf shape eg curled leaves
  misc_feature: Utility: Useful for making plants with increased biomass
  misc_feature: Utility: Useful for making plants with increased biomass and foliage
MSWAGPDEILLSTSLAGFLDKKLIVLLRDGRKLLGTLCSFDQFANVVLQGACERVIVGELYCDVPFGLYVIRGENVVLIGELDREKDELPSHMTCVSEAEIRTAEKAEKEARDLKGTMRKRMEFLDFD

SEQ ID NO: 1368 - protein, 128 aa, Zea mays
  misc_feature (1)..(128): Ceres CLONE ID no. 1273479
  misc_feature: Utility: Useful for increasing chlorophyll and photosynthetic capacity
  misc_feature: Utility: Useful for increasing seed/fruit yield or modifying fruit content
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with altered leaf shape eg curled leaves
  misc_feature: Utility: Useful for making plants with increased biomass
  misc_feature: Utility: Useful for making plants with increased biomass and foliage
MSWSAPDDILLSTSLAGFLDKKLIVLLRDGRKLLGTLCSFDQFANVVLQGACERVIVGGQYCDVPLGLYVIRGENVVLIGELDHEKDELPAHMTCVLEAEIRKAEKAEREARDLKGTMRKRMEFLDFD

SEQ ID NO: 1369 - protein, 105 aa, Zea mays
  misc_feature (1)..(105): Ceres CLONE ID no. 1389544
  misc_feature: Utility: Useful for increasing chlorophyll and photosynthetic capacity
  misc_feature: Utility: Useful for increasing seed/fruit yield or modifying fruit content
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with altered leaf shape eg curled leaves
  misc_feature: Utility: Useful for making plants with increased biomass
  misc_feature: Utility: Useful for making plants with increased biomass and foliage
  misc_feature (88)..(88): Xaa is any aa, unknown, or other
  misc_feature (104)..(104): Xaa is any aa, unknown, or other
MSWSAPDDILLSTSLAGFLDTNVVLQGACERVIVGEQYCDVPLGLYVIRGENVVLIGELDREKDELPAHMTCVSEAEIRKAEKAEREXRDLKGTMRKRMEFLDXD

SEQ ID NO: 1370 - DNA, 777 bp, Arabidopsis thaliana
  misc_feature (1)..(777): Ceres CLONE ID no. 118337
  misc_feature (1)..(777): Also known as  Ceres CDNA ID no. 23385924
ctctctcttaggttttttttcccttctcccaatctcatcttctccgaaaacctttcttctctcaaatttctgtgaaaacatgtctgacgacgagcaccactttgaggccagcgaatccggagcttccaagacctatcctcaatcagccggtaacatccgtaaaggtggtcacatcgtcatcaaaaaccgtccctgcaaggttgttgaggtttcgacttccaaaactggcaagcacggtcacgccaaatgtcactttgttgctattgatatcttcactgctaagaagcttgaagatattgttccatcttcccacaattgtgatgttccacatgtgaaccgtgttgattaccagttgattgatatcactgaggatggcttcgtgagccttctcactgacagtggtggcaccaaggatgatctcaagcttcccaccgatgatggtctcaccgcccagttgttgtgttttgttaatgcacatgaggcttggattcgatgagggaaaggatattgtggtgtctgtcatgtcttccatgggagaggagcagatctgtgccgtcaaggaagttggtggtggcaagtaaacaagtatcattcgatatattattaccagtttgacaacggacgtcaatgttataagaaccaaaagatgtttttctttttcctaatttagaccctttgtgtgtgtttcttgttgcaagacaaccatatctattggttttggattgttggaaaagtttgtgttgaaacattcaaagtttcttatgagatgttattctc

SEQ ID NO: 1371 - protein, 138 aa, Arabidopsis thaliana
  misc_feature (26)..(62): Pfam Name: KOW; Pfam Description: KOW motif
  misc_feature (84)..(137): Pfam Name: eIF-5a; Pfam Description: Eukaryotic initiation factor 5A hypusine, DNA-binding OB fold
  misc_feature: Utility: Useful for increasing chlorophyll and photosynthetic capacity
  misc_feature: Utility: Useful for making plants with increased biomass and foliage
  misc_feature: Utility: Useful for making shorter plants and plants with modified flowers
  misc_feature: Utility: Useful for making smaller plants
MSDDEHHFEASESGASKTYPQSAGNIRKGGHIVIKNRPCKVVEVSTSKTGKHGHAKCHFVAIDIFTAKKLEDIVPSSHNCDVPHVNRVDYQLIDITEDGFVSLLTDSGGTKDDLKLPTDDGLTAQLLCFVNAHEAWIR

SEQ ID NO: 1372 - protein, 154 aa, Zea mays
  misc_feature (1)..(154): Ceres CLONE ID no. 1389175
  misc_feature: Utility: Useful for increasing chlorophyll and photosynthetic capacity
  misc_feature: Utility: Useful for making plants with increased biomass and foliage
  misc_feature: Utility: Useful for making shorter plants and plants with modified flowers
  misc_feature: Utility: Useful for making smaller plants
  misc_feature (116)..(116): Xaa is any aa, unknown, or other
  misc_feature (117)..(117): Xaa is any aa, unknown, or other
  misc_feature (118)..(118): Xaa is any aa, unknown, or other
  misc_feature (137)..(137): Xaa is any aa, unknown, or other
MSDEEHHFESSDAGASKTYPQQAGNIRKGGHIVIKGRPCKVVEVSTSKTGKHGHAKCHFVAIDIFTAKKLEDIVPSSHNCDVPHVNRIDYQLIDISEDGFVSLLTDSGGTKDDLKXXXDDSLSALMKSGFEEGKDVXVSVMSSMGEEQICAVKG

SEQ ID NO: 1373 - protein, 123 aa, Brassica napus
  misc_feature (1)..(123): Ceres CLONE ID no. 1069165
  misc_feature: Utility: Useful for increasing chlorophyll and photosynthetic capacity
  misc_feature: Utility: Useful for making plants with increased biomass and foliage
  misc_feature: Utility: Useful for making shorter plants and plants with modified flowers
  misc_feature: Utility: Useful for making smaller plants
  misc_feature (111)..(111): Xaa is any aa, unknown, or other
MSDTDEHHFESKADSGASKTYPQQAGAIRKGGHIVIKARPCKVVEVSTSKTGKHGHAKCHFVAIDIFNGKKLEDIVPSSHNCDVPHVDRQDYQLIDITDDGYVSLLTESGXTKDDLKLPTDDV

SEQ ID NO: 1374 - protein, 125 aa, Triticum aestivum
  misc_feature (1)..(125): Ceres CLONE ID no. 1326914
  misc_feature: Utility: Useful for increasing chlorophyll and photosynthetic capacity
  misc_feature: Utility: Useful for making plants with increased biomass and foliage
  misc_feature: Utility: Useful for making shorter plants and plants with modified flowers
  misc_feature: Utility: Useful for making smaller plants
MSDTDEHHFESKADSGASKTYPQQAGAIRKGGHIVIKARPCKVVEVSTSKTGKHGHAKCHFVAIDIFNGKKLEDIVPSSHNCDVPHVDRQDYQLIDITDDGYVSLLTESGNTKDDLKLPTDDVLL

SEQ ID NO: 1375 - protein, 161 aa, Triticum aestivum
  misc_feature (1)..(161): Ceres CLONE ID no. 567871
  misc_feature: Utility: Useful for increasing chlorophyll and photosynthetic capacity
  misc_feature: Utility: Useful for making plants with increased biomass and foliage
  misc_feature: Utility: Useful for making shorter plants and plants with modified flowers
  misc_feature: Utility: Useful for making smaller plants
MSDTDEHHFESKADSGASKTYPQQAGAIRKGGHIVIKARPCKVVEVSTSKTGKHGHAKCHFVAIDIFNGKKLEDIVPSSHNCDVPHVDRQDYQLIDITDDGYVSLLTESGNTKDDLKLPTDDVLLGQIKTGFADGKDLILSVMSAMGEEQICAVKEIGGGK

SEQ ID NO: 1376 - protein, 146 aa, Triticum aestivum
  misc_feature (1)..(146): Ceres CLONE ID no. 743658
  misc_feature: Utility: Useful for increasing chlorophyll and photosynthetic capacity
  misc_feature: Utility: Useful for making plants with increased biomass and foliage
  misc_feature: Utility: Useful for making shorter plants and plants with modified flowers
  misc_feature: Utility: Useful for making smaller plants
MSDTDEHHFESKADSGASKTYPQQAGAIRKGGHIVIKARPCKVVEVSTSKTGKHGHAKCHFVAIDIFNGKKLEDIVPSSHNCDVPHVDRQDYQLIDITDDGYVSLLTESGNTKDDLKLPTDDVLLGQIKTGFADGKDLILSGCPPG

SEQ ID NO: 1377 - protein, 155 aa, Glycine max
  misc_feature (1)..(155): Ceres CLONE ID no. 1488709
  misc_feature: Utility: Useful for increasing chlorophyll and photosynthetic capacity
  misc_feature: Utility: Useful for making plants with increased biomass and foliage
  misc_feature: Utility: Useful for making shorter plants and plants with modified flowers
  misc_feature: Utility: Useful for making smaller plants
  misc_feature (122)..(122): Xaa is any aa, unknown, or other
  misc_feature (123)..(123): Xaa is any aa, unknown, or other
MSDTDEHHFESKADSGASKTYPQQAGAIRKGGHIVIKARPCKVVEVSTSKTGKHGHAKCHFVAIDIFNGKKLEDIVPSSHNCDVPHVDRQDYQLIDITDDGYVSLLTESGNTKDDLKLPTDXXLLGQIKTGFADGKDLILSVMSAMGEEQICAVK

SEQ ID NO: 1378 - protein, 138 aa, Glycine max
  misc_feature (1)..(138): Ceres CLONE ID no. 1075190
  misc_feature: Utility: Useful for increasing chlorophyll and photosynthetic capacity
  misc_feature: Utility: Useful for making plants with increased biomass and foliage
  misc_feature: Utility: Useful for making shorter plants and plants with modified flowers
  misc_feature: Utility: Useful for making smaller plants
  misc_feature (116)..(116): Xaa is any aa, unknown, or other
  misc_feature (134)..(134): Xaa is any aa, unknown, or other
MSETDEHHFESKADSGASKTYPQQAGAIRKGGHIVIKARPCKVVEVSTSKTGKHGHAKCHFVAIDIFNGKKLEDIVPSSHNCDVPHVDRQDYQLIDITDDGYVSLLTESGNTKDDXEASTDDVLLGQIKTGFAXGKDL

SEQ ID NO: 1379 - protein, 127 aa, Brassica napus
  misc_feature (1)..(127): Ceres CLONE ID no. 939972
  misc_feature: Utility: Useful for increasing chlorophyll and photosynthetic capacity
  misc_feature: Utility: Useful for making plants with increased biomass and foliage
  misc_feature: Utility: Useful for making shorter plants and plants with modified flowers
  misc_feature: Utility: Useful for making smaller plants
MSDSEEHHFESKADAGASKTYPQQAGTVRKNGFIVIKNRPCKVVEVSTSKTGKHGHAKCHFVAIDIFNGKKLEDIVPSSHNCDIPHVNRTEYQLIDISEDGFVSLLTSDGNTKDDLRLPTDETLVAQ

SEQ ID NO: 1380 - protein, 135 aa, Zea mays
  misc_feature (1)..(135): Ceres CLONE ID no. 388126
  misc_feature: Utility: Useful for increasing chlorophyll and photosynthetic capacity
  misc_feature: Utility: Useful for making plants with increased biomass and foliage
  misc_feature: Utility: Useful for making shorter plants and plants with modified flowers
  misc_feature: Utility: Useful for making smaller plants
MSDSEEHHFESKADAGASKTYPQQAGTVRKNGFIVIKNRPCKVVEVSTSKTGKHGHAKCHFVAIDIFNGKKLEDIVPSSHNCDIPHVNRTEYQLIDISEDGFVSLLTSDGNTKDDLRLPTDETLVAAACSCHLPF

SEQ ID NO: 1381 - protein, 160 aa, Zea mays
  misc_feature (1)..(160): Ceres CLONE ID no. 1289769
  misc_feature: Utility: Useful for increasing chlorophyll and photosynthetic capacity
  misc_feature: Utility: Useful for making plants with increased biomass and foliage
  misc_feature: Utility: Useful for making shorter plants and plants with modified flowers
  misc_feature: Utility: Useful for making smaller plants
MSDSEEHHFESKADAGASKTYPQQAGTVRKNGFIVIKNRPCKVVEVSTSKTGKHGHAKCHFVAIDIFNGKKLEDIVPSSHNCDIPHVNRTEYQLIDISEDGFVSLLTSDGNTKDDLRLPTDETLVAQIKEGFESGKDLVVTVQSAMGEEQICALKDVGPK

SEQ ID NO: 1382 - protein, 134 aa, Zea mays
  misc_feature (1)..(134): Ceres CLONE ID no. 687467
  misc_feature: Utility: Useful for increasing chlorophyll and photosynthetic capacity
  misc_feature: Utility: Useful for making plants with increased biomass and foliage
  misc_feature: Utility: Useful for making shorter plants and plants with modified flowers
  misc_feature: Utility: Useful for making smaller plants
  misc_feature (125)..(125): Xaa is any aa, unknown, or other
MSDSEEHHFESKADAGASKTYPQQAGTVRKNGFIVIKNRPCKVVEVSTSKTGKHGHAKSPFGAINIFNGKKLEDIGPSSPNCDIPHVNRTEYQLIDISEDGFVSLLTSDGNTKDDLRLPTDETLXAQIKEGFES

SEQ ID NO: 1383 - DNA, 1123 bp, Arabidopsis thaliana
  misc_feature (1)..(1123): Ceres CLONE ID no. 150912
  misc_feature (1)..(1123): Also known as  Ceres CDNA ID no. 23388597
atcaaaggagagagatcgacaatggcaccttcgtcatcaagcggtttaaccttcaagctacatcctttggtaatcgtcaacatatcggatcactacactagggtcaaaactcagctcaatcctcctgcttcaatctgcgcaagcggccatggctcaaacaacggcgaagcaatgttccagcaaaaccctagggtttacggatgtgtgatcggtgtccagagaggtcgtactgttgagatattcaacagtttcgagcttttatatgatccttctactcaaaccctcgatagatctttcctcgagaagaagcaagagctctataagaaggtgttccctgatttctatattctgggatggtactctacgggaagtgatgctgaggaatctgatatgcatatccataaagctttgatggatatcaatgaatctcctgtttatgtgcttttaaaccctgctatcaatcacacacagaaggatcttccagtgactatttatgaaagtgaattgcatgtcattgatggaatcccgcagctaattttcgctcatacaagctacacaatcgagacagttgaagctgaacggatatcagttgatcatgttgcacatcttaaaccatctgacggaggctcagcagcaacccagttggctgctcatcttactggtatacatagtgccatcaagatgcttaatagcagaatcagagtgctttaccaaaatcttgctgcaatgcagaaaggtgataaatcttgtgacaactcagttctgagacaagtatctagcctgctaagaagattgcctgccatggaatcagagagatttcaagataatttcttgatggagtacaacgacaaattactaataacttacctagcgatgattacaaattgttccagcaacatgaacgagatggtcgacaaattcaacaccgcatatgacagaaacactcgaagaggtggaagaactgcattcatgtaaaagatcctttccagcgattctagttctaaagatcttctcttggttcctgaaaccatttttaacattgcctctgtgagaatctataactcagacggcaagactttatcctcttcattgtttctatatctataagaacatctgcttatct

SEQ ID NO: 1384 - protein, 317 aa, Arabidopsis thaliana
  misc_feature (6)..(136): Pfam Name: Mov34; Pfam Description: Mov34/MPN/PAD-1 family
  misc_feature (6)..(136): Pfam Name: Mov34; Pfam Description: Mov34/MPN/PAD-1 family
  misc_feature: Utility: Useful for increasing chlorophyll and photosynthetic capacity
  misc_feature: Utility: Useful for making ornamental plants with modified leaves
  misc_feature: Utility: Useful for making plants sterile and for genetic confinement
  misc_feature: Utility: Useful for making smaller plants
  misc_feature: Utility: Useful for making stronger plants
MAPSSSSGLTFKLHPLVIVNISDHYTRVKTQLNPPASICASGHGSNNGEAMFQQNPRVYGCVIGVQRGRTVEIFNSFELLYDPSTQTLDRSFLEKKQELYKKVFPDFYILGWYSTGSDAEESDMHIHKALMDINESPVYVLLNPAINHTQKDLPVTIYESELHVIDGIPQLIFAHTSYTIETVEAERISVDHVAHLKPSDGGSAATQLAAHLTGIHSAIKMLNSRIRVLYQNLAAMQKGDKSCDNSVLRQVSSLLRRLPAMESERFQDNFLMEYNDKLLITYLAMITNCSSNMNEMVDKFNTAYDRNTRRGGRTAFM

SEQ ID NO: 1385 - protein, 318 aa, Arabidopsis thaliana
  misc_feature (1)..(318): Public GI no. 17940314
  misc_feature: Utility: Useful for increasing chlorophyll and photosynthetic capacity
  misc_feature: Utility: Useful for making ornamental plants with modified leaves
  misc_feature: Utility: Useful for making plants sterile and for genetic confinement
  misc_feature: Utility: Useful for making smaller plants
  misc_feature: Utility: Useful for making stronger plants
MAPSSSSGLTFKLHPLVMLNISDHFTRVKTQLNPPAASCATGNGSNNADAMLLQNPRVYGCVIGLQRGRTVEIFNSFELIFDPALDTLDRSFLEKKQELYKKVFPDFYVLGWYSTGSDATESDMHIHKALMDINESPVYVLLNPAINHAQKDLPVTIYESEFHVIDGIPQSIFVHTSYTIETVEAERISVDHVAHLKPSDGGSAATQVAAHLTGIHSAIKMLNSRIRVLYQHIVAMQKGCDKPCENSVLRQVSSLLRSLPAAESEKFNENFLMEYNDKLLMSYLAMITNCTSNMNEVVDKFNTAYDKHSRRGGRTAFM

SEQ ID NO: 1386 - protein, 300 aa, Arabidopsis thaliana
  misc_feature (1)..(300): Ceres CLONE ID no. 36616
  misc_feature: Utility: Useful for increasing chlorophyll and photosynthetic capacity
  misc_feature: Utility: Useful for making ornamental plants with modified leaves
  misc_feature: Utility: Useful for making plants sterile and for genetic confinement
  misc_feature: Utility: Useful for making smaller plants
  misc_feature: Utility: Useful for making stronger plants
MLNISDHFTRVKTQLNPPAASCATGNGSNNADAMLLQNPRVYGCVIGLQRGRTVEIFNSFELIFDPALDTLDRSFLEKKQELYKKVFPDFYVLGWYSTGSDATESDMHIHKALMDINESPVYVLLNPAINHAQKDLPVTIYESEFHVIDGIPQSIFVHTSYTIETVEAERISVDHVAHLKPSDGGSAATQLAAHLTGIHSAIKMLNSRIRVLYQHIVAMQKGDKPCENSVLRQVSSLLRSLPAAESEKFNENFLMEYNDKLLMSYLAMITNCTSNMNEVVDKFNTAYDKHSRRGGRTAFM

SEQ ID NO: 1387 - protein, 329 aa, Arabidopsis thaliana
  misc_feature (1)..(329): Public GI no. 50947311
  misc_feature: Utility: Useful for increasing chlorophyll and photosynthetic capacity
  misc_feature: Utility: Useful for making ornamental plants with modified leaves
  misc_feature: Utility: Useful for making plants sterile and for genetic confinement
  misc_feature: Utility: Useful for making smaller plants
  misc_feature: Utility: Useful for making stronger plants
MSAPSDPAVATHPQAGAAAAASSSSGLTFKLHPLVIVNVSDHHTRVKAQAACSGDGASSAAAGGQPPRVFGCVIGVQRGRTVEIFNSFELVLDPVSGTLDRAFLEKKQELYKKVFPDFYVLGWYSTGSDVRDTDMQIHKALMDINESPVYLLLNPAINLSQKDLPVTIYESELHVIDGSPQLIFVRANYTIETVEAERISVDHVAHLKPSDGGSAATQLAAHLTGIHSAIKMLNSRVRVIHQYLVSMQKGDMPLDNSLLRQVSSLVRRLPAMESEKFQDDFLMEYNDTLLMTYLAMFTNCSSTMNELVEKFNATYERSTARRGGRGAFM

SEQ ID NO: 1388 - protein, 332 aa, Zea mays
  misc_feature (1)..(332): Ceres CLONE ID no. 328761
  misc_feature: Utility: Useful for increasing chlorophyll and photosynthetic capacity
  misc_feature: Utility: Useful for making ornamental plants with modified leaves
  misc_feature: Utility: Useful for making plants sterile and for genetic confinement
  misc_feature: Utility: Useful for making smaller plants
  misc_feature: Utility: Useful for making stronger plants
MSAPSDAAVAAAAPASTTTAAASSGGLTFKLHPLVIVNVSDHHTRVKAQAACSGDSSSPSSSAPGAGQPPRVFGCVIGVQRGRTVEIFNSFELVLDPVSGTLDRAFLDKKQELYKKVFPDFYVLGWYSTGSDVHDTDMLIHKSLMDINESPVYLLLNPTINLSQKDLPVTIYESELHVIDGIPQLIFVRSNYTIETVEAERISVDHVAHLKPSDGGSAATQLAAHLTGIHSAIKMLNSRVRVIHQYLVAMQKGDIPLDNSLLRQVSSLVRRLPAMESQKFQDDFLMEYNDTLLMTYLAMVTKCSSTMNELVEKINTSYERTTSRRGGRGAFM

SEQ ID NO: 1389 - DNA, 1420 bp, Arabidopsis thaliana
  misc_feature (1)..(1420): Ceres CLONE ID no. 152141
  misc_feature (1)..(1420): Also known as  Ceres CDNA ID no. 23471937
aaaatccgaaaaagaccaatcaatcctttctccctgaaatggcggcggctctgcagacgaatatccggacggtcaaggttccggctacgttcagagctgtaagtaaacagtcattggcaccctttagagtaagatgtgctgttgcttcccctgggaaaaaacgatacaccatcactctccttcccggagacggcatcggtccggaggttgtctccattgccaaaaatgtgcttcagcaagctggatctttggaaggtgtggaatttaacttccgtgagatgcccattggaggagctgctttggatttggtcggagtgcccttgccggaggagactatctcagctgcaaaagaatcagatgcagtgcttcttggagccattggagggtacaaatgggataacaatgaaaaacatctgaggcctgagaaggggttacttcagattcgtgcagctctcaaagtctttgcaaatctgagacctgctacagttctcccacagttagtggatgcttccaccttaaagagagaggtagcagaaggtgttgatctaatggttgtaagggagcttacaggaggtatttactttggagagccaaggggcataaagaccaatgaaaatggcgaggaagttgggtttaatactgaggtttatgctcacgagattgatagaattgctcgtgttgccttcgagactgctcggaaacggcgtggcaagctgtgttctgttgacaaagctaatgttttggaagcctcaatcttatggaggaaacgagtaacagcattagcctctgaatatcctgatgttgagctgtcacatatgtatgttgacaatgccgcgatgcagcttgttcgtgacccaaaacagtttgacaccatcgtcacaaacaacatttttggtgatatattatccgatgaagcttcaatgatcacaggaagcataggaatgctgccatctgctagtctcagtgattcgggacctggactctttgaacctatacatggttctgcacctgatattgctggacaggataaggcaaacccattggcaaccattctaagcgctgcaatgcttctgaaatacggacttggagaagaaaaggcagccaagagaattgaagacgcagtgttggttgctctgaacaacggattcagaactggagacatatactccgcgggaacaaaactggtgggctgcaaggagatgggagaggaggttctgaagtcagtggactcccaagttccagcttctgtttaatatttgtagaaactttgaagagttcatttccaacaacaaatgttgtaccttgtactcaaagagtctcggtttcattagcgatttttataatgtgagattattagagggacttatttgatcgaactgaaacgttggtgtttttttctgagaaataaatatccttgtgg

SEQ ID NO: 1390 - protein, 404 aa, Arabidopsis thaliana
  misc_feature (44)..(392): Pfam Name: Iso_dh; Pfam Description: Isocitrate/isopropylmalate dehydrogenase
  misc_feature: Utility: Useful for increasing chlorophyll and photosynthetic capacity
  misc_feature: Utility: Useful for making lethal plants for genetic confinement systems
  misc_feature: Utility: Useful for making smaller plants
MAAALQTNIRTVKVPATFRAVSKQSLAPFRVRCAVASPGKKRYTITLLPGDGIGPEVVSIAKNVLQQAGSLEGVEFNFREMPIGGAALDLVGVPLPEETISAAKESDAVLLGAIGGYKWDNNEKHLRPEKGLLQIRAALKVFANLRPATVLPQLVDASTLKREVAEGVDLMVVRELTGGIYFGEPRGIKTNENGEEVGFNTEVYAHEIDRIARVAFETARKRRGKLCSVDKANVLEASILWRKRVTALASEYPDVELSHMYVDNAAMQLVRDPKQFDTIVTNNIFGDILSDEASMITGSIGMLPSASLSDSGPGLFEPIHGSAPDIAGQDKANPLATILSAAMLLKYGLGEEKAAKRIEDAVLVALNNGFRTGDIYSAGTKLVGCKEMGEEVLKSVDSQVPASV

SEQ ID NO: 1391 - protein, 406 aa, Brassica napus
  misc_feature (1)..(406): Ceres CLONE ID no. 1107090
  misc_feature: Utility: Useful for increasing chlorophyll and photosynthetic capacity
  misc_feature: Utility: Useful for making lethal plants for genetic confinement systems
  misc_feature: Utility: Useful for making smaller plants
MAAALQTNIRPVKFPATLRALTKQSSPAPFRVRCAAASPGKKRYNITLLPGDGIGPEVISIAKNVLQQAGSLEGLEFSFQEMPVGGAALDLVGVPLPEETVSAAKESDAVLLGAIGGYKWDKNEKHLKPETGLLQLRAGLKVFANLRPATVLPQLVDASTLKREVAEGVDLMVVRELTGGIYFGVPRGIKTNENGEEVGYNTEVYAAHEIDRIARVAFETARKRRGKLCSVDKANVLDASILWRRRVTALAAEYPDVELSHMYVDNAAMQLVRDPKQFDTIVTNNIFGDILSDEASMITGSIGMLPSASLSDSGPGLFEPIHGSAPDIAGQDKANPLATILSAAMLLKYGLGEEKAAKRIEDAVLGALNKGFRTGDIYSAGTKLVGCKEMGEEVLKSVDSHVQASV

SEQ ID NO: 1392 - protein, 406 aa, Brassica napus; identical to SEQ ID NO: 1391
  misc_feature (1)..(406): Public GI no. 17827
  misc_feature: Utility: Useful for increasing chlorophyll and photosynthetic capacity
  misc_feature: Utility: Useful for making lethal plants for genetic confinement systems
  misc_feature: Utility: Useful for making smaller plants

SEQ ID NO: 1393 - protein, 325 aa, Arabidopsis thaliana
  misc_feature (1)..(325): Ceres CLONE ID no. 95686
  misc_feature: Utility: Useful for increasing chlorophyll and photosynthetic capacity
  misc_feature: Utility: Useful for making lethal plants for genetic confinement systems
  misc_feature: Utility: Useful for making smaller plants
MPVGGAALDLVGVPLREETFTAAKLSDAILLGAIGGYKWDKNEKHLRPEMALFYLRRDLKVFANLRPATVLPQLVDASTLKKEVAEGVDMMIVRELTGGIYFGEPRGITINENGEEVGVSTEIYAAHEIDRIARVAFETARKRRGKLCSVDKANVLDASILWRKRVTALASEYPDVELSHMYVDNAAMQLIRDPKQFDTIVTNNIFGDILSDEASMITGSIGMLPSASLGESGPGLFEPIHGSAPDIAGQDKANPLATILSAAMLLKYGLGEEKAAKRIEDAVVDALNKGFRTGDIYSPGNKLVGCKEMGEEVLKSVESKVPATV

SEQ ID NO: 1394 - protein, 404 aa, Arabidopsis thaliana
  misc_feature (1)..(404): Ceres CLONE ID no. 34420
  misc_feature: Utility: Useful for increasing chlorophyll and photosynthetic capacity
  misc_feature: Utility: Useful for making lethal plants for genetic confinement systems
  misc_feature: Utility: Useful for making smaller plants
MAAFLQTNIRLEIIPGRYSSLTDHKFRAPYRIRCAAASPVKKRYNITLLPGDGIGPEVISVAKNVLQKAGFLQGLEFDFQEMPFGGAALDLVGVPLPEETSTAAKQSDAILLGAIGGYKWDKNEKHLRPEMGLLNIRRDLNVFANLRPATVLPQLVDASTLKKEVAQGVDMMIVRELTGGIYFGEPRGITINENGEEVGFNTEIYAAHEIDRIARVAFETARKRRGKLCSVDKANVLDASILWRKRVTALASEYPDVELSHMYVDNAAMQLVRDPKQFDTIVTNNIFGDILSDEASMITGSIGMLPSASLGESGPGLFEPIHGSAPDIAGQDKANPLATILSAAMLLKYGLGEEKAAKMIEDAVVDALNKGFRTGDIYSPGNKLVGCKEMGEEVLKSVDSKVPV

SEQ ID NO: 1395 - protein, 404 aa, Arabidopsis thaliana; identical to SEQ ID NO: 1394
  misc_feature (1)..(404): Public GI no. 15221631
  misc_feature: Utility: Useful for increasing chlorophyll and photosynthetic capacity
  misc_feature: Utility: Useful for making lethal plants for genetic confinement systems
  misc_feature: Utility: Useful for making smaller plants

SEQ ID NO: 1396 - protein, 406 aa, Arabidopsis thaliana
  misc_feature (1)..(406): Public GI no. 4512615
  misc_feature: Utility: Useful for increasing chlorophyll and photosynthetic capacity
  misc_feature: Utility: Useful for making lethal plants for genetic confinement systems
  misc_feature: Utility: Useful for making smaller plants
MAAFLQTNIRLEIIPGRYSSLTDHKFRAPYRIRCAAASPVKKRYNITLLPGDGIGPEVISVAKNVLQKAGFLQGLEFDFQEMPFGGAALDLVGVPLPEETSTAAKQSDAILLGAIGGYKWDKNEKHLRPEMGLLNIRRDLNVFANLRPATVLPQLVDASTLKKEVAQGVDMMIVRELTGGIYFGEPRGITINENGEEVGFNTEIYAAHEIDRIARVAFETARKRRGKLCSVDKANVLDASILWRKRVTALASEYPDVELSHMYVDNAAMQLVRDPKQFDTIVTNNIFGDILSDEASMITGSIGMLPSASLGESGPGLFEPIHGSAPDIAGQDKANPLATILSAAMLLKYGLGEEKAAKMIEDAVVDALNKGFRTGDIYSPGNVCKLVGCKEMGEEVLKSVDSKVPV

SEQ ID NO: 1397 - protein, 409 aa, Arabidopsis thaliana [sequence omitted]

SEQ ID NO: 1398 - protein, 404 aa, Arabidopsis thaliana
  misc_feature (1)..(404): Public GI no. 21592944
  misc_feature: Utility: Useful for increasing chlorophyll and photosynthetic capacity
  misc_feature: Utility: Useful for making lethal plants for genetic confinement systems
  misc_feature: Utility: Useful for making smaller plants
  misc_feature (267)..(267): Xaa is any aa, unknown, or other
MAAFLQTNIRLEIIPGRYSSLTDHKFRAPYRIRCAAASPVKKRYNITLLPGDGIGPEVISVAKNVLQKAGFLQGLEFDFQEMPFGGAALDLVGVPLPEETSTAAKQSDAILLGAIGGYKWDKNEKHLRPEMGLLNIRRDLNVFANLRPATVLPQLVDASTLKKEVAQGVDMMIVRELTGGIYFGEPRGITINENGEEVGFNTEIYAAHEIDRIARVAFETARKRRGKLCSVDKANVLDASILWRKRVTALASEYPDVELSHMYVDNXAMQLVRDPKQFDTIVTNNIFGDILSDEASMITGSIGMLPSASLGESGPGLFEPIHGSAPDIAGQDKANPLATILSAAMLLKYGLGEEKAAKMIEDAVVDALNKGFRTGDIYSPGNKLVGCKEMGEEVLKSVDSKVPV

SEQ ID NO: 1399 - protein, 409 aa, Arabidopsis thaliana
  misc_feature (1)..(409): Public GI no. 18377879
  misc_feature: Utility: Useful for increasing chlorophyll and photosynthetic capacity
  misc_feature: Utility: Useful for making lethal plants for genetic confinement systems
  misc_feature: Utility: Useful for making smaller plants
MAAFLQTNISLNAIKIVPGKYSSLTDHQFRAPYRIRCAAASPGKKRYNIALLPGDGIGPEVISVAKNVLQKAGSLEGLEFDFKEMPVGGAALDLVGVPLPEETFTAAKLSDAILLGAIGGYKWDKNEKHLRPEMALFYLRRDLKVFANLRPATVLPQLVDASTLKKEVAEGVDMMIVRELTGGIYFGEPRGITINENGEEVGVSTEIYAAHEIDRIARVAFETARKRRGKLCSVDKANVLDASILWRKRVAALASEYPDVELSHMYVDNAAMQLIRDPKQFDTIVTNNIFGDILSDEASMITGSIGMLPSASLGESGPGLFEPIHGSAPDIAGQDKANPLATILSAAMLLKYGLGEEKAAKRIEDAVVDALNKGFRTGDIYSPGNKLVGCKEMGEEVLKSVESKVPATV

SEQ ID NO: 1400 - protein, 378 aa, Zea mays
  misc_feature (1)..(378): Ceres CLONE ID no. 325158
  misc_feature: Utility: Useful for increasing chlorophyll and photosynthetic capacity
  misc_feature: Utility: Useful for making lethal plants for genetic confinement systems
  misc_feature: Utility: Useful for making smaller plants
MAASFRCSAAARSYNITLLPGDGIGPEVVAVAKDVLSLAGALEGVELRFQEKLVGGSALDATGVPLPDETLDAAKGSDAVLLGAIGGYKWDNNEKHLKPETGLLQLRAGLGVFANLRPAAVLPQLVDASTLKKEVAEGVDIMVVRELTGGIYFGKPRGFGTNDNGDDIGFNTEVYPASEIDRIARVAFEVARKRRGRLCSVDKANVLEASMLWRKRVTALASEFPDIELSHMYVDNAAMQLVRNPKQFDTIVTNNIFGDILSDEASMITGSIGMLPSASVGESGPGLFEPIHGSAPDIAGQDKANPLATILSAAMLLRYGLGEENAANRIEAAVTETLNHGFRTGDIYSPGTTLVGCKRMGEEVLKTVNSLKEVAAVN

SEQ ID NO: 1401 - protein, 328 aa, Glycine max
  misc_feature (1)..(328): Ceres CLONE ID no. 545212
  misc_feature: Utility: Useful for increasing chlorophyll and photosynthetic capacity
  misc_feature: Utility: Useful for making lethal plants for genetic confinement systems
  misc_feature: Utility: Useful for making smaller plants
  misc_feature (240)..(240): Xaa is any aa, unknown, or other
MLMGGAALDATGLPLPHETLSAAKQSHAVLLGAVGGYKWDRNDKHLKPETGLLQIRKELGVFANLRPATVYSPLVDASTLKREVAEGVDIMLIRELTGGIYFGEPRGFGTNDNGEEIGFNTEIYATHEIDRIAHFAFKVAQKRRRKLCSVDKANVLEASMLWRKRFLAIAQEYPDVELSHMYVDNASMQLIRDPKQFDTMVTNNIFGDILSDEASMVTGSIGMLPSASLGASGPGLFEPXHGSAPDIAGQDKANPFATVLSAAMLLRYGLGEEKAAERIENAVMDTLNRGFRTGDIYSAGTKLVGCKQLGEEILKSVESNVPAGAAAV

SEQ ID NO: 1402 - protein, 409 aa, Zea mays
  misc_feature (1)..(409): Ceres CLONE ID no. 279689
  misc_feature: Utility: Useful for increasing chlorophyll and photosynthetic capacity
  misc_feature: Utility: Useful for making lethal plants for genetic confinement systems
  misc_feature: Utility: Useful for making smaller plants
MAAALQATPIKTLATSRWRVEGAEARPRPRPIAVSFRCSAAARSYNITLLPGDGIGPEVVAVAKDVLSFAGALEGVELRFQEKLVGGSALDATGVPLPDETLDEAKGSDAVLLGAIGGYKWDTNEKHLKPETGLLQLRAGLGVFANLRPAAVLPQLVDASTLKKEVAEGVDIMVVRELTGGIYFGKPRGFGTNDKGDDIGFNTEVYSASEIDRIARVAFEVARKRRGKLCSVDKANVLEASMLWRKKVTALASEFPDIELSHMYVDNAAMQLVRNPKQFDTIVTNNIFGDILSDEASMITGSIGMLPSASVGESGPGLFEPIHGSAPDIAGQDKANPLATILSAAMLLRYGLGEENAARRIEAAVTETLNHGFRTGDIYSPGTTLVGCKRMGEEVLKTVESLKEVAAVN

SEQ ID NO: 1403 - DNA, 1191 bp, Arabidopsis thaliana
  misc_feature (1)..(1191): Ceres CLONE ID no. 157730
  misc_feature (1)..(1191): Also known as  Ceres CDNA ID no. 23477461
gaaatcctagctgaagtctatgctccataatcaaatccagttcatcagagatcaaagatggctattgcacgaactggagtttatgttgatgattaccttgagtagctacaaagattactaaacacagttcgcgaactagacgagagatctcaatcgcttataaatcagacaagacagcaaactaagtattgcttagggcttgcttcacagagttctaaaaagggtaatggtaatcattacaataatggtggtcttgatgaagaggaaacgattgagaaaatgcgtaaagagattgagtctagtcaggaaaatgcgttaagtttgtgtaccgagaaggttttattggcccgacaagcgtatgatcttatagatagtcatgtaaaacgacttgatgaagatctgaataattttgcagaagatttaaagcaagagggaaaaattccaccagacgagccctctgttcttcctccactacctatagttcctaaagcggaaaagcgtaagtccttctatggcacacctcagcccaagaagattgattatagagatagagactgggatcgtgacagggattttgagctcatgcctcctccaggaagcaatcggaaagaccttatgccaattgaagagcagccaatcgatccaaacgaaccaacttactgtgtctgccatcaggtgtcctttggagacatgattgcctgtgacaatgagcaattgccaaggaggtgaatggtttcactatacatgcgttggcctcacacctgagaccagattcaaagggaaatggtactgccccacctgcagactcctcccacagtcacactaatatcatttgtacctgtgagaaggtgccactggcatcttctttggcaccttcccttcatgaccaatgccaccaaactcatctttcttgttacccaacatctagcaagtgcaagtagaagcaaactttagatggagaaatcatcatgttttgtaaacctcgggttaattcgtggagcatatattttgtatatcaattgtatttgggtattggtgggcattttccgttttattctactagtatcgatatttacatctgcttctttctttcttttttcccctcaaaccatgagcctttgtattgatcaaatgacatgtacaaaggttttgttcatcagaaggaatttcactaaaataaaaaattgcttg

SEQ ID NO: 1404 - protein, 15 aa, Arabidopsis thaliana
  misc_feature (208)..(258): Pfam Name: PHD; Pfam Description: PHD-finger
  misc_feature (208)..(258): Pfam Name: PHD; Pfam Description: PHD-finger
  misc_feature: Utility: Useful for increasing chlorophyll and photosynthetic capacity
  misc_feature: Utility: Useful for making larger plants
  misc_feature: Utility: Useful for making ornamental plants with modified flowers
  misc_feature: Utility: Useful for making plants sterile and for genetic confinement
  misc_feature: Utility: Useful for making taller plants and plants with longer inflorescences
MAIARTGVYVDDYLE

SEQ ID NO: 1405 - protein, 242 aa, Glycine max
  misc_feature (1)..(242): Ceres CLONE ID no. 537600
  misc_feature: Utility: Useful for increasing chlorophyll and photosynthetic capacity
  misc_feature: Utility: Useful for making larger plants
  misc_feature: Utility: Useful for making ornamental plants with modified flowers
  misc_feature: Utility: Useful for making plants sterile and for genetic confinement
  misc_feature: Utility: Useful for making taller plants and plants with longer inflorescences
MSFLEEFQANLDSLPVILQKKYALLRDLDKSLHDIQRQNEQRCEQEIEDIRRGVRSGNITPDTSVIRFSDEALDEQNHSIRVADEKVALAVQAYDLVDTHIQHLDQYLKRFGEEIRRERENAAITGVPASGSEGNTKSGRGNESGTGRGGRKKTRQTTVTPAATEAQATANPTGMDLELPVDPNEPTYCFCNQVSYGAMVACDNPNCKIEWFHFGCVGLKEQPKGKWYCSNCAATKNRRRGK

SEQ ID NO: 1406 - protein, 239 aa, Glycine max
  misc_feature (1)..(239): Ceres CLONE ID no. 473923
  misc_feature: Utility: Useful for increasing chlorophyll and photosynthetic capacity
  misc_feature: Utility: Useful for making larger plants
  misc_feature: Utility: Useful for making ornamental plants with modified flowers
  misc_feature: Utility: Useful for making plants sterile and for genetic confinement
  misc_feature: Utility: Useful for making taller plants and plants with longer inflorescences
MSFLEEFHANLDSLPVILRKKYTLLRDLDKSLQDIKRQNEQRCEQEIEDIKRGVRSGNITPDTSAIRFSDEALDEQKHSIRVADEKVALAVQAYDLVDTNIQQLDQYLKKFDEEIRRERENAAITGVPASGPEGNTKSGRGNESGTGRGGRKKTRQTTMVTEAQATSNPTGMDLELPVDPNEPTYCFCNQVSYGAMVACDNPNCKIEWFHFGCVGLKEQPKGKWYCSNCAATKNRRRSK

SEQ ID NO: 1407 - protein, 258 aa, Triticum aestivum
  misc_feature (1)..(258): Ceres CLONE ID no. 704991
  misc_feature: Utility: Useful for increasing chlorophyll and photosynthetic capacity
  misc_feature: Utility: Useful for making larger plants
  misc_feature: Utility: Useful for making ornamental plants with modified flowers
  misc_feature: Utility: Useful for making plants sterile and for genetic confinement
  misc_feature: Utility: Useful for making taller plants and plants with longer inflorescences
MAIARTGVYVDDYLEYSSTLAGDLQRILSTMHELDERAHGILGQTKGQIKYLLGVPSHGFDRPNVVHDENASEKMTRDIENSQDNALSLCTEKVLLARQAYDLIESHIKRLDEDLGQFAEDLKQEGKIPPDEPHILPPMPVGGRDERRRSSFSTPQAARKFVREKEWDRDRERGMDFDLMPPPGSSNKKAVASMDVDQMIDPNEPTYCICHQVSYGDMIACDNENCEGGEWFHYSCVGLTPETRFKGKWFCPTCRNLQ

SEQ ID NO: 1408 - protein, 243 aa, Triticum aestivum
  misc_feature (1)..(243): Public GI no. 50918691
  misc_feature: Utility: Useful for increasing chlorophyll and photosynthetic capacity
  misc_feature: Utility: Useful for making larger plants
  misc_feature: Utility: Useful for making ornamental plants with modified flowers
  misc_feature: Utility: Useful for making plants sterile and for genetic confinement
  misc_feature: Utility: Useful for making taller plants and plants with longer inflorescences
MAIARTGVYVDDYLEYSSTLAGDLQRILSTMRELDERAHGIMGQTKEQIKYLLGVPSHGFDRSNMDDDESASERMKKDIEASQDNALSLCTEKVLLARQAYDLIESHIKRLDEDLGQFAEDLKQEGKIPPDEPSILPAISAFSRDDKRRPGFSTPQATKKFREREWDRERGMDFDLMPPPGSNKKTTAPMDVDQTIDPNEPTYCICHQISYGDMIACDNDNVIIIFFTPNELYISVEQSGKLN

SEQ ID NO: 1409 - DNA, 748 bp, Zea mays
  misc_feature (1)..(748): Ceres CLONE ID no. 221477
  misc_feature (1)..(748): Also known as  Ceres CDNA ID no. 23741964
tcgctagcccagctttagtttatagcactctctcactcagtagtcagctccctccatttgtccattctccaaaggtagttagctaggttaggcacacgcgcgccactcgactagctagcagctatggagggagaagatgacggcgcccaaatgaaactgcagcaacaacaacagtcgccttgcagtgacaacttgagcttgtccgccgcctcctcatggctgccgccacaggtaaggtcgtcgtcgtcgtcgtcgtcgtacacctgcgggtattgcaagaaggagttcagatcagcacaagggctgggaggccacatgaacatccacaggctggacagggccagactgatccaccaacagtacacttcacaccgtattgctgctccccatccaaaccctaatcctagttgcacatcagttcttgaccttgagctcagcttgtcgtcgctgctagcgcatggtgctgccagcagcgacggaggcttgtctgttccagtggcaaagctggcgggcaaccgtttctcctccgcatcgctccccacgaccaaggacgtcgaggggaagaacttagagttgaggataggagcgtgcagtcatggcgatggcgcggaagagcgtctggatcttcagcttagactgggctactactgagccagacagaggaacgaactgctacaatgggtacgtgcagtgcatgatgatggaatgactggctttgtcrtmataataatgatgatccgattattgc

SEQ ID NO: 1410 - protein, 175 aa, Zea mays
  misc_feature (46)..(68): Pfam Name: zf-C2H2; Pfam Description: Zinc finger, C2H2 type
  misc_feature (46)..(68): Pfam Name: zf-C2H2; Pfam Description: Zinc finger, C2H2 type
  misc_feature: Utility: Useful for increasing chlorophyll and photosynthetic capacity
  misc_feature: Utility: Useful for modifying seed structure and content
MEGEDDGAQMKLQQQQQSPCSDNLSLSAASSWLPPQVRSSSSSSSYTCGYCKKEFRSAQGLGGHMNIHRLDRARLIHQQYTSHRIAAPHPNPNPSCTSVLDLELSLSSLLAHGAASSDGGLSVPVAKLAGNRFSSASLPTTKDVEGKNLELRIGACSHGDGAEERLDLQLRLGYY

SEQ ID NO: 1411 - DNA, 933 bp, Zea mays
  misc_feature (1)..(933): Ceres CLONE ID no. 225597
  misc_feature (1)..(933): Also known as  Ceres CDNA ID no. 23751584
gcaaaaggcattcgttcgttcataaacatcgcctgaacaccaaagtcaccctccagcagtttcgctttcttgcttcaccctgcgatcgagatcgagctcaacaaccatggaggatttagtgagtagcccatctttcaggagcgtcctcagcagcagtagcgaagggcaggctcagtcaggagagagttcttggacggattacttcgtggatttcatgttatccgaggaggagaggaagagacaggcagatgctagctcatactcatactgcgctaccgaagacgaaggcgggcagcaaatacggtggcgatggaagcaaccgcgatgaggaggaggaggaagaggaggagtccatggtctccgatgccgcctctcatgcccctacgactgcaggcgccaccgcactgataccagctggcaggtacaaggagctgaagaagctcaagaaaaagcctttcggcaaagccctggaccatgacggttccctggaggatactgcgagctctccggtgaatagcccaaaggtcagtgttgtgtcacdagctggaattgagtcctaaaaggaggtgcaacatcagggacctcaccaagggagtcgttggaattggcgatgatcacggcggggaggggatggacgtctgtacagatgcaacgaccacggaaggagcgaggcttggtgatcagtaccacacgagcatagctccatgtgcggagctgaaggacaaggggatttgtttgttccccttttccgtgctgctgcactaccatgggccaaactgaggaaaaaaacaatatgcgaatgaacagcatatgtagtgtttcgcaacttacactctatgcgcgcatgcatgtgtggtatgaacgaatgcaagaagaatgtgatactgtggatatatatatgtttttccttaatgaatatatgtgaatattact

SEQ ID NO: 1412 - protein, 223 aa, Zea mays
  misc_feature: Utility: Useful for increasing chlorophyll and photosynthetic capacity
  misc_feature: Utility: Useful for making plants sterile and for genetic confinement
  misc_feature: Utility: Useful for making plants with increased biomass and foliage
  misc_feature: Utility: Useful for making smaller plants
  misc_feature: Utility: Useful for making stronger plants
MEDLVSSPSFRSVLSSSSEGQAQSGESSWTDYFVDFMLSEEERKRQADASSYSYCATEDEGGSKYGGDGSNRDEEEEEEEESMVSDAASHAPTTAGATALIPAGRYKELKKLKKKPFGKALDHDGSLEDTASSPVNSPKVSVVSQLELSPKRRCNIRDLTKGVVGIGDDHGGEGMDVCTDATTTEGARLGDQYHTSIAPCAELKDKGICLFPFSVLLHYHGPN

SEQ ID NO: 1413 - protein, 212 aa, Zea mays
  misc_feature (1)..(212): Public GI no. 50937881
  misc_feature: Utility: Useful for increasing chlorophyll and photosynthetic capacity
  misc_feature: Utility: Useful for making plants sterile and for genetic confinement
  misc_feature: Utility: Useful for making plants with increased biomass and foliage
  misc_feature: Utility: Useful for making smaller plants
  misc_feature: Utility: Useful for making stronger plants
MRSAIISCSSTSEDQQAAAAAQAQPEESTWTDYFVDFMMSEEEKKSQEDHGASSYCSHGGDGVYGDCSDQKELEEEEGEEDSMISDAASCAPAAAALPDRYKELKKLKKKVFKALDHDDSLEDTASSPVNSPKVSALTQLELSPKRRCNTRDLTKEVGIGDDRGREGMDYADAMVEGVRFVDQSQKSVTPCGELKDKGLCLFPLSMLLHYHG

SEQ ID NO: 1414 - protein, 191 aa, Triticum aestivum
  misc_feature (1)..(191): Ceres CLONE ID no. 839318
  misc_feature: Utility: Useful for increasing chlorophyll and photosynthetic capacity
  misc_feature: Utility: Useful for making plants sterile and for genetic confinement
  misc_feature: Utility: Useful for making plants with increased biomass and foliage
  misc_feature: Utility: Useful for making smaller plants
  misc_feature: Utility: Useful for making stronger plants
  misc_feature (44)..(44): Xaa is any aa, unknown, or other
  misc_feature (46)..(46): Xaa is any aa, unknown, or other
  misc_feature (51)..(51): Xaa is any aa, unknown, or other
  misc_feature (91)..(91): Xaa is any aa, unknown, or other
  misc_feature (97)..(97): Xaa is any aa, unknown, or other
  misc_feature (103)..(103): Xaa is any aa, unknown, or other
  misc_feature (151)..(151): Xaa is any aa, unknown, or other
  misc_feature (160)..(160): Xaa is any aa, unknown, or other
  misc_feature (175)..(175): Xaa is any aa, unknown, or other
  misc_feature (182)..(182): Xaa is any aa, unknown, or other
MDDLVSSSSLKSVLSCSEAEAQPEESSWTDYFVDFMMSEEEEKXQXASYCXFDQDDEEEGSMISDAASLAPAALADRYKGLKKLKKKVFKXLDHDDXLEDTAXSPVNSPKVSALSQLEFSPKIRCNVTDLAKGAGIGNYYGRDGIDCEDAXAVMEGVRFXDQSQRGITPCAELKXKGLCLVXLSMLLNYQG

SEQ ID NO: 1415 - DNA, 485 bp, Arabidopsis thaliana
  misc_feature (1)..(485): Ceres CLONE ID no. 264705
  misc_feature (1)..(485): Also known as  Ceres CDNA ID no. 23383772
actttttccggcttcattttctagctcttacaatggcttctagattcatgagcagatcctctatctcgtctctcaaatccgccattagatcttcatttcgaaattctcccattggcactggatcttctccggctgctgcttcattcgccggatttcgtattccgtctaaaccagctgcttctcctcttccccgattctccttctccaggtgtccgtcggagcttggttgtgttcagtctctgttaccgctacacagcacggtggcggctgcgcggttgacgtcatgcttaagcacaacttccagaagcagccgagctctcactcaggagatgggactttcagtcccaaggtgacaagatacattcatgaagagtattactattgagggatgcaagtttcttctctaaacttagagactagaatttgttttttgtgttatgactccaaacttatgttctttgattcatgaagggaaaaaatgtaat

SEQ ID NO: 1416 - protein, 106 aa, Arabidopsis thaliana
  misc_feature: Utility: Useful for increasing chlorophyll and photosynthetic capacity
  misc_feature: Utility: Useful for making smaller plants
MASRFMSRSSISSLKSAIRSSFRNSPIGTGSSPAAASFAGFRIPSKPAASPLPRFSFSRCPSELGCVQSLLPLHSTVAAARLTSCLSTTSRSSRALTQEMGLSVPR

SEQ ID NO: 1417 - protein, 100 aa, Arabidopsis thaliana
  misc_feature (1)..(100): Ceres CLONE ID no. 108581
  misc_feature: Utility: Useful for increasing chlorophyll and photosynthetic capacity
  misc_feature: Utility: Useful for making smaller plants
MASRFMSRSSVSSLKSAIRSSFRNSPIGTGSSPAAASFAGFRIPSKPAASPLPRFSFSRCPSELGCVQSLLPLHSTVAAARLTSCLSTTSRSSRALTQGT

SEQ ID NO: 1418 - protein, 104 aa, Arabidopsis thaliana
  misc_feature (1)..(104): Ceres CLONE ID no. 28462
  misc_feature: Utility: Useful for increasing chlorophyll and photosynthetic capacity
  misc_feature: Utility: Useful for making smaller plants
MASRFMSRSSVSSLKSAIRSSFRNSPIGTGSSPAAASFAGFRIPSKPAASPLPRFSFSRCPSELGCVQSLLPLHSTVAAARLTSCLSTTSRSSRALTQDGIDDT

SEQ ID NO: 1419 - protein, 104 aa, Arabidopsis thaliana; identical to SEQ ID NO: 1418
  misc_feature (1)..(104): Ceres CLONE ID no. 33570
  misc_feature: Utility: Useful for increasing chlorophyll and photosynthetic capacity
  misc_feature: Utility: Useful for making smaller plants

SEQ ID NO: 1420 - protein, 108 aa, Brassica napus
  misc_feature (1)..(108): Ceres CLONE ID no. 979674
  misc_feature: Utility: Useful for increasing chlorophyll and photosynthetic capacity
  misc_feature: Utility: Useful for making smaller plants
MASACNRFMNRSSVSSLRSAIRSSLHKSPIGTGSSPSASSAGFRIPSKPAASPRFSFSRCPSELGCAQSLLPLHSTVAAARLTSCLSVTSRNSRALSQGTLCCTSPDL

SEQ ID NO: 1421 - protein, 101 aa, Brassica napus
  misc_feature (1)..(101): Ceres CLONE ID no. 977919
  misc_feature: Utility: Useful for increasing chlorophyll and photosynthetic capacity
  misc_feature: Utility: Useful for making smaller plants
  misc_feature (8)..(8): Xaa is any aa, unknown, or other
MASACCNXFMNRSSVSSLRSAIRSALHKSPVGTGTPPSASSAGFRIPSKPAASPRFSFSRCPSELGCVQSLLPLHSTVAAARLTSCLSVTSRSSRALSQGT

SEQ ID NO: 1422 - protein, 102 aa, Brassica napus
  misc_feature (1)..(102): Ceres CLONE ID no. 1068835
  misc_feature: Utility: Useful for increasing chlorophyll and photosynthetic capacity
  misc_feature: Utility: Useful for making smaller plants
MASACNRFINRSSVSSLRSAIRSSLHKSPTGIGSSSAGFRIPSKPAASPRFSFSRCPSELGCAQSLLPLHSTVAAARLTSCLSVTSRNSRALSQEMGLSVPR

SEQ ID NO: 1423 - protein, 104 aa, Brassica napus
  misc_feature (1)..(104): Ceres CLONE ID no. 1118546
  misc_feature: Utility: Useful for increasing chlorophyll and photosynthetic capacity
  misc_feature: Utility: Useful for making smaller plants
MASACNRFINRSSVSSLRSAIRSSLHKSPIGPGSSSAGFRIPSKPAASPRFSFSRCPSELGCAQSLLPLHSTVAAARLTSCLSVTSRNSRALSQGTLCCTSPDL

SEQ ID NO: 1424 - protein, 100 aa, Brassica napus
  misc_feature (1)..(100): Ceres CLONE ID no. 967899
  misc_feature: Utility: Useful for increasing chlorophyll and photosynthetic capacity
  misc_feature: Utility: Useful for making smaller plants
MASACNRFINRSSVSSLRSAVRSALHKSPIGTGTPPSASSAGFRIPSKPAASPRFSFFRCPSELGCVQSLLPLHSTVAAARLTSCLSVTSRSSRALSQGT

SEQ ID NO: 1425 - protein, 100 aa, Brassica napus
  misc_feature (1)..(100): Ceres CLONE ID no. 953793
  misc_feature: Utility: Useful for increasing chlorophyll and photosynthetic capacity
  misc_feature: Utility: Useful for making smaller plants
  misc_feature (29)..(29): Xaa is any aa, unknown, or other
  misc_feature (30)..(30): Xaa is any aa, unknown, or other
MASACNRFINRSSVSSLRSAIRSSLHKSXXGIGSSSAGFRIPSKPAASPRFSFSRCPSELGCAQSLLPLHSTVAAARLTSCLSVTSRNSRALSQDGIDGT

SEQ ID NO: 1426 - protein, 92 aa, Zea mays
  misc_feature (1)..(92): Ceres CLONE ID no. 1063637
  misc_feature: Utility: Useful for increasing chlorophyll and photosynthetic capacity
  misc_feature: Utility: Useful for making smaller plants
MASTCFRAAARVASAAGRSAAATRSAPSAARAAAAAHRASSFSRMPVELGCCAGLSLLPLHSAVAAARLTSRLSTASSCRALSQEMGLSVRR

SEQ ID NO: 1427 - protein, 94 aa, Glycine max
  misc_feature (1)..(94): Ceres CLONE ID no. 1104229
  misc_feature: Utility: Useful for increasing chlorophyll and photosynthetic capacity
  misc_feature: Utility: Useful for making smaller plants
MASACSRIAQRTSISSIKSAIKSNIRASSFSKPASSSSPLRQSLLTRISPELRCAQSMLPLHSAVAAARMTSCLSVTSRSCRALSQELGLSVPR

SEQ ID NO: 1428 - protein, 96 aa, Glycine max
  misc_feature (1)..(96): Ceres CLONE ID no. 604258
  misc_feature: Utility: Useful for increasing chlorophyll and photosynthetic capacity
  misc_feature: Utility: Useful for making smaller plants
MASACSRIAQRTSISSIKSAIKSNIRASSFSKPASSSSPLRQSLLTRISPELRCAQSMLPLHSAVAAARMTSCLSVTSRSCRALSQGTLCCTSPGL

SEQ ID NO: 1429 - protein, 89 aa, Glycine max
  misc_feature (1)..(89): Ceres CLONE ID no. 682422
  misc_feature: Utility: Useful for increasing chlorophyll and photosynthetic capacity
  misc_feature: Utility: Useful for making smaller plants
MASACSRIAQRTSISSIRSSIKSNIRASSSFSKPASSSSPLRQSLLTRISAELRCAQSMLPLHSAVAAARMTSRLSVTSRSCRALSQGT

SEQ ID NO: 1430 - protein, 97 aa, Glycine max
  misc_feature (1)..(97): Ceres CLONE ID no. 620922
  misc_feature: Utility: Useful for increasing chlorophyll and photosynthetic capacity
  misc_feature: Utility: Useful for making smaller plants
MASACSRIAQRTSISSIRSSIKSNIRASSSFSKPASSSSPLRQSLLTRISAELRCAQSMLPLHSAVAAARMTSRLSVTSRSCRALSQGTLCCTSPGL

SEQ ID NO: 1431 - protein, 92 aa, Glycine max
  misc_feature (1)..(92): Ceres CLONE ID no. 712495
  misc_feature: Utility: Useful for increasing chlorophyll and photosynthetic capacity
  misc_feature: Utility: Useful for making smaller plants
MASACSRMAQRTSISSIKSAIKSNIRASSFSKPASSSSPLRQSLLTRISPELRCAQSMLPLHSAVAAARMTSCLSVTSRSCRALSQDGIDGT

SEQ ID NO: 1432 - protein, 88 aa, Triticum aestivum
  misc_feature (1)..(88): Ceres CLONE ID no. 639432
  misc_feature: Utility: Useful for increasing chlorophyll and photosynthetic capacity
  misc_feature: Utility: Useful for making smaller plants
MASTCFRAAARAATAACRSAASRSMPSVGRSAARRAPLISRVPLELGCCAGMSLLPLHSAVAAARLTSRLSTASRSSSALSQDENDDT

SEQ ID NO: 1433 - protein, 93 aa, Zea mays
  misc_feature (1)..(93): Ceres CLONE ID no. 1489971
  misc_feature: Utility: Useful for increasing chlorophyll and photosynthetic capacity
  misc_feature: Utility: Useful for making smaller plants
MASTCFRAAARVASAASRSAAAYRSAPSAARAVATAAHRISCFSRVPVELGCCAGLSLLPLHSAVASARLTSRLSTASSCRALSQQMGQSVRR

SEQ ID NO: 1434 - DNA, 1353 bp, Glycine max
  misc_feature (1)..(1353): Ceres CLONE ID no. 464504
  misc_feature (1)..(1353): Also known as  Ceres CDNA ID no. 23670902
gactcaaccaattccaaattctcaactttcctaactttagcaaccatctaagaagttcagtcccttaattatctctcaccttgaattagaaaagcattcaaagctttgaacccaatttcactgtttgcacctcaaacatcttagaagtcccaattgagtctcaattccacaaccaaaaatgcaaagttcaatttcacaatctgatatttttatcactgattaccttgtaccccaagaagttccatttcaatttcaatttcaagatatgagcaagaatgacaacaacatgccaatgaaccataccaataataaccttcaaatgcctcaaatcacatctttctccaagcctccaaggtcctcatcaaatctaagcaaccgcaaaccctccttgaaaaacatcacaatcccttccataacctctggtcttgcaacagctatgtcacaaacaacagcaacaacaacaacaatagctacaaccatgtataacaacaaccaagtttcttcttcttctttttcttcagatgaaaccaacaataccaaagacgacaagcactatagaggggttagaagaaggccatgggggaagtatgctgcagaaatccgtgaccctaatagaaaaggttcaagggtgtggcttggaacctttgacacagccatagaagctgctaaggcttatgacaaagctgctttcaagatgagagggagcaaagccatattgaacttccctttggagattggatcagatcagtctaaagaagagtcatcatcatcatcatcatcagtttcaagcagcagcatcgtcatcaaggttggtgtgaagagagaaagagaggaagagagtgaaaggaagaacaactatgagaaaagtgagtttaacaacaatagtaatagtaataagcatgtgaagaaagaagagtgccctttgactccatcatgttggaaaggcttttgggacactgatgttatgggaacaatytttagtgtgcctcctttgtcaccmctatytccmctaatggttgtttgagattttgtggaacttttgctctttcaatgatgttttgaggtaaccmaactaaggggagagagagagatgatgctggtgattgtcctctytgatttaggttgctaatttgcctaaatcaaaatggtagtactaattaatctactaatagattaatttgcaagtgaatatatatatggatttgtataatgtaaatataggatagtactatkaagcaagatctttttgtttgttgaaaaaaaaaacaaaaaacccatgcttatcttcttcctttaggtaaaaaaatgtactgtacttgaagcaatattgaaatttgtttattcgtttattgg

SEQ ID NO: 1435 - protein, 281 aa, Glycine max
  misc_feature (124)..(188): Pfam Name: AP2; Pfam Description: AP2 domain
  misc_feature (124)..(188): Pfam Name: AP2; Pfam Description: AP2 domain
  misc_feature: Utility: Useful for increasing chlorophyll and photosynthetic capacity
  misc_feature: Utility: Useful for making shorter plants and plants with modified flowers
  misc_feature: Utility: Useful for making smaller plants
MQSSISQSDIFITDYLVPQEVPFQFQFQDMSKNDNNMPMNHTNNNLQMPQITSFSKPPRSSSNLSNRKPSLKNITIPSITSGLATAMSQTTATTTTIATTMYNNNQVSSSSFSSDETNNTKDDKHYRGVRRRPWGKYAAEIRDPNRKGSRVWLGTFDTAIEAAKAYDKAAFKMRGSKAILNFPLEIGSDQSKEESSSSSSSVSSSSIVIKVGVKREREEESERKNNYEKSEFNNNSNSNKHVKKEECPLTPSCWKGFWDTDVMGTIFSVPPLSPLSPLMVV

SEQ ID NO: 1436 - DNA, 1816 bp, Glycine max
  misc_feature (1)..(1816): Ceres CLONE ID no. 627596
  misc_feature (1)..(1816): Also known as  Ceres CDNA ID no. 23702084
cacagcccttctaaaacgcccttctaaaacgccttacttacttactctgtgccttctttcatcatccaaaaaagaaaaccgttggcattcacacaaagaaaacctttgggtttcccaaaatgtcatcatcggaactctcctctttctttcttctccgtctatcagacatactcagtttcgatgttttgctcggagttatgtttctagttgccgtgttcggctactggctggttcccggcggttttgcttgggctttttccaagttcaagcccgcgattcccgggccttccggttacccggtggtgggtctggtttgggctttcatagggcctcttactcacagggtccttgctaagttggctgaaacctttgatgcaaagcccttgatggcgttctctgtggggttcactcgtttcatcatctcttctcaccccgacaccgccaaagagatcttgaacagttccgctttcgcggatcgtcccgttaaggaatctgcttatgaacttctctttcaccgtgcgatggggtttgcaccctacggtgagtactggaggaacctgaggaggatctccgcaactcacatgttctctccgaggagaatcgcagcccaaggagtgtttcgggcccggattggagcccaaatggtgagagacatcgtgggcctgatggggagggacggtgtggtggaggtgaggaaggtgttgcattttgggtcgttgaataacgtgatgaagagcgtgtttgggaggagttatgtgtttggtgaggggggtgatgggtgtgagctcgaggggttggtgagcgaggggtatcatttgcttggggtgtttaactggagtgaccactttccactcttgggttggttggatttgcaaggtgtgaggaagagctgtaggagtttggttgatagagtgaatgtttatgttgggaaaatcattttggagcatagagtgaagagggttgctcaaggtgaggataataaggccattgatactgatagttctggtgactttgttgatgtgctgctggatttggagaaagagaataggctaaaccactctgatatggttgctgttttgtgggaaatgatatttagagggactgatacggtagctatccttctagagtggattctagcaagaatggttcttcatccagaaatacaagcaaaggcacaatctgaaatagactctgtggttgggtctgggcgtagtgtgagtgatgatgaccttccaaaccttccttacgttcgagccatagtgaaggaaaccttaaggatgcacccaccaggccctcttctttcatgggccagactttctattcatgacacacaaattggcaatcactttgttccagctggcaccactgctatggtaaacatgtgggccataactcacgaccaagaagtgtggtatgagccaaaacagttcaagccggagcgttttttgaaggacgaggacgtgccaatcatgggatctgatyttaggttggcmccttttggctytgggaggagagtgtgccctggaaaagccatgggcttggccactgttgagctttggcttgctatgttcttacaaaaattcaaatggatgccctgtgatgattytggtgttgacttgtctgagtgtttgaagctctccatggagatgaaacactctytcaaaaccaaagttgttgcaaggcctgtagtttytcttgcaatgtaatgggttggagtatcccatccttttactcccattaataataatattcctttccgttgtaaaaaaaaaaaaaaaaaacggcacgagaagccggcacgagaagccggcacgag

SEQ ID NO: 1437 - protein, 528 aa, Glycine max
  misc_feature (53)..(520): Pfam Name: p450; Pfam Description: Cytochrome P450
  misc_feature: Utility: Useful for increasing chlorophyll and photosynthetic capacity
  misc_feature: Utility: Useful for making ornamental plants with modified flowers
  misc_feature: Utility: Useful for making plants sterile and for genetic confinement
  misc_feature: Utility: Useful for making smaller plants
  misc_feature: Utility: Useful for making stronger plants
MSSSELSSFFLLRLSDILSFDVLLGVMFLVAVFGYWLVPGGFAWAFSKFKPAIPGPSGYPVVGLVWAFIGPLTHRVLAKLAETFDAKPLMAFSVGFTRFIISSHPDTAKEILNSSAFADRPVKESAYELLFHRAMGFAPYGEYWRNLRRISATHMFSPRRIAAQGVFRARIGAQMVRDIVGLMGRDGVVEVRKVLHFGSLNNVMKSVFGRSYVFGEGGDGCELEGLVSEGYHLLGVFNWSDHFPLLGWLDLQGVRKSCRSLVDRVNVYVGKIILEHRVKRVAQGEDNKAIDTDSSGDFVDVLLDLEKENRLNHSDMVAVLWEMIFRGTDTVAILLEWILARMVLHPEIQAKAQSEIDSVVGSGRSVSDDDLPNLPYVRAIVKETLRMHPPGPLLSWARLSIHDTQIGNHFVPAGTTAMVNMWAITHDQEVWYEPKQFKPERFLKDEDVPIMGSDLRLAPFGSGRRVCPGKAMGLATVELWLAMFLQKFKWMPCDDSGVDLSECLKLSMEMKHSLKTKVVARPVVSLAM

SEQ ID NO: 1438 - protein, 537 aa, Glycine max
  misc_feature (1)..(537): Public GI no. 12325138
  misc_feature: Utility: Useful for increasing chlorophyll and photosynthetic capacity
  misc_feature: Utility: Useful for making ornamental plants with modified flowers
  misc_feature: Utility: Useful for making plants sterile and for genetic confinement
  misc_feature: Utility: Useful for making smaller plants
  misc_feature: Utility: Useful for making stronger plants
MTIDMYLSFASRSGSSPFPSLELCLSIFLFISLFVFWLTPGGFAWALYKARFHTRPESKTGPAIPGPSGLPIFGLLLAFVNNALTHRILANIADTCKAKALMAFSVGSTRFVITSEPETAKELLNSSAFADRPVKESAYELLFDRAMGFAPFGDYWRELRRISSTHLFSPKRIFSSGESRRKIGQNMVGEIKNAMECYGEVHIKKILHFGSLNNVMSSVFGKTYNFNEGIVYSKESNELEHLVSEGYELLGIFNWSDHFPGMRWLDLQGVRRRCRSLVGRVNVFVGKIINDHKSKRSLRDNPEESTYDDDFVDVLLGMHGNSKLSDSDMIAVLWEMIFRGTDTVAILLEWILARMVLHPDIQAKAQAEIDCIVGDSGRQVTDSDLPKLPYVRAIVKETLRMHPPGPLLSWARLSIHDTQIGTHFIPAGTTAMVNMWAITHDEKVWPEAHEYKPERFLGAQESNNFPIMGSDLRLAPFGAGRRVCPGKSMGLATVELWLAQLLGSYKWVSCGEVDLSETLKLSLEMKNTLVCKAIPRG

SEQ ID NO: 1439 - protein, 517 aa, Arabidopsis thaliana
  misc_feature (1)..(517): Ceres CLONE ID no. 1152303
  misc_feature: Utility: Useful for increasing chlorophyll and photosynthetic capacity
  misc_feature: Utility: Useful for making ornamental plants with modified flowers
  misc_feature: Utility: Useful for making plants sterile and for genetic confinement
  misc_feature: Utility: Useful for making smaller plants
  misc_feature: Utility: Useful for making stronger plants
MSPEAYVLFFNSFNLVTFEAFASVSLIIATVAFLLSPGGLAWAWTGSSKSRVSIPGPSGSLSVFSGSNPHRVLAALAKRFKASPLMAFSVGFSRFVISSEPETAKEILSSSAFADRPVKESAYELLFHRAMGFAPYGEYWRNLRRISSTHLFSPRRIASFEGVRVGIGMKMVKKIKSLVTSDACGEVEVKKIVHFGSLNNVMTTVFGESYDFDEVNGKGCFLERLVSEGYELLGIFNWSDHFWFLRWFDFQGVRKRCRALVSEVNTFVGGIIEKHKMKKGNNLNGEENDFVDVLLGLQKDEKLSDSDMIAVLWEMIFRGTDTVAILVEWVLARMVLHQDIQDKLYREIASATSNNIRSLSDSDIPKLPYLQAIVKETLRLHPPGPLLSWARLAIHDVHVGPNLVPAGTIAMVNMWSITHNAKIWTDPEAFMPERFISEDVSIMGSDLRLAPFGSGRRVCPGKAMGLATVHLWIGQLIQNFEWVKGSCDVELAEVLKLSMEMKNPLKCKAVPRNVGFA

SEQ ID NO: 1440 - protein, 517 aa, Arabidopsis thaliana; identical to SEQ ID NO: 1439
  misc_feature (1)..(517): Public GI no. 15222937
  misc_feature: Utility: Useful for increasing chlorophyll and photosynthetic capacity
  misc_feature: Utility: Useful for making ornamental plants with modified flowers
  misc_feature: Utility: Useful for making plants sterile and for genetic confinement
  misc_feature: Utility: Useful for making smaller plants
  misc_feature: Utility: Useful for making stronger plants

SEQ ID NO: 1441 - protein, 385 aa, Triticum aestivum
  misc_feature (1)..(385): Ceres CLONE ID no. 796158
  misc_feature: Utility: Useful for increasing chlorophyll and photosynthetic capacity
  misc_feature: Utility: Useful for making ornamental plants with modified flowers
  misc_feature: Utility: Useful for making plants sterile and for genetic confinement
  misc_feature: Utility: Useful for making smaller plants
  misc_feature: Utility: Useful for making stronger plants
MGFAPSGDAHWRALRRLAAAHLFGPRRVAASAPHRSSIGTRMLGDVASLMARHGEVAPRRFLHAASLNHVMAVVFGKRYDDFTSQEGVVVEEMVNEGYDLLGTFNWADHLPFLKWLDLQGVRRRCNRLVRQVEAYVGNIIQEHKARRASGSGIADELSGDFVDVLLGLDGEDKMSESDMIAVLWEMIFRGTDTVAILMEWIMARMVLHPEIQSKARAELDAVVGRGRAVMDEDVARLPYIQCIVKETLRMHPPGPLLSWARLAVHDAHVGGHLVPAGTTAMVNMWAIAHDAAVWPEPELFRPERFMEEEVSVLGSDLRLAPFGAGRRVCPGKMLALATVHLWLAQLLHRFEWAPATAASGGVDLSERLKMSLEMATPLVCRAVAR

SEQ ID NO: 1442 - protein, 515 aa, Triticum aestivum
  misc_feature (1)..(515): Public GI no. 50916627
  misc_feature: Utility: Useful for increasing chlorophyll and photosynthetic capacity
  misc_feature: Utility: Useful for making ornamental plants with modified flowers
  misc_feature: Utility: Useful for making plants sterile and for genetic confinement
  misc_feature: Utility: Useful for making smaller plants
  misc_feature: Utility: Useful for making stronger plants
MDATLGASTTHGYLLLLPANSTTFFSPLLAALLAVTSLLWLVPGGPAWALSRCRRPPPGAPGALAALAGPAAHRALAAMSRSVPGGAALASFSVGLTRFVVASRPDTARELLSSAAFADRPVKDAARGLLFHRAMGFAPSGDYWRALRRVSANHLFTPRRVAASAPRRLAIGERMLDRLSALAGGEIGMRRVLHAASLDHVMDTVFGTRYDGDSQEGAELEAMVKEGYDLLGMFNWGDHLPLLKWLDLQGVRRRCRTLVQRVDVFVRSIIDEHRQRKRRTGGNGGGEELPGDFVDVLLGLQGEEKMTESDMVAVLWEMIFRGTDTVAILLEWIMARMVLHPDIQAKAQAELDAVVGRGRAVSDGDVAGLRYLQCVVKEALRVHPPGPLLSWARLAVRDAHVGGHVVPAGTTAMVNMWAIAHDPELWPEPDEFRPERFAEEDVSVLGGDLRLAPFGAGRRACPGKTLALATVHLWLAQLLHRFEWAPVGGGVHLLERLNMSLEMEKPLVCKAKPRW

SEQ ID NO: 1443 - protein, 525 aa, Triticum aestivum
  misc_feature (1)..(525): Public GI no. 50939101
  misc_feature: Utility: Useful for increasing chlorophyll and photosynthetic capacity
  misc_feature: Utility: Useful for making ornamental plants with modified flowers
  misc_feature: Utility: Useful for making plants sterile and for genetic confinement
  misc_feature: Utility: Useful for making smaller plants
  misc_feature: Utility: Useful for making stronger plants
MALSSMAAAQESSLLLFLLPTSAASVFPPLISVVVLAALLLWLSPGGPAWALSRCRGTPPPPGVAGGAASALSGPAAHRVLAGISRAVEGGAAVMSLSVGLTRLVVASRPETAREILVSPAFGDRPVKDAARQLLFHRAMGFAPSGDAHWRGLRRASAAHLFGPRRVAGSAPEREAIGARIVGDVASLMSRRGEVPLRRVLHAASLGHVMATVFGKRHGDISIQDGELLEEMVTEGYDLLGKFNWADHLPLLRWLDLQGIRRRCNRLVQKVEVFVGKIIQEHKAKRAAGGVAVADGVLGDFVDVLLDLQGEEKMSDSDMIAVLWEMIFRGTDTVAILMEWVMARMVMHPEIQAKAQAEVDAAVGGRRGRVADGDVASLPYIQSIVKETLRMHPPGPLLSWARLAVHDARVGGHAVPAGTTAMVNMWAIAHDAAVWPEPDAFRPERFSEGEDVGVLGGDLRLAPFGAGRRVCPGRMLALATAHLWLAQLLHAFDWSPTAAGVDLSERLGMSLEMAAPLVCKAVARA

SEQ ID NO: 1444 - protein, 523 aa, Triticum aestivum
  misc_feature (1)..(523): Public GI no. 2739008
  misc_feature: Utility: Useful for increasing chlorophyll and photosynthetic capacity
  misc_feature: Utility: Useful for making ornamental plants with modified flowers
  misc_feature: Utility: Useful for making plants sterile and for genetic confinement
  misc_feature: Utility: Useful for making smaller plants
  misc_feature: Utility: Useful for making stronger plants
MTSHIDDNLWIIALTSKCTQENLAWVLLIMGSLWLTMTFYYWSHPGGPAWGKYYTYSPPLSIIPGPKGFPLIGSMGLMTSLAHHRIAAAAATCRAKRLMAFSLGDTRVIVTCHPDVAKEILNSSVFADRPVKESAYSLMFNRAIGFASYGVYWRSLRRIASNHLFCPRQIKASELQRSQIAAQMVHILNNKRHRSLRVRQVLKKASLSNMMCSVFGQEYKLHDPNSGMEDLGILVDQGYDLLGLFNWADHLPFLAHFDAQNIRFRCSNLVPMVNRFVGTIIAEHRASKTETNRDFVDVLLSLPEPDQLSDSDMIAVLWEMIFRGTDTVAVLIEWILARMALHPHVQSKVQEELDAVVGKARAVAEDDVAVMTYLPAVVKEVLRLHPPGPLLSWARLSINDTTIDGYHVPAGTTAMVNTWAICRDPHVWKDPLEFMPERFVTAGGDAEFSILGSDPRLAPFGSGRRACPGKTLGWATVNFWVASLLHEFEWVPSDEKGVDLTEVLKLSSEMANPLTVKVRPRRG

SEQ ID NO: 1445 - protein, 552 aa, Triticum aestivum
  misc_feature (1)..(552): Ceres CLONE ID no. 779234
  misc_feature: Utility: Useful for increasing chlorophyll and photosynthetic capacity
  misc_feature: Utility: Useful for making ornamental plants with modified flowers
  misc_feature: Utility: Useful for making plants sterile and for genetic confinement
  misc_feature: Utility: Useful for making smaller plants
  misc_feature: Utility: Useful for making stronger plants
MAPSEKCGWLLYVSLAAKCCGNGDGKPYRVVGFVVVLLAAFVVTSLLHWASQGGAAWGRYWWRRKGLGIGEARIPGPRGFPVIGSMGLMTGLAHRKLAAAAAGNVRRRRLMSFSMGETRVVVTADPDVARELLASPAFADRPVKESAYGLMFHRAIGFAPYGAYWRTLRRVSSSHLFSPRQVAASAAQRAVIAHQMVDAMRPVGGAGVKHVEARRFLKRASLHNVMWSVFGRRYELDEAGSGEAAELKSLVDEGYDLLGQLNWSDHLPWLARFDLQKIRSRCSALVPRVNRFVGRIIDEHRAALNDDDDAVVDFTDVLLSLQGSDKLSDADMIAVLWEMIFRGTDTVAVVIEWVLARLMLHQDVQARVHEELDRVVGPNRAVTESDAASLVFLQAVVKEVLRLHPPGPLLSWARLATSDVHVDGLHVPAGTTAMVNMWAITHDPTVWVKPAEFKPERFLGGSSSDHAAAGAEFSVTGSDLRLAPFGSGRRSCPGKSLAIATVGFWVATLLHEFEWTPPSSDGSGGVDLSEVLRLSCEMAAPLEARLRPRRAV

SEQ ID NO: 1446 - protein, 530 aa, Triticum aestivum
  misc_feature (1)..(530): Public GI no. 20197777
  misc_feature: Utility: Useful for increasing chlorophyll and photosynthetic capacity
  misc_feature: Utility: Useful for making ornamental plants with modified flowers
  misc_feature: Utility: Useful for making plants sterile and for genetic confinement
  misc_feature: Utility: Useful for making smaller plants
  misc_feature: Utility: Useful for making stronger plants
MATKLESSLIFALLSKCSVLSQTNLAFSLLAVTIIWLAISLFLWTYPGGPAWGKYLFGRLISGSYKTGNVIPGPKGFPLVGSMSLMSSTLAHRRIADAAEKFGAKRLMAFSLGETRVIVTCNPDVAKEILNSPVFADRPVKESAYSLMFNRAIGFAPHGVYWRTLRRIASNHLFSTKQIRRAETQRRVISSQMVEFLEKQSSNEPCFVRELLKTASLNNMMCSVFGQEYELEKNHVELREMVEEGYDLLGTLNWTDHLPWLSEFDPQRLRSRCSTLVPKVNRFVSRIISEHRNQTGDLPRDFVDVLLSLHGSDKLSDPDIIAVLWEMIFRGTDTVAVLIEWILARMVLHPDMQSTVQNELDQVVGKSRALDESDLASLPYLTAVVKEVLRLHPPGPLLSWARLAITDTIVDGRLVPAGTTAMVNMWAVSHDPHVWVDPLEFKPERFVAKEGEVEFSVLGSDLRLAPFGSGRRICPGKNLGFTTVMFWTAMMLHEFEWGPSDGNGVDLSEKLRLSCEMANPLPAKLRRRRS

SEQ ID NO: 1447 - protein, 553 aa, Triticum aestivum
  misc_feature (1)..(553): Public GI no. 5921925
  misc_feature: Utility: Useful for increasing chlorophyll and photosynthetic capacity
  misc_feature: Utility: Useful for making ornamental plants with modified flowers
  misc_feature: Utility: Useful for making plants sterile and for genetic confinement
  misc_feature: Utility: Useful for making smaller plants
  misc_feature: Utility: Useful for making stronger plants
MENRRSSGGSGWWVCVLPLFTKDGPAYFLHSSSDDVSAWRQWPLYIALLIVAVCAVLVSWLSPGGCAWAGRHKRGRVAIPGPKGWPIIGSLMDMSVGLPHRKLESLARLHGAKQLMSFSLGCTPAVITSDPEVARELLTSPHFANRPLKQSAQQLLFGRAIGFAPNGGYWRLLRRIASAHLFAPRRIAAHEAGRQADVVAMLDDIQKEYHSKGVVRVRRHLQGAALNNIMGSVFGRRFDMSHENEEVKKLREMVDEGFQLLGAFNWADHLPWLRPLDPLRIHARCARLVPRVTTFVSNIIEQHRREEQRRESGDQCDFVDVLLSLQGEDKLDEEDMIAVLWEMIFRGTDTTALLTEWTMAELVLHPEAQKKAQAELDAVVGHDRSVKDSDIPKLPYIQAVVKEALRMHPPGPLLSWARLSTEDVNMGDGMCVPAGTTAMVNMWSITHDPNIWESPYEFRPERFVVFEGGEEVDVRGNDLRLAPFGAGRRVCPGKALGLATVNLWVAKLLHHFEWLPHAEHPVDLSEVLKLSCEMARPLHCVPVTRVPFAKFSD

SEQ ID NO: 1448 - protein, 534 aa, Arabidopsis thaliana
  misc_feature (1)..(534): Ceres CLONE ID no. 29661
  misc_feature: Utility: Useful for increasing chlorophyll and photosynthetic capacity
  misc_feature: Utility: Useful for making ornamental plants with modified flowers
  misc_feature: Utility: Useful for making plants sterile and for genetic confinement
  misc_feature: Utility: Useful for making smaller plants
  misc_feature: Utility: Useful for making stronger plants
MATKLDTSSLLLALLSKCSLLTQTNLALSLLVASLASLALSLFFWSHPGGPAWGKYFLHRRRQTTVIPGPRGLPFVGSMSLMSNTLAHRCIAATAEKFRAERLMAFSLGETRVIVTCNPDVAKEILNSPVFADRPVKESAYSLMFNRAIGFAPYGVYWRTLRKIASNHLFSPKQIKRSETQRSVIANQIVKCLTKQSNTKGLCFARDLIKTASLNNMMCSVFGKEYELEEEHEEVSELRELVEEGYDLLGTLNWTDHLPWLSEFDPQRIRSRCSNLVPKVNRFVNRIISDHREQTRDSPSDFVDVLLSLDGPDKLSDPDIIAVLWEMIFRGTDTVAVLIEWILARMVLHPDIQSTVHNELDQIVGRSRAVEESDVVSLVYLTAVVKEVLRLHPPGPLLSWARLAITDTIIDGRRVPAGTTAMVNMWAIAHDPHVWENPLEFKPERFVAKEGEVEFSVLGSDLRLAPFGSGRRVCPGKNLGLTTVTFWTATLLHEFEWLTPSDEKTVDLSEKLRLSCEMANPLAAKLRPRRSFSV

SEQ ID NO: 1449 - protein, 515 aa, Zea mays
  misc_feature (1)..(515): Ceres CLONE ID no. 689576
  misc_feature: Utility: Useful for increasing chlorophyll and photosynthetic capacity
  misc_feature: Utility: Useful for making ornamental plants with modified flowers
  misc_feature: Utility: Useful for making plants sterile and for genetic confinement
  misc_feature: Utility: Useful for making smaller plants
  misc_feature: Utility: Useful for making stronger plants
  misc_feature (45)..(45): Xaa is any aa, unknown, or other
  misc_feature (46)..(46): Xaa is any aa, unknown, or other
  misc_feature (206)..(206): Xaa is any aa, unknown, or other
  misc_feature (319)..(319): Xaa is any aa, unknown, or other
  misc_feature (326)..(326): Xaa is any aa, unknown, or other
  misc_feature (367)..(367): Xaa is any aa, unknown, or other
  misc_feature (372)..(372): Xaa is any aa, unknown, or other
  misc_feature (374)..(374): Xaa is any aa, unknown, or other
MASAACSCTDGTWWVYALPALLGSDTLCAHPALLAGLIFLATVSXXLLAWATSPGGPAWTNGRGRLGVTPIVGPRGLPVFGSIFALSRGLPHRALAEMARAAGPRAKELMAFSVGDTPAVVSSCPATAREVLAHPSFADRPVKRSARELMFARAIGFAPNGEYWRRLRRVASTHLFSPRRVASHEPGRQGDAEAMLRSIAAEQSAXGAVALRPHLQAAALNNIMGSVFGTRYDVTSGAGAAEAEHLKSMVREGFELLGAFNWSDHLPWLAHLYDPSNVTRRCAALVPRVQTFVRGVIDEHRRRRQNSAALNDNADFVDXLLSLEGXEKLGDDDMVAILWEMVFRGTDTTTLLTEWCMAELVRHPAVXARVRXEXDAAVGAGGCPTDADVARMPYLQAVVKETLRAHPPGPLLSWARLATADVPLCNGMVVPAGTTAMVNMWAITHDAAVWADPDAFAPERFLPSGGGADVDVRGVDLRLAPFGAGASRLPRQEPGPHHRGPLGCPPRARLPVGPA

SEQ ID NO: 1450 - DNA, 533 bp, Triticum aestivum
  misc_feature (1)..(533): Ceres CLONE ID no. 729085
  misc_feature (1)..(533): Also known as  Ceres CDNA ID no. 13547035
gactcggacaccggtcactggacagcacggcatctgctctctcgcccctcgaaatatcccaagctccaaagcccaaagcatcgatcagagccgatcaaatatagtatttcttgagcactactagctagagagaagtattctcgtgttgctgttagcctgctttactggaaagatgagccccgaggagggagagaggctcttgttcccttccttcgtcttcccggacggtttcccggcggacgacgccacaccagccgtctccggtggagagcagaagaaggccggccggcagcggcggcggaggagggcgaggcaggcagcggcaggcgaaggcgcgggaggggacgatgcggcgaagaaacgccggctgagtgacgagcaggcgcagttcctggagatgagcttcaggaaggaacgtaaactggaaacgccccgcaaggtgcagctcgccgcggagctgggcctggacaccaagcaggtcgcggtgtggttccagaaccgccgsgcccgctacaagagcaagctcatcgagg

SEQ ID NO: 1451 - protein, 120 aa, Triticum aestivum
  misc_feature (62)..(116): Pfam Name: Homeobox; Pfam Description: Homeobox domain
  misc_feature: Utility: Useful for increasing chlorophyll and photosynthetic capacity
  misc_feature: Utility: Useful for making shorter plants and plants with modified flowers
  misc_feature: Utility: Useful for making smaller plants
  misc_feature (111)..(111): Xaa is any aa, unknown, or other
MSPEEGERLLFPSFVFPDGFPADDATPAVSGGEQKKAGRQRRRRRARQAAAGEGAGGDDAAKKRRLSDEQAQFLEMSFRKERKLETPRKVQLAAELGLDTKQVAVWFQNRXARYKSKLIE

SEQ ID NO: 1452 - protein, 92 aa, Triticum aestivum
  misc_feature (1)..(92): Ceres CLONE ID no. 901184
  misc_feature: Utility: Useful for increasing chlorophyll and photosynthetic capacity
  misc_feature: Utility: Useful for making shorter plants and plants with modified flowers
  misc_feature: Utility: Useful for making smaller plants
MSSEEGERLLFPSFVFPDSFPADDATPVVSGGEQKKAGRQRRRRRARQAASGEGGGDDAAKKRRLSDEQAQFLEMNFRKERKLETPRKVQLA

SEQ ID NO: 1453 - protein, 224 aa, Triticum aestivum
  misc_feature (1)..(224): Public GI no. 46242609
  misc_feature: Utility: Useful for increasing chlorophyll and photosynthetic capacity
  misc_feature: Utility: Useful for making shorter plants and plants with modified flowers
  misc_feature: Utility: Useful for making smaller plants
LSLFCLVGCCVAGGEQKKARQRRRRKVKPEAAAALAGESGGDEQAKKRRLSDEQARFLEMSFKKERKLETPRKVQLAAELGLDAKQVAVWFQNRRARHKSKLMEEEFAKLRSAHDAVVLQNCHLETELLKLKERLADVEEEKAKLAAVAAATTGGGGGGGGGSSSPTSSSFSTVTYHPVLAGQFGVEAAAEEADLTYMSEYAYNSYMLELAAAGYCGGVYDQFS

SEQ ID NO: 1454 - protein, 239 aa, Zea mays
  misc_feature (1)..(239): Ceres CLONE ID no. 324157
  misc_feature: Utility: Useful for increasing chlorophyll and photosynthetic capacity
  misc_feature: Utility: Useful for making shorter plants and plants with modified flowers
  misc_feature: Utility: Useful for making smaller plants
MGCEEEERLLFPSFVFPESFAEAATPGSGGEQKKARQRRRRKPRPAEGGEGADEQARKRRLSDDQARFLELSFRKERKLETPRKVQLAADLGLDAKQVAVWFQNRRARHKSKLMEEEFSKLRAAHDAVVLHNCHLETELLKMKDRLAEVEEEKTKLVAAAAAAAGGAAGAGSSSPSSSSFSTVTHHPAAALQVGQFGVEPEEAADLAYMTEYAYNSYMNMMDLAPGYFGGVVYDYDHFN

SEQ ID NO: 1455 - protein, 140 aa, Zea mays
  misc_feature (1)..(140): Ceres CLONE ID no. 1565969
  misc_feature: Utility: Useful for increasing chlorophyll and photosynthetic capacity
  misc_feature: Utility: Useful for making shorter plants and plants with modified flowers
  misc_feature: Utility: Useful for making smaller plants
  misc_feature (57)..(57): Xaa is any aa, unknown, or other
  misc_feature (58)..(58): Xaa is any aa, unknown, or other
  misc_feature (109)..(109): Xaa is any aa, unknown, or other
  misc_feature (110)..(110): Xaa is any aa, unknown, or other
MGYEEEDRLLFPSSVFTESFTEAAATATTPGSGSEQTKARQLSDGQARKRRLSDGHXXFLELSFGKERKLETPRKVQLAAELGLDAKQVAVWFQNRRARHKSKLMEEEXXSLRAAHDAAVLHNCHLETEVVGQCTTPSRR

SEQ ID NO: 1456 - protein, 240 aa, Zea mays
  misc_feature (1)..(240): Public GI no. 45593100
  misc_feature: Utility: Useful for increasing chlorophyll and photosynthetic capacity
  misc_feature: Utility: Useful for making shorter plants and plants with modified flowers
  misc_feature: Utility: Useful for making smaller plants
MDRYGEKQQQQQMFASYVDASLLAASGEVQGERPRARRRRRRGARCVGGGGGGGEVDGGDPKKRRLSDEQVEMLELSFREERKLETGRKVHLASELGLDPKQVAVWFQNRRARHKSKLLEEEFSKLKHAHDAAILHKCHLENEVLRLKERLVVAEEEVRRLRSAAGSHTASGEGGDIMGLGGSGACVAGSPSSSFWTGTCQPPSFGGGDPFGDDDLVYVPEYGGYADNSVVEWFSLYGLI

SEQ ID NO: 1457 - protein, 240 aa, Zea mays
  misc_feature (1)..(240): Public GI no. 50938719
  misc_feature: Utility: Useful for increasing chlorophyll and photosynthetic capacity
  misc_feature: Utility: Useful for making shorter plants and plants with modified flowers
  misc_feature: Utility: Useful for making smaller plants
MDRYGEKQQQQQMFASYVDASLLAASGEVQGERPRARRRRRRGARCVGGGGGGGEVDGGDPKKRRLSDEQVEMLELSFREERKLETGRKVHLASELGLDPKQVAVWFQNRRARHKSKLLEEEFSKLKHAHDAAILHKCHLENEVLRLKERLVVAEEEVRRLRSAAGSHTASGEGGDIMGLGGSGACVAGSPSSSFSTGTCQPPSFGGGDHLGDDDLVYVPEYGGYADNSVVEWFSLYGLI

SEQ ID NO: 1458 - protein, 234 aa, Zea mays
  misc_feature (1)..(234): Ceres CLONE ID no. 1440579
  misc_feature: Utility: Useful for increasing chlorophyll and photosynthetic capacity
  misc_feature: Utility: Useful for making shorter plants and plants with modified flowers
  misc_feature: Utility: Useful for making smaller plants
MEQYDGLFPPAYVDDSSSLLLVPNANGTAQEERPRARRRRRRAARCGGGGGELDGGGDHKKRRLTDEQVEMLELSFREERKLETGRKVHLAAELGLDPKQVAVWFQNRRARHKSKLLEEEFAKLKQAHDAAILHKCHLENEVMRLKDKLVLAEEELTRFRSAGNHAVSGDGGDVMARAVCSGSPSSSFSTGTCQQPGGGGGGGDHLGDDDLLYVPDYAYADSSVVEWFSLYGLM

SEQ ID NO: 1459 - protein, 205 aa, Glycine max
  misc_feature (1)..(205): Ceres CLONE ID no. 527229
  misc_feature: Utility: Useful for increasing chlorophyll and photosynthetic capacity
  misc_feature: Utility: Useful for making shorter plants and plants with modified flowers
  misc_feature: Utility: Useful for making smaller plants
MMLMSQLFPADAYTQIISQQGETNKKPRRRRNKKNKGGENGASEANKKRKLSEVQVNLLEQNFGNERKLESERKDRLAMELGLDPRQVAVWFQNRRARWKNKKLEEEYSSLKKNHEATLLEKCCLESEVLKLKEQLSEAEKEIQRLLESAERVPSNSSSSSQSQSMEAVDPPFFGEFGVDGYEDDVFYVPETHYINGMEWINLYM

SEQ ID NO: 1460 - protein, 208 aa, Arabidopsis thaliana
  misc_feature (1)..(208): Ceres CLONE ID no. 1351153
  misc_feature: Utility: Useful for increasing chlorophyll and photosynthetic capacity
  misc_feature: Utility: Useful for making shorter plants and plants with modified flowers
  misc_feature: Utility: Useful for making smaller plants
MAFISQLYPDVYTQIVQPVGEVKQPKRRRKKTKGSVASADGGNGLFRKRKLTDEQVNMLEMSFGDEHKLESERKDRLAAELGLDPRQVAVWFQNRRARWKNKRLEEEYNKLKNSHDNVVVDKCRLESEVIQLKEQLYDAEREIQRLAERVEGGSSNSPISSSVSVEANETPFFGDYKVGDDGDDYDHLFYPVPENSYIDEAEWMSLYI

SEQ ID NO: 1461 - protein, 263 aa, Arabidopsis thaliana
  misc_feature (1)..(263): Public GI no. 7415614
  misc_feature: Utility: Useful for increasing chlorophyll and photosynthetic capacity
  misc_feature: Utility: Useful for making shorter plants and plants with modified flowers
  misc_feature: Utility: Useful for making smaller plants
MHVRNDSSGSSLVAMLASCSPAAAVQAQPGGGGMEDTVSCGQKRPYYSTIEASGEDPGEEDVGDDCIQQSKKRRLTFDQVRSHEKNFEIENKLEPERKMQLANELGLQPRQVAVWFQNRRARWKTKQLERDYEVLTLDYNRLKSEFEAVLQEKQELQDEMECLTEKIQTAIPNSADPILEKRKRIISMSQPSSLKTFEGPVKSERIAAEANGRNDALTPCKEEGSKEEGSKETSSDSISQVKYLTRTAFVLWIAARFSHCPIV

SEQ ID NO: 1462 - protein, 217 aa, Arabidopsis thaliana
  misc_feature (1)..(217): Public GI no. 4006894
  misc_feature: Utility: Useful for increasing chlorophyll and photosynthetic capacity
  misc_feature: Utility: Useful for making shorter plants and plants with modified flowers
  misc_feature: Utility: Useful for making smaller plants
MNYTVDDQNMAFISQLYPDVYTQIVQPVGEVKQPKRRRKKTKGSVASADGGNGLFRKRKLTDEQVNMLEMSFGDEHKLESERKDRLAAELGLDPRQVAVWFQNRRARWKNKRLEEEYNKLKNSHDNVVVDKCRLESEVIQLKEQLYDAEREIQRLAERVEGGSSNSPISSSVSVEANETPFFGDYKVGDDGDDYDHLFYPVPENSYIDEAEWMSLYI

SEQ ID NO: 1463 - DNA, 1640 bp, Arabidopsis thaliana
  misc_feature (1)..(1640): Ceres CLONE ID no. 1011386
  misc_feature (1)..(1640): Also known as  Ceres CDNA ID no. 23648951
gattcattctcttcagtcagagatttcgaaaccctagtcgatttcgagatccaaccaactctgctccttatctcagcttgttgaatttgcgaagtatgggagacgctagagacaacgaagcctacgaggaggagctcttggactatgaagaagaagacgagaaggtcccagattctggaaacaaagttaacggtgaagccgtgaaaaaagggtacgtgggaatacacagttctggattcagagacttccttttaaaaccggagcttctcagagctattgttgactctggatttgaacatccatctgaagtgcaacatgaatgtatccctcaagctatcttgggcatggatgtcatctgccaagcaaagtctggtatggggaagactgctgtgtttgtcctgtctactctacaacagattgaaccatctcctggccaggtttctgcacttgtcttgtgccatacaagagagctagcttaccagatctgcaatgagtttgtgcgattcagtacctatctgcctgatacaaaggtttcggtgttctatggtggagtcaacattaaaattcacaaagacttgctgaagaatgaatgtcctcacattgttgttggtacccctggtcgggtgcttgcacttgccagggagaaagatctctctttgaagaatgtgaggcattttattcttgatgaatgtgataaaatgctcgagtcacttgacatgcgaagggatgtgcaggagattttcaagatgactcctcatgacaaacaagtaatgatgttctcagcaacgctcagcaaagagatacgcccagtctgcaaaaaatttatgcaagatccaatggaaatatatgtcgatgatgaagccaagttgactcttcatgggcttgtccagcactacatcaaactgagcgagatggagaaaaaccggaagttgaatgaccttcttgatgcgttggacttcaatcaagttgtcatttttgtgaagagcgtgagcagggctgctgagctgaacaagttactggtggaatgcaatttcccctcaatatgcatccactctggaatgtctcaagaagagaggttgactcgatacaaaagtttcaaggaagggcacaaaaggatccttgtggcgactgacttggtaggaagagggattgacattgagcgtgtcaacattgtcatcaactatgacatgccagattctgctgatacctatcttcacagggttggcagagctggtagatttggaaccaagggtcttgcaatcacatttgttgcatctgcttcagattcagaggttcttaaccaggtacaagagaggtttgaggttgatataaaggaacttccggagcagattgatacttcaacctacatgccttcttaaacaagtagcacgtccctcaggaaagaagctcttcagatttcaaccttgtaggtgttcgaagggtgatgggggttcacaactatctctcgctccgtttgttttagtgttttctatgacgacatttttttccatatgtttagaacgtctgttgtactctttaaaggagattcgagtcactctccaaatcgcacagttaaaagctgtccagttttttgtacaagagattattatgtttgaaatatcaggatttagtctcgactc

SEQ ID NO: 1464 - protein, 427 aa, Arabidopsis thaliana
  misc_feature (69)..(239): Pfam Name: DEAD; Pfam Description: DEAD/DEAH box helicase
  misc_feature (307)..(383): Pfam Name: Helicase_C; Pfam Description: Helicase conserved C-terminal domain
  misc_feature (69)..(239): Pfam Name: DEAD; Pfam Description: DEAD/DEAH box helicase
  misc_feature (307)..(383): Pfam Name: Helicase_C; Pfam Description: Helicase conserved C-terminal domain
  misc_feature: Utility: Useful for increasing chlorophyll and photosynthetic capacity
  misc_feature: Utility: Useful for making lethal plants for genetic confinement systems
  misc_feature: Utility: Useful for making plants sterile and for genetic confinement
  misc_feature: Utility: Useful for making smaller plants
  misc_feature: Utility: Useful for making taller plants and plants with longer inflorescences
MGDARDNEAYEEELLDYEEEDEKVPDSGNKVNGEAVKKGYVGIHSSGFRDFLLKPELLRAIVDSGFEHPSEVQHECIPQAILGMDVICQAKSGMGKTAVFVLSTLQQIEPSPGQVSALVLCHTRELAYQICNEFVRFSTYLPDTKVSVFYGGVNIKIHKDLLKNECPHIVVGTPGRVLALAREKDLSLKNVRHFILDECDKMLESLDMRRDVQEIFKMTPHDKQVMMFSATLSKEIRPVCKKFMQDPMEIYVDDEAKLTLHGLVQHYIKLSEMEKNRKLNDLLDALDFNQVVIFVKSVSRAAELNKLLVECNFPSICIHSGMSQEERLTRYKSFKEGHKRILVATDLVGRGIDIERVNIVINYDMPDSADTYLHRVGRAGRFGTKGLAITFVASASDSEVLNQVQERFEVDIKELPEQIDTSTYMPS

SEQ ID NO: 1465 - protein, 428 aa, Zea mays
  misc_feature (1)..(428): Ceres CLONE ID no. 1462142
  misc_feature: Utility: Useful for increasing chlorophyll and photosynthetic capacity
  misc_feature: Utility: Useful for making lethal plants for genetic confinement systems
  misc_feature: Utility: Useful for making plants sterile and for genetic confinement
  misc_feature: Utility: Useful for making smaller plants
  misc_feature: Utility: Useful for making taller plants and plants with longer inflorescences
MGEAKENDVYEEELLDYEEDDDKTVDGSAAKPTGEVAKKGYVGIHSSGFRDFLLKPELLRAIQDCGFEHPSEVQHECIPQAILGMDVICQAKSGMGKTAVFVLSSLQQIDPVAGQVAALVLCHTRELAYQICHEFERFSKYLTEVKVAVFYGGVHIRKHKDLLKNECPHIVVGTPGRILALARDKDLSLKNVRHFILDECDKMLESLDMRRDVQEIFKMTPHDKQVMMFSATLSKEIRPVCKKFMQDPMEIYVDDEAKLTLHGLVQHYIKLSEAEKNRKLNDLLDALDFNQVVIFVKSVSRAAELNKLLCECNFPSICIHSGMTQEERLTRYKNFKEGHKRILVATDLVGRGIDIERVNIVINYDMPDSADTYLHRVGRAGRFGTKGLAITFVSSASDSDVLNQVQERFEVDIKELPEQIDTSTYMPS

SEQ ID NO: 1466 - protein, 426 aa, Glycine max
  misc_feature (1)..(426): Ceres CLONE ID no. 476264
  misc_feature: Utility: Useful for increasing chlorophyll and photosynthetic capacity
  misc_feature: Utility: Useful for making lethal plants for genetic confinement systems
  misc_feature: Utility: Useful for making plants sterile and for genetic confinement
  misc_feature: Utility: Useful for making smaller plants
  misc_feature: Utility: Useful for making taller plants and plants with longer inflorescences
MGELKDTEAYEEELIDYEEEEEKAPDSAKPVAESGKKGYVGIHSSGFRDFLLKPELLRAIVDSGFEHPSEVQHECIPQAILGMDVICQAKSGMGKTAVFVLSTLQQVDPVPGQVAALVLCHTRELAYQICHEFERFSTYLPDIKAAVFYGGVNIKVHKELLKNECPHIVVGTPGRILALARDKDLGLKNVRHFILDECDKMLESLDMRRDVQEIFKLTPHDKQVMMFSATLSKEIRPVCKKFMQDPMEIYVDDEAKLTLHGLVQHYIKLQETEKNRKLNDLLDALDFNQVVIFVKSVSRAAELNKLLVECNFPSICIHSAMSQEERLKRYKGFKEGKQRILVATDLVGRGIDIERVNIVINYDMPDSADTYLHRVGRAGRFGTKGLAITFVSSTADSEVLNQVQSRFEVDIKELPEQIDTSTYMPN

SEQ ID NO: 1467 - DNA, 848 bp, Arabidopsis thaliana
  misc_feature (1)..(848): Ceres CLONE ID no. 6082
  misc_feature (1)..(848): Also known as  Ceres CDNA ID no. 23384719
acccctcttccctctctttatctctctcaagatttgctctgtccagagctccaaatttcaagaacataaacactacacacaaaacactgaatacgatgttgcttggaaagagacaacgaccaccgatcaacagaaccacaagtctatcggagataaagttcgatctaaaccttcccagcgagtcagagccatcaaatcaacagaagccaaccgttgcgagcccgtacggttccaacggtcaagctgtaacagcagccgttgatcaaaaccgtgggttcttagatcaacggctcttatccatggtcacaccgagaggtaacctgaggagacactcaggcgatttctccgacgctagacatttcttgagatcttgcgcactttgtgaacgccttcttgttcctggccgcgacatctatatgtataggggagataaggctttttgtagctcagagtgcaggcaagagcaaatggcacaagatgagaggaaagagaaaggtaaatcggcggcaccggcgaaagaaccggcggtgacagctcccgcgagagcgaaacccggcaaagggagagctgcagccgccgtgtaatccccattttcatatacattttagctatatatatgtgtggtttgctatgtgtttgtatatgattatgatgggtaatacatatataaagcattaagcgttaattaaccgtgattaactgtgttaatcaccctcgtgttgtggtgaaattagatgattttcgagggttaaattttacaagttttgatctatttgaaataaaatcaaatgtattatatatatgtaagacttgtgtttgttaagtacttaatgagaaaaattaagatt

SEQ ID NO: 1468 - protein, 162 aa, Arabidopsis thaliana
  misc_feature (74)..(132): Pfam Name: DUF581; Pfam Description: Protein of unknown function (DUF581)
  misc_feature: Utility: Useful for increasing increasing anthocyanin content
  misc_feature: Utility: Useful for making plants with altered leaf shape eg curled leaves
  misc_feature: Utility: Useful for making plants with increased biomass and foliage
  misc_feature: Utility: Useful for making smaller plants
MLLGKRQRPPINRTTSLSEIKFDLNLPSESEPSNQQKPTVASPYGSNGQAVTAAVDQNRGFLDQRLLSMVTPRGNLRRHSGDFSDAGHFLRSCALCERLLVPGRDIYMYRGDKAFCSSECRQEQMAQDERKEKGKSAAPAKEPAVTAPARAKPGKGRAAAAV

SEQ ID NO: 1469 - protein, 157 aa, Brassica napus
  misc_feature (1)..(157): Ceres CLONE ID no. 1068042
  misc_feature: Utility: Useful for increasing increasing anthocyanin content
  misc_feature: Utility: Useful for making plants with altered leaf shape eg curled leaves
  misc_feature: Utility: Useful for making plants with increased biomass and foliage
  misc_feature: Utility: Useful for making smaller plants
SPLSLFPRSLFRAKSRAHIHTLAMLLGKRQRPPINRTTSLSEIKFDLNLPSESEVPSTHQSPNQNTVVGPSGSNGQHVAAAVDPRFLAMVSPRGNLRRHSGEFSDAGHFLRSCSLCERLLVPGRDIYMYRGDTAFCSSECREQQMTQDEGKEKVKPT

SEQ ID NO: 1470 - protein, 143 aa, Glycine max
  misc_feature (1)..(143): Ceres CLONE ID no. 602291
  misc_feature: Utility: Useful for increasing increasing anthocyanin content
  misc_feature: Utility: Useful for making plants with altered leaf shape eg curled leaves
  misc_feature: Utility: Useful for making plants with increased biomass and foliage
  misc_feature: Utility: Useful for making smaller plants
  misc_feature (123)..(123): Xaa is any aa, unknown, or other
  misc_feature (128)..(128): Xaa is any aa, unknown, or other
  misc_feature (130)..(130): Xaa is any aa, unknown, or other
  misc_feature (134)..(134): Xaa is any aa, unknown, or other
  misc_feature (141)..(141): Xaa is any aa, unknown, or other
MLLGKRPRPPMKRTTSMSEMTLDLNTAADAAAAADQQRSGVGPSAAADQTTRMLASPKILRRHSSYFGDARHFLRACSLCKRPLVPGRDIYMYRGDSAFCSLECRQQQINQDERKEKFVMASXKKVVXPXPFGXQVVATAXKG

SEQ ID NO: 1471 - protein, 199 aa, Glycine max
  misc_feature (1)..(199): Public GI no. 50945605
  misc_feature: Utility: Useful for increasing increasing anthocyanin content
  misc_feature: Utility: Useful for making plants with altered leaf shape eg curled leaves
  misc_feature: Utility: Useful for making plants with increased biomass and foliage
  misc_feature: Utility: Useful for making smaller plants
MMMMGKRGGRKNPMRRTTSMTEFAPPVDVLVGGRVADEAEAEAEADEATELEVSGGGEVEEEDAAVEEASYGWFGAGADGAGVRADWLAAYRARAAPALAGLRRNSADFSAVETAAFLRACGLCNRRLGPGRDTFMYKGDTAFCSLECRQQHITHEEWKEKRALAIATAAAAPPQPPPSMPDPTAAGSDNPAGGTLAAA

SEQ ID NO: 1472 - protein, 185 aa, Zea mays
  misc_feature (1)..(185): Ceres CLONE ID no. 347137
  misc_feature: Utility: Useful for increasing increasing anthocyanin content
  misc_feature: Utility: Useful for making plants with altered leaf shape eg curled leaves
  misc_feature: Utility: Useful for making plants with increased biomass and foliage
  misc_feature: Utility: Useful for making smaller plants
MMLGKRSGRPSPTARQHMRRTTSLTEFAAPDKVLADVAEEEDEELQLLPAHAEAAELEGPYGWAIGGAAAAGRADWLAAYRARAAPVLAGLRRNSADFSAAETAAFLRACGLCNRRLGPGRDTFVYRGDTAFCSLECRQQHITIEEWKEKCALATPPASDPVVPLPPRPSGAGSDKPATVLASKS

SEQ ID NO: 1473 - protein, 166 aa, Triticum aestivum
  misc_feature (1)..(166): Ceres CLONE ID no. 894286
  misc_feature: Utility: Useful for increasing increasing anthocyanin content
  misc_feature: Utility: Useful for making plants with altered leaf shape eg curled leaves
  misc_feature: Utility: Useful for making plants with increased biomass and foliage
  misc_feature: Utility: Useful for making smaller plants
MRRTTSLREVAPPSVLAVVLEDEDEDEQAKAVVQAEEGGAGGGQDWLAALGGGSGAPGTDWLAAYRARAAPARAGLRRNSADYSKVETAAFLRHCGLCRRLLGPGRDTFMYKGEAAFCSLECRQQHITHEEWKDKCTPRSMSEAAAPATSRGRSGKTDTGGTVAAA

SEQ ID NO: 1474 - DNA, 680 bp, Arabidopsis thaliana
  misc_feature (1)..(680): Ceres CLONE ID no. 13812
  misc_feature (1)..(680): Also known as  Ceres CDNA ID no. 23367346
aagaagatttgttcaggcacacgctaaaacacacaaacaaaaaaacaactcttcaagaacatatacatttaatatttatataaacaaaaaagaatggatcttgatttaatacaagatctgcccatcttgaatttcccaccagccatcaagatccgagccaacaccaacagagatgatgacggcggcggctgcaccactcccacttcttccgaccacaagattcctcccaccacagccaccactcctcctcctccaccgcagaaaccccgtccaccttccacaccgtcgtctctcggcatcagatcttgcaagagaaagcttatgacgtcattgtccaagtatgagatcatcgtcaacaaagatgagatcgagcggttcttctcctctgtttacaaccaaacgatggcgtcatccaccacgacggctatcacggtggccaagcggcgaagaagtttccgttcttgttcacgaagatgatcaataattggacgtttcattaaaggttccataatttcgaatagctttttcgatttttatttatttttatgtaatgtttttatcaactttacacgtcgacccactctataaatatacatgtgcgatcgatcgatggaatctttttttctttactaaaatttgctagctgttttgataacgaatgaccaaattccagtagtttc

SEQ ID NO: 1475 - protein, 127 aa, Arabidopsis thaliana
  misc_feature: Utility: Useful for increasing increasing anthocyanin content
  misc_feature: Utility: Useful for making ornamental plants with modified leaves
  misc_feature: Utility: Useful for making plants sterile and for genetic confinement
  misc_feature: Utility: Useful for making plants with increased biomass and foliage
  misc_feature: Utility: Useful for making smaller plants
MDLDLIQDLPILNFPPAIKIRANTNRDDDGGGCTTPTSSDHKIPPTTATTPPPPPQKPRPPSTPSSLGIRSCKRKLMTSLSKYEIIVNKDEIERFFSSVYNQTMASSTTTAITVAKRRRSFRSCSRR

SEQ ID NO: 1476 - protein, 122 aa, Brassica napus
  misc_feature (1)..(122): Ceres CLONE ID no. 1080126
  misc_feature: Utility: Useful for increasing increasing anthocyanin content
  misc_feature: Utility: Useful for making ornamental plants with modified leaves
  misc_feature: Utility: Useful for making plants sterile and for genetic confinement
  misc_feature: Utility: Useful for making plants with increased biomass and foliage
  misc_feature: Utility: Useful for making smaller plants
MDLDLLQDLPMLNFPSPIKIRSNNRDADGGGGGCTTPTSSDHKIPPSSATTPPPPPQKRRALPPSLVYRSCKRKLLTSSKFEIIANKDEIDRFFSSVYNQTMTSSPTTATTSTLPVARRRRS

SEQ ID NO: 1477 - protein, 133 aa, Brassica napus
  misc_feature (1)..(133): Ceres CLONE ID no. 873616
  misc_feature: Utility: Useful for increasing increasing anthocyanin content
  misc_feature: Utility: Useful for making ornamental plants with modified leaves
  misc_feature: Utility: Useful for making plants sterile and for genetic confinement
  misc_feature: Utility: Useful for making plants with increased biomass and foliage
  misc_feature: Utility: Useful for making smaller plants
  misc_feature (32)..(32): Xaa is any aa, unknown, or other
MDIGLIQDLPMLNFPSPIKIRSNIDDDGNSGXCTTPTSSHHKIPPLTATTPPPPPQKRRPPPTPSSLVRSCKRKLMTSSKFEIIVNKDEIDRFFSSVYNQRVTSSPTTTTTTTTTTALTVSKRRRSFRSCSRK

SEQ ID NO: 1478 - protein, 129 aa, Glycine max
  misc_feature (1)..(129): Ceres CLONE ID no. 478304
  misc_feature: Utility: Useful for increasing increasing anthocyanin content
  misc_feature: Utility: Useful for making ornamental plants with modified leaves
  misc_feature: Utility: Useful for making plants sterile and for genetic confinement
  misc_feature: Utility: Useful for making plants with increased biomass and foliage
  misc_feature: Utility: Useful for making smaller plants
  misc_feature (25)..(25): Xaa is any aa, unknown, or other
  misc_feature (79)..(79): Xaa is any aa, unknown, or other
  misc_feature (103)..(103): Xaa is any aa, unknown, or other
  misc_feature (125)..(125): Xaa is any aa, unknown, or other
MSTDLHLHHELPKLRIAAVVKTDDXLPSDAQDDRNAVSSAVTQAEAENDGAITVDVGVKVNDESCRTPTSKESKIPATXTCPPAPRKPKFASCKRKLLEEFQXFDVTNKEDMDAFFRSTFPKRGXTTCT

SEQ ID NO: 1479 - DNA, 1103 bp, Arabidopsis thaliana
  misc_feature (1)..(1103): Ceres CLONE ID no. 32811
  misc_feature (1)..(1103): Also known as  Ceres CDNA ID no. 23416861
tcacataatcacattgcatgattgatcaaatactcgattttccgtgaaatctctttgaatatttcgattccttgttaccatggcgcttcatgggtctggagttttttgtaaagtttcaaacatggtagagatcacttctccgtttggtggttccatgaggctgcttcacttgcctaaatcttatccgattcactgcaacatggtttcagctagcaatacatttgggtcagctcatctcaagctgcaaaacaaagaaccgtgctcccgtttaaggccttgtcgagtcaaacgcgaagaaaataaccaaactgcggatgttgaaagcatttcaatggatgagaacacgttgaagcaagatctcgagactgcggtccaggaagagaattatgtggaggcagctaaaatccgtgataaactaaaagagcttcaagaagacaacaaagcctctgttttatcagccaattctcggttctaccaatctttcagaaacggggatttagctgcgatgcaatcactatggtcaaaatcaggaaacccgtgctgtgtacatccaggggccaaaggcataactggttatgattacgtgatggaaagctgggagcttgtgtggatgaactatgagtttccgttactgattgagctgaaagatgtcgaggttcatgtccgaggagaagtaggttatgtaacgtgtatggagtttgtgaagacgaaagggagtagtagttggggagctcagtttgtgtcgaatgtgtttgaacggatcgatggacaatggtttatatgcattcaccatgcttctcctgttgatatttgatcaaagaatcgaagaaacgatacacattttcaaaacgttttatttttatatgcgtttggaggttgcggtgggatacattggtggtttgcttaagggtgatgaaggactgttttttatttctgaggttggcgattgggaatgaaaacgccacacaaacgagaagaggcataagttgtgacgtttgtactagaagaggcacaaaggatcattttattataaccagagccttgtagatctggcaaatcatgtagacaatgaaaaatgagaagaaaaataaactctttttatt

SEQ ID NO: 1480 - protein, 244 aa, Arabidopsis thaliana
  misc_feature (90)..(119): Pfam Name: UVR; Pfam Description: UvrB/uvrC motif
  misc_feature (90)..(119): Pfam Name: UVR; Pfam Description: UvrB/uvrC motif
  misc_feature: Utility: Useful for increasing increasing anthocyanin content
MALHGSGVFCKVSNMVEITSPFGGSMRLLHLPKSYPIHCNMVSASNTFGSAHLKLQNKEPCSRLRPCRVKREENNQTADVESISMDENTLKQDLETAVQEENYVEAAKIRDKLKELQEDNKASVLSANSRFYQSFRNGDLAAMQSLWSKSGNPCCVHPGAKGITGYDYVMESWELVWMNYEFPLLIELKDVEVHVRGEVGYVTCMEFVKTKGSSSWGAQFVSNVFERIDGQWFICIHHASPVDI

SEQ ID NO: 1481 - protein, 231 aa, Arabidopsis thaliana
  misc_feature (1)..(231): Public GI no. 50915438
  misc_feature: Utility: Useful for increasing increasing anthocyanin content
MAAAAASTPARAWWRAAAPASASTAAVSCFRVGAKSLTGLQMTSTRANKVRTVHVKSGEAEGSPSTESITRDEETLQRDLQTAIQEENYAQAAKLRDELRVLQEDSRSAVLAANARFYNAFKNGDLVAMHSAWAKGDHVYVVHPSAGRISGYDMVMQSWEMVCDADYEFPLQIDLQDVEVHVRGDLGYVTCLELVKTKGSSSWGRQVATNVFEKVDGKWFICIHHASHFDE

SEQ ID NO: 1482 - protein, 240 aa, Arabidopsis thaliana
  misc_feature (1)..(240): Public GI no. 51979387
  misc_feature: Utility: Useful for increasing increasing anthocyanin content
MAAPNPSATMAAAAASTPARAWWRAAAPASASTAAVSCFRVGAKSLTGLQMTSTRANKVRTVHVKSGEAEGSPSTESITRDEETLQRDLQTAIQEENYAQAAKLRDELRVLQEDSRSAVLAANARFYNAFKNGDLVAMHSAWAKGDHVYVVHPSAGRISGYDMVMQSWEMVCDADYEFPLQIDLQDVEVHVRGDLGYVTCLELVKTKGSSSWGRQVATNVFEKVDGKWFICIHHASHFDE

SEQ ID NO: 1483 - protein, 247 aa, Zea mays
  misc_feature (1)..(247): Ceres CLONE ID no. 322953
  misc_feature: Utility: Useful for increasing increasing anthocyanin content
MALAAATATTTSPARASWRPTVPATSASAAGVCFRVGAKRFSPGLRTASTCRHRHRGRTRLTTAHVKSGEAEGRPSTEESATGIGGPDEDSLRRELETAIEEEDYARAAALRDELRVLQEDCRAAVLAANARFYAAFKDGDLAAMRRAWARGDHVYVVHPSAGRISGYEMVMQSWEMVCDAGYEFPLQVDLQDVEVRVRGGVGYVTCLEMVRTKGSSSWGKQLATNVFEEVDGEWLMCVHHASHFDE

SEQ ID NO: 1484 - protein, 242 aa, Triticum aestivum
  misc_feature (1)..(242): Ceres CLONE ID no. 1004568
  misc_feature: Utility: Useful for increasing increasing anthocyanin content
MSAAQAASAILRPSASTPLREAAFFFTDNHNPSPARLCIRRGSAERTFAGLQIAASNFNRSRICHVKSGEADGYPQTEEDQLADEETLQRNLDRAIREEDYARAAKIRDDLRVLHEDTEASVLAANTRFYNAFKNGDFTAMYSIWAKGDHVYVVHPGAGRISGYDVVLQSWEMVCNADYEFPLNIDLKNIEVHVCGDLGYVTCLELVKTKGKSWGKQIATNVFEKIDGTWYICIHHASHIEE

SEQ ID NO: 1485 - DNA, 797 bp, Zea mays
  misc_feature (1)..(797): Ceres CLONE ID no. 224062
  misc_feature (1)..(797): Also known as  Ceres CDNA ID no. 23749815
cagaagggggcaaagctcgcggcctcgcgtcgcgccggtcgttccggtccaacgcggcgacgccaaaggctgccgtccccgggcttcctcctccccctcaccccttcccctcgccaaaccacaggaagaagcgagcagggcatcgagttttctcgatcgatggcatcggcgcctgccgattcctacgggtgcgcggcgtgcggcgcgcccctgaacctgtcggcggcgcacctgtacccggcggacttctacttcgaggccgggaacaagggcacgctgtccttctcgtgggtggacgagtcgcgcctgcggttcgcgcccgaggaccgcatccgccccttcttcgagaccctcaactactggggcatccagcggaagcgcacgcgcatcagctgcgacgcctgcggccacctgcttggccacgtctacgacgacggtccgccggccatgcagggcaccggccagttcgggatggggcccagccaggtcatcccgcgccgccccaggtaccgcttcaagatcaaggccatcgccgccagctcctcggcacctgccgccgccgcctatgaaaagtgatgctccatagatttcttcatctggttgcgtgtcctgtgtgctgtcggtgctgtggttcgtgacttcctgtaaattacgtagcttcctgcaattcgcgtcctgcgttgttttctttagaaacagtgtgtttgaaatggcatgcgactgaaactatgattgaaatggcatgcgacttctaatatacacacaagacagaagatataaataaaaaactatgattg

SEQ ID NO: 1486 - protein, 138 aa, Zea mays
  misc_feature: Utility: Useful for increasing increasing anthocyanin content
MASAPADSYGCAACGAPLNLSAAHLYPADFYFEAGNKGTLSFSWVDESRLRFAPEDRIRPFFETLNYWGIQRKRTRISCDACGHLLGHVYDDGPPAMQGTGQFGMGPSQVIPRRPRYRFKIKAIAASSSAPAAAAYEK

SEQ ID NO: 1487 - protein, 139 aa, Zea mays
  misc_feature (1)..(139): Ceres CLONE ID no. 1490254
  misc_feature: Utility: Useful for increasing increasing anthocyanin content
MASAPADSYGCAACGALLDLSAAHLYPADFYFEAGNKGTLSFSWVDESRLRFAPEDRIRPFFETLNYWGIQRKRTRISCDACGHLLGHVYDDGPPAMQGTGQFGMGPSQVIPRRPRYRFKIKAIAASSSAPAAAAAYGK

SEQ ID NO: 1488 - protein, 141 aa, Glycine max
  misc_feature (1)..(141): Ceres CLONE ID no. 1074247
  misc_feature: Utility: Useful for increasing increasing anthocyanin content
MAQPPAPATPAAAYGCAACGADLNLSASNLYPAGTYFEAGNKGTLSFSWVDESRLRFAAEDRIRPFFETLDYWGIQRKRTRVSCDACGRLLGHVYDDGPPLMDGTGQLGMGPSQVVPRRPRYRFKVKAVTAAGSSSAAAAR

SEQ ID NO: 1489 - protein, 135 aa, Glycine max
  misc_feature (1)..(135): Public GI no. 30680080
  misc_feature: Utility: Useful for increasing increasing anthocyanin content
MASTIYTCKECGSDLNLNPNDLFPPDFYFEAGNKGTLSFAAVDAEKFRFEKEDKIMPFFETLNYWGIQRKRTKIKCTSCNHLIGYIYDDGPPLTGGIGQYGFGPSQVIPRAPRYRFKTKARQDGWQYGGLTAFWN

SEQ ID NO: 1490 - protein, 127 aa, Arabidopsis thaliana
  misc_feature (1)..(127): Ceres CLONE ID no. 20269
  misc_feature: Utility: Useful for increasing increasing anthocyanin content
MASTIYTCKECGSDLNLNPNDLFPPDFYFEAGNKGTLSFAAVDAEKFRFEKEDKIMPFFETLNYWGIQRKRTKIKCTSCNHLIGYIYDDGPPLTGGIGQYGFGPSQVIPRAPRYRFKTKAVQVSSQT

SEQ ID NO: 1491 - protein, 127 aa, Arabidopsis thaliana; identical to SEQ ID NO: 1490
  misc_feature (1)..(127): Public GI no. 50058911
  misc_feature: Utility: Useful for increasing increasing anthocyanin content

SEQ ID NO: 1492 - protein, 127 aa, Brassica napus
  misc_feature (1)..(127): Ceres CLONE ID no. 1036315
  misc_feature: Utility: Useful for increasing increasing anthocyanin content
MAFTMYSCKECGSDLNLNPNDLFPPDFYFEAGNKATISFAAVDADKFRFEKEDKIMPFFETLNYWGIQRKRTKIKCHSCGHLVGYIYDDGPPLTGGIGQYGFGPSQVVPRAPRYRFKTKTLLISSQT

SEQ ID NO: 1493 - protein, 125 aa, Glycine max
  misc_feature (1)..(125): Ceres CLONE ID no. 592780
  misc_feature: Utility: Useful for increasing increasing anthocyanin content
MASVYSCTECGSNLNLNSAHAYPPDFYFEAGNKGSVSFSVADPTKFKFEKEDKLRPFFETVNYWGIQRKRTKIKCNTCDCLLGYVYDDGPPLTDSPGQFHMGPSQVIPRAPRYRFKTKTLRITST

SEQ ID NO: 1494 - DNA, 1209 bp, Arabidopsis thaliana
  misc_feature (1)..(1209): Ceres CLONE ID no. 254065
  misc_feature (1)..(1209): Also known as  Ceres CDNA ID no. 23449358
aattagaatctttcccgacaaagaaatagctctaagcacgacctttttcttcctaagtcgccggcgagacaaaaaaaacataatcccgacggttacacgtaccggataattgtatttaagttgaatccgctttgtactttcctcacagccaaagatttttccttactaggattttcattttctcttctgttttcgtttcaaattcagaaaatcttccgtttcaatccggtttatatcggtttttagcaatgtcgatggtaactgtcaaagttagcaacgtttctcttgaagcaacagaaagagatctcaaggagttcttctctttttccggcgatattgcttacctcgagactcaaagcgagaatgatggttctaaattagcatatgtcacattcaaggatttacaaggagctgaaaccgcagttctcctcaccggatcgacgattgttgattcatcggtcacagttacaatgtcaccagattaccaactacctcctgatgctttagcttccattgaatcattgaaagagagcaataaatcatcatctcctacgcgagaagatgtatcggtatttagaaaagctgaagatgttgtaagtggtatgatttcaaaagggtttgttttaggtaaagacgctatagctaaagcgaagagtcttgatgagaagcatcagttgacatcaacagcttcagctagagttacatctttcgacaaaagaatcggattcacggagaaaatcaacaccgggactacagttgtgagcgaaaaagttaaagaagttgatcagaagtttcaagtcacagagaaaacaaaatcagcaatagctgctgctgagcagacagtgagcaatgctggttctgctataatgaaaaaccggtatgttttaaccggtgccacgtgggttacgggtgcgtttaacagagtgagtaaagctgctgaagaagttggacaaaaggcgaaagagaaagttggtttggctgaggaagaagaagaagagaagaagaaagtggttgatgaagttgctatagttcatctgactgaatcaccaaaggctttagaccaatcagaacaagattcaaaactccctgaatcaaaatcacagccacacaaggagcttaacgcaagtgttgtttgagctcaaccttgagatacgtataaggaactttctccaaacgttttttggaacaatgaagctgactctttaggac

SEQ ID NO: 1495 - protein, 295 aa, Arabidopsis thaliana
  misc_feature (6)..(73): Pfam Name: RRM_1; Pfam Description: RNA recognition motif. (a.k.a. RRM, RBD, or RNP domain)
  misc_feature: Utility: Useful for increasing increasing anthocyanin content
  misc_feature: Utility: Useful for making ornamental plants with modified leaves
  misc_feature: Utility: Useful for making smaller plants
MSMVTVKVSNVSLEATERDLKEFFSFSGDIAYLETQSENDGSKLAYVTFKDLQGAETAVLLTGSTIVDSSVTVTMSPDYQLPPDALASIESLKESNKSSSPTREDVSVFRKAEDVVSGMISKGFVLGKDAIAKAKSLDEKHQLTSTASARVTSFDKRIGFTEKINTGTTVVSEKVKEVDQKFQVTEKTKSAIAAAEQTVSNAGSAIMKNRYVLTGATWVTGAFNRVSKAAEEVGQKAKEKVGLAEEEEEEKKKVVDEVAIVHLTESPKALDQSEQDSKLPESKSQPHKELNASVV

SEQ ID NO: 1496 - protein, 313 aa, Arabidopsis thaliana
  misc_feature (1)..(313): Ceres CLONE ID no. 39922
  misc_feature: Utility: Useful for increasing increasing anthocyanin content
  misc_feature: Utility: Useful for making ornamental plants with modified leaves
  misc_feature: Utility: Useful for making smaller plants
MTMTTVKVSNVSLGATDRDLKEFFSFSGDILYLETQSETERTKLAYVTFKDLQGAETAVLLSGATIVDSSVIVSMAPDYQLSPEALASLEPKDSNKSPKAGDSVLRKAEDVVSSMLAKGFILGKDAIAKAKSVDEKHQLTSTASAKVASFDKKIGFTDKINTGTVVVGEKVREVDQKYQVSEKTKSAIAAAEQTVSNAGSAIMKNRYVLTGATWVTGAFNKVAKAAEEVGQKAKEKVGMAEEEDKRKVVDEFARVHLSESPKAASSTQEAERESKLSESPEAKKDSEHLEPQSKPLQQQSPPPMASAPAPAQP

SEQ ID NO: 1497 - protein, 313 aa, Arabidopsis thaliana; identical to SEQ ID NO: 1496
  misc_feature (1)..(313): Public GI no. 21593540
  misc_feature: Utility: Useful for increasing increasing anthocyanin content
  misc_feature: Utility: Useful for making ornamental plants with modified leaves
  misc_feature: Utility: Useful for making smaller plants

SEQ ID NO: 1498 - protein, 280 aa, Glycine max
  misc_feature (1)..(280): Ceres CLONE ID no. 477450
  misc_feature: Utility: Useful for increasing increasing anthocyanin content
  misc_feature: Utility: Useful for making ornamental plants with modified leaves
  misc_feature: Utility: Useful for making smaller plants
MTIKTVKVSNVSLGATEQDIKEFFSFSGDIEYVELQSHDERSQIAFITFKDSQGAETAVLLSGATIVDMPVTISLDPDYQLPPAALASPVRETRTPGGGADSAFRKAEDVVSGMLAKGFILGKDAVNKAKTFDEKHQLSSTASAKVASFDQKIGLSEKISAGATVVGDRVREVDQKFQVSEKTKSAFAAAEQTVSNAGSAIMKNRYVLTGASWVTGAFSKVSKAAGEVGQKTKEKVESAEEQQKRKVEDQYAQVLSESPKAAEASEQKSSKPAPAQGLIL

SEQ ID NO: 1499 - protein, 314 aa, Glycine max
  misc_feature (1)..(314): Public GI no. 32489377
  misc_feature: Utility: Useful for increasing increasing anthocyanin content
  misc_feature: Utility: Useful for making ornamental plants with modified leaves
  misc_feature: Utility: Useful for making smaller plants
MAASTFSTVKVSNVSLKASLRDVKEFFSFSGDIVHVEMQSSDELSQVAYITFKDNQGSETAMLLTGATIVDMAVIVTPATDYELPASVLAALEPKDSKPSALQKAEDIVGTMLAKGFILGRDALDRAKALDEKHQLTSTATARVSSFDKKMGLSEKISVGTSAVNDKVKEMDQKYQVSEKTRSALAAAEQSVSTAGSAIMKNRYVLTGAAWVTGAFNKVANAANDVGTKAKEKIASEQEHKTVELESAEPNSSEGHGTQKDVDGEFAKIQVSESPEDIPISTTATVPITDEDSSQASPPAASPKKPEPAQGLIL

SEQ ID NO: 1500 - protein, 303 aa, Zea mays
  misc_feature (1)..(303): Ceres CLONE ID no. 241340
  misc_feature: Utility: Useful for increasing increasing anthocyanin content
  misc_feature: Utility: Useful for making ornamental plants with modified leaves
  misc_feature: Utility: Useful for making smaller plants
  misc_feature (295)..(295): Xaa is any aa, unknown, or other
MATSMLSTVKVSNVSLKAAQRDIKEFFSFSGDIVHVEMQSFDELSQVAYITFKDKQGAETAMLLTGATIVDMAVIVTPANDYELPSSVLAALEPKDTKPSALQKAEDIVGTMLAKGFILGRDALDKAKALDEKHQLTSTATARVSSFDKRIGLSEKISVGTSVVNDKVKEMDQKYQVSEKTKSALAAAEHSVSTAGSAIMKNRYVLTGAAWVTGAFSKVTSAANEAGAKAKEKIAVEQEHKNAEGGPAQANISETHEAHRGLDGGFSRLHDSETPEDIPISTASVPAVTDEEPSXGFSTSWCS

SEQ ID NO: 1501 - protein, 317 aa, Triticum aestivum
  misc_feature (1)..(317): Ceres CLONE ID no. 700178
  misc_feature: Utility: Useful for increasing increasing anthocyanin content
  misc_feature: Utility: Useful for making ornamental plants with modified leaves
  misc_feature: Utility: Useful for making smaller plants
MATSTLSTVMVSNLSLKAALRDVKEFFSFSGDLVHVEMQSGDELSQVAYIAFKDKQGAETAMLLTGATIVDMAVIVTPATDYELPADVLAALEPKDAKSSALEKAEDIVGTMLAKGFILGRDALDKAKALDEKHQLTSTATARVSSFDKRIGLSEKISVGTSVVNDKVKEMDQKYLVSEKTRSALAAAEQGVSTAGSAIMKNRYVLTGAAWVTGAFSKVANTANDVGAKAKEKIAAEQEGKTVAAGHAQADMSDAREKPRDLDGEVTKIHVSENPEDIPISTAAVFPITVDDSSDASPPPPATALPKKPEPAQGLIL

SEQ ID NO: 1502 - DNA, 1202 bp, Arabidopsis thaliana
  misc_feature (1)..(1202): Ceres CLONE ID no. 22339
  misc_feature (1)..(1202): Also known as  Ceres CDNA ID no. 23368521
gttagatgatctgtccatttttttcttttttcttctgtgtataaatatatttgagcacaaagaaaaactaataaccttctgttttcagcaagtagggtcttataaccttcaaagaaatattccttcaattgaaaacccataaaccaaaatagatattacaaaaggaaagagagatattttcaagaacaacataattagaaaagcagaagcagcagttaagtggtactgagataaatgatatagtttctcttcaagaacagtttctcattacccaccttctcctttttgctgatctatcgtaatcttgagaactcaggatcaatggaggaaggtgggagtagtcacgacgcagagagtagcaagaaactagggagagggaaaatagagataaagaggatagagaacacaacaaatcgtcaagttactttctgcaaacgacgcaatggtcttctcaagaaagcttatgaactctctgtcttgtgtgatgccgaagttgccctcgtcatcttctccactcgtggccgtctctatgagtacgccaacaacagtgtgaggggtacaattgaaaggtacaagaaagcttgttccgatgccgtcaaccctccttccgtcaccgaagctaatactcagtactatcagcaagaagcctctaagcttcggaggcagattcgagatattcagaattcaaataggcatattgttggggaatcacttggttccttgaacttcaaggaactcaaaaacctagaaggacgtcttgaaaaaggaatcagccgtgtccgctccaaaaagaatgagctgttagtggcagagatagagtatatgcagaagagggaaatggagttgcaacacaataacatgtacctgcgagcaaagatagccgaaggcgccagattgaatccggaccagcaggaatcgagtgtgatacaagggacgacagtttacgaatccggtgtatcttctcatgaccagtcgcagcattataatcggaactatattccggtgaaccttcttgaaccgaatcagcaattctccggccaagaccaacctcctcttcaacttgtgtaactcaaaacatgataacttgtttcttcccctcataacgattaagagagagacgagagagttcattttatatttataacgcgactgtgtattcatagtttaggttctaataatgataataacaaaactgttgtttc

SEQ ID NO: 1503 - protein, 248 aa, Arabidopsis thaliana
  misc_feature (24)..(74): Pfam Name: SRF-TF; Pfam Description: SRF-type transcription factor (DNA- binding and dimerisation domain)
  misc_feature (89)..(188): Pfam Name: K-box; Pfam Description: K-box region
  misc_feature: Utility: Useful for increasing seed/fruit yield or modifying fruit content
  misc_feature: Utility: Useful for making plants with altered leaf shape eg curled leaves
MEEGGSSHDAESSKKLGRGKIEIKRIENTTNRQVTFCKRRNGLLKKAYELSVLCDAEVALVIFSTRGRLYEYANNSVRGTIERYKKACSDAVNPPSVTEANTQYYQQEASKLRRQIRDIQNSNRHIVGESLGSLNFKELKNLEGRLEKGISRVRSKKNELLVAEIEYMQKREMELQHNNMYLRAKIAEGARLNPDQQESSVIQGTTVYESGVSSHDQSQHYNRNYIPVNLLEPNQQFSGQDQPPLQLV

SEQ ID NO: 1504 - protein, 249 aa, Arabidopsis thaliana
  misc_feature (1)..(249): Public GI no. 17223670
  misc_feature: Utility: Useful for increasing seed/fruit yield or modifying fruit content
  misc_feature: Utility: Useful for making plants with altered leaf shape eg curled leaves
MDEGGSSHDAESSKKIGRGKIEIKRIENTTNRQVTFCKRRNGLLKKAYELSVLCDAEVALVIFSTRGLLYEYASNSVKGTIERYKKACSDAVNPPTVTEANTKHYQQEASKLRRQIRDIQNSNRHIVGESLGSLNFKELKNLEGRLEKGISRVRSKKSELLVAEIEYMQKREMELQHVNMYLRAKIEQGARLNPEQHGSGVIQGTAVYESGLSSSHDQSQHYNRNYIPVNLLEPNQQFSGQDQPPLQLV

SEQ ID NO: 1505 - protein, 246 aa, Arabidopsis thaliana
  misc_feature (1)..(246): Public GI no. 52548150
  misc_feature: Utility: Useful for increasing seed/fruit yield or modifying fruit content
  misc_feature: Utility: Useful for making plants with altered leaf shape eg curled leaves
MEGGASNEVAESSKKIGRGKIEIKRIENTTNRQVTFCKRRNGLLKKAYELSVLCDAEVALVIFSTRGRLYEYANNSVRGTIERYKKACSDAVNPPTITEANTQYYQQEASKLRRQIRDIQNLNRHILGESLGSLNFKELKNLESRLEKGISRVRSKKHEMLVAEIEYMQKREIELQNDNMYLRSKITERTGLQQQESSVIHQGTVYESGVTSSHQSGQYNRNYIAVNLLEPNQNSSNQDQPPLQLV

SEQ ID NO: 1506 - protein, 246 aa, Arabidopsis thaliana
  misc_feature (1)..(246): Public GI no. 52548152
  misc_feature: Utility: Useful for increasing seed/fruit yield or modifying fruit content
  misc_feature: Utility: Useful for making plants with altered leaf shape eg curled leaves
MEGGASNEVAESSKKIGRGKIEIKRIENTTNRQVTFCKRRNGLLKKAYELSVLCDAEVALVIFSTRGRLYEYANNSVRGTIERYKKACSDAVNPPTITEANTQYYQQEASKLRRQIRDIQNLNRHILGESLGSLNFKELKNLESRLEKGISRVRSKKHEMLVAEIEYMQKREIELQNDNMYLRSKITERTGLQQQESSVIHQGTAYESGVTSSHQSGQYNRNYIAVNLLEPNQNSSNQDQPPLQLV

SEQ ID NO: 1507 - protein, 246 aa, Arabidopsis thaliana
  misc_feature (1)..(246): Public GI no. 52548134
  misc_feature: Utility: Useful for increasing seed/fruit yield or modifying fruit content
  misc_feature: Utility: Useful for making plants with altered leaf shape eg curled leaves
MEDGASNEVAESSKKIGRGKIEIKRIENTTNRQVTFCKRRNGLLKKAYELSVLCDAEVALVIFSTRGRLYEYANNSVRGTIERYKKACSDAVNPPTITEANTQYYQQEASKLRRQIRDIQNLNRHILGESLGSLNFKELKNLESRLEKGISRVRSKKHEMLVAEIEYMQKREIELQNDNMYLRSKITERTGLQQQESSVIHQGTVYESGVTSSHQSGQYNRNYIAVNLLEPNQNSSNQDQPPLQLV

SEQ ID NO: 1508 - protein, 249 aa, Arabidopsis thaliana
  misc_feature (1)..(249): Public GI no. 6970411
  misc_feature: Utility: Useful for increasing seed/fruit yield or modifying fruit content
  misc_feature: Utility: Useful for making plants with altered leaf shape eg curled leaves
MEFPKQITPADDPESSSQKKLGRGKIEIKRIENTTNRQVTFCKRRNGLLKKAYELSVLCDAEVALIVFSTRGRLYEYANNSVRATIERYKKACDSSNTGSVTETNVQFYQQEASKLRRQIREIQNSNRHILGEALSTLNVKELKNLEGRLEKGISRIRSKKNEMLFAEIEYMQKREIELQNHNNFLRAKIAENDRAQQQQANMMPGTLSAYDQSMPPPQSYDRSFLPVILESNHHYNRQGQNQTPLQLV

SEQ ID NO: 1509 - protein, 244 aa, Arabidopsis thaliana
  misc_feature (1)..(244): Public GI no. 5031217
  misc_feature: Utility: Useful for increasing seed/fruit yield or modifying fruit content
  misc_feature: Utility: Useful for making plants with altered leaf shape eg curled leaves
LATTEFPNQSSEGSSSQKKMGRGKIEIKRIENTTNRQVTFCKRRNGLLKKAYELSVLCDAEIALIVFSSRGRLYEYANNSVKSTIERYKKASDTSNPGSVSETNAQFYQQESSKLRRQIRDIQNLNRHIMGEALSSLTFRELKNLEGRLEKGISRIRSKKNELLFAEIEYMQKREIELQNANMYLRAKIAENERNQQQTELMPGSVYETMPSSQPYDRSFLVANLLEPPNHHYSRQDQTPLQLV

SEQ ID NO: 1510 - protein, 225 aa, Arabidopsis thaliana
  misc_feature (1)..(225): Public GI no. 14279306
  misc_feature: Utility: Useful for increasing seed/fruit yield or modifying fruit content
  misc_feature: Utility: Useful for making plants with altered leaf shape eg curled leaves
MGRGKIEIKRIENTTNRQVTFCKRRNGLLKKAYELSVLCDAEVALIVFSSRGRLYEYANNSVRTTIERYKKVCSDSSNTGSVSEANAQFYQQEASKLRRQIRDIQNLNRHILGEALSSLNFKELKNLETRLEKGISRIRSKKNELLFAEIEYMQKREIELQNSNLFLRAQIAENERAQQQMNLMPGSQYESVPQQPYDSQNLLPVNLLDPNHHYSRHDQTALQLV

SEQ ID NO: 1511 - protein, 241 aa, Arabidopsis thaliana
  misc_feature (1)..(241): Public GI no. 62132641
  misc_feature: Utility: Useful for increasing seed/fruit yield or modifying fruit content
  misc_feature: Utility: Useful for making plants with altered leaf shape eg curled leaves
MELPNEGGEGSSQKKLGRGKIEIKRIENTTNRQVTFCKRRNGLLKKAYELSVLCDAEVALVVFSTRGRLYEYANNSVRATIERYKKACAASTNAESVSEANTQFYQQESSKLRRQIRDIQNLNRHILGEALGSLSLKELKNLEGRLEKGLSRVRSRKHETLFADVEFMQKREIELQNHNNYLRAKIAEHERAQQQQQNLMPETMCESLPSQTYDRNFFPVNLLGSDQQEYSRQDQTALQLV

SEQ ID NO: 1512 - protein, 242 aa, Glycine max
  misc_feature (1)..(242): Ceres CLONE ID no. 1043518
  misc_feature: Utility: Useful for increasing seed/fruit yield or modifying fruit content
  misc_feature: Utility: Useful for making plants with altered leaf shape eg curled leaves
MEDPNQAQEGSSQKKMGRGKIEIKRIENTTNRQVTFCKRRNGLLKKAYELSVLCDAEVALVVFSTRGRLYEYANNSVRATIERYKKANAAASNAESVSEANTQFYQQESSKLRRQIRDIQNLNRHILGEALGSLSLKELKNLEGRLEKGLSRVRSRKHETLFADVEFMQKREIELQNHNNYLRAKIAEHERAQQQQSNMMSGTLCESLPSQSYDRNFFPVNLIASDDQQQYSSQDHTALQLV

SEQ ID NO: 1513 - protein, 243 aa, Glycine max
  misc_feature (1)..(243): Ceres CLONE ID no. 1046745
  misc_feature: Utility: Useful for increasing seed/fruit yield or modifying fruit content
  misc_feature: Utility: Useful for making plants with altered leaf shape eg curled leaves
  misc_feature (82)..(82): Xaa is any aa, unknown, or other
  misc_feature (111)..(111): Xaa is any aa, unknown, or other
MEDPNQAQEGSSQKKMGRGKIEIKRIENTTNRQVTFCKRRNGLLKKAYELSVLCDAEVALVVFSTRGRLYEYANNSVRATIXRYKKANAAASNAESVSEANTQFYQQESSXLRRQIRDIQNLNRHILGEALGSLSLKELKNLEGRLEKGLSRVRSRKHETLFADIEFMQKREIELQNHNNFLRAKIAENERAQQRQQDMIPGTECESTIPNSQSYDRNFFPVNLIDSNNNQYSRQDQTALQLV

SEQ ID NO: 1514 - protein, 242 aa, Glycine max
  misc_feature (1)..(242): Public GI no. 33308109
  misc_feature: Utility: Useful for increasing seed/fruit yield or modifying fruit content
  misc_feature: Utility: Useful for making plants with altered leaf shape eg curled leaves
MEFPNQAPESSSQKKLGRGKIEIKRIENTTNRQVTFCKRRNGLLKKAYELSVLCDAEVALIVFSNRGRLYEYANNSVRATIDRYKKAYADPTNSGSVSEANTQFYQQEASKLRRQIREIQNSNRHILGEALSSLNAKELKNLEGRLEKGISRIRSKKNEMLFSEIEFMQKRETELQHHNNFLRAKIAENEREEQQHTHMMPGTSYDQSMPSHSYDRNFLPAVILESNNNHYPHQVQTALQLV

SEQ ID NO: 1515 - protein, 242 aa, Glycine max
  misc_feature (1)..(242): Public GI no. 16973296
  misc_feature: Utility: Useful for increasing seed/fruit yield or modifying fruit content
  misc_feature: Utility: Useful for making plants with altered leaf shape eg curled leaves
MEFANQAPESSTQKKLGRGKIEIKRIENTTNRQVTFCKRRNGLLKKAYELSVLCDAEVALIVFSTRGRLYEYANNSVRATIDRYKKACADSTDGGSVSEANTQFYQQEASKLRRQIREIQNSNRHILGESLSTLKVKELKNLEGRLEKGISRIRSKKNEILFSEIEFMQKRETELQHHNNFLRAKIAESEREQQQQQTHMIPGTSYDPSMPSNSYDRNFFPVILESNNNHYPRQGQTALQLV

SEQ ID NO: 1516 - DNA, 1371 bp, Arabidopsis thaliana
  misc_feature (1)..(1371): Ceres CLONE ID no. 99784
  misc_feature (1)..(1371): Also known as  Ceres CDNA ID no. 23363679
ataaaatggcgcaaagtgtgaaagttgaaacatatcctcatatttagcatcactcctctaatattattttttcaaacaagaacaatggcaaaccatctccaagtccccttaaccaaaccggatcgagttaaagaagaacaagaggttgaagaagaggcaagattgctagcgagaaggctcgcgaatgcagccgcattacctatggttctcaaagccgccttggagctcggcgtgatcgacaccatcaccacagtaggaggtggcgatttgtggctctcaccttctgaaatagcactaagactcccaaccaaaccatgcaacctggaagctccggttttgctagaccgtatgcttcgatttctcgtcagccattcggtcttaaaatgccgtactgtaatagaagagaacggtcaaaccggaaaagttgagagggtatatgcagctgaaccggtctgcaaatatctcttgaacaaaagtgacgacgtctcgggttcttttgcatcgctctttatgcttgacctcagcgacgtatttatcaagacatggacacatctcaaagatgtgatattagcaggaagagatgcatttagttctgcccatgggatgaaactattcgaatacatccaagccgatgagcgatttggtaaagtgtttaaccgggctatgttggaatcttccaccatggttacggagaaggttcttaaattttatgaaggattcaaagatgtgaagactttggtggatgtagggggaggacttggcaacacactaggtctcatcacttccaagtatcctcatcttattggtatcaatttcgatttagctccggtgttagccaatgctcattcttatcccggtgtgaaccatgtggctggtgatatgttcatcaagattccaaagggggatgccattttcatgaagtggatactacatgattggacggacgaacaatgcgtagcaattcttaaaaactgttggaaaagtctcgaagaaaatggaaaactgataatagtggaaatggttacaccggtggaagcaaagagcggagatatatgttctaacattgtgtttggtatggacatgacaatgttaacacaatgttcaggtggtaaagagagatctctctatgagtttgaaaatttagcatatgcatcgggtttttctcgttgtgcaatcgtatgcgctgtttatccattttccgtcatcgaaatctacaaatagattcattcaacatatgccattttacgatatttacacaacccgtttcttcttctatttgggatgtaatgtttgtgattatcatttgtgtgtggtcgatcttttgtaatgttttcgtgtgatgttcttaccgttgtaatgatatatgtgtct

SEQ ID NO: 1517 - protein, 378 aa, Arabidopsis thaliana
  misc_feature (40)..(99): Pfam Name: Dimerisation; Pfam Description: Dimerisation domain
  misc_feature (107)..(355): Pfam Name: Methyltransf_2; Pfam Description: O-methyltransferase
  misc_feature: Utility: Useful for increasing seed/fruit yield or modifying fruit content
  misc_feature: Utility: Useful for making plants sterile and for genetic confinement
  misc_feature: Utility: Useful for making smaller plants
  misc_feature: Utility: Useful for making taller plants and plants with longer inflorescences
  misc_feature (328)..(328): Xaa is any aa, unknown, or other
MANHLQVPLTKPDRVKEEQEVEEEARLLARRLANAAALPMVLKAALELGVIDTITTVGGGDLWLSPSEIALRLPTKPCNLEAPVLLDRMLRFLVSHSVLKCRTVIEENGQTGKVERVYAAEPVCKYLLNKSDDVSGSFASLFMLDLSDVFIKTWTHLKDVILAGRDAFSSAHGMKLFEYIQADERFGKVFNRAMLESSTMVTEKVLKFYEGFKDVKTLVDVGGGLGNTLGLITSKYPHLIGINFDLAPVLANAHSYPGVNHVAGDMFIKIPKGDAIFMKWILHDWTDEQCVAILKNCWKSLEENGKLIIVEMVTPVEAKSGDICSNIXFGMDMTMLTQCSGGKERSLYEFENLAYASGFSRCAIVCAVYPFSVIEIYK

SEQ ID NO: 1518 - protein, 378 aa, Arabidopsis thaliana
  misc_feature (1)..(378): Public GI no. 9759075
  misc_feature: Utility: Useful for increasing seed/fruit yield or modifying fruit content
  misc_feature: Utility: Useful for making plants sterile and for genetic confinement
  misc_feature: Utility: Useful for making smaller plants
  misc_feature: Utility: Useful for making taller plants and plants with longer inflorescences
MANHLQVPLTKPDRVKEEQEVEEEARLLARRLANAAASPMVLKAALELGVIDTITTVGGGDLWLSPSEIALRLPTKPCNLEAPALLDRMLRFLVSHSVLKCRTVIEENGQTGKVERVYAAEPVCKYLLNKSDDVSGSFASLFMLDLSDVFIKTWTHLEDVILEGRDAFSSAHGMKLFEYIQADERFGKVFNRAMLESSTMVTEKVLKFYEGFKDVKTLVDVGGGLGNTLGLITSKYPHLIGINFDLAPVLANAHSYPGVNHVAGDMFIKIPKGDAIFMKWILHDWTDEQCVAILKNCWKSLEENGKLIIVEMVTPVEAKSGDICSNIVFGMDMTMLTQCSGGKERDLYEFENLAYASGFSRCAIVCAVYPFSVIEIYK

SEQ ID NO: 1519 - protein, 381 aa, Arabidopsis thaliana
  misc_feature (1)..(381): Public GI no. 12323398
  misc_feature: Utility: Useful for increasing seed/fruit yield or modifying fruit content
  misc_feature: Utility: Useful for making plants sterile and for genetic confinement
  misc_feature: Utility: Useful for making smaller plants
  misc_feature: Utility: Useful for making taller plants and plants with longer inflorescences
MSNHLQDPLTTYPKPGLTKEEQEIDEKMVSLQAESIVNAVAFPMVLKAALELGVIDTIAAASNGTWLSPSEIAVSLPNKPTNPEAPVLLDRMLRLLVSHSILKCCMVESRENGQTGKIERVYAAEPICKYFLKDSDGSGSLSSLLLLLHSQVILKTWTNLKDVILEGKDAFSSAHDMRLFEYISSDDQFSKLFHRAMSESSTMVMKKVLEEYRGFEDVNTLVDVGGGIGTILGLITSKYPHIKGVNFDLAQVLTQAPFYPGVKHVSGDMFIEVPKGDAIFMKWILHDWGDEDCIKILKNCWKSLPEKGKVIIVEMITPMEPKPNDFSCNTVLGMDLLMLTQCSGGKERSLSQFENLAFASGFLLCEIICLSYSYSVIEFHK

SEQ ID NO: 1520 - protein, 381 aa, Arabidopsis thaliana
  misc_feature (1)..(381): Public GI no. 27808586
  misc_feature: Utility: Useful for increasing seed/fruit yield or modifying fruit content
  misc_feature: Utility: Useful for making plants sterile and for genetic confinement
  misc_feature: Utility: Useful for making smaller plants
  misc_feature: Utility: Useful for making taller plants and plants with longer inflorescences
MTNHLQDPLPTYPKPVLTKEEQEVDEKMVSLQAESIVNTVAFPMVLKAAFELGVIDTIAAAGNDTWLSPCEIACSLPTKPTNPEAPVLLDRMLSLLVSHSILKCRMIETGENGRTGKIERVYAAEPVCKYFLSDSDGTGSLVPLFMLLHTQVFFKTWTNLKDVILEGRDAFNSAHGMKIFEYINSDQPFAELFNRAMSEPSTMIMKKVLDVYRGFEDVNTLVDVGGGNGTVLGLVTSKYPHIKGVNFDLAQVLTQAPFYPGVEHVSGDMFVEVPKGDAVFMKWILHDWGDEDCIKILKNCWKSLPEKGKIIIVEFVTPKEPKGGDLSSNTVFAMDLLMLTQCSGGKERSLSQFENLAFASGFLRCEIICLAYSYSVIEFHK

SEQ ID NO: 1521 - protein, 381 aa, Arabidopsis thaliana
  misc_feature (1)..(381): Public GI no. 12323395
  misc_feature: Utility: Useful for increasing seed/fruit yield or modifying fruit content
  misc_feature: Utility: Useful for making plants sterile and for genetic confinement
  misc_feature: Utility: Useful for making smaller plants
  misc_feature: Utility: Useful for making taller plants and plants with longer inflorescences
MTNHLQDPLPTYPKPVLTKEEQEVDEKMVSLQAESIVNTVAFPMVLKAAFELGVIDTIAAAGNDTWLSPCEIACSLPTKPTNPEAPVLLDRMLSLLVSHSILKCRMIETGENGRTGKIERVYAAEPVCKYFLRDSDGTGSLVPLFMLLHTQVFFKTWTNLKDVILEGRDAFNSAHGMKIFEYINSDQPFAELFNRAMSEPSTMIMKKVLDVYRGFEDVNTLVDVGGGNGTVLGLVTSKYPHIKGVNFDLAQVLTQAPFYPGVEHVSGDMFVEVPKGDAVFMKWILHDWGDEDCIKILKNCWKSLPEKGKIIIVEFVTPKEPKGGDLSSNTVFAMDLLMLTQCSGGKERSLSQFENLAFASGFLRCEIICLAYSYSVIEFHK

SEQ ID NO: 1522 - protein, 371 aa, Arabidopsis thaliana; identical to SEQ ID NO: 664
  misc_feature (1)..(371): Public GI no. 47232556
  misc_feature: Utility: Useful for increasing seed/fruit yield or modifying fruit content
  misc_feature: Utility: Useful for making plants sterile and for genetic confinement
  misc_feature: Utility: Useful for making smaller plants
  misc_feature: Utility: Useful for making taller plants and plants with longer inflorescences

SEQ ID NO: 1523 - protein, 365 aa, Arabidopsis thaliana
  misc_feature (1)..(365): Public GI no. 6760443
  misc_feature: Utility: Useful for increasing seed/fruit yield or modifying fruit content
  misc_feature: Utility: Useful for making plants sterile and for genetic confinement
  misc_feature: Utility: Useful for making smaller plants
  misc_feature: Utility: Useful for making taller plants and plants with longer inflorescences
MGSTGETQMTPTHVSDEEANLFAMQLASASVLPMVLKAAIELDLLEIMAKAGPGSFLSPSDLASQLPTKNPEAPVMLDRMLRLLASYSILTCSLRTLPDGKVERLYCLGPVCKFLTKNEDGVSIAALCLMNQDKVLVESWYHLKDAVLDGGIPFNKAYGMTAFDYHGTDPRFNKVFNKGMADHSTITMKKILETYKGFEGLKSIVDVGGGTGAVVNMIVSKYPSIKGINFDLPHVIEDAPQYPGVQHVGGDMFVSVPKGNAIFMKWICHDWSDEHCIKFLKNCYAALPDDGKVILAECILPVAPDTSLATKGVVHMDVIMLAHNPGGKERTEQEFEALAKGSGFQGIRVCCDAFNTYVIEFLKKI

SEQ ID NO: 1524 - protein, 363 aa, Arabidopsis thaliana
  misc_feature (1)..(363): Public GI no. 18025321
  misc_feature: Utility: Useful for increasing seed/fruit yield or modifying fruit content
  misc_feature: Utility: Useful for making plants sterile and for genetic confinement
  misc_feature: Utility: Useful for making smaller plants
  misc_feature: Utility: Useful for making taller plants and plants with longer inflorescences
MGSANPDNKNSMTKEEEEACLSAMRLASASVLPMVLKSAIELDLLELIKKSGPGAYVSPSELAAQLPTQNPDAPVMLDRILRLLASYSVLNCTLKDLPDGGIERLYSLAPVCKFLTKNEDGVSMAALLLMNQDKVLMESWYHLKDAVLEGGIPFNKAYGMTAFEYHGKDPRFNKVFNQGMSNHSTIIMKKILEIYQGFQGLKTVVDVGGGTGATLNMIVSKYPSIKGINFDLPHVIEDAPSYPGVDHVGGDMFVSVPKGDAIFMKWICHDWSDAHCLKFLKNCHEALPENGKVILAECLLPEAPDSTLSTQNTVHVDVIMLAHNPGGKERTEKEFEALAKGAGFRGFIKVCCAYNSWIMELLK

SEQ ID NO: 1525 - protein, 283 aa, Zea mays
  misc_feature (1)..(283): Ceres CLONE ID no. 283499
  misc_feature: Utility: Useful for increasing seed/fruit yield or modifying fruit content
  misc_feature: Utility: Useful for making plants sterile and for genetic confinement
  misc_feature: Utility: Useful for making smaller plants
  misc_feature: Utility: Useful for making taller plants and plants with longer inflorescences
  misc_feature (7)..(7): Xaa is any aa, unknown, or other
MLRLLAXYDVVRCQMEDRDGRYERRYSAAPVCKWLTPNEDGVSMAALALMNQDKVLMESWYYLKDAVLDGGIPFNKAYGMTAFEYHGTDARFNRVFNEGMKNHSVIITKKLLDFYTGFEGVSTLVDVGGGVGATLHAITSRHPHISGVNFDLPHVISEAPPFPGVRHVGGDMFASVPAGDAILMKWILHDWSDAHCATLLKNCYDALPENGKVIVVECVLPVNTEATPKAQGVFHVDMIMLAHNPGGKERYEREFRELAKGAGFSGFKATYIYANAWAIEFIK

SEQ ID NO: 1526 - protein, 362 aa, Zea mays; identical to SEQ ID NO: 670
  misc_feature (1)..(362): Public GI no. 4808524
  misc_feature: Utility: Useful for increasing seed/fruit yield or modifying fruit content
  misc_feature: Utility: Useful for making plants sterile and for genetic confinement
  misc_feature: Utility: Useful for making smaller plants
  misc_feature: Utility: Useful for making taller plants and plants with longer inflorescences

SEQ ID NO: 1527 - protein, 365 aa, Zea mays
  misc_feature (1)..(365): Public GI no. 602588
  misc_feature: Utility: Useful for increasing seed/fruit yield or modifying fruit content
  misc_feature: Utility: Useful for making plants sterile and for genetic confinement
  misc_feature: Utility: Useful for making smaller plants
  misc_feature: Utility: Useful for making taller plants and plants with longer inflorescences
MGSTGETQMTPTQVSDEEANLFAMQLASASVLPMVLKAAIELDLLEIMAKAGPGVFLSPTDIASQLPTKNPDAPVMLDRMLRLLASYSILTYSLRTLADGKVERLYGLGPVCKFLTKNEEGVSIAPLCLMNQDKVLLESWYHLKDAVLEGGIPFNKAYGMTAFEYHGTDPRFNKVFNRGMADHSTITMKKILETYKGFEGLTSVVDVGGGTGAVLNMIVSKYPSIKGINFDLPHVIEDAPQYPGVEHVGGDMFVSVPKGDAIFMKWICHDWSDEHCLKFLKNCYAALPDNGKVILGECILPVAPDSSLATKGVVHIDVIMLAHNPGGKERTEQEFQALAKGAGFQGFNVACSAFNTYVIEFLKKN

SEQ ID NO: 1528 - protein, 360 aa, Glycine max; identical to SEQ ID NO: 669
  misc_feature (1)..(360): Ceres CLONE ID no. 561287
  misc_feature: Utility: Useful for increasing seed/fruit yield or modifying fruit content
  misc_feature: Utility: Useful for making plants sterile and for genetic confinement
  misc_feature: Utility: Useful for making smaller plants
  misc_feature: Utility: Useful for making taller plants and plants with longer inflorescences

SEQ ID NO: 1529 - protein, 353 aa, Triticum aestivum
  misc_feature (1)..(353): Ceres CLONE ID no. 751041
  misc_feature: Utility: Useful for increasing seed/fruit yield or modifying fruit content
  misc_feature: Utility: Useful for making plants sterile and for genetic confinement
  misc_feature: Utility: Useful for making smaller plants
  misc_feature: Utility: Useful for making taller plants and plants with longer inflorescences
MAASADEEACMYALQLVSSSILPMTLKNAIELGLLETLVAAGGKLLTPAEVAAKLPSTANPAAADMVDRMLRLLASYNVVSCTMEEGKDGRLSRRYRAAPVCKFLTPNEDGVSMAALALMNQDKVLMESWYYLKDAVLDGGIPFNKAYGMSAFEYHGTDPRFNRVFNEGMKNHSIIITKKLLEVYKGFEGLGTIVDVGGGVGATVGAITAAYPAIKGINFDLPHVISEAQPFPGVTHVGGDMFQKVPSGDAILMKWILHDWSDEHCATLLKNCYDALPAHGKVVLVECILPVNPEATPKAQGVFHVDMIMLAHNPGGRERYEREFEALAKGAGFKAIKTTYIYANAFAIEFTK

SEQ ID NO: 1530 - protein, 364 aa, Zea mays
  misc_feature (1)..(364): Ceres CLONE ID no. 286311
  misc_feature: Utility: Useful for increasing seed/fruit yield or modifying fruit content
  misc_feature: Utility: Useful for making plants sterile and for genetic confinement
  misc_feature: Utility: Useful for making smaller plants
  misc_feature: Utility: Useful for making taller plants and plants with longer inflorescences
MGSTAGDVAAVVDEEACMYAMQLASSSILPMTLKNAIELGLLEVLQKEAGGGKAALAPEEVVARMPAAPGDPAAAAAMVDRMLRLLASYDVVRCQMEDRDGRYERRYSAAPVCKWLTPNEDGVSMAALALMNQDKVLMESWYYLKDAVLDGGIPFNKAYGMTAFEYHGTDSRFNRVFNEGMKNHSVIITKKLLDFYTGFEGVSTLVDVGGGVGATLHAITSRHPHISGVNFDLPHVISEAPPFPGVRHVGGDMFASVPAGDAILMKWILHDWSDAHCATLLKNCYDALPENGKVIVVECVLPVNTEATPKAQGVFHVDMIMLAHNPGGKERYEREFRELAKGAGFSGFKATCIYANAWAIEFIK

SEQ ID NO: 1531 - protein, 285 aa, Triticum aestivum
  misc_feature (1)..(285): Ceres CLONE ID no. 570057
  misc_feature: Utility: Useful for increasing seed/fruit yield or modifying fruit content
  misc_feature: Utility: Useful for making plants sterile and for genetic confinement
  misc_feature: Utility: Useful for making smaller plants
  misc_feature: Utility: Useful for making taller plants and plants with longer inflorescences
  misc_feature (127)..(127): Xaa is any aa, unknown, or other
  misc_feature (130)..(130): Xaa is any aa, unknown, or other
  misc_feature (133)..(133): Xaa is any aa, unknown, or other
  misc_feature (134)..(134): Xaa is any aa, unknown, or other
  misc_feature (136)..(136): Xaa is any aa, unknown, or other
  misc_feature (139)..(139): Xaa is any aa, unknown, or other
MLRLLASYNVVSCTMEEGKDGRLSRRYGAAPVCKFLTPNEDGVSMAALALMNQDKVLMESWYYLKDAVLDGGIPFNKAYGMSAFEYHGTDPRFNRVFNEGMKNHSIIITKKLLEVYKGFEGLGTIVXVGXKVXXAXVGXIVAAYPAIKGINFDLPHVISEAPPFPGVTHVGGDMFQKVPSGDAILMKWILHDWSDEHCATLLKNCYDALPAHGKVVLVECILPVNPEATPKAQGVFHVDMIMLAHNPGGRERYEREFEALAKGAGFKAIKTTYIYANAFAIEFTK

SEQ ID NO: 1532 - DNA, 1208 bp, Arabidopsis thaliana
  misc_feature (1)..(1208): Ceres CLONE ID no. 100319
  misc_feature (1)..(1208): Also known as  Ceres CDNA ID no. 23389186
aaaaatcgaatcaagcatcttcttctttcacgtacgaaacaaaaagctcagagcagagtcgaatcgcgatgaagcatcgagttcggtgttcatgaaggtcagagagttaagtattagcagaactggttaggtcttagtgacaaacaaggtattcatgttatccatccctgatactagaatgtggaatctagcatcgagttatcttacgggaaacattggaccgaaaaacgatatcagaagaccggtccatgctcatgcggagtgttcagatgacgatgtatcttctgtaggtagtaaagacgaaggtctcgagtgtcctatatgctgggaatcatttaatatagttgaaaacgttccgtatgtgttatggtgtggacatacgatgtgtaaaaactgcattttgggacttcaatgggctattgtgaaattgcctactcacccggttcagcttcctctcttcatttcatgcccctggtgcaaccttttgtctttccgtctggtcttcagaggaacactcagattccctcacaagaactactttgtgctttggatggtcgagaggatgaatggagagagacgtaactcacctggtggagctcaaacagatggaaacaatgatcatacaagggaaactccatctccatgtctccacaatcgccatcatcgcagtcaacctgaaccatcacgttctgttaatgatcatcgcattccaagggacaacatacaaacttcactgaggaagtctctggttttctttgtccagttgacagcaaagttcccattagttgtcatatttctgctgataatactctatgcaataccgaccagtgcagccatattggcgatgtacattctagtcactctcttgctggctctaccgtcgtttctcatcctctacttcgcttatccttgtctcgactggcttgttcgagagattgtcacatgaactttctaaggatgcgttcagaaacttcccattcctaatttgacgacttttcttcaacaactgagacccaagatcgktcagtcctycatgtaagtatracaatttcataattaccgtcttctttatctatatatggatgtagttttggattgcattgttgctctacgaagctggacgtatgtgttgtaagggctcttgcagaaacttattagtatttgtggatttgtttgtgagtgtttgagtgtctcaataagatttatgt

SEQ ID NO: 1533 - protein, 263 aa, Arabidopsis thaliana
  misc_feature (54)..(83): Pfam Name: zf-C3HC4; Pfam Description: Zinc finger, C3HC4 type (RING finger)
  misc_feature (54)..(83): Pfam Name: zf-C3HC4; Pfam Description: Zinc finger, C3HC4 type (RING finger)
  misc_feature: Utility: Useful for increasing seed/fruit yield or modifying fruit content
  misc_feature: Utility: Useful for making ornamental plants with modified flowers
  misc_feature: Utility: Useful for making plants sterile and for genetic confinement
  misc_feature: Utility: Useful for making plants with increased biomass and foliage
  misc_feature: Utility: Useful for making smaller plants
  misc_feature: Utility: Useful for making taller plants and plants with longer inflorescences
MLSIPDTRMWNLASSYLTGNIGPKNDIRRPVHAHAECSDDDVSSVGSKDEGLECPICWESFNIVENVPYVLWCGHTMCKNCILGLQWAIVKLPTHPVQLPLFISCPWCNLLSFRLVFRGTLRFPHKNYFVLWMVERMNGERRNSPGGAQTDGNNDHTRETPSPCLHNRHHRSQPEPSRSVNDHRIPRDNIQTSLRKSLVFFVQLTAKFPLVVIFLLIILYAIPTSAAILAMYILVTLLLALPSFLILYFAYPCLDWLVREIVT

SEQ ID NO: 1534 - protein, 264 aa, Glycine max
  misc_feature (1)..(264): Ceres CLONE ID no. 625275
  misc_feature: Utility: Useful for increasing seed/fruit yield or modifying fruit content
  misc_feature: Utility: Useful for making ornamental plants with modified flowers
  misc_feature: Utility: Useful for making plants sterile and for genetic confinement
  misc_feature: Utility: Useful for making plants with increased biomass and foliage
  misc_feature: Utility: Useful for making smaller plants
  misc_feature: Utility: Useful for making taller plants and plants with longer inflorescences
MWNFASNCIAGTVGLKNDSKPTHSASECSDDENSVIGREEGLECPICWESFNIVENVPYVLWCGHTLCKNCILGLQWAVVKFPTLPVQLPLFISCPWCNLLSFRLVYRGNLKFPRKNYFLLWMVESMNGDRGKSHSPFCGDNQQHSIKDNLTMGSQVSHGNLRRGLVRHPETSSSNQYHGNTGNHLNTERFHVYLRKSLIFFVQLTAKFPLVIIFLLIVLYAIPASAAILALYVLVTILFALPSFLILYFSYPSLDWLVREIIT

SEQ ID NO: 1535 - protein, 266 aa, Glycine max
  misc_feature (1)..(266): Ceres CLONE ID no. 1246429
  misc_feature: Utility: Useful for increasing seed/fruit yield or modifying fruit content
  misc_feature: Utility: Useful for making ornamental plants with modified flowers
  misc_feature: Utility: Useful for making plants sterile and for genetic confinement
  misc_feature: Utility: Useful for making plants with increased biomass and foliage
  misc_feature: Utility: Useful for making smaller plants
  misc_feature: Utility: Useful for making taller plants and plants with longer inflorescences
MWNFASSLIAGSVGLKNDSPKPTHSASEFSDDETSMVSREERLECPICWESFNIVENVPYVLWCGHTLCKNCILGLQWAVVNFPTLPIRLPLFISCPWCNLLSLRLVYQGNLKFPHKNYFLLWMVESMNGDRVKSHSTVCGDHQPVWPIIDSLTNGSQVSHDSLQGGQVCHPESSSSNHYHGDTSNYLSIETLHTSLRKSLVLFVHLTAKFPLIIIFLLIVLYAIPVIAAILALYILVTILFALPSFLILYFAYPSLDWLVREIIT

SEQ ID NO: 1536 - protein, 267 aa, Glycine max
  misc_feature (1)..(267): Public GI no. 37718893
  misc_feature: Utility: Useful for increasing seed/fruit yield or modifying fruit content
  misc_feature: Utility: Useful for making ornamental plants with modified flowers
  misc_feature: Utility: Useful for making plants sterile and for genetic confinement
  misc_feature: Utility: Useful for making plants with increased biomass and foliage
  misc_feature: Utility: Useful for making smaller plants
  misc_feature: Utility: Useful for making taller plants and plants with longer inflorescences
MWNFASSAWGSGLGKKNTPNCTPSNGDCSDDEASSCTSREEGLECPICWESFNIVENVPYVLWCGHTMCKNCILGLQWAIIKVPTVPIQLPFFVSCPWCNLLSLRIIYKGNLAFPRKNYFLLWMVEGMNGERARSRSAIHSEQQTTWLSSSSRASGNEGYSNPIRRPLPPPVETQSPSVNHANHGVPILNAERVQALLRKSLSFLVHLTAKFPLVFIFLLIVLYAIPASAAVLLLYILITVLFALPSFLILYFAYPSLDWLVREIFA

SEQ ID NO: 1537 - protein, 260 aa, Triticum aestivum
  misc_feature (1)..(260): Ceres CLONE ID no. 937503
  misc_feature: Utility: Useful for increasing seed/fruit yield or modifying fruit content
  misc_feature: Utility: Useful for making ornamental plants with modified flowers
  misc_feature: Utility: Useful for making plants sterile and for genetic confinement
  misc_feature: Utility: Useful for making plants with increased biomass and foliage
  misc_feature: Utility: Useful for making smaller plants
  misc_feature: Utility: Useful for making taller plants and plants with longer inflorescences
MWSFASNAIAGSIKKKVQPSKGSLSNHDCSDDDGSSCASREEGLECPICCESFNIVENVPYVLWCGHTMCKNCILGLQWAVVKFPTLPIQLPLFVSCPWCNLLSFRLVYKGNLKFPRKNYFLLWMVESMNGDRAKFHSSGHEERQSVCPSSGGTSSSQHHRRTPTARAETSSSARDRNAAANTPNTASVSLQKLMVCFVQLTAKFPLVIMFLLIVLYAVPASAAVLLLYVLVTFLFALPSFLILYFAYPTLDWLVREIFT

SEQ ID NO: 1538 - protein, 270 aa, Zea mays
  misc_feature (1)..(270): Ceres CLONE ID no. 1549251
  misc_feature: Utility: Useful for increasing seed/fruit yield or modifying fruit content
  misc_feature: Utility: Useful for making ornamental plants with modified flowers
  misc_feature: Utility: Useful for making plants sterile and for genetic confinement
  misc_feature: Utility: Useful for making plants with increased biomass and foliage
  misc_feature: Utility: Useful for making smaller plants
  misc_feature: Utility: Useful for making taller plants and plants with longer inflorescences
MWGFASNAWAAGLEKRSFPNRTSSSAAYSDDEASSCTSREEGLECPICWESFNIVENVPYALWCGHTMCKNCILGLQWAVIKVPTVPIQLPFFICCPWCNLLSPRVLYKGNLTFPRKNYFLLWMVEGMNGERARSRPAIRSEQHTPWLSSSSSVANGNAGCSNPTRRHLPPPSVDTSPTNANHANHGGSPLLNAGRVQASLRKSLSFLVHLTAKFPLVFVFLLIVLYAIPASAAVLLLYILITVLFALPSFLILYFAYPSLDWLVREIFA

SEQ ID NO: 1539 - DNA, 1125 bp, Arabidopsis thaliana
  misc_feature (1)..(1125): Ceres CLONE ID no. 124720
  misc_feature (1)..(1125): Also known as  Ceres CDNA ID no. 23372506
attttcttctcttcttcacacaaacacacacagatctcttcttcatcacattacttctggctttacatcttttttcttctccatgaggaaagggagaggctcttccgtcgttggacccgcccttccagtaaccgccggtggatctgtgaaggagccgaggtatagaggcgttaggaagagaccttggggtcgattcgcagctgagatccgtgatccattaaaaaaatctcgtgtctggctcggtactttcgattccgccgtagatgctgcacgcgcttacgataccgccgctcgtaacctccgtggtccaaaggccaagaccaatttcccgatcgattgttctccttcttctcctctccaacctctcacctacctccacaatcaaaacctctgttctcctccggtgattcagaaccagatcgatccgtttatggaccatcggttatacggcggaggtaatttccaggagcagcagcagcagcagattattagtcggccggcgagtagcagcatgagcagcaccgttaaatcttgtagcggaccgagaccgatggaagccgcggcggcgtcttcgtcggtggcgaaaccgttacatgcgattaagagatatccgagaactccaccggtagctccggaggattgtcatagcgactgcgattcttcgtcgtctgttattgacgacggagatgatatcgcatcttcgtcttcccgccggaaaacgccgtttcagtttgatcttaatttcccgccgttggatggcgttgacttattcgctggcgggatagatgatctccactgtaccgatctacgtctctgatttgctgctttacaaaaaaaatccgttgattacacacaaaaaaaattctcaaattttacaaaatgataactttatgctcttttgtttttccattttcctttgatatcatattgaaagagaaaaaaaggaagaacaaaaaaaaaagattgagcgtgatgattttatcatcaacgaagatgatgacgattaaaaagagagagagattgtgttaagatctgttactgtaagaaccagatctgggtttcatttttatctgtttcttcttataaaagatccaacaaccctttgttacatatatataacattcc

SEQ ID NO: 1540 - protein, 244 aa, Arabidopsis thaliana
  misc_feature (25)..(88): Pfam Name: AP2; Pfam Description: AP2 domain
  misc_feature: Utility: Useful for increasing seed/fruit yield or modifying fruit content
  misc_feature: Utility: Useful for making ornamental plants with modified leaves
  misc_feature: Utility: Useful for making plants sterile and for genetic confinement
  misc_feature: Utility: Useful for making plants with increased biomass
  misc_feature: Utility: Useful for making plants with increased biomass and foliage
  misc_feature: Utility: Useful for making smaller plants
MRKGRGSSVVGPALPVTAGGSVKEPRYRGVRKRPWGRFAAEIRDPLKKSRVWLGTFDSAVDAARAYDTAARNLRGPKAKTNFPIDCSPSSPLQPLTYLHNQNLCSPPVIQNQIDPFMDHRLYGGGNFQEQQQQQIISRPASSSMSSTVKSCSGPRPMEAAAASSSVAKPLHAIKRYPRTPPVAPEDCHSDCDSSSSVIDDGDDIASSSSRRKTPFQFDLNFPPLDGVDLFAGGIDDLHCTDLRL

SEQ ID NO: 1541 - protein, 235 aa, Brassica napus
  misc_feature (1)..(235): Ceres CLONE ID no. 975672
  misc_feature: Utility: Useful for increasing seed/fruit yield or modifying fruit content
  misc_feature: Utility: Useful for making ornamental plants with modified leaves
  misc_feature: Utility: Useful for making plants sterile and for genetic confinement
  misc_feature: Utility: Useful for making plants with increased biomass
  misc_feature: Utility: Useful for making plants with increased biomass and foliage
  misc_feature: Utility: Useful for making smaller plants
  misc_feature (194)..(194): Xaa is any aa, unknown, or other
  misc_feature (214)..(214): Xaa is any aa, unknown, or other
  misc_feature (228)..(228): Xaa is any aa, unknown, or other
  misc_feature (229)..(229): Xaa is any aa, unknown, or other
  misc_feature (234)..(234): Xaa is any aa, unknown, or other
FHQLQTHRSLLNHITSGSPTMRKGRGSSAVPPALPGSVKEPRYRGVRKRPWGRFAAEIRDPLKKSRVWLGTFDSAEEAARAYDAAARNLRGPKAKTNFQIDCSPSSPLQPLHHRNQIDPFMDHRLYGGEQEVVIISRPASSSMSSTVKSCSGVRPASSSVAKAATKRYPRTPPVAPEDCRSDCDSSSSVVEDGXDIASSSSRRKPPFEFDLNFXPLDGVDLFVGADDXXCTDLXL

SEQ ID NO: 1542 - protein, 208 aa, Glycine max
  misc_feature (1)..(208): Ceres CLONE ID no. 1044385
  misc_feature: Utility: Useful for increasing seed/fruit yield or modifying fruit content
  misc_feature: Utility: Useful for making ornamental plants with modified leaves
  misc_feature: Utility: Useful for making plants sterile and for genetic confinement
  misc_feature: Utility: Useful for making plants with increased biomass
  misc_feature: Utility: Useful for making plants with increased biomass and foliage
  misc_feature: Utility: Useful for making smaller plants
MVKEKKNVVVKNKKPNNNADELHFRGVRKRPWGRYAAEIRDPGKKTRVWLGTFDTAEDAARAYDAAARNFRGPKAKTNFPVPPDDNNNNNVNVNKNKSVNVKSHSPSQSSTVESATPEREATRRSTSAAIDRFPFLPIQQQILMTHPVAAPMRPVFFLDRAHFMTQSFPLRFEPGPVQSDSDSSSVVVDCQPKREINLDLNLAPPNEY

SEQ ID NO: 1543 - protein, 176 aa, Glycine max
  misc_feature (1)..(176): Public GI no. 55419650
  misc_feature: Utility: Useful for increasing seed/fruit yield or modifying fruit content
  misc_feature: Utility: Useful for making ornamental plants with modified leaves
  misc_feature: Utility: Useful for making plants sterile and for genetic confinement
  misc_feature: Utility: Useful for making plants with increased biomass
  misc_feature: Utility: Useful for making plants with increased biomass and foliage
  misc_feature: Utility: Useful for making smaller plants
MAPRSKPSPISPNPDPNSKEIRYRGVRKRPWGRYAAEIRDPRKKTRVWLGTFDTAEEAARAYDAKAREFRGAKAKTNFADNNANDFTRSPSQSSTVESSSPPPLDLTLASPCSSLPVTAQRPVYFFDAFATGGSGCPASGFAQSDSDSSSSVVDFEGGVRRRVFDLDLNQLPAEMD

SEQ ID NO: 1544 - protein, 218 aa, Glycine max
  misc_feature (1)..(218): Public GI no. 56384582
  misc_feature: Utility: Useful for increasing seed/fruit yield or modifying fruit content
  misc_feature: Utility: Useful for making ornamental plants with modified leaves
  misc_feature: Utility: Useful for making plants sterile and for genetic confinement
  misc_feature: Utility: Useful for making plants with increased biomass
  misc_feature: Utility: Useful for making plants with increased biomass and foliage
  misc_feature: Utility: Useful for making smaller plants
MGRGGATTAAAAVEPVFFKEPRYRGVRKRPWGRFAAEIRDPLKKARVWLGTFDTAEEAARAYDTAARNLRGPKAKTNFPLAQPFYQNPEAGNPFGELRFYAGGAGEGFQDHRRPTSSGMSSTVESFGGPRPVRPPMPPSAVTGRRYPRTPPVAPGDCRSDCDSSSSVVDDADNDNAASSTMLSFKRQPLPFDLNAPPLEEGDVANGLGEDLHCTLLCL

SEQ ID NO: 1545 - protein, 225 aa, Glycine max
  misc_feature (1)..(225): Public GI no. 57012880
  misc_feature: Utility: Useful for increasing seed/fruit yield or modifying fruit content
  misc_feature: Utility: Useful for making ornamental plants with modified leaves
  misc_feature: Utility: Useful for making plants sterile and for genetic confinement
  misc_feature: Utility: Useful for making plants with increased biomass
  misc_feature: Utility: Useful for making plants with increased biomass and foliage
  misc_feature: Utility: Useful for making smaller plants
MRRGRAAAAPAPVTGEPNGSGGSKEIRFRGVRKRPWGRFAAEIRDPWKKTRVWLGTFDSAEDAARAYDAAARALRGPKAKTNFPLPYAHHHQFNQGHNPNNDPFVDSRFYPQDNPIISQRPTSSSMSSTVESFSGPRPPPAPRQQTTASSRKYTRSPPVVPDDCHSDCDSSSSVVDHGDCEKENDNDNDNIASSSFRKPLLFDLNLPPPMDDAGADDLHCTALCL

SEQ ID NO: 1546 - protein, 190 aa, Glycine max
  misc_feature (1)..(190): Public GI no. 50929507
  misc_feature: Utility: Useful for increasing seed/fruit yield or modifying fruit content
  misc_feature: Utility: Useful for making ornamental plants with modified leaves
  misc_feature: Utility: Useful for making plants sterile and for genetic confinement
  misc_feature: Utility: Useful for making plants with increased biomass
  misc_feature: Utility: Useful for making plants with increased biomass and foliage
  misc_feature: Utility: Useful for making smaller plants
MVGGEVMCEAAAPRYRGVRKRPWGRFAAEIRDPAKRARVWLGTYDSAEAAARAYDVAARNLRGPLARTNFPLVSSLPLPSPHYHLPGKAAAAAPPVAGPACSASSTVESSSGPRGPRPAATAAAVPRRRVPRPAPPAPDAGCHSDCASSASVVDDADDASTVRSRVAAFDLNLPPPLDRDHVDLCTDLRL

SEQ ID NO: 1547 - protein, 211 aa, Zea mays
  misc_feature (1)..(211): Ceres CLONE ID no. 273307
  misc_feature: Utility: Useful for increasing seed/fruit yield or modifying fruit content
  misc_feature: Utility: Useful for making ornamental plants with modified leaves
  misc_feature: Utility: Useful for making plants sterile and for genetic confinement
  misc_feature: Utility: Useful for making plants with increased biomass
  misc_feature: Utility: Useful for making plants with increased biomass and foliage
  misc_feature: Utility: Useful for making smaller plants
MRRRGVAAADADGDVELRFRGVRKRPWGRYAAEIRDPAKKARVWLGTFDSAEDAARAYDAAARMLRGPKARTNFPLPAAAALHHPHMPAAAAAAAPPYTTYPTATGVVSTPPVARPACSSLSSTVESFSGARPRPVLPPRFPPPSIPDGDCRSDCGSSASVVDDDCTDAAASASCPFPLPFDLNLPPGGGGAGVGFYADEEDELRLTALRL

SEQ ID NO: 1548 - DNA, 768 bp, Zea mays
  misc_feature (1)..(768): Ceres CLONE ID no. 288251
  misc_feature (1)..(768): Also known as  Ceres CDNA ID no. 23743430
gcacgagaccattacctagaacatcctaatcgaaaaataagcttctagcagcatccgccaccgccgcggaggcctatatctccccgcgtccgctagccctagccgccgcccgccgacttcatcgttgccgtcgtctagacctcttcacgcactggaaaggttaaagtccgacatcaatggcgaagcatcatcctgatctcatcatgtgccggaagcagcctggcatcgcgattggccgcctttgcgagaaatgtgatggcaagtgtgttgtctgcgactcgtacgtgcgcccatgtacgcttgtccgggtctgcgacgagtgcaattatggttcgttccagggaaggtgtgtgatctgtggaggagtcggcatctcagacgcttactactgcaaggagtgcacccagcaggagaaggaccgggacggttgccccaagatcgtgaatcttggaagcgccaagacggatctcttctatgagcgcaagaagtatggttttaagaagagatgaccgagaagatggagctgtgtgtggttcactttggctgtgtggtctgttctatggcactgaatactgagagtaggcagctgaggcagcagctttgtattcctgttatggtttgataattgatactggcatggaaatacagctgtgatatgcgttgtaataactaagtttaactgtatgatgcaagagactgcttatgtaatctgtgcttgatggtaatggttatgaatggacttgaaatattggcatgatagctgtcatc

SEQ ID NO: 1549 - protein, 110 aa, Zea mays
  misc_feature (1)..(106): Pfam Name: PHF5; Pfam Description: PHF5-like protein
  misc_feature: Utility: Useful for increasing seed/fruit yield or modifying fruit content
MAKHHPDLIMCRKQPGIAIGRLCEKCDGKCVVCDSYVRPCTLVRVCDECNYGSFQGRCVICGGVGISDAYYCKECTQQEKDRDGCPKIVNLGSAKTDLFYERKKYGFKKR

SEQ ID NO: 1550 - protein, 101 aa, Arabidopsis thaliana
  misc_feature (1)..(101): Ceres CLONE ID no. 94739
  misc_feature: Utility: Useful for increasing seed/fruit yield or modifying fruit content
MCRKQPGIAIGRLCEKCDGKCVICDSYVRPCTLVRICDECNYGSFQGRCVICGGVGISDAYYCKECTQQEKDRDGCPKIVNLGSAKTDLFYERKKYGFKKR

SEQ ID NO: 1551 - protein, 101 aa, Arabidopsis thaliana; identical to SEQ ID NO: 1550
  misc_feature (1)..(101): Ceres CLONE ID no. 35872
  misc_feature: Utility: Useful for increasing seed/fruit yield or modifying fruit content

SEQ ID NO: 1552 - protein, 101 aa, Arabidopsis thaliana; identical to SEQ ID NO: 1550
  misc_feature (1)..(101): Ceres CLONE ID no. 22599
  misc_feature: Utility: Useful for increasing seed/fruit yield or modifying fruit content

SEQ ID NO: 1553 - protein, 101 aa, Triticum aestivum
  misc_feature (1)..(101): Ceres CLONE ID no. 1053778
  misc_feature: Utility: Useful for increasing seed/fruit yield or modifying fruit content
MCRKQPGIAIGRLCEKCDGKCVICDSYVRPCTLVRVCDECNYGSFQGRCVICGGVGISDAYYCKKCTQQEKDRDGCPKIVNLGSAKTDLFYERKKYGFKKR

SEQ ID NO: 1554 - protein, 97 aa, Glycine max
  misc_feature (1)..(97): Ceres CLONE ID no. 855135
  misc_feature: Utility: Useful for increasing seed/fruit yield or modifying fruit content
  misc_feature (94)..(94): Xaa is any aa, unknown, or other
MCRKQPGIAIGRLCEKCDGKCVICDSYVRPCTLVRVCDECNYGSFQGRCVICGGVGISDAYYCKECTQQEKDRDGCPKIVNLGSAKTDLFYERXKYG

SEQ ID NO: 1555 - DNA, 1425 bp, Arabidopsis thaliana
  misc_feature (1)..(1425): Ceres CLONE ID no. 8014
  misc_feature (1)..(1425): Also known as  Ceres CDNA ID no. 23370386
aaatagcatctccttcagtgtctcttacagtttccgatctatccaaatcatagattcttttatcttcacaatctgttagtgtctcgtagctctaattaggtaataactaatgggagtgtcaaagaagaaatcaggtgagattagaggagatttaatcccagggttaccagaggaattaccaattgagtgtttggttagagttccttttcagtttcattcttccatcaaatctgtttgccgatcatggaaatgcgttatctccagtcgttcttttatcaaggaacggataggttttggtaaagctgaatctcttctctgccttgttcaacctctgacttcaccaccgtctccggcgatgattgaaggtggtgagatgagtcagaagaagaaagaggaagaagaaggcgagtctcagatgacgcagcagctgctacaaccgcgtattactggaacgccactttacggtttaagcgtttataacgcaacgctggacacgtggcaccgagtcgcgattcctgaacggattcctttgttctgcgaatgcgttgcgattcaggacgcggggaaagtgttgttaatcggcggttgggatccggagacgttgcagcctgtgcgagatgtttttgttctggatttctttgccggagaaggaagcggaagaaggttcagaagaggcaggccgatgtcggcggcgagatcgtttttcgcctgtgcttctgttggttcgacgaaagtttacgtcgccggaggacatgatgatcagaagaacgctctccgatcggcggaagtgtacgatgtagagaaagacgagtggtcgatgcttcctccgatgacggaaggaagagacgagtgtcacggattctcgatggcgacggatcctggattttgtgttttgagcggttatggaacggagacgcaaggccaattccgatctgacggcgagatttacgatccgattacgaattcatggtcgacaatcgagaatgtctggccgtttcccgatttgagtccgagaggtcgcaccgccgcggctgctgctgaattccccggagattttagaggttgtcggttatggtgttttattgatagcgagagacagagtcagcctcattgggaagttgaagacgattcgatgaaatggaaggtaattatggatacgattcggcttccggtgacgacgatgacttcggtttttgctggaagtttgagtggccaagcggtggcaatgattggcggtggtggtgaagaaagtggaacgatgatggtgaagacgacggcggagaagaatggcgggaagtggagccacgtcaacactccctctggtttttcgagtcttcctttctcgtgttcttcaatctacgtttgaagaatctctgttgtagaacactttgacttaagtcaacgttaatagttaatacttaatac

SEQ ID NO: 1556 - protein, 418 aa, Arabidopsis thaliana
  misc_feature (141)..(193): Pfam Name: Kelch_1; Pfam Description: Kelch motif
  misc_feature (195)..(242): Pfam Name: Kelch_2; Pfam Description: Kelch motif
  misc_feature (16)..(61): Pfam Name: F-box; Pfam Description: F-box domain
  misc_feature: Utility: Useful for increasing seed/fruit yield or modifying fruit content
MGVSKKKSGEIRGDLIPGLPEELPIECLVRVPFQFHSSIKSVCRSWKCVISSRSFIKERIGFGKAESLLCLVQPLTSPPSPAMIEGGEMSQKKKEEEEGESQMTQQLLQPRITGTPLYGLSVYNATLDTWHRVAIPERIPLFCECVAIQDAGKVLLIGGWDPETLQPVRDVFVLDFFAGEGSGRRFRRGRPMSAARSFFACASVGSTKVYVAGGHDDQKNALRSAEVYDVEKDEWSMLPPMTEGRDECHGFSMATDPGFCVLSGYGTETQGQFRSDGEIYDPITNSWSTIENVWPFPDLSPRGRTAAAAAEFPGDFRGCRLWCFIDSERQSQPHWEVEDDSMKWKVIMDTIRLPVTTMTSVFAGSLSGQAVAMIGGGGEESGTMMVKTTAEKNGGKWSHVNTPSGFSSLPFSCSSIYV

SEQ ID NO: 1557 - protein, 409 aa, Arabidopsis thaliana
  misc_feature (1)..(409): Public GI no. 21594431
  misc_feature: Utility: Useful for increasing seed/fruit yield or modifying fruit content
MTMEVSKKKGGDFQQCHDLIPGLPSELALECLVRVPFQFQSAMRSVCRSWRSLLSDSSFIQERRRCGKTELLLCLVQPLTPPIPASKSVDETLMVDEKKSEDESHPRVFCTPRFGLSVYNAAMSTWHRVAFPEEEQIPLFCECVVLQDAGKILLIGGWDPETLQPTRDVYVLEFAGRKWRRGAPMKESRSFFACASVSPTKVYVAGGHDDQKNALRSAEVYDVEKDEWSSVTPMTEGRDECQGFAVGTGLRFCVLSGYGTESQGRFRSDGEIYDPATNSWSRIDNVWRFPDTSPRGRTAGDFRSSSTLWCFTDTDLQSERRWETNDDSRNLKLDLQSIQLPMTGSSVFAGSLGGESVVMIGGKRESEGEGEGGVMMKMTTEKKMGKWSHHVHIPCDFSTLPFSHASIYV

SEQ ID NO: 1558 - protein, 407 aa, Arabidopsis thaliana
  misc_feature (1)..(407): Public GI no. 7486482
  misc_feature: Utility: Useful for increasing seed/fruit yield or modifying fruit content
MEVSKKKGGDFQQCHELIPGLPSELALECLVRVPFQFQSAMRSVCRSWRSLLSDSSFIQERRRCGKTELLLCLVQPLTPPIPASKSVDETLMVDEKKSEDESHPRVFCTPRFGLSVYNAAMSTWHRVAFPEEEQIPLFCECVVLQDAGKILLIGGWDPETLQPTRDVYVLEFAGRKWRRGAPMKESRSFFACASVSPTKVYVAGGHDDQKNALRSAEVYDVEKDEWSSVTPMTEGRDECQGFAVGMGLRFCVLSGYGTESQGRFRSDGEIYDPATDSWSRIDNVWRFPDTSPRGRTAGDFRSSSTLWCFTDTDLQSERRWETNDDSRNLKLDLQSIQLPMTGSSVFAGSLGGESVVMIGGKRESEGEGEGGVMMKMTTEKKMGKWSHHVHIPCDFSTLPFSHASIYV

SEQ ID NO: 1559 - protein, 409 aa, Arabidopsis thaliana
  misc_feature (1)..(409): Public GI no. 21700857
  misc_feature: Utility: Useful for increasing seed/fruit yield or modifying fruit content
MTMEVSKKKGGDFQQCHELIPGLPSELALECLVRVPFQFQSAMRSVCRSWRSLLSDSSFIQERRRCGKTELLLCLVQPLTPPIPASKSVDETLMVDEKKSEDESHPRVFCTPRFGLSVYNAAMSTWHRVAFPEEEQIPLFCECVVLQDAGKILLIGGWDPETLQPTRDVYVLEFAGRKWRRGAPMKESRSFFACASVSPTKVYVAGGHDDQKNALRSAEVYDVEKDEWSSVTPMTEGRDECQGFAVGMGLRFCVLSGYGTESQGRFRSDGEIYDPATDSWSRIDNVWRFPDTSPRGRTAGDFRSSSTLWCFTDTDLQSERRWETNDDSRNLKLDLQSIQLPMTGSSVFAGSLGGESVVMIGGKRESEGEGEGGVMMKMTTEKKMGKWSHHVHIPCDFSTLPFSHASIYV

SEQ ID NO: 1560 - DNA, 1379 bp, Arabidopsis thaliana
  misc_feature (1)..(1379): Ceres CLONE ID no. 13186
  misc_feature (1)..(1379): Also known as  Ceres CDNA ID no. 23368442
aattccctctagtaccaaatcctattactattgaaggtatactctatagttatttatttagttaagtatatatattaaaaataaataacattaattagtactagtcttatcatatttattagctcattttcttataaaatactaatataataggaaatttaagcacaagatgagctttgcccatcgagagcctcaaaacccaaaagtctcttcttcttcacgagatccaatcttttgctttttagtaattaattacatcttcttccttctcttctctcttcttcttccctctctcatacctacctataagcaacacaaagaacaccattgatcccatctgttttgttccctatatttcgttaatccatccatacgcattccaactacacgctttttgtatgcaaccccaaatagcagcttaaagaaagcagagaggatcttcttttatttcccctctgagcaacagaagccattattcaaagaaaggcttctttaatttactcgcagggagagggaaaagagaaaaaattgaaaaactccattttcaagtcattaaaatggcatcttcttcaacaaactcaccatgcgccgcttgcaaattcctccggcgaaaatgtcaaccggaatgtgtattcgcgccctatttcccaccggaccagccacaaaaattcgcaaacgttcacaaagtgtttggagcaagtaacgtgacaaagctcctcaacgagcttcacccttcacaacgtgaagacgcagtgaactctttggcctatgaagccgacatgcgcctccgtgaccctgtctacggctgcgttggcgtcatctctctcctccaacatcagcttcgtcagcttcagatagatctcagctgtgctaaatctgagctctctaagtaccaaagcctcggtatcctcgccgccactcatcagagtcttggcatcaacttactcgccggagcagcagatggaacagccaccgccgtgagagaccactatcaccaccaccagttttttcctagagaacaaatgtttggtggcttggatgttccggccggtaacaactacgacggtgggattcttgccattggacagatcactcagtttcagcagccgagagccgccgctggagatgatggtcgccgtactgttgatccgtcttgagattttagggttttggtggtgttcatcttcgtcgatcgcttggtgatgagaaaactataattttaagaaaatatttgatgtggaaaaccaaaatattttaaacgtatggtacgtctctcttaatgacattaatttcggtttttattattattattacttagatatattatgatagtcacttttgtatttctttcaaattttatggacttgctctcttaattg

SEQ ID NO: 1561 - protein, 199 aa, Arabidopsis thaliana
  misc_feature (9)..(109): Pfam Name: DUF260; Pfam Description: Protein of unknown function DUF260
  misc_feature: Utility: Useful for increasing seed/fruit yield or modifying fruit content
  misc_feature: Utility: Useful for making larger plants
  misc_feature: Utility: Useful for making ornamental plants with modified flowers
  misc_feature: Utility: Useful for making ornamental plants with modified leaves
  misc_feature: Utility: Useful for making plants with altered leaf shape eg curled leaves
  misc_feature: Utility: Useful for making plants with increased biomass
  misc_feature: Utility: Useful for making plants with increased biomass and foliage
  misc_feature: Utility: Useful for making shorter plants and plants with modified flowers
  misc_feature: Utility: Useful for making smaller plants
MASSSTNSPCAACKFLRRKCQPECVFAPYFPPDQPQKFANVHKVFGASNVTKLLNELHPSQREDAVNSLAYEADMRLRDPVYGCVGVISLLQHQLRQLQIDLSCAKSELSKYQSLGILAATHQSLGINLLAGAADGTATAVRDHYHHHQFFPREQMFGGLDVPAGNNYDGGILAIGQITQFQQPRAAAGDDGRRTVDPS

SEQ ID NO: 1562 - DNA, 640 bp, Arabidopsis thaliana
  misc_feature (1)..(640): Ceres CLONE ID no. 16204
  misc_feature (1)..(640): Also known as  Ceres CDNA ID no. 23358452
aatcgtcgtctctccccaattcaaaaaaagaaataacctaaacgtgttcacacagagatctcgagatgaaagataaccaaacggaagttgaatcgaggagcactgatgatagattgaaagttagagggaacaaagttggaaagaaaacaaaggatccaaacaggcctaagaaaccaccaagtcctttcttcgtcttcctggacgatttccgaaaggagtttaatctggctaaccctgacaacaaatccgtcggtaatgttggtagagcagctggaaagaaatggaaaaccatgactgaggaagaaagagcaccttttgtagcaaaatcacagagcaaaaagactgagtatgctgtgactatgcaacagtataacatggaactggctaatggaaacaagacaactggagatgatgagaaacaagagaaagctgctgatgattaggaagttggatcagtgatttgtgtatcaactatatctgttgttttatgtcaacttttagctagcttttagggagaacaattgttacattcctgttttatcctttctgtcaactgtgggattattcagatgtaactttggatttagctttgagcttcaattccaccttttatgagatcatatcatatgtttgcaatctt

SEQ ID NO: 1563 - protein, 125 aa, Arabidopsis thaliana
  misc_feature (34)..(103): Pfam Name: HMG_box; Pfam Description: HMG (high mobility group) box
  misc_feature: Utility: Useful for increasing seed/fruit yield or modifying fruit content
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with increased biomass
MKDNQTEVESRSTDDRLKVRGNKVGKKTKDPNRPKKPPSPFFVFLDDFRKEFNLANPDNKSVGNVGRAAGKKWKTMTEEERAPFVAKSQSKKTEYAVTMQQYNMELANGNKTTGDDEKQEKAADD

SEQ ID NO: 1564 - protein, 140 aa, Brassica napus
  misc_feature (1)..(140): Ceres CLONE ID no. 956177
  misc_feature: Utility: Useful for increasing seed/fruit yield or modifying fruit content
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with increased biomass
MKGGESKAQAKSTDERLKTRGKKAGKKVKDPNKPKRPPSAFFVFLEGFRKEFNLANPDNKSVGAVGKAAGAKWKSMTAEDKAPYVAKAETKKTEYAKTMQKYNMKLANGTSTAGDDDSDKSKSEVNDEEDAASDEEEDDD

SEQ ID NO: 1565 - protein, 152 aa, Glycine max
  misc_feature (1)..(152): Ceres CLONE ID no. 721511
  misc_feature: Utility: Useful for increasing seed/fruit yield or modifying fruit content
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with increased biomass
MKGGKSKTESKRADAKLAVNKKGAATKTRKPAGKGKAAKDPNKPKRPPSAFFVFMEEFRKVFNKEHPDNKAVSAVGKAAGAKWKTMSDAEKAPYVAKSEKRKVEYEKNMRAYNKKQAEGPTGGDEEESEKSVSEVNDEDDDEEGSGEEEDDD

SEQ ID NO: 1566 - protein, 152 aa, Glycine max
  misc_feature (1)..(152): Public GI no. 18645
  misc_feature: Utility: Useful for increasing seed/fruit yield or modifying fruit content
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with increased biomass
MKGGKSKTESKRADPKLAVNKKGAATKARKPAGKGKAAKDPNKPKRPPSAFFVFMEEFRKVFNKEHPENKAVSAVGKAAGAKWKTMSDAEKAPYVAKSEKRKVEYEKNMRAYNKKQAEGPTGGDEEESEKSVSEVNDEDDDEEGSGEEEDDD

SEQ ID NO: 1567 - protein, 98 aa, Glycine max
  misc_feature (1)..(98): Ceres CLONE ID no. 641329
  misc_feature: Utility: Useful for increasing seed/fruit yield or modifying fruit content
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with increased biomass
MEEFRKVFNKEHPDNKAVSAVGKAAGAKWKTMSDAEKAPYVAKSEKRKVEYEKNMRAYNKKQAEGPTGGDEEESEKSVSEVNDEDDDEEGSGEEEDDD

SEQ ID NO: 1568 - protein, 98 aa, Glycine max
  misc_feature (1)..(98): Ceres CLONE ID no. 782784
  misc_feature: Utility: Useful for increasing seed/fruit yield or modifying fruit content
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with increased biomass
MEEFRKVFNKEHPENKAVSAVGKAAGAKWKTMSDAEKAPYVAKSEKRKVEYEKNMRAYNKKQAEGPTGGDEEESEKSVSEVNDEDDDEEGSGEEEDDD

SEQ ID NO: 1569 - protein, 146 aa, Glycine max
  misc_feature (1)..(146): Public GI no. 1052956
  misc_feature: Utility: Useful for increasing seed/fruit yield or modifying fruit content
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with increased biomass
MKGGKSKAKSDNKLAVKKRGCETKKSKKSVKDPNKPKRPPSAFFVFMEDFRKTYKEKHPNNKSVAAVGKAGGDKWKQLTDAEKAPFIAKAEKRKQEYEKSMQAYNRKQAGEAADEEESDKSRSEVNDDEEDEDGSAEDDDDDDDDE

SEQ ID NO: 1570 - protein, 154 aa, Glycine max
  misc_feature (1)..(154): Public GI no. 436424
  misc_feature: Utility: Useful for increasing seed/fruit yield or modifying fruit content
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with increased biomass
MKGGKSKGESKKAETKLAVNKKGAPATKGGKKPAKGKEPKDPNKPKRPPSAFFVFMEDFRKQFKKGNADNKAVSAVGKAAGAKWKSMTEAEKAPYAAKAEKRKAEYEKSMKSYNKKQAEGPAAVEEEEESEKSESEVHDENDDEEESEEEDDDE

SEQ ID NO: 1571 - protein, 149 aa, Glycine max
  misc_feature (1)..(149): Public GI no. 729737
  misc_feature: Utility: Useful for increasing seed/fruit yield or modifying fruit content
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with increased biomass
MKGGKSKGESKKAETKLAVNKKGAAATKGGKKPAKGKEPKDPNKPKRPPSAFFVFMADFREQYKKDHPNNKSVAAVGKACGEEWKSLSEEEKAPYVDRALKKKEEYEITLQAYNKKLEGKDDEEGSDKSKSEVNDEDEDEEDEEDEDDD

SEQ ID NO: 1572 - protein, 145 aa, n/a
  misc_feature (1)..(145): Ceres CLONE ID no. 1060767
  misc_feature: Utility: Useful for increasing seed/fruit yield or modifying fruit content
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with increased biomass
MKGGKSKTETRSSKLSVAKKPAKAAGRSKAAAKDPNKPKRPASAFFVFMEDFRQTYKKDHPNNKSVAAVGKAGGEKWKSLSDSEKAPFVAKADKRKVEYEKTMKAYNKKLEEGPKEDEEESDKSVSEVNDEDDADDGSDEEEDDD

SEQ ID NO: 1573 - DNA, 1048 bp, Arabidopsis thaliana
  misc_feature (1)..(1048): Ceres CLONE ID no. 101250
  misc_feature (1)..(1048): Also known as  Ceres CDNA ID no. 23646538
aacacaccgaaaactgaatcaaatctcctagctcttctacgcaaaatcgagtgcatcgacaatggcggaacgtggtgtcgaacgtggtggagatcgcggcgatttcggacgtggattcggtggtcgcggcggtggaagaggtggtccgagaggtcgtggtcgccgtgcaggtcgtgctccagaggaggagaaatgggtgccagtgactaagcttggtcgtctcgtaaaggaaggtaagatcacaaagattgagcagatctacctccattctctcccagtcaaggagtaccagatcatagatttactcgtcggtccttcattgaaagacgaagtgatgaaaatcatgccggttcaaaaacaaaccagagccggtcagagaacgagattcaaggccttcatcgtcgtcggagatagtaacggtcacgtcggattaggagtcaaatgctccaaggaagttgcgacggcgatcagaggcgcgatcattctcgcgaaattgtctgtggttccgatacgaagaggttattggggtaacaagattggaaaaccacatacggttccgtgtaaggtaaccgggaaatgtggatctgttactgtacgtatggttccagctccgagaggttctggtattgtggcggctagagttcctaagaaggttcttcaattcgctggaattgatgatgtctttacttcttctagaggatccaccaaaactcttggaaacttcgtcaaggcaacatttgattgtctgcagaagacatacggattccttacaccggaattctggaaagagacgagattctcaaaatcaccataccaagagcacactgatttcttgcttatacctcctggcgtcaagatcagcgaggttgttgtagacaaaagcgtagagtaataccactttatcttgttacatgagacttgagtgttgtcaaaagctcaagtcagattttgttccaaccttggttttttgatttgtcggttataatgtctttagtaatctagatacgtatctgttttacactttgaattcaatcatacgaatcttctt

SEQ ID NO: 1574 - protein, 276 aa, Arabidopsis thaliana
  misc_feature (86)..(152): Pfam Name: Ribosomal_S5; Pfam Description: Ribosomal protein S5, N- terminal domain
  misc_feature (169)..(242): Pfam Name: Ribosomal_S5_C; Pfam Description: Ribosomal protein S5, C- terminal domain
  misc_feature: Utility: Useful for increasing seed/fruit yield or modifying fruit content
  misc_feature: Utility: Useful for making plants sterile and for genetic confinement
MAERGVERGGDRGDFGRGFGGRGGGRGGPRGRGRRAGRAPEEEKWVPVTKLGRLVKEGKITKIEQIYLHSLPVKEYQIIDLLVGPSLKDEVMKIMPVQKQTRAGQRTRFKAFIVVGDSNGHVGLGVKCSKEVATAIRGAIILAKLSVVPIRRGYWGNKIGKPHTVPCKVTGKCGSVTVRMVPAPRGSGIVAARVPKKVLQFAGIDDVFTSSRGSTKTLGNFVKATFDCLQKTYGFLTPEFWKETRFSKSPYQEHTDFLLIPPGVKISEVVVDKSVE

SEQ ID NO: 1575 - protein, 279 aa, Zea mays
  misc_feature (1)..(279): Ceres CLONE ID no. 295792
  misc_feature: Utility: Useful for increasing seed/fruit yield or modifying fruit content
  misc_feature: Utility: Useful for making plants sterile and for genetic confinement
MAERGGERGGERGGERGGFGRGFGRGGRGDRGGRRGGRRGGRQQEEEKWVPVTKLGRLVKENRINKIEEIYLHSLPVKEHQIVETLVPGLKDEVMKITPVQKQTRAGQRTRFKAFVVVGDGDGHVGLGVKCAKEVATAIRGAIILAKLSVVPVRRGYWGNKIGQPHTVPCKVTGKCGSVTVRMVPAPRGSGIVAARVPKKVLQFAGIEDVFTSSRGSTKTLGNFVKATFDCLMKTYGFLTPEFWAETKYAKTPFQEFTDLLAKPTKGLLIEAPTETVEA

SEQ ID NO: 1576 - protein, 279 aa, Zea mays; identical to SEQ ID NO: 1575
  misc_feature (1)..(279): Ceres CLONE ID no. 285704
  misc_feature: Utility: Useful for increasing seed/fruit yield or modifying fruit content
  misc_feature: Utility: Useful for making plants sterile and for genetic confinement

SEQ ID NO: 1577 - protein, 278 aa, Triticum aestivum
  misc_feature (1)..(278): Ceres CLONE ID no. 557178
  misc_feature: Utility: Useful for increasing seed/fruit yield or modifying fruit content
  misc_feature: Utility: Useful for making plants sterile and for genetic confinement
MADRGGERGGDRGGERGGFGRGFGRGGRGDRGGRRGGRRGPRQEEEKWVPVTKLGRLVKEGRFTKMEELYLHSLPIKEHQIVEQLCPGLKDEVMKITPVQKQTRAGQRTRFKAFVVVGDSNGHVGLGVKCAKEVATAIRGAIILAKLSIVPVRRGYWGNKIGLPHTVPCKVTGKCGSVTVRMVPAPRGSGIVAARVPKKVLQFAGIDDVFTSSRGSTKTLGNFVKATFDCLMKTYGFLTPDFWRETTFTKAPYQEFTDILVKPTKALMLDAPAEKIEA

SEQ ID NO: 1578 - protein, 278 aa, Triticum aestivum
  misc_feature (1)..(278): Ceres CLONE ID no. 754768
  misc_feature: Utility: Useful for increasing seed/fruit yield or modifying fruit content
  misc_feature: Utility: Useful for making plants sterile and for genetic confinement
MADRGGERGGDRGGERGGFGRGFGRGGRGDRGGRRGGRRGPRQEEEKWVPVTKLGRLVKEGRFTKMEELYLHSLPIKEHQIVEQLCPGLKDEVMKITPVQKQTRAGQRTRFKAFVVVGDSNGHVGLGVKCAKEVATAIRGAIILAKLSIVPVRRGYWGNKIGLPHTVPCKVTGKCGSVTVRMVPAPRGSGIVAARVPKKVLQFAGIDDVFTSSRGSTKTLGNFVKATFDCLMKTYGFLTPDFWRETTFTKAPYQEFTDILAKPTKALMLDAPAEKIEA

SEQ ID NO: 1579 - DNA, 1590 bp, Zea mays
  misc_feature (1)..(1590): Ceres CLONE ID no. 283597
  misc_feature (1)..(1590): Also known as  Ceres CDNA ID no. 23758447
aggcaggcaggcaccgcacgaggcctccatttggaccaccgggaccagaacccgatcgggcacggcggagaacgcgacgaagcataaaataagccatcacaactgcatttaaagcaaggcttcccactgagccgaaggtcctgagttcgacacagtctctcttcaaaaaatacaggggtacccaggctctaataatttgtacaaaaccgatggaaacttctaaatctcctcaatcgtcaaagaacagtcatattgtggtgccttctgatagtaatggcccccgatttgacaatgatggtttttcttcagaagctgcatcaaatcaaatggtcgttttcaactctgaagcaggagataaagagcaagatgaactgggggaaaaccgtttgcagaagtcaatcataacaaggggaatatcgccatctattggagcattcactgtccaatgtgctaaatgttttaaatggaggcttattccaacgaaagagaagtatgaagaaattcgtgaacgtattatagaggaaccttttgtatgcaaaagagctcgtgaatggagacctgatgtaacatgcaatgacccagaagatatatctcaggatggtagcaggctttgggctattgacaaacccaatattgcacaaccccctcgcggatgggaaaggcagattaggataagaggtgaagggggtaccaaatttgctgatgtatactatacctctcctactggaaggaaacttaggtctctggttgaagtcgataggttcctccaagagaatccggagtatggtgctcagggtgtaactttagctcagttttcgttccagatacctagacctctacggcaggactatgtgaaaaagaaaccgaagttgataaatccaagtgatgaagcaagtatgattgcctctaagtcttttcaaccagaagaagtgaaacccatagcctgggcagttgctacaaaacacgagggcgatgccagtgaagaagcttctctcaccgatgaggcacctacatcagaagtcatgctagcccggaagagaaaagcaggaagctctttgtcgatagagccaaaccatctctctgatgaacttgaaccaaagctggaggatgcttagaacggggagacgtctaccttataagtaaaagttagcagcatcgtgatgccaactgccccctatcatggttttattggccctctgcttgtttctcatttccctttggagccagtttctctgttttgcgaggtcacacaagccttatttgtagtattacaacacagaagctggctgacccaaaatccgacactctgggggcagcaacttaacaaaatgtttgtacgagggtttagagccccacggtgcttctttggataagtatgtttattaccttgtacttagctaggaacctgcttatatgtaagatctttgtgtacgacggagaattgtcacagcggcataattctggtgcatcttggatttaatctcctgttctttgttagaccggccagtaggcagtagcaaaggttttgaaatgtctcaagttatataactactgtggtattgctagtgtaattctctgagcatgtttttt

SEQ ID NO: 1580 - protein, 301 aa, Zea mays
  misc_feature (75)..(128): Pfam Name: zf-CW; Pfam Description: CW-type Zinc Finger
  misc_feature (135)..(212): Pfam Name: MBD; Pfam Description: Methyl-CpG binding domain
  misc_feature: Utility: Useful for increasing seed/fruit yield or modifying fruit content
  misc_feature: Utility: Useful for making plants with increased biomass
  misc_feature: Utility: Useful for making plants with modified flowers
  misc_feature: Utility: Useful for making smaller plants
METSKSPQSSKNSHIVVPSDSNGPRFDNDGFSSEAASNQMVVFNSEAGDKEQDELGENRLQKSIITRGISPSIGAFTVQCAKCFKWRLIPTKEKYEEIRERIIEEPFVCKRAREWRPDVTCNDPEDISQDGSRLWAIDKPNIAQPPRGWERQIRIRGEGGTKFADVYYTSPTGRKLRSLVEVDRFLQENPEYGAQGVTLAQFSFQIPRPLRQDYVKKKPKLINPSDEASMIASKSFQPEEVKPIAWAVATKHEGDASEEASLTDEAPTSEVMLARKRKAGSSLSIEPNHLSDELEPKLEDA

SEQ ID NO: 1581 - protein, 258 aa, Zea mays
  misc_feature (1)..(258): Ceres CLONE ID no. 407007
  misc_feature: Utility: Useful for increasing seed/fruit yield or modifying fruit content
  misc_feature: Utility: Useful for making plants with increased biomass
  misc_feature: Utility: Useful for making plants with modified flowers
  misc_feature: Utility: Useful for making smaller plants
MVVFNSEAADELGENRLQKSVITKGISPSIGAFTVQCAKCFKWRLIPTKEKYEEIRERIIQEPFVCKRAREWRPDITCNDPEDISQDGSRLWAIDKPNIAQPPHGWERQIRIRGEGGTKFADVYYTSPTGRKLRSLVEVDRFLQENPEHVAQGVTLAQFSFQIPRPLRQDYVKKKPKLINASDEASTITSKSSEPEEVNPIAWAVPTKHEGDASEEASFADETLASEVVLTRKRKIGSSLSVEPNHLSDELEPKLEDA

SEQ ID NO: 1582 - protein, 258 aa, Zea mays
  misc_feature (1)..(258): Ceres CLONE ID no. 225383
  misc_feature: Utility: Useful for increasing seed/fruit yield or modifying fruit content
  misc_feature: Utility: Useful for making plants with increased biomass
  misc_feature: Utility: Useful for making plants with modified flowers
  misc_feature: Utility: Useful for making smaller plants
MVVFNSEAADELGENRLQKSVITKGISPSIGAFTVQCAKCFKWRLIPTKEKYEEIRERIIQEPFVCKRAREWRPDITCNDPEDISQDGSRLWAIDKPNIAQPPHGWERQIRIRGEGGTKFADVYYTSPTGRKLRSLVEVDRFLQENPEHVAQGVTLAQFSFQIPRPLRQDYVKKKPKLINASDEASTITSKSYEPEEVNPIAWAVPTKHEGDASEEASFADETLASEVVLTRKRKIGSSLSVEPNHLSDELEPKLEDA

SEQ ID NO: 1583 - protein, 297 aa, Zea mays
  misc_feature (1)..(297): Public GI no. 13936312
  misc_feature: Utility: Useful for increasing seed/fruit yield or modifying fruit content
  misc_feature: Utility: Useful for making plants with increased biomass
  misc_feature: Utility: Useful for making plants with modified flowers
  misc_feature: Utility: Useful for making smaller plants
MESSKSPQSSKNSRIVVPSDSNRSRFDNDGFSSETASNQMVVFNSEAADELGENRLQKSVITKGISPSIGAFTVQCAKCFKWRLIPTKEKYEEIRERIIQEPFVCKRAREWRPDITCNDPEDISQDGSRLWAIDKPNIAQPPHGWERQIRIRGEGGTKFADVYYTSPTGRKLRSLVEVDRFLQENPEHVAQGVTLAQFSFQIPRPLRQDYVKKKPKLINASDEASTITSKSSEPEEVNPIAWAVPTKHEGDASEEASFADETLASEVVLTRKRKIGSSLSVEPNHLSDELEPKLEDA

SEQ ID NO: 1584 - protein, 270 aa, Arabidopsis thaliana
  misc_feature (1)..(270): Ceres CLONE ID no. 40501
  misc_feature: Utility: Useful for increasing seed/fruit yield or modifying fruit content
  misc_feature: Utility: Useful for making plants with increased biomass
  misc_feature: Utility: Useful for making plants with modified flowers
  misc_feature: Utility: Useful for making smaller plants
MSQSRAVQRSSSPNEDRGENQLVVYDLKGNDDTEEEVLPVQSQPLSSRTQCPSIGAFTVQCASCFKWRLMPSMQKYEEIREQLLENPFFCDTAREWKPDISCDVPADIYQDGTRLWAIDKPNISRPPAGWQRLLRIRGEGGTRFADVYYVAPSGKKLRSTVEVQKYLNDNSEYIGEGVKLSQFSFQIPKPLQDDYVRKRPARLLDSIDNTNTPVAKEANPLAWISPDDHISLQLGTPTESGLNNSHYQPSKKKKTSTLSIFGSNDELADR

SEQ ID NO: 1585 - protein, 272 aa, Arabidopsis thaliana
  misc_feature (1)..(272): Public GI no. 21593605
  misc_feature: Utility: Useful for increasing seed/fruit yield or modifying fruit content
  misc_feature: Utility: Useful for making plants with increased biomass
  misc_feature: Utility: Useful for making plants with modified flowers
  misc_feature: Utility: Useful for making smaller plants
MSMSQSRAVQRSSSPNEDRGENQLVVYDLKGNDDTEEEVLPVQSQPLSSRTQCPSIGAFTVQCASCFKWRLMPSMQKYEEIREQLLENPFFCDTAREWKPDISCDVPADIYQDGTRLWAIDKPNISRPPAGWQRLLRIRGEGGTRFADVYYVAPSGKKLRSTVEVQKYLNDNSEYIGEGVKLSQFSFQIPKPLQDDYVRKRPARLLDSIDNTNTPVAKEANPLAWISPDDHISLQLGTPTESGLNNSHYQPSKKKKTSTLSIFGSNDELADR

SEQ ID NO: 1586 - DNA, 1560 bp, Zea mays
  misc_feature (1)..(1560): Ceres CLONE ID no. 292789
  misc_feature (1)..(1560): Also known as  Ceres CDNA ID no. 24234794
tcattcggcctatcacaaccacttactctcgtgcgctctccgtgggagcgaggactcgcggccggcggcagcggcaggttctcctagatctccggcatcatcagtaacaaatggctgacggtgaggacattcagccccttgtttgtgacaatggaactggcatggtcaaggctggttttgctggtgacgatgcgccaagggctgttttcccaagcattgtcggacgcccccgtcacactggtgtgatggttggcatggggcagaaggatgcgtatgttggtgacgaggcccagtccaagaggggtatcctgactttgaagtaccccatcgaacatggtattgttagcaattgggatgacatggagaagatctggcaccacaccttctataatgaactccgtgtggcgcctgaagagcaccctgtgctgctgacggaagccccactcaaccccaaagctaacagggagaagatgacccaaatcatgtttgagaccttcaatgttcctgccatgtatgtcgccatccaggctgtgctttccctgtacgccagtgggcgtacaactggtattgtgttggactctggtgatggtgtcagccacaccgtgccaatctacgaaggttatgcccttcctcatgccatcctgcgtcttgaccttgctgggcgtgacctgactgacagcctgatgaagatcctcaccgagagaggttactccttcaccaccacggccgaacgggaaatcgtacgggacatcaaggaaaagcttgcatacgtggctcttgactatgatcaggagctggagaacgccaagagcagctcatctgtggagaagagctacgagctgcctgatggccaggtgatcaccattggggcggagaggttccgatgccccgaggtcctcttccagccttccttcattggtatggaagctcctggcatccatgagaccacctacaactccatcatgaaatgcgacgtggatatcaggaaggacttgtatggtaacattgttctcagtggtggcacaaccatgttccctggcatcgctgaccgtatgagcaaggagatcaccgcccttgccccgagcagcatgaaaatcaaggtggtggctccacccgagaggaaatacagtgtctggataggagggtccatccttgcctccctgagcaccttccaacagatgtggatctcaaaggctgagtacgatgagtcaggaccagcgattgttcaccggaagtgcttctaagctcaagggcccccttcgtccccattctatgtattcctttccttgagtgcttttcttataagctactatgtttgagattgccggcctttgagcaggcaatgttgttggatctgtatcttgtggatcactacaatgcatgcgttgctccatcttcttttcatgccaagtttgctgtcatacttgctagtggggaaaacaacaatgacaacagtggtgagaacagcaaccacaaaaaaagagaggatggaaattattgaagttcctaggatcgtattgtaactgtacttgtgcgagtaacattattggttctctttgc

SEQ ID NO: 1587 - protein, 377 aa, Zea mays
  misc_feature (8)..(377): Pfam Name: Actin; Pfam Description: Actin
  misc_feature: Utility: Useful for increasing seed/fruit yield or modifying fruit content
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with increased biomass
  misc_feature: Utility: Useful for making smaller plants
MADGEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDSLMKILTERGYSFTTTAEREIVRDIKEKLAYVALDYDQELENAKSSSSVEKSYELPDGQVITIGAERFRCPEVLFQPSFIGMEAPGIHETTYNSIMKCDVDIRKDLYGNIVLSGGTTMFPGIADRMSKEITALAPSSMKIKVVAPPERKYSVWIGGSILASLSTFQQMWISKAEYDESGPAIVHRKCF

SEQ ID NO: 1588 - protein, 377 aa, Zea mays
  misc_feature (1)..(377): Ceres CLONE ID no. 996136
  misc_feature: Utility: Useful for increasing seed/fruit yield or modifying fruit content
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with increased biomass
  misc_feature: Utility: Useful for making smaller plants
MADGEDIQPLVCDNGTGMVKAGFAGDDAPRAVFPSIVGRPRHTGVMVGMGQKDAYVGDEAQSKRGILTLKYPIEHGIVNNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDSLMKILTERGYSFTTSAEREIVRDIKEKLAYVALEYDQELENAKSSSSVEKSYELPDGQVITIGAERFRCPEVLFQPSFIGMEAPGIHETTYNSIMKCDVDIRKDLYGNIVLSGGTTMFPGIADRMSKEITALAPSSMKIKVVAPPERKYSVWIGGSILASLSTFQQMWISKAEYDESGPGIVHRKCF

SEQ ID NO: 1589 - protein, 377 aa, Zea mays
  misc_feature (1)..(377): Public GI no. 62732981
  misc_feature: Utility: Useful for increasing seed/fruit yield or modifying fruit content
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with increased biomass
  misc_feature: Utility: Useful for making smaller plants
MADGEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDSLMKILTERGYSFTTTAEREIVRDIKEKLAYVALDYEQELEAAKSSSSVEKSYELPDGQVITIGAERFRCPEVLFQPSFIGMEAPGIHETTYNSIMKCDVDIRKDLYGNIVLSGGSTMFPGIADRMSKEITALAPSSMKIKVVAPPERKYSVWIGGSILASLSTFQQMWISKGEYDESGPAIVHRKCF

SEQ ID NO: 1590 - protein, 377 aa, Zea mays
  misc_feature (1)..(377): Public GI no. 9965319
  misc_feature: Utility: Useful for increasing seed/fruit yield or modifying fruit content
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with increased biomass
  misc_feature: Utility: Useful for making smaller plants
MADGEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDSLMKILTERGYSFTTTAEREIVRDIKEKLAYVALDYEQELETAKTSSSVEKSYELPDGQVITIGAERFRCPEVLFQPSFIGMESPGIHETTYNSIMKCDVDIRKDLYGNIVLSGGSTMFPGIADRMSKEITALAPSSMKIKVVAPPERKYSVWIGGSILASLSTFQQMWISKGEYDESGPAIVHRKCF

SEQ ID NO: 1591 - protein, 377 aa, Zea mays
  misc_feature (1)..(377): Public GI no. 15076949
  misc_feature: Utility: Useful for increasing seed/fruit yield or modifying fruit content
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with increased biomass
  misc_feature: Utility: Useful for making smaller plants
MADGEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDALMKILTERGYSFTTTAEREIVRDIKEKLAYVALDYEQELENAKSSSSVEKSYELPDGQVITIGAERFRCPEVLFQPSLIGMEAAGIHETTYNSIMKCDVDIRKDLYGNIVLSGGTTMFPGIADRMSKEITALAPSSMKIKVVAPPERKYSVWIGGSILASLSTFQQMWISKGEYEESGPSIVHRKCF

SEQ ID NO: 1592 - protein, 377 aa, Zea mays
  misc_feature (1)..(377): Public GI no. 52353611
  misc_feature: Utility: Useful for increasing seed/fruit yield or modifying fruit content
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with increased biomass
  misc_feature: Utility: Useful for making smaller plants
MADGEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDSLMKILTERGYSFTTSAEREIVRDIKEKLAYVALDYEQELETAKNSSSVEKSYELPDGQVITIGAERFRCPEVLFQPSMIGMEAAGIHETTYNSIMKCDVDIRKDLYGNIVLSGGTTMFPGIADRMSKEITALAPSSMKIKVVAPPERKYSVWIGGSILASLSTFQQMWISKDEYDESGPAIVHRKCF

SEQ ID NO: 1593 - protein, 377 aa, Arabidopsis thaliana
  misc_feature (1)..(377): Ceres CLONE ID no. 122726
  misc_feature: Utility: Useful for increasing seed/fruit yield or modifying fruit content
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with increased biomass
  misc_feature: Utility: Useful for making smaller plants
MADGEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDSLMKILTERGYMFTTTAEREIVRDIKEKLAYVALDYEQELETAKSSSSVEKNYELPDGQVITIGAERFRCPEVLFQPSLIGMEAPGIHETTYNSIMKCDVDIRKDLYGNIVLSGGSTMFPGIADRMSKEITALAPSSMKIKVVAPPERKYSVWIGGSILASLSTFQQMWISKSEYDESGPSIVHRKCF

SEQ ID NO: 1594 - protein, 377 aa, Arabidopsis thaliana
  misc_feature (1)..(377): Public GI no. 24496452
  misc_feature: Utility: Useful for increasing seed/fruit yield or modifying fruit content
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with increased biomass
  misc_feature: Utility: Useful for making smaller plants
MADGEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDSLMKILTERGYSFTTSAEREIVRDIKEKLAYVALDYEQELETAKNSSSVEKSYELPDGQVITIGAERFRCPEVLFQPSMIGMESSGIHETTYNSIMKCDVDIRKDLYGNIVLSGGTTMFPGIADRMSKEITALAPSSMKIKVVAPPERKYSVWIGGSILASLSTFQQMWISKDEYDESGPAIVHRKCF

SEQ ID NO: 1595 - protein, 377 aa, Arabidopsis thaliana; identical to SEQ ID NO: 1593
  misc_feature (1)..(377): Public GI no. 20465865
  misc_feature: Utility: Useful for increasing seed/fruit yield or modifying fruit content
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with increased biomass
  misc_feature: Utility: Useful for making smaller plants

SEQ ID NO: 1596 - protein, 377 aa, Arabidopsis thaliana
  misc_feature (1)..(377): Public GI no. 32186890
  misc_feature: Utility: Useful for increasing seed/fruit yield or modifying fruit content
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with increased biomass
  misc_feature: Utility: Useful for making smaller plants
MADGEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDALMKILTERGYMFTTTAEREIVRDMKEKLAYVALDYEQELETAKSSSSVEKNYELPDGQVITIGAERFRCPEVLFQPSFIGMEAAGIHETTYNSIMKCDVDIRKDLYGNIVLSGGSTMFPGIADRMSKEITALAPSSMKIKVVAPPERKYSVWIGGSILASLSTFQQMWISKGEYDESGPSIVHRKCF

SEQ ID NO: 1597 - protein, 377 aa, Zea mays
  misc_feature (1)..(377): Ceres CLONE ID no. 230603
  misc_feature: Utility: Useful for increasing seed/fruit yield or modifying fruit content
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with increased biomass
  misc_feature: Utility: Useful for making smaller plants
MADGEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDSLMKILTERGYSFTTSAEREIVRDIKEKLAYIALDYEQELETAKNSSSVEKSYELPDGQVITIGAERFRCPEVLFQPSMIGMEAAGIHETTYNSIMKCDVDIRKDLYGNIVLSGGSTMFPGIADRMSKEITSLAPSSMKIKVVAPPERKYSVWIGGSILASLSTFQQMWISKEEYDESGPAIVHRKCF

SEQ ID NO: 1598 - protein, 377 aa, Zea mays; identical to SEQ ID NO: 1597
  misc_feature (1)..(377): Public GI no. 53759189
  misc_feature: Utility: Useful for increasing seed/fruit yield or modifying fruit content
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with increased biomass
  misc_feature: Utility: Useful for making smaller plants

SEQ ID NO: 1599 - protein, 377 aa, Zea mays; identical to SEQ ID NO: 1597
  misc_feature (1)..(377): Ceres CLONE ID no. 219282
  misc_feature: Utility: Useful for increasing seed/fruit yield or modifying fruit content
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with increased biomass
  misc_feature: Utility: Useful for making smaller plants

SEQ ID NO: 1600 - protein, 377 aa, Zea mays; identical to SEQ ID NO: 1597
  misc_feature (1)..(377): Ceres CLONE ID no. 331439
  misc_feature: Utility: Useful for increasing seed/fruit yield or modifying fruit content
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with increased biomass
  misc_feature: Utility: Useful for making smaller plants

SEQ ID NO: 1601 - protein, 377 aa, Zea mays
  misc_feature (1)..(377): Public GI no. 50919951
  misc_feature: Utility: Useful for increasing seed/fruit yield or modifying fruit content
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with increased biomass
  misc_feature: Utility: Useful for making smaller plants
MADGEDIQPLVCDNGTGMVKAGFAGDDAPRAVFPSIVGRPRHTGVMVGMGQKDAYVGDEAQSKRGILTLKYPIEHGIVNNWDDMEKIWHHTFYNELRVAPEEHPILLTEAPLNPKANREKMTQIMFETFNAPAMYVAIQAVLSLYASGRTTGIVLDSGDGVTHTVPIYEGYALPHAILRLDLAGRDLTDCLMKILTERGYSFTTTAEREIVRDIKEKLAYIALDYEQELETAKSSSSVEKSYELPDGQVITIGAERFRCPEVLFQPSLIGMEAPGIHETTYNSIMKCDVDIRKDLYGNIVLSGGTTMFPGIADRMSKEITALAPSSMKIKVVAPPERKYSVWIGGSILASLSTFQQMWISKGEYDESGPSIVHRKCF

SEQ ID NO: 1602 - protein, 377 aa, Zea mays
  misc_feature (1)..(377): Ceres CLONE ID no. 338602
  misc_feature: Utility: Useful for increasing seed/fruit yield or modifying fruit content
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with increased biomass
  misc_feature: Utility: Useful for making smaller plants
MADAEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNTPAMYVAIQAVLSLYASGRTTGIVLDSGDGVSHTVPIYEGYALPHAILRLDLAGRDLTDYLMKILTERGYSFTTTAEREIVRDMKEKLAYIALDYDQEMETAKTSSSVEKSYELPDGQVITIGAERFRCPEVLFQPSFIGMEAAGIHETTYNSIMKCDVDIRKDLYGNIVLSGGTTMFPGIADRMSKEITALAPSSMKIKVVAPPERKYSVWIGGSILASLSTFQQMWIAKAEYDESGPSIVHRKCF

SEQ ID NO: 1603 - protein, 377 aa, Zea mays; identical to SEQ ID NO: 1602
  misc_feature (1)..(377): Ceres CLONE ID no. 299306
  misc_feature: Utility: Useful for increasing seed/fruit yield or modifying fruit content
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making plants with increased biomass
  misc_feature: Utility: Useful for making smaller plants

SEQ ID NO: 1604 - DNA, 614 bp, Arabidopsis thaliana
  misc_feature (1)..(614): Ceres CLONE ID no. 1952
  misc_feature (1)..(614): Also known as  Ceres CDNA ID no. 23388951
ggaagtgaaggaggtatatccggaggtggtatgtctgggggcagtggaagtaaacacaaaattggaggaggtaaacacggaggtcttggaggtaaattcggaaagaaaagaggcatgtccggaagtggaggaggcatgtcaggaagtgaaggaggtgtgtctggaagtgaaggaagtatgtccggaggtggtatgtctgggggtagcggaagtaaacacaaaattggaggaggtaaacacggaggtcttagaggtaaattcggaaagaaaagaggtatgtcaggaagtgaaggaggtatgtctggaagtgaaggaggtgtgtcggaaagtggtatgtccgggagtggagggggtaaacacaaaatcggaggaggtaaacacaaatttggaggaggtaaacacggaggtggaggtggccacatggcggagtaaagaacaatggtcaagttgttccaacattaagcagatcattgtgcattagttcaagattgtatgattgggaaagtaaaagaaagaaaaaatattttctaataagttttatgtttatatgtaatgttgaatctgattattatgataaaaagacataaatgtgatacaatgtttattttaagagc

SEQ ID NO: 1605 - protein, 296 aa, Arabidopsis thaliana
  misc_feature: Utility: Useful for making larger plants
  misc_feature: Utility: Useful for making ornamental plants with modified flowers
  misc_feature: Utility: Useful for making ornamental plants with modified leaves
  misc_feature: Utility: Useful for making plants with enhanced plant architecture
  misc_feature: Utility: Useful for making plants with increased biomass
  misc_feature: Utility: Useful for making plants with increased biomass and foliage
  misc_feature: Utility: Useful for making plants with modified flowers
  misc_feature: Utility: Useful for making shorter plants and plants with modified flowers
  misc_feature: Utility: Useful for making smaller plants
  misc_feature (139)..(139): Xaa is any aa, unknown, or other
PRVKKVCLEVKEVCLVVEEVNPKVKKVNSKLNWERKKVCPEACQEVKKVCLEVKEVCPVVEEVNPKVKKVNSKLNWERKKVCPEACQEVKKVCLEVKEVCPEVEEVNPKVEKVNSKLNWERKNVCTEACQEVKEVCLEXKEVYPEVVCLGAVEVNTKLEEVNTEVLEVNSERKEACPEVEEACQEVKEVCLEVKEVCPEVVCLGVAEVNTKLEEVNTEVLEVNSERKEVCQEVKEVCLEVKEVCRKVVCPGVEGVNTKSEEVNTNLEEVNTEVEVATWRSKEQWSSCSNIKQIIVH

SEQ ID NO: 1606 - DNA, 1539 bp, Arabidopsis thaliana
  misc_feature (1)..(1539): Ceres CLONE ID no. 4289
  misc_feature (1)..(1539): Also known as  Ceres CDNA ID no. 23380466
aggttcacttctttgatcttccattactaaatgttctctcctctttctctctttttgtaatttctctcttaaattcttcattgatgttttgattcgttttagtaagaattttgattcatttccaaaagatattcctattcccatcttcttttctaatccgctttctttaatattccaacatctatatatatgcctacgaattcgaatcatcagcatcatcttcaacaccagcttaacgaaaatggaagtataataagtggccacggactagtactctctcaccaacttccacctctccaagcaaaccctaaccctaaccaccaccatgtcgctacctctgctggtcttccagtcaaggatgggtggatcgatggcggagagagcaaggcaggccaacattcctccactagcgggacccctaaagtgtcctcgatgcgactccagcaacactaagttctgttactacaacaactataacctcactcagcctcgttacttctgcaaaggttgccgtcgctactggacacaagggggcgccctgagaaacgtccctgtaggtggaggctgccggaggaataacaagaagggcaaaaatggaaatttaaaatcttcttcttcttcgtccaaacagtcttcctcggtcaacgctcaaagtcctagctcaggacagctaaggacaaatcatcagttccctttttcaccaactctttacaatctcactcaactcggaggtattggtttgaacttagccgctactaatggcaacaaccaagctcaccagatcggttccagtttgatgatgagcgatctagggtttctccatggacgaaatacttcaactccgatgacgggaaacattcatgaaaacaacaacaataataacaatgaaaacaacctaatggcatccgttggatctttgagcccctttgctctcttcgatccaacgacggggctatacgctttccagaacgacggtaatatcgggaacaacgttgggatatctggttcttctacttccatggttgattctagggtttatcagacgcctmcggtgaagatggaagaacaacctaattwggctaacttgtytagaccggtctccggtttgacgtctcctgggaatcaaacaaatcaatacttttggcctkkwwcggatttctcgggtccttctaatgatatcttgtgagatttttgtgtgttttgtcggatcattaacgtatgttacgacttacgacgtggagattgattaaaaggactaccaacggtcaggattaactgcatgcatagtctgtgctcaagacgatgatcgtggagaagtacaaggacaaactaaaaggtatcttaattagagattgtggttttacaacttaaattcgatacttatttatataatcaggtgtgtcatataatttgtttgtattgcgtgatttcatggttgatctgatttctcaagttgctatatatgcctcaatacatgtgtgtaacagtccaatttgtatactctttagactgaattttatcgaatatataatatttttc

SEQ ID NO: 1607 - protein, 331 aa, Arabidopsis thaliana
  misc_feature (72)..(134): Pfam Name: zf-Dof; Pfam Description: Dof domain, zinc finger
  misc_feature (72)..(134): Pfam Name: zf-Dof; Pfam Description: Dof domain, zinc finger
  misc_feature: Utility: Useful for making larger plants
  misc_feature: Utility: Useful for making plants sterile and for genetic confinement
  misc_feature: Utility: Useful for making smaller plants
MPTNSNHQHHLQHQLNENGSIISGHGLVLSHQLPPLQANPNPNHHHVATSAGLPSRMGGSMAERARQANIPPLAGPLKCPRCDSSNTKFCYYNNYNLTQPRYFCKGCRRYWTQGGALRNVPVGGGCRRNNKKGKNGNLKSSSSSSKQSSSVNAQSPSSGQLRTNHQFPFSPTLYNLTQLGGIGLNLAATNGNNQAHQIGSSLMMSDLGFLHGRNTSTPMTGNIHENNNNNNNENNLMASVGSLSPFALFDPTTGLYAFQNDGNIGNNVGISGSSTSMVDSRVYQTPPVKMEEQPNLANLSRPVSGLTSPGNQTNQYFWPGSDFSGPSNDIL

SEQ ID NO: 1608 - protein, 320 aa, Arabidopsis thaliana
  misc_feature (1)..(320): Public GI no. 3927829
  misc_feature: Utility: Useful for making larger plants
  misc_feature: Utility: Useful for making plants sterile and for genetic confinement
  misc_feature: Utility: Useful for making smaller plants
MVFSSVSSFLDPPINWPQSANPNNHPHHHQLQENGSLVSGHHQVLSHHFPQNPNPNHHHVETAAATTVDPSSLNGQAAERARLAKNSQPPEGALKCPRCDSANTKFCYFNNYNLTQPRHFCKACRRYWTRGGALRNVPVGGGCRRNKKGKSGNSKSSSSSQNKQSTSMVNATSPTNTSNVQLQTNSQFPFLPTLQNLTQLGGIGLNLAAINGNNGGNGPVMGNNNENNLMTSLGSSSHFALFDRTMGLYNFPNEVNMGLSSIGATRVSQTAQVKMEDNHLGNISRPVSGLTSPGNQSNQYWTGQGLPGSSSNDHHHQHLM

SEQ ID NO: 1609 - protein, 340 aa, Arabidopsis thaliana
  misc_feature (1)..(340): Public GI no. 30684022
  misc_feature: Utility: Useful for making larger plants
  misc_feature: Utility: Useful for making plants sterile and for genetic confinement
  misc_feature: Utility: Useful for making smaller plants
MVFSSVSSFLDPPINWPQSANPNNHPHHHQLQENGSLVSGHHQVLSHHFPQNPNPNHHHVETAAATTVDPSSLNGQAAERARLAKNSQPPEGALKCPRCDSANTKFCYFNNYNLTQPRHFCKACRRYWTRGGALRNVPVGGGCRRNKKGKSGNSKSSSSSQNKQSTSMVNATSPTNTSNVQLQTNSQFPFLPTLQNLTQLGGIGLNLAAINGNNGGNGNTSSSFLNDLGFFHGGNTSGPVMGNNNENNLMTSLGSSSHFALFDRTMGLYNFPNEVNMGLSSIGATRVSQTAQVKMEDNHLGNISRPVSGLTSPGNQSNQYWTGQGLPGSSSNDHHHQHLM

SEQ ID NO: 1610 - DNA, 1873 bp, Arabidopsis thaliana
  misc_feature (1)..(1873): Ceres CLONE ID no. 7925
  misc_feature (1)..(1873): Also known as  Ceres CDNA ID no. 23376949
agaacactcttgtcacacttccatttagggttttctgcaaatttctccgttcgagatcaattccgtcgagatctcaagctctctcactcgtagtaaaaaaatggcggcggtagcggcaccgatagcttcgaagccccgcggatctaaagctgaatcgttcgtagacaacaagcggagagaagatatccgattcgcgaacatcaactctgctcgagccgtctctgacgccgtccgtactagtttgggaccgaaaggaatggacaagatgatttccacggcgaacggagaggtaatcattactaacgatggagctacgatccttaacaagatggaggttttgcagccagcggcgaagatgttggtcgaactttccaaatcacaagattcagccgccggagatggtactacaaccgtcgtagtaatcgccggtgcgcttctcaaggagtgtcaatcgcttctcacaaacgggatccaccctactgtcatttcagattcgcttcacaaagcgtgtggtaaggcgatcgatattttgactgccatggctgttccagtggagctcactgatagagattcacttgtgaaatctgcgagcacatcgcttaacagtaaggttgttagtcagtactctacattgcttgctcctttagctgtagatgcggttctctctgttatagatccggaaaagcctgagattgtggatttgcgtgatattaagattgttaagaagcttggtgggactgtggatgatacacatactgtgaaaggtttggtttttgataagaaggttagccgtgctgctggtggaccgactcgtgtggagaatgctaagattgctgtgattcagttccagatctcacctcctaagactgatatcgagcagagtattgttgtctctgattatactcagatggataggatcttgaaagaagagaggaattacatattggggatgattaagaagatcaaagcaactggttgcaatgtgttgttgattcagaagagtattttgagggatgcagtgactgatctatctcttcactatttggccaaagctaagattatggttattaaggatgttgagagagatgagattgaatttgtcaccaagacattgaactgcttgcctatcgccaatattgagcatttcagagctgagaagcttggccatgctgatcttgttgaggaggcctcccttggagatggaaagattttgaagatcactggtatcaaggacatggggagaactacatctgttctagttcgtggctccaaccagcttgttctagatgaagctgaaaggagtttacatgatgccttgtgtgtggttaggtgtctagtgagcaaaaggttcttgattgcaggaggtggtgcaccagagattgagctctcaaggcagctcggtgcttgggctaaggtgctacatgggatggaaggttactgtgtgaagtcttttgctgaagctctcgaagttattccttacacactagccgagaatgcagggttaaaccctatcgccattgtgactgaactcaggaacaagcatgctcaaggggaaatcaacgcagggatcaatgtgaggaaaggacagatcactaacatcttggaggaaaatgttgttcagcccctgcttgtgagtaccagtgcgatcactttagcaactgaatgcgttaggatgattttgaagattgatgacatcgtaactgtgaggtagtgtggtagtttctttcaaaacaggtcccagaacacttctattgctctatctaagcttttgtttcgtttttttcatgtgttgtgcttgcacaatggttttgaacttagactcccttttcttgcaacatgtgctattgcagttaagtggctttatttgtggttt

SEQ ID NO: 1611 - protein, 536 aa, Arabidopsis thaliana
  misc_feature (40)..(536): Pfam Name: Cpn60_TCP1; Pfam Description: TCP-1/cpn60 chaperonin family
  misc_feature: Utility: Useful for making larger plants
MAAVAAPIASKPRGSKAESFVDNKRREDIRFANINSARAVSDAVRTSLGPKGMDKMISTANGEVIITNDGATILNKMEVLQPAAKMLVELSKSQDSAAGDGTTTVVVIAGALLKECQSLLTNGIHPTVISDSLHKACGKAIDILTAMAVPVELTDRDSLVKSASTSLNSKVVSQYSTLLAPLAVDAVLSVIDPEKPEIVDLRDIKIVKKLGGTVDDTHTVKGLVFDKKVSRAAGGPTRVENAKIAVIQFQISPPKTDIEQSIVVSDYTQMDRILKEERNYILGMIKKIKATGCNVLLIQKSILRDAVTDLSLHYLAKAKIMVIKDVERDEIEFVTKTLNCLPIANIEHFRAEKLGHADLVEEASLGDGKILKITGIKDMGRTTSVLVRGSNQLVLDEAERSLHDALCVVRCLVSKRFLIAGGGAPEIELSRQLGAWAKVLHGMEGYCVKSFAEALEVIPYTLAENAGLNPIAIVTELRNKHAQGEINAGINVRKGQITNILEENVVQPLLVSTSAITLATECVRMILKIDDIVTVR

SEQ ID NO: 1612 - protein, 407 aa, Zea mays
  misc_feature (1)..(407): Ceres CLONE ID no. 326385
  misc_feature: Utility: Useful for making larger plants
MAAAVAAPAPSRKTETYTDTKRRDDVRGANIAAARAVADAVRTSLGPRGMDKMIASGDQAQEVIITNDGATILSRMALLQPAARMLAELSRSQDAAAGDGTTTVVVLAGSLLRRAQSLLSAGAHPTAAADALHRLATRAVEILHAMAIPIELSDRESLVKSASTALNSKVVSQYSTLLSPLAVDAALSVVDPAHPDLLDLRDIRIVKKLGGTVDDTELIPGLIFDKKASHAAGGPTRMENAKIAVIQFQISPPKTDIEQSVIVSDYAQMDRILREERNYILGMVKKIKAAGCNVLLIQKSILRDAVTDLSLHYLAKAKILVVKDVERDEMEFITKTLNCLPIANIEHFRTDKFGYADVVEEVSVGEGKVVKITGIKDMVGPQLYLSGDLTNWLLMKLNAVSMMHSVS

SEQ ID NO: 1613 - DNA, 729 bp, Arabidopsis thaliana
  misc_feature (1)..(729): Ceres CLONE ID no. 10857
  misc_feature (1)..(729): Also known as  Ceres CDNA ID no. 23372044
aagttgaggcatcgtcatcgtgaaatgtgcagctccggaaataaataatcactaaaataaccagatccgatctactgccccggtttctcgccggaatctccattctgtaaccggcgatcctctttctgttatggaagacgtgaaagggaaggagattattgatgatgctcctattgacaacaaggtttcagatgaaatggagagtgaggaaaatgcgatcaagaaaaagtatggaggattgttgcctaagaagattcctttgatatctaaggaccatgaacgtgcgttttttgactcagctgattgggctttaggcaagcaaaaaggacagaagccgaaagggcctttggaagctctccgcccaaaactgcagccaaccccgcaacagcaaccaagagcaagacgaatggcttattcttcaggcgaaactgaagacactgagattgataacaacgaagctccggatgaccaagcctgcgcatcagctgtggatagtaccaatttaaaggacgatggaggcgcaaaagacaacatcaaatcatgaacaacatatagagatctcttgaggagcgcaaacaaacaacatcacaagtcaatttacagaagaataagcgaccaggtttgctttgcaacggttgtaatatcaagtctcttaccttatcatacttgggactgcaaatctgtatcacttacaaacctcctggcttgaaacgtctattggacgattgt

SEQ ID NO: 1614 - protein, 137 aa, Arabidopsis thaliana
  misc_feature (31)..(125): Pfam Name: Lg106; Pfam Description: Lg106-like protein
  misc_feature: Utility: Useful for making larger plants
  misc_feature: Utility: Useful for making plants sterile and for genetic confinement
  misc_feature: Utility: Useful for making smaller plants
MEDVKGKEIIDDAPIDNKVSDEMESEENAIKKKYGGLLPKKIPLISKDHERAFFDSADWALGKQKGQKPKGPLEALRPKLQPTPQQQPRARRMAYSSGETEDTEIDNNEAPDDQACASAVDSTNLKDDGGAKDNIKS

SEQ ID NO: 1615 - protein, 116 aa, Arabidopsis thaliana
  misc_feature (1)..(116): Ceres CLONE ID no. 1334970
  misc_feature: Utility: Useful for making larger plants
  misc_feature: Utility: Useful for making plants sterile and for genetic confinement
  misc_feature: Utility: Useful for making smaller plants
  misc_feature (87)..(87): Xaa is any aa, unknown, or other
  misc_feature (88)..(88): Xaa is any aa, unknown, or other
  misc_feature (89)..(89): Xaa is any aa, unknown, or other
  misc_feature (94)..(94): Xaa is any aa, unknown, or other
  misc_feature (95)..(95): Xaa is any aa, unknown, or other
MESEENAIKKKYGGLLPKKIPLISEDHERAFFDSADWALGKQKGQKPKGPLEALRPKLQPTPQQQPRARRMAYSSGETEDSETDNTXXXGRTRXXASVVDSTNLKDDGGAKDNIKS

SEQ ID NO: 1616 - protein, 160 aa, Glycine max
  misc_feature (1)..(160): Ceres CLONE ID no. 648816
  misc_feature: Utility: Useful for making larger plants
  misc_feature: Utility: Useful for making plants sterile and for genetic confinement
  misc_feature: Utility: Useful for making smaller plants
MSDAKVEDLKKEEEVGDDSPRNEVDSEKSADDLKDSDNDKSDGNPMPSSQQEEAAVKKKYGGMLPKKPPLISKDHERAYFDSTDWALGKQGAQKPKGPLEALRPKLQPTQQHARSRRSAYAPADDNEVDGCNSDASAEHQSATEEVGGDKSDTAQDQSCH

SEQ ID NO: 1617 - protein, 123 aa, Triticum aestivum
  misc_feature (1)..(123): Ceres CLONE ID no. 617857
  misc_feature: Utility: Useful for making larger plants
  misc_feature: Utility: Useful for making plants sterile and for genetic confinement
  misc_feature: Utility: Useful for making smaller plants
MKDANAAGHDNVGNSEPMDQSGDNAMPSAQQQEQVIKKKFGGLIPKKPPLISKDHERAYFDSADWALGKSGQQGVAKPKGPLEALRPKLQPTRQQQQRSRSSIYSSSENEDGDGAGSEDMNIN

SEQ ID NO: 1618 - protein, 104 aa, Zea mays
  misc_feature (1)..(104): Ceres CLONE ID no. 399368
  misc_feature: Utility: Useful for making larger plants
  misc_feature: Utility: Useful for making plants sterile and for genetic confinement
  misc_feature: Utility: Useful for making smaller plants
MDQTEDNSMPSAQQQEEAIKKKFGGLMPKKPPLISKDHERAYFDSADWALGKQGVAKPKGPLEALRPKLQPTRQQQQQRARRPIYTSSENEDGDGAGAEDMNIN

SEQ ID NO: 1619 - DNA, 807 bp, Arabidopsis thaliana
  misc_feature (1)..(807): Ceres CLONE ID no. 19481
  misc_feature (1)..(807): Also known as  Ceres CDNA ID no. 23366921
cacacatacatcttctccatccattacacaacgaagcatagtggcaaacccgtaaatacataataccaatgacgaccaaagattgcggaaaccacggcggcggcggaggaggaggaaccgccagtcgaatctgcggagtaatcatcggcttcatcatcatcgtcttgataacaatattcctcgtttggataatcctccaaccgacaaaaccaagattcatcctccaagacgccaccgtctacgcctttaatctctcgcagcctaacctcctcacctcaaactttcagatcacgatcgcttcacgtaaccgaaactcaagaatcggaatctactacgaccgtcttcacgtctacgctacttaccggaaccaacaaatcactctacgtacagcaattcctccgacgtaccaaggccataaagaagacaacgtttggtctcctttcgtttatggaaactccgtccctatcgctcctttcaacgccgtggctctcggcgacgagcagaatcgtgggtttgtcacgttgattatacgcgccgatggacgcgtgaggtggaaggtcgggactcttattacagggaagtatcatctccatgttcgttgtcaggcgttcataaatctggctgataaagccgccggagttcatgtcggcgaaaacgccgtcaagtacatgttgatcaataagtgcagtgtcaatgtttagtaggtaaaatgacacaactttgacgccgtcaatgtttgcattcttcttcttttcatttttcttctacttggataatgtttttgcttcaatatcgtttaatttgtcc

SEQ ID NO: 1620 - protein, 210 aa, Arabidopsis thaliana
  misc_feature (40)..(178): Pfam Name: Hin1; Pfam Description: Harpin-induced protein 1 (Hin1)
  misc_feature: Utility: Useful for making larger plants
  misc_feature: Utility: Useful for making ornamental plants with modified leaves
  misc_feature: Utility: Useful for making plants sterile and for genetic confinement
  misc_feature: Utility: Useful for making plants with increased biomass and foliage
MTTKDCGNHGGGGGGGTASRICGVIIGFIIIVLITIFLVWIILQPTKPRFILQDATVYAFNLSQPNLLTSNFQITIASRNRNSRIGIYYDRLHVYATYRNQQITLRTAIPPTYQGHKEDNVWSPFVYGNSVPIAPFNAVALGDEQNRGFVTLIIRADGRVRWKVGTLITGKYHLHVRCQAFINLADKAAGVHVGENAVKYMLINKCSVNV

SEQ ID NO: 1621 - protein, 187 aa, Zea mays
  misc_feature (1)..(187): Ceres CLONE ID no. 342958
  misc_feature: Utility: Useful for making larger plants
  misc_feature: Utility: Useful for making ornamental plants with modified leaves
  misc_feature: Utility: Useful for making plants sterile and for genetic confinement
  misc_feature: Utility: Useful for making plants with increased biomass and foliage
MALLVGVVALIVYLVLRPTHPRFYLQDAALRQLDLSNGSAPLLSTAAQVTVASRNPNGRVGVYYDRLDVYATYKYQQVTLASRLPAVYQGHGDVDVWSPVLAGPAVPFAPFLADALAKDLAAGYLVLQLRIDGRVRWKVGSWVSGHYHMFVTCPAYFISSGAGSGYRGAVGAHGLRFQTTTYCRVEV

SEQ ID NO: 1622 - protein, 213 aa, Triticum aestivum
  misc_feature (1)..(213): Ceres CLONE ID no. 632710
  misc_feature: Utility: Useful for making larger plants
  misc_feature: Utility: Useful for making ornamental plants with modified leaves
  misc_feature: Utility: Useful for making plants sterile and for genetic confinement
  misc_feature: Utility: Useful for making plants with increased biomass and foliage
MSKDCGNHGEDDIRRTCRRFLAFLFFLALVVAVIALIVYLVLRPTHPRFYLQDASLRQLDVLTANASAAAGVLSTVLQVTVASRNPNDRVGVYYDRLDVYASYKYQQITLASALPPVYQGHGDVEVWSPVLSGPNVPFAPYLADALAKDVQAGYLILQVKIDGRVRWKVGSWISGHYHIFVTCPAFLIGTGGNGAPGANGLRFQTATYCHVEV

SEQ ID NO: 1623 - protein, 213 aa, Zea mays
  misc_feature (1)..(213): Ceres CLONE ID no. 443426
  misc_feature: Utility: Useful for making larger plants
  misc_feature: Utility: Useful for making ornamental plants with modified leaves
  misc_feature: Utility: Useful for making plants sterile and for genetic confinement
  misc_feature: Utility: Useful for making plants with increased biomass and foliage
MGKDCGNHGDDDFRQSCRRLLAILLTMALLVGVVALIVYLVLRPTHPRFYLQDAALRQLDLSNGSAPLLSTAAQVTVASRNPNGRVGVYYDRLDVYATYKYQQVTLASRLPTVYQGHGDVDVWSPVLAGPAVPFAPFLADALAKDLAAGYLVLQLRIDGRVRWKVGSWVSGHYHMFVTCPAYFISSGAGSGYRGAVGAHGLRFQTTTYCRVEV

SEQ ID NO: 1624 - protein, 221 aa, Triticum aestivum
  misc_feature (1)..(221): Ceres CLONE ID no. 699425
  misc_feature: Utility: Useful for making larger plants
  misc_feature: Utility: Useful for making ornamental plants with modified leaves
  misc_feature: Utility: Useful for making plants sterile and for genetic confinement
  misc_feature: Utility: Useful for making plants with increased biomass and foliage
MAVKDCGGHKGGGCECHRRRLYRKCCGALLALVLLALFIILIVYLVLRPHKPRFYLQDLAVLCLNVTPPTSAYLFTTMQATVAARNPNDRVGVYYDEADMYAQYKGVAITVPTRLPVAYQGHRDQSVWSPYLRSMDSVVLPPQLAVALAQDETAGYVLVDVRVDGQVRWKVGTWISGHYHLRVNCPALIRVNEGKGSYGATTGGGPDYFRFQQAAACAVDV

SEQ ID NO: 1625 - protein, 188 aa, Zea mays
  misc_feature (1)..(188): Ceres CLONE ID no. 1279273
  misc_feature: Utility: Useful for making larger plants
  misc_feature: Utility: Useful for making ornamental plants with modified leaves
  misc_feature: Utility: Useful for making plants sterile and for genetic confinement
  misc_feature: Utility: Useful for making plants with increased biomass and foliage
MASCLLALVLIVAFVSLVVYLALRPSKPSFYLQDLQLRRPISLGDPSLTASAQVTLAARNPNDRVGIFYKRLDVFVTYRDEAVTVPVSLPPQYQGHRDFTVWSPVLSAESVPVAAYVADAMKQDVAAGFVALQVKVDGRVKWKVGSWVSGSYHLFVSCPAVLSAGYPGVNNTVSSLKFAQPTGCSVEV

SEQ ID NO: 1626 - DNA, 586 bp, Arabidopsis thaliana
  misc_feature (1)..(586): Ceres CLONE ID no. 28979
  misc_feature (1)..(586): Also known as  Ceres CDNA ID no. 23381298
ttgcctaaatcattttaaagactgtatagaggaaaacaaaactgcaaaaacaaaaataaaaaaaacatcgcacaagaaaataaaagatttgtagaatcaactaagaaaatggctagcactatgatgactacattgcctcagttcaatggtcttcgagccaccaaaatctctgcagctcctgtacaaggcctggcaagtgttcagcccatgagacgcaagggaaatggagctttgggtgcaaagtgtgacttcatcggttcatcaacaaatctgataatggtaacgtcgacgaccctgatgttgttcgcggggagattcggacttgcgccatcagccaataggaaggcgacagctggacttaggttggaggcacgtgactcaggtctacaaacgggtgacccggccgggttcacgcttgcggacactttggcttgtggcaccgttggtcatatcatcggtgtaggagttgtccttggccttaaaaacattggtgctatttgaagttcctaaagctcttttatttgtatttgtaaaatttgtagatttttataacaatattctcatgcacctgaacgagatctaatgc

SEQ ID NO: 1627 - protein, 130 aa, Arabidopsis thaliana
  misc_feature (50)..(130): Pfam Name: PSI_PSAK; Pfam Description: Photosystem I psaG / psaK
  misc_feature: Utility: Useful for making larger plants
MASTMMTTLPQFNGLRATKISAAPVQGLASVQPMRRKGNGALGAKCDFIGSSTNLIMVTSTTLMLFAGRFGLAPSANRKATAGLRLEARDSGLQTGDPAGFTLADTLACGTVGHIIGVGVVLGLKNIGAI

SEQ ID NO: 1628 - protein, 105 aa, Brassica napus
  misc_feature (1)..(105): Ceres CLONE ID no. 1084062
  misc_feature: Utility: Useful for making larger plants
MTTLPQFNGLRASKISAAPVQGLATVVPMRRKGNGALGAKCDFIGSSTNLIMVTSTTLMLFAGRFGLAPSANRKATAGLKLEARDSGLQTGDPAGFTLADTLACG

SEQ ID NO: 1629 - protein, 79 aa, Zea mays
  misc_feature (1)..(79): Ceres CLONE ID no. 302875
  misc_feature: Utility: Useful for making larger plants
MVTTTTLMLFAGRFGLAPSANRKATAGLKLEARDSGLQTGDPAGFTLADTLACGAVGHILGVGIVLGLKNTGALDQIIG

SEQ ID NO: 1630 - protein, 79 aa, Zea mays; identical to SEQ ID NO: 1629
  misc_feature (1)..(79): Ceres CLONE ID no. 1347193
  misc_feature: Utility: Useful for making larger plants

SEQ ID NO: 1631 - protein, 125 aa, Glycine max
  misc_feature (1)..(125): Ceres CLONE ID no. 653284
  misc_feature: Utility: Useful for making larger plants
  misc_feature (14)..(14): Xaa is any aa, unknown, or other
MTTLPQFSGLRPQXSAAPVKNLVAVQQPMRPKGKGALGARCDYIGSSTNLIMVASTTLMLFAGRFGLAPSANRKATAGLKLEVRDSGLQTGDPAGFTLADTLACGSVGHIIGVGVVLGLKNIGAL

SEQ ID NO: 1632 - protein, 127 aa, Parthenium argentatum
  misc_feature (1)..(127): Ceres CLONE ID no. 1605870
  misc_feature: Utility: Useful for making larger plants
MSSLPQFTGLKATSLSLSPVQNMVSLQPMKPKGKGKGALSVRCDFIGSSTNLIMVTSTTLMLFAGRFGLAPSANRKATAGLKLEVRDSGLQTGDPAGFTLADTLACGTVGHIIGVGVVLGLKNIGAI

SEQ ID NO: 1633 - protein, 130 aa, Parthenium argentatum
  misc_feature (1)..(130): Ceres CLONE ID no. 1606960
  misc_feature: Utility: Useful for making larger plants
MASAIMSSLPQFNGLKATSPSPSPVQNMVALQPMKPKGKGALGVRCDFIGSSTNLIMVTSTTLMLFAGRFGLAPSANRKATAGLKLEVRDSGLQTGDPAGFTLADTLACGTVGHIIGVGVVLGLKNIGAI

SEQ ID NO: 1634 - protein, 132 aa, Parthenium argentatum
  misc_feature (1)..(132): Ceres CLONE ID no. 1608365
  misc_feature: Utility: Useful for making larger plants
MATAVMSSLPQFTGLKATSSSLSPVQNMVSMQPMKPKAKGKGALGVRCDFIGSSTNLIMVTSTTLMLFAGRFGLAPSANRKATAGLKLEVRDSGLQTGDPAGFTLADTLACGTVGHIIGVGVVLGLKNIGAI

SEQ ID NO: 1635 - protein, 130 aa, Triticum aestivum
  misc_feature (1)..(130): Ceres CLONE ID no. 1054986
  misc_feature: Utility: Useful for making larger plants
MASQLSAMTSVPQFHGLRSYSSPRSIATLPSLRKRSQGIRCDYIGSSTNIIMVTTTTLMLFAGRFGLAPSANRKATAGLKLEARESGLQTGDPAGFTLADTLACGSFGHILGVGIVLGLKNTGVLDQIIG

SEQ ID NO: 1636 - DNA, 1425 bp, Arabidopsis thaliana
  misc_feature (1)..(1425): Ceres CLONE ID no. 37969
  misc_feature (1)..(1425): Also known as  Ceres CDNA ID no. 23377412
aaatgttcttaaatctatggaaaatcggcatcttaactgttagcaaagaaaaaaaaaggctttaactattactagtatccttagatgaatatagctttaaataggtaaactatagctataaagtaaataacaaataagcaaggagattaaatatttatagttacttttttgttcttcgaatttagtaaatttactgttttcaagttgctttacattttgattaaggaagttttcttagagagattaggtatgtaaagcttttcttcgtctatatataagtatagatcgtcctcagaagaacaaattgttttattaagaaaatattttaatccgagcttaattctttcgtctgctatattctaaatgaaatcccgtggtagggagatgttcaaagtcggaccaattgggtcacaacgtgcttatcttaagaatttggaatgggaagagaagggacgcaacatgatctctagtatatatgtcgctttcgacaaagataccataaattctattcagtttagctattgtcagaacggaggtcatgtcgtgtctaaaaagtatggtatgtctgatgcccaaaaacaaaagtatggttcgtacaacggtcgattccacgtaatggtgagactaaatgacgatgagtttgtgaccgggttgagtgcaatatatctttgtaaagggatcacgaatttgaatattcacactaatcaggggaaacacggcccgatttgtgatagatattcatcatcaaagaatattatggataactataaggtggaaattgatgtgaagatacgtaatcgtcgtgagtttggtggtttctttgggtcttttgataactatggcactctgacttccattggcatttatgtgtgtcccattacaaggatcaatgacgtagccctcagaaccaactacaaagtcaccgatgactacgacgaccaaagcactttctatcaatcatctggtcctttaaccacaatcaaccataatcggaagcttgaatatcaaatgcctcatgaggtctccgatgtcaagcccattgttcataaccccaatttcgaagacaagatcagtctctaccaatcatcggatcgtctagccagaagcactaacactctgacacttgagtatcagatccaggagttcctcgatgtcaatcccattggtcgtaagtccaaactcaaatatggcatattctccaagttggcgcgtcttttcagaaatctcttggattagatcttttttttttttcgtttgcattcgtgcaagatccggattggtatgtatttgagtcccacccattacaaggcccgacctggttgacgaagcaacttcttgtggcagtattcaacaatagcttaaataaagtagctttaatgaagcaatgtttgtttcatctttctatatatatcgcaactcttaagt

SEQ ID NO: 1637 - protein, 290 aa, Arabidopsis thaliana
  misc_feature: Utility: Useful for making larger plants
MKSRGREMFKVGPIGSQRAYLKNLEWEEKGRNMISSIYVAFDKDTINSIQFSYCQNGGHVVSKKYGMSDAQKQKYGSYNGRFHVMVRLNDDEFVTGLSAIYLCKGITNLNIHTNQGKHGPICDRYSSSKNIMDNYKVEIDVKIRNRREFGGFFGSFDNYGTLTSIGIYVCPITRINDVALRTNYKVTDDYDDQSTFYQSSGPLTTINHNRKLEYQMPHEVSDVKPIVHNPNFEDKISLYQSSDRLARSTNTLTLEYQIQEFLDVNPIGRKSKLKYGIFSKLARLFRNLLD

SEQ ID NO: 1638 - DNA, 1835 bp, Arabidopsis thaliana
  misc_feature (1)..(1835): Ceres CLONE ID no. 113719
  misc_feature (1)..(1835): Also known as  Ceres CDNA ID no. 23362877
aaaaacttaaaccgatctatcaagcaagtggttcctctctctctctacctctcgtttttggccaacgtcgtcgtcttcacgatccacgacgattcagttcttgagttccggcgattatcggtctctcacttctggttccgttgaacccctcatttctcttctcgcccgttctctcaaattccgatatttgcccctgtgattcgaaaccctaatttcgcctatcaatctggaaaatctctcaattcgaagactttagcagcgcaaagatactctatccgggtaataagatcgaagaaaccatcaatttcttaccaaagtcgtgattcttggatctcgtctttgtttgatggacacaattagggtccaaggaggttcctggatcttcgaaatcgaccgcacagtcgctcacggagtcgacctctcgcacggaaaccatcaatggctcccacgaattcaagatcagcggctactctttggtcaaaggcatggggattggcaaatacgttacctcggatactttcatggtcggtggatactcctgggccatctacttctacccagatggaaagagtccagaggataattctgtctacgtgtctctcttcatagcccttgcgagtgaaggagccgatgttagggctttgtttgagcttaccctcgtggatcagagcggtaacgaaaggcacaaagttcatagccattttggtagaactctcgaaagcggaccctatactcttaaatatcgagggagtatgtggggatacaaacgatttttcaagaggtctcttttggagtcatcggactatctgaaggacaatggtctcttggtccgttgttgtgttggagtggtgaagtcacgcacagaaggaccgaggtgttacaatatcccggtgccggtttctggcttgggtcagcagtttggaaagcttttggaaagtgggaaaggagctgacgttactttcgaagttgatggagaaacatttcctgctcacaaattggttcttgcagcacgttctgcagttttcagggcacagctttttggcccgttgagaagtgaaaataccaattgtataatcatagaagacgtacaagcccctattttcaagatgttgcttcattttatctactgggatgaaatgcctgatatgcaagacttaatcggcacagacttgaaatgggcatcaactcttgtggctcagcatctgcttgcagctgcagaccgttatgctcttgagcggcttagaacaatatgcgagtcaaaactctgtgaaggaatcagcataaatacggtagcaaccaccttggctcttgcagagcagcatcattgtttccagctgaaagccacctgcctcaaatttatagctttgccagaaaacctgaaagctgtgatggaaacggatgggtttgattatctgaaggaaagctgcccgtccctactaagtgagctattggagtatgtggctaggctgagtgagcactctttaacatcatcagggcatcgaaaggagttatttgctgatggttgtgacttaaatgggagacgtgtgaagcaacggttacattagcaactaattgagagagagagagagagaggtcacttcgagagcctgagaagatgatggtgaagtaaacagaattttagaagagtaaagatttgtgtatttgtcattgtaaaaggattagtggttgatctgtgttgttcagctagctaatagagtgaaatgttgggtttttttcttttcttttctcttttgttttcccaggattttatgaccagaaccggttctctcaaggaaaaagtttcatgtgacttcattgataaatttggacttgcc

SEQ ID NO: 1639 - protein, 359 aa, Arabidopsis thaliana
  misc_feature (145)..(264): Pfam Name: BTB; Pfam Description: BTB/POZ domain
  misc_feature (4)..(121): Pfam Name: MATH; Pfam Description: MATH domain
  misc_feature: Utility: Useful for making larger plants
  misc_feature: Utility: Useful for making lethal plants for genetic confinement systems
  misc_feature: Utility: Useful for making plants with increased biomass and foliage
  misc_feature: Utility: Useful for making smaller plants
MGIGKYVTSDTFMVGGYSWAIYFYPDGKSPEDNSVYVSLFIALASEGADVRALFELTLVDQSGNERHKVHSHFGRTLESGPYTLKYRGSMWGYKRFFKRSLLESSDYLKDNGLLVRCCVGVVKSRTEGPRCYNIPVPVSGLGQQFGKLLESGKGADVTFEVDGETFPAHKLVLAARSAVFRAQLFGPLRSENTNCIIIEDVQAPIFKMLLHFIYWDEMPDMQDLIGTDLKWASTLVAQHLLAAADRYALERLRTICESKLCEGISINTVATTLALAEQHHCFQLKATCLKFIALPENLKAVMETDGFDYLKESCPSLLSELLEYVARLSEHSLTSSGHRKELFADGCDLNGRRVKQRLH

SEQ ID NO: 1640 - protein, 407 aa, Arabidopsis thaliana
  misc_feature (1)..(407): Public GI no. 22531225
  misc_feature: Utility: Useful for making larger plants
  misc_feature: Utility: Useful for making lethal plants for genetic confinement systems
  misc_feature: Utility: Useful for making plants with increased biomass and foliage
  misc_feature: Utility: Useful for making smaller plants
MGTTRVCSEVSSGSSKSLSQSLTVSTSTTETVNGFHEFKICGYSLAKGVGVGKYVASDTFMVGGYSWAIYFYPDGKSPEDNSSYVSLFIALASEGADVRALFELTLVDQSGNGKHKVHSHFGRALDSGPYTLKYRGSMWGYKRFFRRSSLESSDYLKENSLLVRCRVGVVKSVTEGPRYYNIPVPVSNLGQQLGNLLESGKGCDVVFQVDGETFNAHKLVLATRSPVFNAQLFGPLGDRNTKCITIEDMEAPIFKVLLHFIYWDELPDMQELIGTDSTLASTLVAQHLLAAADRYALERLKAICESKLCEGVAINTVATTLALAEQHHCLQLKAVCLKFVALPENLKAVMQTDGFDYLKESCPSLLTELLQYVARLSEHSVIVSGHRKEIFADGCDASGRRVKPRLH

SEQ ID NO: 1641 - protein, 410 aa, Glycine max
  misc_feature (1)..(410): Ceres CLONE ID no. 713993
  misc_feature: Utility: Useful for making larger plants
  misc_feature: Utility: Useful for making lethal plants for genetic confinement systems
  misc_feature: Utility: Useful for making plants with increased biomass and foliage
  misc_feature: Utility: Useful for making smaller plants
MGKILRENAKPSANSSSAYPSAAPATTSSTSVTETVRGSHQFKITGYSLSKGIGIGKYMASDVFSVGGYNWAIYFYPDGKSVEDNATYVSLFIALASEGTDVRALFELTLLDQSGKERHKVHSHFERTLESGPYTLKYRGSMWGYKRFFKRTALETSDYLKDDCLSVNCSVGVVRSHTEGPKIYTIAIPPSSIGQKFGQLLESGKGSDVNFEVNGDIFAAHKLVLAARSPVFRAQLFGPMKDQNTQRIKVEDMEAPVFKALLHFIYWDSLPDMQELTGLNSKWASTLMAQHLLAAADRYGLERLRLMCEASLCEDVAINTVATTLALAEQHHCFQLKAVCLKFIATSENLRAVMQTDGFEYLKESCPSVLTELLEYVARFTEHSDIMCKHRNEALLDGSDINGRRVKQRL

SEQ ID NO: 1642 - protein, 434 aa, Glycine max
  misc_feature (1)..(434): Public GI no. 50939715
  misc_feature: Utility: Useful for making larger plants
  misc_feature: Utility: Useful for making lethal plants for genetic confinement systems
  misc_feature: Utility: Useful for making plants with increased biomass and foliage
  misc_feature: Utility: Useful for making smaller plants
MGAGRACRGGPSSSSPAAAAAAVGRPFPPIAASCPFSSSSAAAAAPAAPSETASTSVTKTVNGSHHFKIAGYPLAKGIGVGKYIASECFTVGGYDWAIYFYPDGKSPEDGAAYVSLFIALASEGTDVRALFELTLVDQSGKGQDKVHTHFGRSLEGGPYTLKYRGSMWGYKRFFKRSALETSDYLKDDCLLVNCTVGVVQSHTEGPKIYTIPVPPSNMSQHIGQLLTDGKRTDITFEVDGEVFPAHKVVLAARSPVFRAQLFGPMKDKNMKRITIEDMEASVFKALLHFMYWDELPDIEELTGLNTTWVSTLMAQHLLAAADRYALERLKLLCELKLCEDVAINTVANTLALAEQHHCYQLKTVCLRFVALPENLKAVMQTDGFDYLQQSCPSLLTELLEYVAKVGEHSVSPCLYSNEVLDGGDANGRRVKPRI

SEQ ID NO: 1643 - protein, 425 aa, Zea mays
  misc_feature (1)..(425): Ceres CLONE ID no. 288779
  misc_feature: Utility: Useful for making larger plants
  misc_feature: Utility: Useful for making lethal plants for genetic confinement systems
  misc_feature: Utility: Useful for making plants with increased biomass and foliage
  misc_feature: Utility: Useful for making smaller plants
MGAGRVCRGGPFSASPAAGAAAGRPFPPLTASSSSPSSAPSETASTSVTKTVNGSHHFKIAGYSLSKGIGVGKFIASESFNVGGFDWAIYFYPDGKSGEDGAAYVSLFIALASEGTDVRALFELTLVDQSGKGQDKVHTHFGRSLESGPYTLKYRGSMWGYKRFFKRVALETSDYLKDDCLLVNCTVGVVQSHTEGPKIYTIPVPRSNMALHIGQLLTSGKRTDIAFEVDGEMFPAHKVILSARSPVFRAQLFGPMKDKDMKCIKIEDMEAPVFKALLHFMYWDELPDLEELTGVNTTWVSTLMAQHLLAAADRYALERLKLLCELKLCEDVAINTVANTLALAEQHHCYQLKTVCLKFVALPENLKAVMQTDGFDYLQQSCPSLLTELLEYVAKIGEHSVSPCLYSTEVLDGGDANGRRVKPRI

SEQ ID NO: 1644 - protein, 422 aa, Zea mays
  misc_feature (1)..(422): Ceres CLONE ID no. 297897
  misc_feature: Utility: Useful for making larger plants
  misc_feature: Utility: Useful for making lethal plants for genetic confinement systems
  misc_feature: Utility: Useful for making plants with increased biomass and foliage
  misc_feature: Utility: Useful for making smaller plants
MGAGRVCRGGPSSVSPAAGRPFSTLAASSSASPSSAPSETASTSVTKTVNGSHHFKIAGYSLSKGIGVGKFIASESFNVGGFDWAIYFYPDGKSAEDGAAYVSLFIALASEGTDVRALFELTLVDQSGKGQDKVHTHFGRSLESGPYTLKYRGSMWGYKRFFKRTALETSDYLKDDCLLVNCTVGVVQSHTEGPKIYTIPVPRSNMALHIGQLLTSGKRTDIAFEVDGEMFPAHKVILSARSPVFRAQLFGPMKDKDMKCIKIEDMEAPVFKALLHFMYWDELPDIEELTGVNTTWVSTLMAQHLLAAADRYALERLKLLCELKLCEDVAINTVANTLALAEQHHCYQLKTVCLKFVALPENLKAVMQTDGFDYLQQSCPSLLTELLEYVAKAGEHSVSPCLYSTEVLDGGDANGRRVKPRI

SEQ ID NO: 1645 - protein, 363 aa, Zea mays
  misc_feature (1)..(363): Public GI no. 31432214
  misc_feature: Utility: Useful for making larger plants
  misc_feature: Utility: Useful for making lethal plants for genetic confinement systems
  misc_feature: Utility: Useful for making plants with increased biomass and foliage
  misc_feature: Utility: Useful for making smaller plants
MSPAARRGNPSRSASAIVADTATGYHLLKVDGYSLTKATPTGSSLTSTQFTVGGHRWRIKYYPNGDSADSADYISIYLLLDEKASLDLKVEAKYLISFADQVKTQPSLKYRTVRTFHRQGSWTWGYGKFIKREDFEKSDHLRDDSFTIRCDILVVHKIHTKETAEILPVETFVSVPPSDMNQQFGDLLETEKGADVVLEVGGQTFAAHRCVLAARSPVFRAELYGLMKEGDTAGVVCIEEMEAQVFKVLLRFLYTDSLPEMKEEEDVMCQHLLVAADRYNLERLKLICEEKLCKYISVGTVSNILALADQHHCDGLKKACFNFLGSPANLSAVVAGDGFKHLSKICPSLMEELVVVLALPGSS

SEQ ID NO: 1646 - protein, 369 aa, Zea mays
  misc_feature (1)..(369): Public GI no. 31432206
  misc_feature: Utility: Useful for making larger plants
  misc_feature: Utility: Useful for making lethal plants for genetic confinement systems
  misc_feature: Utility: Useful for making plants with increased biomass and foliage
  misc_feature: Utility: Useful for making smaller plants
MSPAVGRGNPPSRSASSSTIVAETATGYHLLKINGYSLTKATTPTGSFLPSSPFTVGGHRWNIKYYPNGDDVKTADYISFFLVLEEEETNMGLTVQAKFKFSFANQVKKQPSLKYRPIKTFNLEDSCGWGYVEFIKRVDLEKSDDLRDDSFTIRCDIVVVREIRTEETTEILPVESFVPVPPSDMDQQFGDLLETEKGADVVFEVGGQTFAAHRCVLAARSPVFRAALYGSMKEGDTDGVVHIEDMEAQVFKLLLRFVYTDSLPEMETEEDVVCQHLLVTADRYDLHRLKLMCENRLCKYIGVSTVSNILALADQHHCDGLKKACFSFLGSPANLSAVVASDGFKHLSRSCPSLMEELVVMLALPPSHA

SEQ ID NO: 1647 - protein, 366 aa, Zea mays
  misc_feature (1)..(366): Public GI no. 50928869
  misc_feature: Utility: Useful for making larger plants
  misc_feature: Utility: Useful for making lethal plants for genetic confinement systems
  misc_feature: Utility: Useful for making plants with increased biomass and foliage
  misc_feature: Utility: Useful for making smaller plants
MGDHRDPAFPAAAGGCRLPKTSSVSVTESVTAVHDFKVTGYSLIEGLGIGRYVSSSTFTVGGVDWAVRFYPDGSTVTCLGNASAFLYYCGREKEVRTRFTLNLLGKDGKLSQVTNSYMKHTFSPASDNWGFIKFAEKSKLQSSPFLHNDCLTIRCLLTVVRESHTKDVEVNSVVVPPSNLHTDFENMLQDGEGSDVTFTVGGQEFRAHKCVLAFRSPVFKAELFGPMKENGTQCIKIDDMEPEVFEALLHFIYTDRLPDSCRDGKAAAMQHLLVAADRYGVDRLRLICERRLSETIDVETVATTLVLAEQHHCSQLRQACIGFVASPNMLGPVIESDGFKHLVESCPLIMKEILSKVSHIWIDKSC

SEQ ID NO: 1648 - protein, 348 aa, Triticum aestivum
  misc_feature (1)..(348): Ceres CLONE ID no. 859287
  misc_feature: Utility: Useful for making larger plants
  misc_feature: Utility: Useful for making lethal plants for genetic confinement systems
  misc_feature: Utility: Useful for making plants with increased biomass and foliage
  misc_feature: Utility: Useful for making smaller plants
MRTASMCTASTVRGTHTFKIAGYSLHKGLGVGNFIPSATFDIGGYLWRVLYYPDGEMEMENGDHASVFLDLVSEDTEARAFFEVRLVDKTNKLPPSVVLSQKTPYVFNSNGRRSSVGDDFLQPSAYLLDDSLVLECDVTVLRESKVTLTATTFDIQVPPSDLGEHFRELLEKEEEADVVFEVEGEVFPAHKIVVAGRSPVFKAQLFGPMSDRAKQRITVEDMQPAVFKALLHFIYTDSLPSMEKLDGDEGKEMVKHLLVAADRYAMERMKVMCESILCKSLDVENVTATLALADQHHCSNLRDACLEFITSTDRMDDVMASQGYAHLKRSCPSIVIDVLEKAKKSRKI

SEQ ID NO: 1649 - protein, 382 aa, Triticum aestivum
  misc_feature (1)..(382): Public GI no. 31432164
  misc_feature: Utility: Useful for making larger plants
  misc_feature: Utility: Useful for making lethal plants for genetic confinement systems
  misc_feature: Utility: Useful for making plants with increased biomass and foliage
  misc_feature: Utility: Useful for making smaller plants
MPASAAATTGSSDGGRPPHYSSASAIVGGTVTGHHILQIDGYSYTKEKLPSGKFIQSRSFKVGDHQWRLSYFPNVKGSDYADYISVYLCLVEGQPVKARATFSLLDRAGQPAPASASYYTRDMPMGRFAVSDIGFGYHQFIKRELLEKSGHVRDDGFAIRCDVTVVTELRTEDRTPPLVEVPPPDLRRHLGGLLESGDGADVTFHVAGEEVRAHRYILAARSPVFKAELFGQMKESSSSNTVVNVDDMEAEVFRALLVFIYTNALPETKTKANQEDELVIAQHLLVAADRYGMERLKLLCEEKLVEYIDRGSAVMLMALAEQHHCHGLKEVCFRFLESKETLSAVMATDGFLHLMQSCPSLVKELLFRVVDHSLEITHVVRL

SEQ ID NO: 1650 - protein, 384 aa, Triticum aestivum
  misc_feature (1)..(384): Public GI no. 50942543
  misc_feature: Utility: Useful for making larger plants
  misc_feature: Utility: Useful for making lethal plants for genetic confinement systems
  misc_feature: Utility: Useful for making plants with increased biomass and foliage
  misc_feature: Utility: Useful for making smaller plants
MVASASRLRPSSTTRTASSCKPETARGTHVFTIHGYSLQAVDGAGSNKASFIRSAAFDVGGFDWCLRYYHNGNIESDDDYISVFLELMTKDAEVRTIFDIRMLDQYTDDSSCVLVSTTNNTRRVFGTTNFKSKCLVWGSKNFIRRSELEGSVYLRDDRLMIECNLTVIKTPLVKTEERAAMPGDIIHFQVPPTNLSRDLGKLLEDNVGADLSFEVGGDVFPAHSVVLAARSPVFMAELYGPMRAKRGERIAIQDMQPVVFKALLHFMYTDSFSPAINDDLSRDERQELAKHLLVAADRYAVEGLKTICEKALCMSLSVDNVATIVALADQHNCGRLKEACVKFIASSNRLDDVVETEGYGRLKTSCPSILLDVIEMATKSRKIN

SEQ ID NO: 1651 - DNA, 440 bp, Arabidopsis thaliana
  misc_feature (1)..(440): Ceres CLONE ID no. 147593
  misc_feature (1)..(440): Also known as  Ceres CDNA ID no. 23380962
aaattttttccctcttacgacgatttcgagttcgagagagaagaatggaggtggtggagaggaagacggagatggcggaggaaggatgtacgacgccgagaagcacgatgtataggattccggtggcgtctgtttgtccaccgccgccgaggaagaagttgatggtggtgagaaaacgagatccgccgaggaacgggtactttcagccaccagatcttgaaactttgttctacgcacagcctcgaagagaagcttccgcttagattttgagatttgatttgatttgaattatctaggttttttttttactttcttctctgtagatacatgtttagggtttgttctcttattagattttatttatctttcagagagatgactttgtttgtgtatcgaaattggaatttgctaaaatgaaactttgatctgttttccaattc

SEQ ID NO: 1652 - protein, 72 aa, Arabidopsis thaliana
  misc_feature: Utility: Useful for making larger plants
  misc_feature: Utility: Useful for making ornamental plants with modified flowers
  misc_feature: Utility: Useful for making plants sterile and for genetic confinement
  misc_feature: Utility: Useful for making plants with increased biomass and foliage
  misc_feature: Utility: Useful for making shorter plants and plants with modified flowers
  misc_feature: Utility: Useful for making smaller plants
MEVVERKTEMAEEGCTTPRSTMYRIPVASVCPPPPRKKLMVVRKRDPPRNGYFQPPDLETLFYAQPRREASA

SEQ ID NO: 1653 - protein, 50 aa, Brassica napus
  misc_feature (1)..(50): Ceres CLONE ID no. 1090124
  misc_feature: Utility: Useful for making larger plants
  misc_feature: Utility: Useful for making ornamental plants with modified flowers
  misc_feature: Utility: Useful for making plants sterile and for genetic confinement
  misc_feature: Utility: Useful for making plants with increased biomass and foliage
  misc_feature: Utility: Useful for making shorter plants and plants with modified flowers
  misc_feature: Utility: Useful for making smaller plants
MEEVVERTTEMAEEGCTTPRSSKYRIPVSLVCPPPPRKKSMVARKRDPPR

SEQ ID NO: 1654 - protein, 82 aa, Brassica napus
  misc_feature (1)..(82): Public GI no. 8778541
  misc_feature: Utility: Useful for making larger plants
  misc_feature: Utility: Useful for making ornamental plants with modified flowers
  misc_feature: Utility: Useful for making plants sterile and for genetic confinement
  misc_feature: Utility: Useful for making plants with increased biomass and foliage
  misc_feature: Utility: Useful for making shorter plants and plants with modified flowers
  misc_feature: Utility: Useful for making smaller plants
MEEKNYDDGDTVTVDDDYQMGCTTPTRDDCRIPAYPPCPPPVRRKRSLLGFGKKREPPKKGYFQPPDLDLFFSVVAASQAAT

SEQ ID NO: 1655 - protein, 89 aa, Triticum aestivum
  misc_feature (1)..(89): Ceres CLONE ID no. 912191
  misc_feature: Utility: Useful for making larger plants
  misc_feature: Utility: Useful for making ornamental plants with modified flowers
  misc_feature: Utility: Useful for making plants sterile and for genetic confinement
  misc_feature: Utility: Useful for making plants with increased biomass and foliage
  misc_feature: Utility: Useful for making shorter plants and plants with modified flowers
  misc_feature: Utility: Useful for making smaller plants
MEVEVPMEYGVTTTTVAEEQGWETPRREDCRIPALPTCPPPPPRKKPAAELGRAAPRRGPPKGGYFQPPDIESLFLLAPPRRHAASTCA

SEQ ID NO: 1656 - protein, 90 aa, Zea mays
  misc_feature (1)..(90): Ceres CLONE ID no. 297709
  misc_feature: Utility: Useful for making larger plants
  misc_feature: Utility: Useful for making ornamental plants with modified flowers
  misc_feature: Utility: Useful for making plants sterile and for genetic confinement
  misc_feature: Utility: Useful for making plants with increased biomass and foliage
  misc_feature: Utility: Useful for making shorter plants and plants with modified flowers
  misc_feature: Utility: Useful for making smaller plants
MESSVGIEKAAAVAVGAGVGGGGGGYGCGGWETPKREECRIPATLPCPAAPRKAVPDFGKRRSPPKNGYFQPPDLEALFALAPRRQAFCA

SEQ ID NO: 1657 - protein, 83 aa, Triticum aestivum
  misc_feature (1)..(83): Ceres CLONE ID no. 937009
  misc_feature: Utility: Useful for making larger plants
  misc_feature: Utility: Useful for making ornamental plants with modified flowers
  misc_feature: Utility: Useful for making plants sterile and for genetic confinement
  misc_feature: Utility: Useful for making plants with increased biomass and foliage
  misc_feature: Utility: Useful for making shorter plants and plants with modified flowers
  misc_feature: Utility: Useful for making smaller plants
  misc_feature (8)..(8): Xaa is any aa, unknown, or other
  misc_feature (59)..(59): Xaa is any aa, unknown, or other
  misc_feature (81)..(81): Xaa is any aa, unknown, or other
MAMESGAXAAAAAAAGYYGGNCGWETPKREECRIPATLPCPAAPRKAAADFGTPRRPPXNGYFQPPDLEALFALAPRRQAXCA

SEQ ID NO: 1658 - protein, 92 aa, Triticum aestivum
  misc_feature (1)..(92): Public GI no. 34908220
  misc_feature: Utility: Useful for making larger plants
  misc_feature: Utility: Useful for making ornamental plants with modified flowers
  misc_feature: Utility: Useful for making plants sterile and for genetic confinement
  misc_feature: Utility: Useful for making plants with increased biomass and foliage
  misc_feature: Utility: Useful for making shorter plants and plants with modified flowers
  misc_feature: Utility: Useful for making smaller plants
MESKAEALAAAAAAAAAAASAASTGGGHACGGWETPKREECRIPATLPCPAAPRKAVPDFGKRRGPPKNGYFQPPDLEALFALAPRRQASSY

SEQ ID NO: 1659 - protein, 81 aa, Triticum aestivum
  misc_feature (1)..(81): Ceres CLONE ID no. 1052536
  misc_feature: Utility: Useful for making larger plants
  misc_feature: Utility: Useful for making ornamental plants with modified flowers
  misc_feature: Utility: Useful for making plants sterile and for genetic confinement
  misc_feature: Utility: Useful for making plants with increased biomass and foliage
  misc_feature: Utility: Useful for making shorter plants and plants with modified flowers
  misc_feature: Utility: Useful for making smaller plants
MAMESGSEAAAAAGYYGGTCGWETPKREECRILATLPCPAAPRKAAADFGTPRRPPKNGYFQPPDLEALFALAPRRQASCA

SEQ ID NO: 1660 - protein, 65 aa, Glycine max
  misc_feature (1)..(65): Ceres CLONE ID no. 630011
  misc_feature: Utility: Useful for making larger plants
  misc_feature: Utility: Useful for making ornamental plants with modified flowers
  misc_feature: Utility: Useful for making plants sterile and for genetic confinement
  misc_feature: Utility: Useful for making plants with increased biomass and foliage
  misc_feature: Utility: Useful for making shorter plants and plants with modified flowers
  misc_feature: Utility: Useful for making smaller plants
MEWEDECRTPRLVQNQIPAVFICPPPPPRKKPVAGKRRPPPKEGYFHPPDLDSLFSVPARKEACV

SEQ ID NO: 1661 - DNA, 1186 bp, Arabidopsis thaliana
  misc_feature (1)..(1186): Ceres CLONE ID no. 150798
  misc_feature (1)..(1186): Also known as  Ceres CDNA ID no. 23375985
accatccactctactcaacatggactcctccaaactctcatctctctctctttgcctcttcctcatttgcattatctatctcccccaacattctctcgcatgcggctcttgcaacccacggaagggcggaaagcactcccctaagctaccagttcctccggtgaccgtccctaagctaccagttcctccggtgaccgtccctaagctaccagtccctccggtgaccgtccctaagctacccgttcctcctgtgaccatccctaagctacccgttccaccagtgactgtacctaagctacccgttcctcctgtgaccgtccccaagctacccgttcctccagtgaccgtccccaagctacccgttcctccagtgacagtccctaagctacccgttcccccggtaactgtacctaagctacccgttcctccagtgaccgtccctaagctaccccttcctccgatttcagggctacccatacctccagtggtaggtcccaatctgccattgccacctttgccaattgtaggtcctattcttccaccgggaacaaccccaccagccacaggagggaaggactgtcctccaccgccagggagcgtaaagccaccatcagggggcgggaaggcgacatgtccaatagacacgctgaagttaggtgcttgcgtcgacttgttgggaggtttagtaaagatagggcttggggatccagcagttaacaaatgttgtccgttacttaaaggcctcgttgaaatcgaagccgcggcttgtctctgcactaccctcaagctcaaagctcttgacctcaatctttatgtccctgatgctcttcagcttctccttacctgtggcaaaaatccacctccgggctacacttgttccatatgataaactcactccacttataaaggatgctttggagaaaaaagtgagaagagaatggcagagctccaatctttcctgtcttggtttaccaaatacatcatatcaaatcctatccctttgattctttcctctatcgttcccttatgcttgtatcattaattaatgtgtgctttttagattaatgattcttctcttgtattaaagtatgatttgaaatcctttttttttctctatctctttttattgaattgattgaactgcgttcatgatactgtcaaaaagagagaaaaagagtacaatttt

SEQ ID NO: 1662 - protein, 288 aa, Arabidopsis thaliana
  misc_feature (205)..(286): Pfam Name: Tryp_alpha_amyl; Pfam Description: Protease inhibitor/seed storage/LTP family
  misc_feature: Utility: Useful for making larger plants
MDSSKLSSLSLCLFLICIIYLPQHSLACGSCNPRKGGKHSPKLPVPPVTVPKLPVPPVTVPKLPVPPVTVPKLPVPPVTIPKLPVPPVTVPKLPVPPVTVPKLPVPPVTVPKLPVPPVTVPKLPVPPVTVPKLPVPPVTVPKLPLPPISGLPIPPVVGPNLPLPPLPIVGPILPPGTTPPATGGKDCPPPPGSVKPPSGGGKATCPIDTLKLGACVDLLGGLVKIGLGDPAVNKCCPLLKGLVEIEAAACLCTTLKLKALDLNLYVPDALQLLLTCGKNPPPGYTCSI

SEQ ID NO: 1663 - protein, 190 aa, Glycine max
  misc_feature (1)..(190): Ceres CLONE ID no. 814247
  misc_feature: Utility: Useful for making larger plants
MESSKIYAYLFLCMIFLSSATPILGCGYCGKPPKKHKPGKTPKTPKTPVVKPPVTIPPINVPPVVLPPIVKPPGILPPIPIINPPTTPGKGGNTPCPPPKSPAQATCPIDTLKLGACVDLLGGLVHIGLGDPVANQCCPVLQGLVEVEAAVCLCTTLKLKLLNLNIYVPLALQLLVTCGKSPPPGYTCSL

SEQ ID NO: 1664 - protein, 258 aa, Glycine max
  misc_feature (1)..(258): Ceres CLONE ID no. 467982
  misc_feature: Utility: Useful for making larger plants
  misc_feature (28)..(28): Xaa is any aa, unknown, or other
  misc_feature (47)..(47): Xaa is any aa, unknown, or other
MSQNLLTTLNHQCHPHPPHVPKPHPKPXLHPHPPYVPKPPVVKPPYXPKPPVVNPPYVPKPPVVPVTPPYVPKPPIVNPPYVPKPPVVPVRPPYIPKPPVVPVTPPYVPKPPIVYPPVVPTPPIVTPPIVYPPVVPVPPLPPIVTPPNPPSETPCPPPPPPPVVPYPPPAQPTCPIDSLKLGACVDVLGGLIHIGIGSSAKQTCCPVLAGLVDLDAAVCLCTTIRAKILNINIIIPIALQLLIDCGKTPPDGFKCADS

SEQ ID NO: 1665 - protein, 228 aa, Glycine max
  misc_feature (1)..(228): Ceres CLONE ID no. 541495
  misc_feature: Utility: Useful for making larger plants
PKPPVVPVTPPYIPKPPVVTPPYVPKPPVVPVTPPYVPKPPVVPVTPPYVPKPPIVKPPIVYPPVVPKPPIVTPPYVPKPPIVKPPIVYPPVVPTPPIVYPPVVPTPPVVTPPVVTPPSPPSETPCPPPPPPVVPYPPPAQPTCPIDTLKLGACVDVLGGLIHIGIGSSAQQTCCPVLAGLVDLDAAVCLCTTIRAKILNINIIIPIALQLLIDCGKTPPDGFKCADS

SEQ ID NO: 1666 - DNA, 839 bp, Arabidopsis thaliana
  misc_feature (1)..(839): Ceres CLONE ID no. 152076
  misc_feature (1)..(839): Also known as  Ceres CDNA ID no. 23361565
aaaaaaccctaattcctccatttcgaaattccaacgaattctctggtgattttaccaaaggcgatggcaacatcgatgagtttgaatctaattggggcattcaaaggcttgtctctctcttcaacctcgtcttttctcagaggcgagttgagtttttcccccaaaacaactttcactgttactcttcctctggaaaatcttcaagctccggttccgttgacaattgaatcggcccataagaaaggagctggtagcaccaagaacggtcgtgattctcctgggcaacgactcggcgtcaagatctacggtgaccaagttgctaaacctggtgctatcattgttcgtcaacgtggcactaagttccatgctgggaaaaatgttgggattggtaaagatcataccatcttctctttaatcgatggattagtcaagttcgagaagtttggtcctgacaggaagaagataagtgtgtatccaagagaaattgtaccagagaatcccaatagctacagagcaagaaagagagaaaacttcagattgcaaagggagaagaagaaggcgagacgtgagaattacacttacacacttcctacacctgaacttgttcttgcatctgcatcaatcgatgatgctgaagccaatccggagtgctagaagatcgaatgtgaagttttcattatctctttttgtttagtcttgttcatgaaaatgatcctttcagagtattaagagttggttgtattgtcgaatccaagcctctcttttgtcaaattgagtcccaagcaggcggatttttacccaacttgagttcagagtgtaatcaaatgggttatttgttt

SEQ ID NO: 1667 - protein, 196 aa, Arabidopsis thaliana
  misc_feature (57)..(137): Pfam Name: Ribosomal_L27; Pfam Description: Ribosomal L27 protein
  misc_feature (57)..(137): Pfam Name: Ribosomal_L27; Pfam Description: Ribosomal L27 protein
  misc_feature: Utility: Useful for making larger plants
  misc_feature: Utility: Useful for making smaller plants
MATSMSLNLIGAFKGLSLSSTSSFLRGELSFSPKTTFTVTLPLENLQAPVPLTIESAHKKGAGSTKNGRDSPGQRLGVKIYGDQVAKPGAIIVRQRGTKFHAGKNVGIGKDHTIFSLIDGLVKFEKFGPDRKKISVYPREIVPENPNSYRARKRENFRLQREKKKARRENYTYTLPTPELVLASASIDDAEANPEC

SEQ ID NO: 1668 - protein, 198 aa, Arabidopsis thaliana
  misc_feature (1)..(198): Public GI no. 21436345
  misc_feature: Utility: Useful for making larger plants
  misc_feature: Utility: Useful for making smaller plants
MAMATSMSLNLIGAFKGLSLSSTSSFLRGDLSFSPKTSFTVTLPLENLQAPIPLTIESAHKKGAGSTKNGRDSPGQRLGVKIYGDQVAKPGAIIVRQRGTKFHAGKNVGIGKDHTIFSLIDGLVKFEKFGPDRKKISVYPREIVPENPNSYRARKRENFRLQREKKKARRENYSYTLPTPELVLASASVDDAEANPEC

SEQ ID NO: 1669 - protein, 190 aa, Glycine max
  misc_feature (1)..(190): Ceres CLONE ID no. 543435
  misc_feature: Utility: Useful for making larger plants
  misc_feature: Utility: Useful for making smaller plants
  misc_feature (160)..(160): Xaa is any aa, unknown, or other
MATASMCMSFNLATAFKGLSLSSSSSFFGGSSGSLRAGPASVVSLPRRCPLTIENAHKKGAGSTKNGRDSQGKRLGVKIYGDQVAKPGSIIVRQRGTKFHAGKNVGLGKDYTIFSLIDGVVKFEKYGPDRKKVSVYPREVQPENPNSYRARKREYFRVRXERKKARQGAILKSQLVLASADDAAITNPMC

SEQ ID NO: 1670 - protein, 179 aa, Glycine max
  misc_feature (1)..(179): Public GI no. 282960
  misc_feature: Utility: Useful for making larger plants
  misc_feature: Utility: Useful for making smaller plants
MAVSFSLVGAFKGLSLASSSSFLKGDFGAAFPVAPKFSVSFPLKSPLTIESAHKKGAGSTKNGRDSPGQRLGVKIFGDQVAKPGSIIVRQRGTKFHPGKNVGLGKDHTIFSLIDGLVKFEKFGPDRKKISVYPREVQPENPNSYRNRKRESFRLQRERRKARREGVILQSSVDTCFCCC

SEQ ID NO: 1671 - protein, 180 aa, Zea mays
  misc_feature (1)..(180): Ceres CLONE ID no. 291623
  misc_feature: Utility: Useful for making larger plants
  misc_feature: Utility: Useful for making smaller plants
MAFALAGAFKGLSLVPATTSSFPRGDRASLSVGGAAGVPVPVPARRLTIQMAHKKGAGSTKNGRDSKGQRLGVKIYGDQLAKPGAIIIRQRGTRVYPGNNVGMGKDHTLFSLIDGLVKFEKYGPDKKKVSVYPYEKEPENPNSYRARKREYFRMRRERKKARAEGAAEPQLVLAAVDENS

SEQ ID NO: 1672 - protein, 195 aa, Zea mays
  misc_feature (1)..(195): Public GI no. 50904335
  misc_feature: Utility: Useful for making larger plants
  misc_feature: Utility: Useful for making smaller plants
MASMAFTLVGAFKGMSLSSPCHSSSSASFLRADRVSLSVGGGVGMGVPMTMPVRRLTIQMAHKKGAGSTKNGRDSPGQRLGVKIYGDQVAKPGAIIIRQRGTRVYPGNNVGMGKDHTLFSLIDGLVKFEKYGPDKKKVSVYPYEKQPENPNSYRARKREYFRMQRERKKARAEGIVEVQLVLAAADESPEVNADC

SEQ ID NO: 1673 - DNA, 1318 bp, Arabidopsis thaliana
  misc_feature (1)..(1318): Ceres CLONE ID no. 154031
  misc_feature (1)..(1318): Also known as  Ceres CDNA ID no. 23389460
tctttttactgtttccccaaaaattcttttgaaaatcgaatcgacaaattccttccgccgtcggaatgtcaattcccgatcccaactcctccgcatctctaacggtgtctccgtctctatccaccgcatcggaaactccggtaacaccagtaaacactgttagaccaccgccgtctcagccacctcctgctccgccgccactaccgccgccgacttacagacccatagctccgcttcgccaccctaatccgttccaacaacaatctgcttatagtaataacctctacgcacattcgattccggtcagacgccaaattcaagatccgtcagctgttctttacccgtttgctctaccgggtcgagggttttcagcccgacctgttcgaggattcgtcgcagatccttccgtgacggctggtaatctgagtgggtaccctcctcgcccgagttttacttacgatcctggaccatatgagcagcgtcaaatggaatccttgttgcagcagtttataagggagagaaatcctcagattcgtccattaccacgccttggattgggttctcctgttgggttgggtcccattagagcaagtcctcaatttctgcaaccgcgggttgccccgcccccaacttcaattctagacactagcaggaatagaaaggccagaagcaaggatggggctcttgccgttgttagagggagaaaggtccgaatcactgaggggtcttcttctctttattcacttggtcgatcgtggttgaaaaatggtgctcacgttggaattcagccgcaaaggagtggtataatgaaacctttgccaaaaccgttacctgtggatttaacaacagagacaagtgtaccagatgatccagatgaagaatcagcggatgaagacaaagaggacgaggaagctgtaaagcaattatctgagaaggatcttttgaaaagacacatcgagcgagctaagaaagtccgtgcacaattacgagaagaacggtcaagaaggatcaggaggtacaaagaaagaataactcttattctggcacaatccgaagaccgatgatgcttgaagaacgactaaaaaagggtaaagttttgttaggaattagcttcatatgactgttgttgatttagcatactagtaccacgtaacaacatacgtgtagtaatagtataggtgtgttcttcttcgtcttctatagattagtaggactactcaatgaatagtgtttcattcttcctaaaactaaagaggaagataaaattgtttccttaaagtcagcttttactaatttgacaataaaaatttcttctctc

SEQ ID NO: 1674 - protein, 332 aa, Arabidopsis thaliana
  misc_feature: Utility: Useful for making larger plants
  misc_feature: Utility: Useful for making smaller plants
MSIPDPNSSASLTVSPSLSTASETPVTPVNTVRPPPSQPPPAPPPLPPPTYRPIAPLRHPNPFQQQSAYSNNLYAHSIPVRRQIQDPSAVLYPFALPGRGFSARPVRGFVADPSVTAGNLSGYPPRPSFTYDPGPYEQRQMESLLQQFIRERNPQIRPLPRLGLGSPVGLGPIRASPQFLQPRVAPPPTSILDTSRNRKARSKDGALAVVRGRKVRITEGSSSLYSLGRSWLKNGAHVGIQPQRSGIMKPLPKPLPVDLTTETSVPDDPDEESADEDKEDEEAVKQLSEKDLLKRHIERAKKVRAQLREERSRRIRRYKERITLILAQSEDR

SEQ ID NO: 1675 - protein, 274 aa, Glycine max
  misc_feature (1)..(274): Ceres CLONE ID no. 636116
  misc_feature: Utility: Useful for making larger plants
  misc_feature: Utility: Useful for making smaller plants
MPLDPAAATTTASRPISPLPQPQQQHHHHYPSQQQTLPILAPNPHFVYPFAPKGVRAADHAGVSAAFPPPSMMYSGGVRGVPLDYFSHALHVGRPPTHVPFPHAAPAASPPVKKAAARSAVADVNGGKDTNTREKSSEDTFIVVRDRKVRVTDDASLYALCRSWLRNGINEESQPQQKDVIKALPKPLPASMVASYLSNKKEDEKDEDEKEENEQSVEHLSPQDLLKRHIKRAKNVRARLREERLQRITRYRSRLRLLLPPAIEQCRNDTAAGN

SEQ ID NO: 1676 - protein, 310 aa, Zea mays
  misc_feature (1)..(310): Ceres CLONE ID no. 286081
  misc_feature: Utility: Useful for making larger plants
  misc_feature: Utility: Useful for making smaller plants
MSSPPRGQPATAAVPAVAAATSPQLPAASHTLPRAFLATSSPRAIVAAPAPPLFTGRPLNPNPPAHGSSVPHGILYPVLKSASTSNSAAAAVTAQLRRVPPMAVGYPRTHAVAIPIAQQQQPLVHAQPRSFAAVPRALVTGVSTGSEQPPRGVPIGSQPKVNPVPPVGPSNEQSNPKDREKSREEPTVVVINDRKVNLLDSESGSFYALCRSWVRNGVPHESQPSFGNGEPLLPRPLPASVVDSRISDKDDNDVAGEDSDEEPQKNANGEYNTSDLLKQHVKRAKRIRAGLQKDRLRRIERYKQRLALLL

SEQ ID NO: 1677 - DNA, 1305 bp, Zea mays
  misc_feature (1)..(1305): Ceres CLONE ID no. 246416
  misc_feature (1)..(1305): Also known as  Ceres CDNA ID no. 23783423
aaaaaaccgccccctcccttcctcttctcctagctctcttgcctgcgcaccactcgagtcgagactcgagaggcacctgatctttccttcccgtcttcctcccacacgtccccatcaccattgctgcgacgagagtgagcgggagagggtaggtggcgaggcggcggagatggggcgggggccggtgcagctgcgccggatcgagaacaagatcaaccgccaggtgaccttctccaagcgccggaacgggctgctgaagaaggcccacgagatctccgtgctctgcgacgcagaggtcgcgctcatcgtcttctccactaaggggaagctctacgagtactctagccattccagcatggaaggcattcttgagcgttaccagcgttactcatttgaagaaagggcagtacttaacccaagtattgaagaccaggcaaattggggagatgaatatgtccggttaaaatccaaacttgatgcacttcagaagagtcaaaggcagctgttaggagaacaattgagttcactgaccataaaagaactccagcaactggagcaacaactggacagttctttgaagcatattaggtcaagaaagaatcagctcatgttcgattcaatttccgcgcttcagaaaaaggagaaagcacttacagatcaaaacggtgtcctgcaaaagttcatggaggcagagaaggagaaaaacaaggctttgatgaacgcgcagctccgggagcagcaaaatggagcatcaacaagctccccatcactttcaccaccaatagttccagattccatgccaactctaaatatagggccatgtcaacatagaggggcagcagaatctgagtctgaaccgtctcctgctcctgcacaagcaaacaggggcaacctgccaccatggatgctccgcactgtcaagtaacaggtgaggtcttcccagtgtagttttgcagctgatctcgacagcaacacacctgtcaccgaaatgcttcggtgaccctagatatcaaccgatgcacgatccatctcgatcctgtgatcgaataccggcgtaggtactaccaataaagtcaggccccgtcaaatgctttacatggtgattgaagtctggagcttctcagcaccaccatatattgtgttcagttcctgtgtttattgccatagctaccctttttttctctgatctacgagctagacgtagctttgtgcttggagattccactactatgtttcctctgtcctgtgtatgctttaacggagatgcacgttgtacccgtggtaatatatataaatttgcgttgt

SEQ ID NO: 1678 - protein, 251 aa, Zea mays
  misc_feature (9)..(59): Pfam Name: SRF-TF; Pfam Description: SRF-type transcription factor (DNA- binding and dimerisation domain)
  misc_feature (76)..(173): Pfam Name: K-box; Pfam Description: K-box region
  misc_feature: Utility: Useful for making larger plants
  misc_feature: Utility: Useful for making plants that flower early
  misc_feature: Utility: Useful for making plants with increased biomass
  misc_feature: Utility: Useful for making plants with increased biomass and foliage
  misc_feature: Utility: Useful for making smaller plants
MGRGPVQLRRIENKINRQVTFSKRRNGLLKKAHEISVLCDAEVALIVFSTKGKLYEYSSHSSMEGILERYQRYSFEERAVLNPSIEDQANWGDEYVRLKSKLDALQKSQRQLLGEQLSSLTIKELQQLEQQLDSSLKHIRSRKNQLMFDSISALQKKEKALTDQNGVLQKFMEAEKEKNKALMNAQLREQQNGASTSSPSLSPPIVPDSMPTLNIGPCQHRGAAESESEPSPAPAQANRGNLPPWMLRTVK

SEQ ID NO: 1679 - protein, 265 aa, Zea mays
  misc_feature (1)..(265): Public GI no. 9367307
  misc_feature: Utility: Useful for making larger plants
  misc_feature: Utility: Useful for making plants that flower early
  misc_feature: Utility: Useful for making plants with increased biomass
  misc_feature: Utility: Useful for making plants with increased biomass and foliage
  misc_feature: Utility: Useful for making smaller plants
MGRGPVQLRRIENKINRQVTFSKRRSGLLKKAHEISVLCDAEVALIVFSTKGKLYEYSSQDSSMDVILERYQRYSFEERAVLDPSTGDQANWGDEYGSLKIKLDALQKSQRQLLGEQLDPLTTKELQQLEQQLDSSLKHIRSRKNQLLFESISELQKKEKSLKDQNGVLQKHLVETEKEKNNVLSNIHHREQLNEATNIHHQEQLSGATTSSPSPTPPTAQDSMAPPNIGPYQSRGGGDPEPQPSPAQANNSNLPPWMLRTIGNR

SEQ ID NO: 1680 - protein, 249 aa, Zea mays
  misc_feature (1)..(249): Public GI no. 62510920
  misc_feature: Utility: Useful for making larger plants
  misc_feature: Utility: Useful for making plants that flower early
  misc_feature: Utility: Useful for making plants with increased biomass
  misc_feature: Utility: Useful for making plants with increased biomass and foliage
  misc_feature: Utility: Useful for making smaller plants
MGRGPVQLRRIENKINRQVTFSKRRNGLLKKAHEISVLCDADVALIVFSTKGKLYEFSSHSSMEGILERYQRYSFDERAVLEPNTEDQENWGDEYGILKSKLDALQKSQRQLLGEQLDTLTIKELQQLEHQLEYSLKHIRSKKNQLLFESISELQKKEKSLKNQNNVLQKLMETEKEKNNAIINTNREEQNGATPSTSSPTPVTAPDPIPTTNNSQSQPRGSGESEAQPSPAQAGNSKLPPWMLRTSHT

SEQ ID NO: 1681 - protein, 249 aa, Zea mays
  misc_feature (1)..(249): Public GI no. 6175371
  misc_feature: Utility: Useful for making larger plants
  misc_feature: Utility: Useful for making plants that flower early
  misc_feature: Utility: Useful for making plants with increased biomass
  misc_feature: Utility: Useful for making plants with increased biomass and foliage
  misc_feature: Utility: Useful for making smaller plants
MGRGPVQLRRIENKINRQVTFSKRRNGLLKKAHEISVLCDADVALIVFSTKGKLYEFSSHSSMEGILERYQRYSFDERAVLEPNTEDQENWGDEYGILKSKLDALQKSQRQLLGEQLDTLTTKELQQLEHQLEYSLKHIRSKKNQLLFESISELQKKEKSLKNQNNVLQKLMETEKEKNNAIINTNREEQNGATPSTSSPTPVTAPDPIPTTNNSQSQPRGSGESEAQPSPAQAGNSKLPPWMLRTSHT

SEQ ID NO: 1682 - protein, 238 aa, Zea mays
  misc_feature (1)..(238): Public GI no. 7677036
  misc_feature: Utility: Useful for making larger plants
  misc_feature: Utility: Useful for making plants that flower early
  misc_feature: Utility: Useful for making plants with increased biomass
  misc_feature: Utility: Useful for making plants with increased biomass and foliage
  misc_feature: Utility: Useful for making smaller plants
ENTMNRQVTFFKRRNGLLKKAHEISVLCDADVALIVFSTKGKLYEFSSHSSMEGILERYQRYSFDERAVLEPNTEDQENWGDEYGILKSKLDALQKSQRQLLGEQLDTLTTKELQQLEHQLEYSLKHIRSKKNQLLFESISELQKKEKSLKNQNNVLQKLMETEKEKNNAIINTNREEQNGATPSTSSPTPVTAPDPIPTTNNSQSQPRGSGESEAQPSPAQAGNSKLPPWMLRTSHT

SEQ ID NO: 1683 - protein, 250 aa, Zea mays
  misc_feature (1)..(250): Public GI no. 33309864
  misc_feature: Utility: Useful for making larger plants
  misc_feature: Utility: Useful for making plants that flower early
  misc_feature: Utility: Useful for making plants with increased biomass
  misc_feature: Utility: Useful for making plants with increased biomass and foliage
  misc_feature: Utility: Useful for making smaller plants
MGRGRVQLRRIENKINRQVTFSKRRSGLLKKAHEISVLCDAEVALIIFSTKGKLYEYATDSCMERILERYERYTYAEKALISSGPELQGNWCHEFGKLKAKVEALQKSQRHLMGEQLEPLNLKELQQLEQQLESSLKHIRTRKCQLMFESISELQKKEKSLQEQNKMLEKELMEKQKVKALNQQAPWEQQGPPQTSSSSPTSFLIGDSLPTLNIGTYQCSGNEHGEEAAQPQVRIGNSLLPPWMLSHLNG

SEQ ID NO: 1684 - protein, 247 aa, Zea mays
  misc_feature (1)..(247): Public GI no. 6467974
  misc_feature: Utility: Useful for making larger plants
  misc_feature: Utility: Useful for making plants that flower early
  misc_feature: Utility: Useful for making plants with increased biomass
  misc_feature: Utility: Useful for making plants with increased biomass and foliage
  misc_feature: Utility: Useful for making smaller plants
MGRGRVQLKRIENKINRQVTFSKRRSGLLKKAHEISVLCDAEVALIVFSNKGKLYEYSTDSSMEKILERYERYSYAERALFSNEANPQADWRLEYNKLKARVESLQKSQRHLMGEQLDSLSIKELQRLEQQLESSLKFIRSRKTQLILHSISELQKMEKILLEQNKTLEKEIIAKEKAKALVQHAPWEKQNQSQYSSALPPVISDSVPTPTSRTFQARANEEESPQPQLRVSNTLLPPWMLSHMNGQ

SEQ ID NO: 1685 - protein, 244 aa, Zea mays
  misc_feature (1)..(244): Public GI no. 1483232
  misc_feature: Utility: Useful for making larger plants
  misc_feature: Utility: Useful for making plants that flower early
  misc_feature: Utility: Useful for making plants with increased biomass
  misc_feature: Utility: Useful for making plants with increased biomass and foliage
  misc_feature: Utility: Useful for making smaller plants
MGRGRVQLKRIENKINRQVTFSKRRSGLLKKAHEISVLCDAEVALIVFSTKGKLFEYSTDSCMERILERYERYSYADRQLLANDLEQNGSWTLEHAKLKARIEVLQRNQKHFVGEDLDSLSLKELQNLEQQLDSALKHIRSRKNQLMYESISELQRKDKALQEQNNVLAKKVKEKEKELAQQAQWEQQSHTLDSVPSLLPQPLQSSLNIGGSQQARGNGRVDEGTPPHRANALLPPWMLRHLNQ

SEQ ID NO: 1686 - protein, 250 aa, Zea mays
  misc_feature (1)..(250): Public GI no. 33355661
  misc_feature: Utility: Useful for making larger plants
  misc_feature: Utility: Useful for making plants that flower early
  misc_feature: Utility: Useful for making plants with increased biomass
  misc_feature: Utility: Useful for making plants with increased biomass and foliage
  misc_feature: Utility: Useful for making smaller plants
MGRGRVQLKRIENTINRQVTFSKRRAGLLKKANEISVLCDAEVALIIFSTKGKLSEYSTDARMESILERYDRYSSAERAIVAPDPDSQESWRDEYGRLKAKLEALQTSQRHLMGAQLDMLSVKELQQLEQQLENALKNIRTRKNQLMFDSISELQKKEKTLVSQNKDLEKKLIEKEKGKAMAQQGHWDQQGQQYTESSSPPSLLIQDPFPSLTIGINPASGSSEEDYEARPLPPANSNRLPPWMIRSANE

SEQ ID NO: 1687 - protein, 244 aa, Zea mays
  misc_feature (1)..(244): Public GI no. 30090030
  misc_feature: Utility: Useful for making larger plants
  misc_feature: Utility: Useful for making plants that flower early
  misc_feature: Utility: Useful for making plants with increased biomass
  misc_feature: Utility: Useful for making plants with increased biomass and foliage
  misc_feature: Utility: Useful for making smaller plants
MGRGKVQLKRIENKINRQVTFSKRRSGLLKKAHEISVLCDAEVGLIIFSTKGKLYEFSTESCMDKILERYERYSYAEKVLVSSESEIQGNWCHEYRKLKAKVETIQKCQKHLMGEDLESLNLKELQQLEQQLESSLKHIRSRKNQLMHESISELQKKERSLQEENKVLQKELVEKQKAHAAQQDQTQPQTSSSSSSFMLRDAPPAANTSIHPAAAGERAEDAAVQPQAPPRTGLPPWMVSHING

SEQ ID NO: 1688 - protein, 241 aa, Zea mays
  misc_feature (1)..(241): Public GI no. 32478105
  misc_feature: Utility: Useful for making larger plants
  misc_feature: Utility: Useful for making plants that flower early
  misc_feature: Utility: Useful for making plants with increased biomass
  misc_feature: Utility: Useful for making plants with increased biomass and foliage
  misc_feature: Utility: Useful for making smaller plants
  misc_feature (228)..(228): Xaa is any aa, unknown, or other
VQLKRMENKINRQVTFSKRRGGLLKKAHEISILCDAEIALIIFSTKGKLYEYATNSKMDNILERYERYSYAEKALTSSDPDIQGNWCQEYAKLKSKVEALCKSQRHLMGEQLETLNLKELQQLEQQLEGSLKHVRSRKTQVMLDSISELQRKEKSLEEQNKNLEKEILEKQKIKALAQQAHWEHQNQPAPRGSPPRPFVIAESHPTLNIGHFQGRTNAVEAEENQQPXMRICSSLLPPWML

SEQ ID NO: 1689 - protein, 244 aa, Zea mays
  misc_feature (1)..(244): Public GI no. 33391153
  misc_feature: Utility: Useful for making larger plants
  misc_feature: Utility: Useful for making plants that flower early
  misc_feature: Utility: Useful for making plants with increased biomass
  misc_feature: Utility: Useful for making plants with increased biomass and foliage
  misc_feature: Utility: Useful for making smaller plants
MGRGRVELKRIENTINRQVTFSKRRGGLLKKANEISVLCDADVAIIIFSTKGKLSEYSTDARMESILERYDRYSCAERDIVAPDPDSQESWRDEYGRLKAKLEALQTSQRHLMGAQLDMLSAKELQQLEQQLENALKNIRSRKNQLLFDSISELLKKEKTLTTQNKDMEMKLIEKKKVKSMARQGQQYTESSSPPSLLIQDPFPSLTIGINPASGSSEEDNEARLLPPVNRNRLPPWMVRSANE

SEQ ID NO: 1690 - protein, 244 aa, Triticum aestivum
  misc_feature (1)..(244): Ceres CLONE ID no. 1314092
  misc_feature: Utility: Useful for making larger plants
  misc_feature: Utility: Useful for making plants that flower early
  misc_feature: Utility: Useful for making plants with increased biomass
  misc_feature: Utility: Useful for making plants with increased biomass and foliage
  misc_feature: Utility: Useful for making smaller plants
MGRGKVQLKRIENKINRQVTFSKRRSGLLKKAHEISVLCDAEVGLIIFSTKGKLYEFSTESCMDKILERYERYSYAEKVLVSSESEIQGNWCHEYRKLKAKVETIQKCQKHLMGEDLESLNLKELQQLEQQLESSLKHIRSRKNQLMHESISELQKKERSLQEENKVLQKELVEKQKAQAAQQDQTQPQTSSSSSSFMMRDAPPAAATSIHPAAAGERAGDAAVQPQAPPRTGLPLWMVSHING

SEQ ID NO: 1691 - protein, 244 aa, Triticum aestivum
  misc_feature (1)..(244): Public GI no. 39843110
  misc_feature: Utility: Useful for making larger plants
  misc_feature: Utility: Useful for making plants that flower early
  misc_feature: Utility: Useful for making plants with increased biomass
  misc_feature: Utility: Useful for making plants with increased biomass and foliage
  misc_feature: Utility: Useful for making smaller plants
MGRGKVQLKRIENKINRQVTFSKRRSGLLKKAHEISVLCDAEVGLIIFSTKGKLYEYATDSCMDKILERYERYSYAEKVLISAESETQGNWCHEYRKLKAKVETIQKCQKHLMGEDLESLNLKELQQLEQQLESSVKHIRSRKSQLMLESISELQKKEKSLQEENKVLQKELVEKQQVHKRLVQWDQTQPQTSSSSSSFMMREALPTTNISIYAAAAGERAEDAAGQPQIHIGLPPWMVSHING

SEQ ID NO: 1692 - DNA, 1267 bp, Glycine max
  misc_feature (1)..(1267): Ceres CLONE ID no. 557009
  misc_feature (1)..(1267): Also known as  Ceres CDNA ID no. 23693452
ggagtacacagtcaataacggtcacatgcgctttgctacttctctaaacgtgaaaacatttacaccaacctacactccttgctcctacatatcccgcgccttacatgcagttccaagtatcaccaaaccaagcagtgtgatactcatactcagtactcacagcaccactttcaagtgttcaaagttcaactatcccaatatcaacgaaccatggatacttgcaagaagtcccctttgaagccatggaagaaagggccaacaagggggaaaggcgggccccagaacgcctcctgcgagtaccgaggcgttcggcagcgaacttggggcaaatgggttgctgagataagagagccaaagaagagaaccaggctctggcttggttcttttgccacagctgaagaagctgccatggcttatgatgaggctgctaggagactctatggtccagatgcataccttaatctcccccacctgcaacccaggtccacttcaactatcacgtcaggaaagttcaaatggttcccttccaagaacttcatttcaatgtttccttcctgtggattactcaatgtaaatgctcaacctagtgttcatttaatccatcagaggctgcaagagcttaagcgaaattcagttgtgagtcaatcctcatctagttcatccaatgatccaaaggcagaaattcagaatgtagacagcaaaaatcacggagaagatgaaaatcctccaaaagatgttcaaacatcatcagaggaggtgcttggagatcttcaggagaaaccccagatagacctccatgagtttcttcaacagatgggaatacttaaagaagaaagacagtcagaaagaactgatagctcaggaagttcaacagtgcgtgaagctgtgttgacagatgactgtgatcatttgggagtgttttctgacaagagtgttaactgggaggcattgattgagatgcatggacttgcaggtattcaggaatcagaagtcactcagcttgaagcatatgagccaaatgatgatctaactttctcaacttccatttggaacttttaagaaacttascatataagcctaagcaatagatcacaaggttttggttatccaactactctastcckgtatatgtstgcagcatttcaatctgtcggcagcactgkaagagtaagaaagtagctagaatagaagactactartgagaaaggagcttatttcagyagttgygacagcaaatggagaaaataatatcaktctgcgtattatt

SEQ ID NO: 1693 - protein, 282 aa, Glycine max; identical to SEQ ID NO: 64
  misc_feature (28)..(91): Pfam Name: AP2; Pfam Description: AP2 domain
  misc_feature (28)..(91): Pfam Name: AP2; Pfam Description: AP2 domain
  misc_feature: Utility: Useful for making larger plants
  misc_feature: Utility: Useful for making plants with altered leaf shape eg curled leaves
  misc_feature: Utility: Useful for making smaller plants

SEQ ID NO: 1694 - DNA, 1027 bp, Arabidopsis thaliana
  misc_feature (1)..(1027): Ceres CLONE ID no. 96
  misc_feature (1)..(1027): Also known as  Ceres CDNA ID no. 23358923
agatattttgtttctctctttctctctgatatttttcattttcttcttcttctctctctctctccacaaagataagccaacaatggttggtgattacagaggacgctttagtagccgtcgtttctccgacgactctgacgattcttccgacgatgcttcttccgtggagggagagaccacttcttccatgtactctgcggggaaagagtatatggaaacagaatggactaatgagaagcatagtttatatcttaaatctatggaagcttcattcgtagatcagttatataactcgctcggagctctcgggaagaacgagaatgtatccgaatcaacgaggttcggtagcggtagaaaaccgtctcaagaacagttcaaggttcttcatgatggtttctggcagaagattaatgtgaaacaacctgaacatcggattaacggaaggcacggtggtaattctcatgagtttcttaggagtccatggattaagcattataaacctttagtaaagacacaaatcccggtaacggatgagcccgaaaatcaagttgttagcagctctaatgggaagaagggaatatgcagctctggctcagcctctagtctcaagcagctaagctctcattcgcgtgaccacgaccaaatcagcgttggagaagcagaggtatcggatcagaactttgttaacgaaggaataaaaggcgaaaacggaagctcgaagaagatgaagacggtgatgatgagtgaatcgtcgagtaccgatcaggttgttccactcaataagctcttgcaacatgacgtaaatttgaagtctgtttcttgagaggtcagatggtgaagctttatatgaggagagaattttgtaatgtatatatatttgcataacttataagtcaaatttactatccttagttacaagtttcttcatcatatatccctaactataaatatatttatatgctcatgtgagtggattcatttgtactgtaaaacccttagaaagacgtcaaattagtatttgatggtc

SEQ ID NO: 1695 - protein, 246 aa, Arabidopsis thaliana; identical to SEQ ID NO: 222
  misc_feature: Utility: Useful for making larger plants
  misc_feature: Utility: Useful for making ornamental plants with modified flowers
  misc_feature: Utility: Useful for making shorter plants and plants with modified flowers
  misc_feature: Utility: Useful for making stronger plants
  misc_feature: Utility: Useful for making taller plants and plants with longer inflorescences
  misc_feature: Utility: Useful for modifying plant structure, ie increased branching

SEQ ID NO: 1696 - DNA, 1309 bp, Arabidopsis thaliana
  misc_feature (1)..(1309): Ceres CLONE ID no. 949
  misc_feature (1)..(1309): Also known as  Ceres CDNA ID no. 23359423
aaattacaatctctccttttgccaacaatcattgcttaaaaaacacataccttcttctttagttataaaaatgttgaaagaagagagtaatgagagtggtacttgggcacgagcatgtgacacttgtcgttcagccgcctgcactgtctactgtgaagccgactctgcctacttgtgcaccacctgtgatgctcgagttcacgcagccaaccgtgttgcttctcgccatgaacgtgttcgtgtctgtcagtcatgtgagtctgccccagctgcgtttttgtgtaaagcagacgctgcgtctctttgtacagcttgtgatgcagagattcattccgcaaacccactagctagacgtcatcagcgagttccgattcttccattatctgcaaactcttgcagctccatggccccaagtgagactgatgctgataacgatgaggatgatcgagaggttgcttcgtggttactccctaatccagggaaaaacatcggtaatcagaataatgggttcttgtttggtgttgagtaccttgatcttgtggattacagctccagcatggacaaccaattcgaagataatcagtacactcactaccagaggagctttggaggagatggagttgtgccgcttcaagttgaagaatcaacaagtcacctgcaacaaagccaacaaaactttcagttgggtatcaactatggattctcctcaggagctcactacaacaacaactccttaaaggacctaaaccatagcgcatccgtttcatcaatggacatcagtgttgtgccagagtcaactgcaagtgacataacagtccaacacccaagaactactaaagagacgatagaccaactatctggtcctcctactcaggtggtgcaacagcttactccaatggagagggaggctagggtcctgagatacagagagaagaagaagacaaggaaatttgacaagacaataagatatgcttcaagaaaggcatatgcagagataagaccacggatcaagggcagattcgcaaagaggatagaaactgaagctgaggctgaagaaatcttctcaacatcgctaatgtctgagactggatatggaattgttccttccttctaaactcctatggcgaagatggactagattgcatgctgtaaattacttctagtttggatttctacaagttattactgcatatgggtccttagttttgtgacttttgtctaactagtacgagtttaatcagatatgttcctatagctgcagttgtttaagcaacatctcgctacataattgaattggtgaaatcttatc

SEQ ID NO: 1697 - protein, 347 aa, Arabidopsis thaliana
  misc_feature (56)..(101): Pfam Name: zf-B_box; Pfam Description: B-box zinc finger
  misc_feature (284)..(322): Pfam Name: CCT; Pfam Description: CCT motif
  misc_feature: Utility: Useful for making larger plants
MLKEESNESGTWARACDTCRSAACTVYCEADSAYLCTTCDARVHAANRVASRHERVRVCQSCESAPAAFLCKADAASLCTACDAEIHSANPLARRHQRVPILPLSANSCSSMAPSETDADNDEDDREVASWLLPNPGKNIGNQNNGFLFGVEYLDLVDYSSSMDNQFEDNQYTHYQRSFGGDGVVPLQVEESTSHLQQSQQNFQLGINYGFSSGAHYNNNSLKDLNHSASVSSMDISVVPESTASDITVQHPRTTKETIDQLSGPPTQVVQQLTPMEREARVLRYREKKKTRKFDKTIRYASRKAYAEIRPRIKGRFAKRIETEAEAEEIFSTSLMSETGYGIVPSF

SEQ ID NO: 1698 - protein, 321 aa, Arabidopsis thaliana
  misc_feature (1)..(321): Public GI no. 40787165
  misc_feature: Utility: Useful for making larger plants
MLKEESNESGGTRACDTCRSAACTIYREADSTYLCTTCDARVHAAKRVRVCDSCESAPAAFFCKADAAPLCTACDAEIHSANPLARRHQRVPITSNSCGSMATDGDNNVMMVSEEKEDADEVASWLMLNPGKNNQNNGFLFGVEYLDLVDYSSSIDNQFEDQYNHYQRSFGGGEDGVVPLQLEESTSHMQQSQHNFHLGVNYGFSTEPHYSYISVVPESTSSDTTVQHAKETMDQVSGPPTQMVQQLTPADREARVLRYREKKKRRKFEKTIRYASRKAYAEVRPRIKGRFAKRIDMEADAEQLFSTSLMSNTSYGIVPSF

SEQ ID NO: 1699 - protein, 321 aa, Arabidopsis thaliana
  misc_feature (1)..(321): Public GI no. 33943521
  misc_feature: Utility: Useful for making larger plants
MLKEESNESGGTRACDTCRSAACTIYREADSTYLCTTCDARVHAAKRVRVCDSCESAPAAFFCKADAASLCTACDAEIHSANPLARRHQRVPITSNSCGSMATDGDNNVMMVSEEKEDADEVASWLMLNPGKNNQNNGFLFGVEYLDLVDYSSSIDNQFEDQYSKYHRSFGGGEDGVVPLQLEESSTSHMQQSQHNFHLGVNYGYSTEPQYSYVSVVPESLSDTTVQHAKETIDQVCGPPTQMVQQLTPADREARVLRYREKKKRRKFEKTIRYASRKAYAEVRPRIKGRFAKRIDMEADAEQLFSTSVMSNTSYGIVPSF

SEQ ID NO: 1700 - protein, 342 aa, Arabidopsis thaliana
  misc_feature (1)..(342): Public GI no. 22854966
  misc_feature: Utility: Useful for making larger plants
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHHSSETTEPENIVVVGQEEEDEAEAASWLLPSSVKNCGDNNNNTENNRFSVGEEYLDLVDYSSSIDKRFTGQTNQYQQDYNVPQRSYVADGVVPLQVGVANGHMHHEKHNFQFGFTNVSSEASPIHMVSLVPESVTSDATVSHPRSPKAGTEELPEAPVQMLSPMERKARVLRYREKKKTRKFEKRIRYASRKEYAEKRPRIKGRFAKRNEVDANHALSTMVMSDTGYGIVPSFS

SEQ ID NO: 1701 - protein, 345 aa, Arabidopsis thaliana
  misc_feature (1)..(345): Public GI no. 22854942
  misc_feature: Utility: Useful for making larger plants
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHHSSETTEPENIVVVGQEEEDEAEAASWLLPSSVKNCGDNNNNNNNSENNRFSVGEEYLDLVDYSSSMDKRFTGQSNQYQQDYNVPQRSYVADGVVPLQVGVANGHMHHEQHNFQFGFTNVSSEASPIHMVSLVPESVTSDATVSHPRSPKAGTEELPEAPVQMLSPMERKARVLRYREKKKTRKFEKRIRYASRKEYAEKRPRIKGRFAKRNEVDADHALSTMVVFDTGYGIVPSFS

SEQ ID NO: 1702 - protein, 342 aa, Arabidopsis thaliana
  misc_feature (1)..(342): Public GI no. 22854970
  misc_feature: Utility: Useful for making larger plants
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHHSSETTEPENIVVVGQEEEDEAEAASWLLPSSVKNCGDNNNNTENNRFSVGEEYLDLVDYSSSIDKRFTGQTNQYQQDYNVPQRSYVADGVVPLQVGVANGHMHHEKHNFQFGFTNVSSEASPIHMVSLVPESVTSDATVSHPRSPKAGTEELPEAPVQMLSPMERKARVLRYREKKKTRKFEKRIRYASRKEYAEKRPRIKGRFAKRNEVDADHALSTMVMFDTGYGIVPSFS

SEQ ID NO: 1703 - protein, 342 aa, Arabidopsis thaliana
  misc_feature (1)..(342): Public GI no. 22854950
  misc_feature: Utility: Useful for making larger plants
  misc_feature (177)..(177): Xaa is any aa, unknown, or other
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHHSSETTEPENIVVVGQEEEDEAEAASWLLPSSVKNCGDNNNNTENNRFSVGEEYLDLVDYSSSIDKRFXGQTNQYQQDYNVPQRSYVADGVVPLQVGVANGHMHHEKHNFQFGFTNVSSEASPIHMVSLVPESVTSDATVSHPRSPKAGTEELPEAPVQMLSPMERKARVLRYREKKKTRKFEKRIRYASRKEYAEKRPRIKGRFAKRNEVDADHALSTMVMFDTGYGIVPSFS

SEQ ID NO: 1704 - protein, 348 aa, Arabidopsis thaliana
  misc_feature (1)..(348): Public GI no. 22854918
  misc_feature: Utility: Useful for making larger plants
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHHSSETTEPENIVVVGQEEEDEAEAASWLLPSSVKNCGDNNNNTENNRFSVGEEYLDLVDYSSSIDKRFTGQTNQYQQDYNVPQRSYVADGVVPLQVGVSKGHMHHEQHNFQFGFTNVSSEAHQISNGSPIHMVSLVPESVTSDATVSHQRSPKAGTEELPEAPVQMLSPMERKARVLRYREKKKTRKFEKRIRYASRKEYAEKRPRIKGRFAKRNEVDADQAFPTVVMFDTGYGIVPSFS

SEQ ID NO: 1705 - protein, 345 aa, Arabidopsis thaliana
  misc_feature (1)..(345): Public GI no. 22854982
  misc_feature: Utility: Useful for making larger plants
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHSSKTTEPENIVVVGQEEEDEAEAASWLLPSSVKNCGDNNNNNNNNSENNRFSVGEEYLDLVDYSSSIDKRFTGQSNQYQQDYNVPQRSYVADGVVPLQVGVANGHMHHEQHNFQFGFTNVSSEASPIHMVSLVPESVTSDATVSHPRSPKAGTEELPEAPVQMLSPMERKARVLRYREKKKTRKFEKRIRYASRKEYAEKRPRIKGRFAKRNEVDADHALSTMVMFDTGYGIVPSFS

SEQ ID NO: 1706 - protein, 348 aa, Arabidopsis thaliana
  misc_feature (1)..(348): Public GI no. 22854908
  misc_feature: Utility: Useful for making larger plants
  misc_feature (321)..(321): Xaa is any aa, unknown, or other
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHHSSETTEPENIVVVGQEEEDEAEAASWLLPSSVKNCGDNNNNTENNRFSVGEEYLDLVDYSSSIDKRFTGQTNQYQQDYNVPQRSYVADGVVPLQVGVSKGHMHHEQHNFQFGFTNVSSEAHQISNGSPIHMVSLVPESVTSDATVSHQRSPKAGTEELPEAPVQMLSPMERKARVLRYREKKKTRKFEKRIRYASRKEYAEKRPRIKGRFAXRNEVDADQAFPTVVMFDTGYGIVPSFS

SEQ ID NO: 1707 - protein, 348 aa, Arabidopsis thaliana
  misc_feature (1)..(348): Public GI no. 22854910
  misc_feature: Utility: Useful for making larger plants
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHHSSETTEPENIVVVGQEEEDEAEAASWLLPSSVKNCGDNNNNTENNRFSVGEEYLDLVDYSSSIDKRFTGQTNQYQQDYNVPQRSYVADGVVPLQVGVSKGHMHHEQHNFQFGFTNVSSEAHQISNGSPIHMVSLVPESVTSDATVSHQRSPKAGTEELPEAPVQMLSPMERKARVLRYREKKKTRKFEKRIRYASRKEYAEKRPRIKGRFAKRNEVDADQAFPTVVMFDTRYGIVPSFS

SEQ ID NO: 1708 - protein, 345 aa, Arabidopsis thaliana
  misc_feature (1)..(345): Public GI no. 22854934
  misc_feature: Utility: Useful for making larger plants
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHSSKTTEPENIVVVGQEEEDEAEAASWLLPSSVKNCGDNNNNNNNNSENNRFSVGEEYLDLVDYSSSIDKRFTGQSNQYQQDYNVPQRSYVADGVVPLQVGVANGHMHHEQHNFQFGFTNVSSEASPIHMVSLVPESVTSDATVSHPRSPKAGTEELPEAPVQMLSPMERKARVLRYREKKKTRKFEKRIRYASRKEYAEKRPRIKGRFAKRNEVDADQALSTMVVFDTGYGIVPSFS

SEQ ID NO: 1709 - protein, 348 aa, Arabidopsis thaliana
  misc_feature (1)..(348): Public GI no. 22854916
  misc_feature: Utility: Useful for making larger plants
MLKQESNWAQACDTCRSAACTVYCRADSAYLCTSCDAQIHAANRLASRHERVRVCESCERAPAVFFCQADAASLCTACDSQIHSANPLARRHQRVPILPISGCVATNHHSSETTEPENIVVVGQEEEDEAEAASWLLPSSVKNCGDNNNNTENNRFSVGEEYLDLVDYSSSIDKRFTGQTNQYQQDYNVPQRSYVADGVVPLQVGVSKGHMHHEQHNFQFGFTNVSSEAHQISNGSPIHMVSLVPESVTSDATVSHQRSPKAGTEELPEAPVQMLSPMERKARVLRYREKKKTRKFEKRIRYASRKEYAEKRPRIKGRFAKRNEVDADQAFPTVVMFDTGYGIVPSFS

SEQ ID NO: 1710 - DNA, 886 bp, Arabidopsis thaliana
  misc_feature (1)..(886): Ceres CLONE ID no. 2036
  misc_feature (1)..(886): Also known as  Ceres CDNA ID no. 23427576
aaaaagaagctatggcttccaatttctggacttcgacgcactacaaagagcttaaggacccagaagaggttaatgttgttcatcctcttgatgctcagagaggaatctctgttgaagatttcagactcattaagcttcatatgtctaattatatatcgaaactggcacaacacattaagattaggcaaagagttgttgcaactgcagtaacctatatgcgtcgtgtttacacaagaaagagtttgacggaatatgagcctcggcttgttgctcctacatgcttgtatttggcttgcaaagcagaagagagtgtggtgcatgccaaacttcttgtcttctacatgaaaaaactttatgcggatgaaaagtttcgatatgagattaaagatattctggaaatggagatgaaggtcttggaagcattgaacttctatcttgttgtattccacccatatcgatctctgcctgagttcttgcaggattctggaatcaatgacactagtatgacccatctaacttggggtcttgtcaacgacacatatagaatggacctcatccttatacatccgccgtttctcataacactcgcttgcatttacattgcttctgtacacaaagagaaagacataaagacatggtttgaagagctttctgtcgacatgaacattgtgaagaatattgcaatggagatattagatttctatgaaaaccatagactgttcacggaagagagagttcacgccgccttcaacaaacttgctacaaacccataaagtttcgacttgtctgtgtgttttgttcccttgagaaaatataatgttttgccagaagttttggaaatgagattattctgtttattgtacatcagttttgctcgtcttggttc

SEQ ID NO: 1711 - protein, 253 aa, Arabidopsis thaliana
  misc_feature (9)..(143): Pfam Name: Cyclin_N; Pfam Description: Cyclin, N-terminal domain
  misc_feature: Utility: Useful for making larger plants
  misc_feature: Utility: Useful for making ornamental plants with modified flowers
  misc_feature: Utility: Useful for making plants sterile and for genetic confinement
MASNFWTSTHYKELKDPEEVNVVHPLDAQRGISVEDFRLIKLHMSNYISKLAQHIKIRQRVVATAVTYMRRVYTRKSLTEYEPRLVAPTCLYLACKAEESVVHAKLLVFYMKKLYADEKFRYEIKDILEMEMKVLEALNFYLVVFHPYRSLPEFLQDSGINDTSMTHLTWGLVNDTYRMDLILIHPPFLITLACIYIASVHKEKDIKTWFEELSVDMNIVKNIAMEILDFYENHRLFTEERVHAAFNKLATNP

SEQ ID NO: 1712 - protein, 212 aa, Glycine max
  misc_feature (1)..(212): Ceres CLONE ID no. 463096
  misc_feature: Utility: Useful for making larger plants
  misc_feature: Utility: Useful for making ornamental plants with modified flowers
  misc_feature: Utility: Useful for making plants sterile and for genetic confinement
  misc_feature (88)..(88): Xaa is any aa, unknown, or other
MHMANYILKLAQQVKVRQRVVATAVTYMRRVYTRKSMAEYDPRLVAPTCLYLASKAEESTVQARLLVFYIKKLYSDDKYRYEIKDILXMEMKILEALNYYLVVYHPYRSLVPLLQDAGLNDLNMTQLTWGLVNDTYKMDLILVHPPHLIALACIYIASVLREKDTTAWFEELRVDMNVVKNISMEILDFYESNRMFTDERINAALQKLSLRP

SEQ ID NO: 1713 - protein, 253 aa, Glycine max
  misc_feature (1)..(253): Public GI no. 42568400
  misc_feature: Utility: Useful for making larger plants
  misc_feature: Utility: Useful for making ornamental plants with modified flowers
  misc_feature: Utility: Useful for making plants sterile and for genetic confinement
MAANFWNSSHYKQLLDPEEVDVVHDLDKERGISIDDFKLIKFHMSNHIMKLAQHIKVRQRVVATAITYMRRVYIRKSMVEFEPRLVALTCLYLASKAEESIVQARNLVFYIKRLYPDEYNKYELKDILGMEMKVLEALDYYLVVFHPYRSLSEFLQDAALNDVNMNQITWGIVNDTYKMDLILVHPPYRIALACIYIASVHREKDITAWFEDLHEDMNLVKNIAMEILDFYENYRTITEEKVNSAFSKLALKL

SEQ ID NO: 1714 - protein, 259 aa, Glycine max
  misc_feature (1)..(259): Public GI no. 10177354
  misc_feature: Utility: Useful for making larger plants
  misc_feature: Utility: Useful for making ornamental plants with modified flowers
  misc_feature: Utility: Useful for making plants sterile and for genetic confinement
MAANFWNSSHYKQLLDPEEVDVVHDLDKERGISIDDFKLIKFHMSNHIMKLAQHIKVRQRVVATAITYMRRVYIRKSMVEFEPRLVALTCLYLASKAEESIVQARNLVFYIKRLCNIFFFYPDEYNKYELKDILGMEMKVLEALDYYLVVFHPYRSLSEFLQDAALNDVNMNQITWGIVNDTYKMDLILVHPPYRIALACIYIASVHREKDITAWFEDLHEDMNLVKNIAMEILDFYENYRTITEEKVNSAFSKLALKL

SEQ ID NO: 1715 - protein, 257 aa, Glycine max
  misc_feature (1)..(257): Public GI no. 7489457
  misc_feature: Utility: Useful for making larger plants
  misc_feature: Utility: Useful for making ornamental plants with modified flowers
  misc_feature: Utility: Useful for making plants sterile and for genetic confinement
MAANFWTSSHCKQLLDQEDVDKVPQADSDRGITLEEFRLVKIHMSFHIWRLAQQVKVRQRVIATAVTYFRRVYTRKSMTEYDPRLVAPTCLYLASKVEESTVQARLLVFYIKKMCASDEKYRFEIKDILEMEMKLLEALDYYLVVYHPYRPLLQLLQDAGITDLTQFAWGIVNDTYKMDLILIHPPYMIALACIYIASVLKDKDITLWFEELRVDMNIVKNISMEILDFYDTYKIDPQRGLPEDKIAPVMNKLPSKA

SEQ ID NO: 1716 - protein, 257 aa, Zea mays
  misc_feature (1)..(257): Ceres CLONE ID no. 385771
  misc_feature: Utility: Useful for making larger plants
  misc_feature: Utility: Useful for making ornamental plants with modified flowers
  misc_feature: Utility: Useful for making plants sterile and for genetic confinement
MAANFWTSSHCKQLLDPEDVDLVPAADRERGITPEEFRLIKIHMSFHIWRLAQQVKVRQRVVATAISYFRRVYTRKSMSDYDPRLVAPTCLYLASKVEESTVQARLLVFYIKKMCGSDDKYRFEIKDILEMEMKLLEALDYYLVVFHPYRPLLQLLQDAGITDLTQFAWGLVNDTYKMDLILIYPPYMIALACIYIASVLKDKDTTAWFEELRVDMNIVKNISMEILDFYDTYKIDPQRGIPEDKISPVMNKLPAKA

SEQ ID NO: 1717 - protein, 258 aa, Triticum aestivum
  misc_feature (1)..(258): Ceres CLONE ID no. 729756
  misc_feature: Utility: Useful for making larger plants
  misc_feature: Utility: Useful for making ornamental plants with modified flowers
  misc_feature: Utility: Useful for making plants sterile and for genetic confinement
MAANFWASSHSKQLLDPEDVDVVPAADRERGITTEEFRLVKIHMSSHIWRLAQQVKVRQRVIATAITYFRRVYTRKSMSEYDPRLVAPACLYLASKVEESTVQARLLVFYIKKMCAGSDDKYRFEIKDILEMEMKLLEALDYYLVVYHPYRPLLHLLQDAGVTDLTQFAWGLVNDTYKMDLILVQPPYMIALACIYIASVLKDKDTTSWFEELHVDMNIVKNISMEILDFYETYKVDPQRGLSDEKISPIMNKLPAKA

SEQ ID NO: 1718 - protein, 257 aa, Triticum aestivum
  misc_feature (1)..(257): Ceres CLONE ID no. 615259
  misc_feature: Utility: Useful for making larger plants
  misc_feature: Utility: Useful for making ornamental plants with modified flowers
  misc_feature: Utility: Useful for making plants sterile and for genetic confinement
MAANFWTSSHSKQLLDPEEVDVVPAQDRERGVTPVEFRLVKIHMSFHIWRLAQQVKVRQRVIATAITYFRCVYTRKSMTEYDPRLVAPACLYLASKVEESTVQARLLVFYIKKMCGSDDKYRFEIKDILEMEMKLLEALDYYLVVYHPYRPLLQLLQDAGITDLTQFAWGLVNDTYKMDLILIYPPYMIALACIYIASVLKDKDTTSWFEELRVDMNIVKNISMEILDFYDTYKIDPQRGLQEDKIIPVMNKLPSKA

SEQ ID NO: 1719 - DNA, 1371 bp, Arabidopsis thaliana
  misc_feature (1)..(1371): Ceres CLONE ID no. 18857
  misc_feature (1)..(1371): Also known as  Ceres CDNA ID no. 23527182
gacgagacattgaaaactcccatctaccttttctctttctctctctctccctcccaaagtcgaacctgcaatccctaaatccccaatttgagaccatctccagttcgtcatcgtacgacgactctctctctctctctcctcttctctgtatagtcgaattatattacaagttagatagatagcatgaattggttacctgaagctgaagctgaggatgacttcaaaggtcttctctctggtgatttctttgatgatctcatcaatcaccttgacgtccctcttgatgacattgataccaccaatggtgaaggagattgggttgacaggtttcaagaccttgagcctcctcccatggatatgttccccactttgccttctgacctcacctcttgcggctctggcatggccaaggcccctcgtgtggatattcaaaggaacattcctgctttgaaacagtcctattcttctgaagccttgtccagcactctccaccaatcttcagctcctcctgaaatcaaagtttcgaaactatttcagtctttaagtccagtgtcagttctcgagaacagttatggttctctctcgacccacaacaatggatctcagagattggctttccctgtgaaaggcatgagaagcaagcgcaaacgccccacaacactgagacttagctaccttttcccctctgaaccccgaaagcccgagaagtcaaccccgggcaaacctgaatccgagtgttacttttcttctgagcaacatgccaagaagaaacgcaagatccacctgaccacccgcacggtctcttccactctggaggcaagcaactcggatgggatagtccgcaaatgcactcattgcgagacaaccaagaccccacagtggagggaaggacccagtggaccgaagaccctctgcaatgcttgcggagtgaggttcagatctggtcgcctagttccagaataccgaccagcctcaagccccaccttcatcccagctgtgcattcaaactcacacaggaagatcattgagatgagaaggaaggacgacgaacagtttgatagcagcatgattcgggcagtgatatccagagggtaaagcagttttttttttaaagtttggtctctgatccgcagaaatgggaagtcagtggaggaagaagatggtataaaagtagggtttagtgactgttttcaaatctgatgaagagagtttagtggtttagttcaagttagggatatgaaatattttgttgtttcattatgtgtttttatctttatctcttggctgacatttgtgtatcagaggaaaacaggtgaagccaaagtttgctctctttttttcgctatttcaaatctattctttttattcttc

SEQ ID NO: 1720 - protein, 303 aa, Arabidopsis thaliana
  misc_feature (222)..(257): Pfam Name: GATA; Pfam Description: GATA zinc finger
  misc_feature: Utility: Useful for making larger plants
MNWLPEAEAEDDFKGLLSGDFFDDLINHLDVPLDDIDTTNGEGDWVDRFQDLEPPPMDMFPTLPSDLTSCGSGMAKAPRVDIQRNIPALKQSYSSEALSSTLHQSSAPPEIKVSKLFQSLSPVSVLENSYGSLSTHNNGSQRLAFPVKGMRSKRKRPTTLRLSYLFPSEPRKPEKSTPGKPESECYFSSEQHAKKKRKIHLTTRTVSSTLEASNSDGIVRKCTHCETTKTPQWREGPSGPKTLCNACGVRFRSGRLVPEYRPASSPTFIPAVHSNSHRKIIEMRRKDDEQFDSSMIRAVISRG

SEQ ID NO: 1721 - protein, 250 aa, Arabidopsis thaliana; identical to SEQ ID NO: 823
  misc_feature (1)..(250): Ceres CLONE ID no. 1334990
  misc_feature: Utility: Useful for making larger plants

SEQ ID NO: 1722 - protein, 308 aa, Arabidopsis thaliana
  misc_feature (1)..(308): Public GI no. 20466045
  misc_feature: Utility: Useful for making larger plants
MNWLPEAEAEEHLKGILSGDFFDGLTNHLDCPLEDIDSTNGEGDWVARFQDLEPPPLDMFPALPSDLTSCPKGAARVRIPNNMIPALKQSCSSEALSGINSTPHQSSAPPDIKVSYLFQSLTPVSVLENSYGSLSTQNSGSQRLAFPVKGMRSKRRRPTTVRLSYLFPFEPRKSTPGESVTEGYYSSEQHAKKKRKIHLITHTESSTLESSKSDGIVRICTHCETITTPQWRQGPSGPKTLCNACGVRFKSGRLVPEYRPASSPTFIPSVHSNSHRKIIEMRKKDDEFDTSMIRSDIQKVKQGRKKMV

SEQ ID NO: 1723 - protein, 389 aa, Triticum aestivum
  misc_feature (1)..(389): Ceres CLONE ID no. 938230
  misc_feature: Utility: Useful for making larger plants
MEATAPDYYARDKKGSDLFVVDDLLALPCDDEEEEEEGVGDAPFLPANAASAAAVVVKQEAGFGNASADSSTVTALDSCSNSFSGLADGDFSGGLCEPYDQLAELEWLSNYMGEGEESFATEDLHKLQLISGIPSGGFPSANGPPAPAATAATAQPGVFLPEGPVPAKARSKRSRVAPGNWSSRLLVLPPAPASPPSPASMAISPAESGVSAQAFHVKKPSKPAKKKEVPPQAQAQAQTQSVSAPTAPSGVTAAANEGRRCLHCETDKTPQWRTGPMGPKTLCNACGVRYKSGRLVPEYRPAASPTFVTSRHSNSHRKVLELRRQREMHHHHQPSQLQQHAVAGGVGRIMHMESHLLFDGPAAPPILGGGDDFLIHHRLGTADYRQQLI

SEQ ID NO: 1724 - protein, 386 aa, Triticum aestivum
  misc_feature (1)..(386): Public GI no. 52353703
  misc_feature: Utility: Useful for making larger plants
MEVAAADYAGGVRVKKEAGGCGGSGDMFLVDDLLDLPCDEEEEETGLCGAYGGGGAGLGAGVVGGGGDDRAAGNASADSSTVTAVDSCSNSFSGLADGDFSGGLCEPYEQLAELEWVSTYMGEETLPTEDLRKLQLISGIPAAPRAPPALAVSAVQLPAGGAGALPTEAPVPGKARSKRSRVAPCSWSSRLMVLPPPPASPPSPASAVISPSESGTAAPAFPAKKAAKSAKKKDGPSPAPAPNAAAQAAAEGRRCLHCETDKTPQWRTGPMGPKTLCNACGVRYKSGRLVPEYRPAASPTFVVSKHSNSHRKVVELRRQKEMQLLHHHQQPPPHVGAGGGGAAGGLLHVTSPLLFDGPTSSAPLFAGADEFLIHNRISPDYRRQAT

SEQ ID NO: 1725 - protein, 305 aa, Triticum aestivum
  misc_feature (1)..(305): Public GI no. 12711287
  misc_feature: Utility: Useful for making larger plants
MMTMVGHCGYLDGIPTGPVVDEDFDDILNFLDFPLESLEEDGQGVEWDASESKFLGPIPMDALMAFPPVPQGNIGNGRVKAEPNSNHPIKVTEGQGSGIFQTQSPVSVLESSNSCSGGKSISIKHDIAIPVRPRSKRPRSSALNPWILMPPISSTRFASKKTCDARKGKEKKRKMSLLSVPQIADVTKKKTTSGQQFSFKKCTHCQVTKTPQWREGPLGPKTLCNACGVRYRSGRLFPEYRPAASPTFVPTLHSNSHRKVVEMRKKAIYGETSALEEPHNVIVEGPPMSPAPEFVPMSSYLFDVY

SEQ ID NO: 1726 - protein, 295 aa, Zea mays
  misc_feature (1)..(295): Ceres CLONE ID no. 305252
  misc_feature: Utility: Useful for making larger plants
MAQLEWLSGLFDDASIPHEPAFPGAAPIIKSSALAAGALLPPDKMGDALLFRSSSPISVLEHGSFNNANGGGGGCSASSESSSASSSSESFSGSGSGEGHAWSAPVSPPPVLVIPARARSKRSRPSAFTRAGAEAPTILVPTPMYSSGPSHSDPESIAESSPHPAPPMKKKKKAKKPPAPPAPASSDDNDGDADYEEGGERTEPQGCAVRRCTHCQIEKTPQWRAGPLGPKTLCNACGVRYKSGRLFPEYRPAASPTFVPSIHSNSHKKVVEMRQKAVRSGDPSCDLLQFIRRRD

SEQ ID NO: 1727 - protein, 283 aa, Glycine max
  misc_feature (1)..(283): Ceres CLONE ID no. 473814
  misc_feature: Utility: Useful for making larger plants
MDMELLDLPLDFEDVETDAVEEQDWDAQLKLLEDPPPPLGVFPLQQSSAFCGQTRNENAKLGSKSFSASLAKTVRPAYGKTIPVQKVSLKGKDLLQFQTNSPVSVFESSSSSPSVENSNFELPVIPTKRPRTKRRRLSNISLLYSIPFILTSPAFQKFQRMDFSKSDIQTQPSGELLCKFKKKQRKKDIPLPTNKIEMKRSSSQESVAPRKCLHCEVTKTPQWREGPMGPKTLCNACGVRYRSGRLFAEYRPASSPTFVASLHSNSHKKVLEIRNRATQVTVR

SEQ ID NO: 1728 - DNA, 872 bp, Arabidopsis thaliana
  misc_feature (1)..(872): Ceres CLONE ID no. 23518
  misc_feature (1)..(872): Also known as  Ceres CDNA ID no. 23649747
atcgaacattaaaacctgattttactgaaactgtgctgcgaaggagaagccgcaaaccattttttgtcaatctagggttcttcttcgtacttgcagatttcgcctccgttttcactacgatctgtgaagatgttctccgctcagaacaagatcaataaggacaagaatgctgagccaacagaatgcgaggagcaagttgctcaggctttgtttgatttggagaacactaaccaggagttgaaaagcgagttgaaagatctctacatcaaccaagctgttcacatggatatctctggaaaccgcaaagctgttgtgatttacgttccattcagattgaggaaagctttccgcaagattcatccccgtctcgtcagagagcttgagaagaagttcagtggaaaggatgttatctttgttaccacaagaaggatcatgcgtccccccaagaagggtgctgctgttcagaggccacgtaacagaactcttacctcagttcatgaagctatgcttgaagatgttgctttccccgctgagattgttggaaagcgtactcgctaccgtcttgatggttccaagatcatgaaggtctttttggatgccaaggaaaagaacaacacagagtacaagctcgagactatggtcggtgtgtaccgtaaacttactggcaaagatgttgtttttgagtacccagtcgaagcttgaaagaagatgatgaagaaccatcaggatagtgaaagagagcttttgtttatgttttgtggtatttaggatgaaggaaactctcttgattcagttccttgttcacaatctttaatgttctatttacaatgactactttttgtgtttttcaattttgaaacctctatgatttc

SEQ ID NO: 1729 - protein, 190 aa, Arabidopsis thaliana
  misc_feature (4)..(189): Pfam Name: Ribosomal_S7e; Pfam Description: Ribosomal protein S7e
  misc_feature: Utility: Useful for making larger plants
  misc_feature: Utility: Useful for making plants with increased biomass and foliage
  misc_feature: Utility: Useful for making smaller plants
MFSAQNKINKDKNAEPTECEEQVAQALFDLENTNQELKSELKDLYINQAVHMDISGNRKAVVIYVPFRLRKAFRKIHPRLVRELEKKFSGKDVIFVTTRRIMRPPKKGAAVQRPRNRTLTSVHEAMLEDVAFPAEIVGKRTRYRLDGSKIMKVFLDAKEKNNTEYKLETMVGVYRKLTGKDVVFEYPVEA

SEQ ID NO: 1730 - protein, 190 aa, Brassica napus
  misc_feature (1)..(190): Ceres CLONE ID no. 1070069
  misc_feature: Utility: Useful for making larger plants
  misc_feature: Utility: Useful for making plants with increased biomass and foliage
  misc_feature: Utility: Useful for making smaller plants
  misc_feature (119)..(119): Xaa is any aa, unknown, or other
  misc_feature (163)..(163): Xaa is any aa, unknown, or other
MFSAQNKIKKDKNAEPTECDVQVAQALFDLENTNQELKSELKDLYINQAVNMDICGNRKAIVIYVPFRLRKAFRKIHPRLVRELEKKFSGKDVIFVATRRIMRPPKKGAAVQRPRNRTXTSVHEAMLEDVAYPAEIVGKRTRYRLDGSKVMKVYLEAKERNNXEYKLETMVGVYRKLTGKDVTFEYPVEA

SEQ ID NO: 1731 - protein, 191 aa, Arabidopsis thaliana
  misc_feature (1)..(191): Ceres CLONE ID no. 20681
  misc_feature: Utility: Useful for making larger plants
  misc_feature: Utility: Useful for making plants with increased biomass and foliage
  misc_feature: Utility: Useful for making smaller plants
MYSGQNKIHKDKGVAPTEFEEQVTQALFDLENTNQELKSELKDLYINQAVQMDISGNRKAVVIYVPFRLRKAFRKIHLRLVRELEKKFSGKDVIFVATRRIMRPPKKGSAVQRPRNRTLTSVHEAMLEDVAYPAEIVGKRTRYRLDGTKIMKVFLDSKLKNDTEYKLETMVGVYRKLTGKDVVFEYPVIEA

SEQ ID NO: 1732 - protein, 191 aa, Arabidopsis thaliana; identical to SEQ ID NO: 1731
  misc_feature (1)..(191): Public GI no. 6957719
  misc_feature: Utility: Useful for making larger plants
  misc_feature: Utility: Useful for making plants with increased biomass and foliage
  misc_feature: Utility: Useful for making smaller plants

SEQ ID NO: 1733 - protein, 191 aa, Arabidopsis thaliana
  misc_feature (1)..(191): Public GI no. 5532505
  misc_feature: Utility: Useful for making larger plants
  misc_feature: Utility: Useful for making plants with increased biomass and foliage
  misc_feature: Utility: Useful for making smaller plants
MFSAQNKIHKDKGVAPTEFEERVAQAFFDLENTNQELKSDLKDLYINQAVSMDIAGNRKAVVIYVPFRLRKAFRKIHSRLVRELEKKFSGNDVIFVATRRIMRPPKKGSAVQRPRNRTLTSVHEAMLEDVAYPAEIVGKRTRYRVDGTKIMKVYLEPKERNNTEYKLETMVGVYRKLTGKDVVFEYPVADP

SEQ ID NO: 1734 - protein, 191 aa, Glycine max
  misc_feature (1)..(191): Ceres CLONE ID no. 553599
  misc_feature: Utility: Useful for making larger plants
  misc_feature: Utility: Useful for making plants with increased biomass and foliage
  misc_feature: Utility: Useful for making smaller plants
  misc_feature (143)..(143): Xaa is any aa, unknown, or other
  misc_feature (171)..(171): Xaa is any aa, unknown, or other
MYTSRKKIHKDKDAEPTEFEETVAQYLFDLENTNQDLKSDLKDLYINQAIQMDVAGNRKAVVIYVPFRLRKAFRKIHLRLVRELEKKFSGKDVVFIATRRIVRPPKKGSAVQRPRTRTLTAVHDAMLEDVVYPAEIVGKRVRXRIDGSKIMKVFLDPKERNNTEYKLETFXGVYRKLTGKDVVFEYPISEA

SEQ ID NO: 1735 - protein, 191 aa, Glycine max
  misc_feature (1)..(191): Ceres CLONE ID no. 1113804
  misc_feature: Utility: Useful for making larger plants
  misc_feature: Utility: Useful for making plants with increased biomass and foliage
  misc_feature: Utility: Useful for making smaller plants
MYTSRKKIHKDKDAEPTEFEETVGQYLFDLENTNQDLKSDLKDLYINQAIQMDVAGNRKAVVIYVPFRLRKAFRKIHLRLVRELEKKFSGKDVVLIATRRIVRPPKKGSAVQRPRTRTLTAVHDAMLEDVVYPAEIVGKRARYRIDGSKIMKVFLDPKERNNTEYKLETFSGVYRKLTGKDVVFEYPISEA

SEQ ID NO: 1736 - protein, 191 aa, Glycine max
  misc_feature (1)..(191): Ceres CLONE ID no. 479777
  misc_feature: Utility: Useful for making larger plants
  misc_feature: Utility: Useful for making plants with increased biomass and foliage
  misc_feature: Utility: Useful for making smaller plants
MYTSRKKIHKDKDAEPTEFEESVGQALFDLENTNQELKSDLKDLYINSAVQVDVSGNRKAVVIHVPYRLRKGFRKIHVRLVRELEKKFSGKDVILVATRRILRPPKKGSAAQRPRSRTLTAVHEAMLEDVVLPAEIVGKRVRFRIDGSKIMKVYLDPKERNNTEYKLETFAAVYRKLSGKDVVFEYPVSEA

SEQ ID NO: 1737 - protein, 191 aa, Brassica napus
  misc_feature (1)..(191): Ceres CLONE ID no. 1066903
  misc_feature: Utility: Useful for making larger plants
  misc_feature: Utility: Useful for making plants with increased biomass and foliage
  misc_feature: Utility: Useful for making smaller plants
  misc_feature (99)..(99): Xaa is any aa, unknown, or other
  misc_feature (107)..(107): Xaa is any aa, unknown, or other
  misc_feature (109)..(109): Xaa is any aa, unknown, or other
  misc_feature (110)..(110): Xaa is any aa, unknown, or other
  misc_feature (113)..(113): Xaa is any aa, unknown, or other
  misc_feature (114)..(114): Xaa is any aa, unknown, or other
  misc_feature (119)..(119): Xaa is any aa, unknown, or other
  misc_feature (120)..(120): Xaa is any aa, unknown, or other
  misc_feature (125)..(125): Xaa is any aa, unknown, or other
  misc_feature (127)..(127): Xaa is any aa, unknown, or other
  misc_feature (128)..(128): Xaa is any aa, unknown, or other
  misc_feature (140)..(140): Xaa is any aa, unknown, or other
  misc_feature (141)..(141): Xaa is any aa, unknown, or other
  misc_feature (148)..(148): Xaa is any aa, unknown, or other
  misc_feature (163)..(163): Xaa is any aa, unknown, or other
  misc_feature (166)..(166): Xaa is any aa, unknown, or other
  misc_feature (184)..(184): Xaa is any aa, unknown, or other
  misc_feature (187)..(187): Xaa is any aa, unknown, or other
MFSAQNKIHKDKGVAPTDFEQEVAQAFFDLENTNQELKSDLKDLYINQAVQMDCSGNRKAIVIYVPFRLRKAFRKIHPRLVRELEKKFSGKDVIFVATXRIMRPPKXGXXVQXXRNRTXXSVHEXMXXDVAYPAEIVGKXXRYRVDGXKIMKVYLEPKERNNXEYXLETMVGVYRKLTGKDVVXEYXVADP

SEQ ID NO: 1738 - protein, 190 aa, Brassica napus
  misc_feature (1)..(190): Public GI no. 4128206
  misc_feature: Utility: Useful for making larger plants
  misc_feature: Utility: Useful for making plants with increased biomass and foliage
  misc_feature: Utility: Useful for making smaller plants
MYTALQKIHKDKDAEPTEFEENVAQALFDFENTNQEIKSDLKDLYINSALQIDVSGGKKAVVIHVPYRLRKSFRKIHPRLVRELEKKFSGKEVVLIATRRILRPPKKGSAVQRPRSRTLTAVHDAMLEDIVYPAEIVGKRVRYRLDGSKIMKVFLDPKAKNDTENKLETFAGVYRKLSGKDVVFEFPLTE

SEQ ID NO: 1739 - protein, 192 aa, Brassica napus
  misc_feature (1)..(192): Public GI no. 57471724
  misc_feature: Utility: Useful for making larger plants
  misc_feature: Utility: Useful for making plants with increased biomass and foliage
  misc_feature: Utility: Useful for making smaller plants
MYTARKKIQKDKGVEPSEFEDTVAQAFFDLENGNQELKSDLKDLYINTAIQMDVVGNRKAVVIHVPYRLRKPFRKIHVRLVRELEKKFSGKDVVFVATRRIVRPPKKGSAVQRPRTRTLTAVHDGILEDVVYPAEIVGKRVRYRLDGAKVIKIYLDPKERNNTEYKLETFSAVYRRLCGKDVVFEYPVTETA

SEQ ID NO: 1740 - protein, 192 aa, Zea mays
  misc_feature (1)..(192): Ceres CLONE ID no. 1283519
  misc_feature: Utility: Useful for making larger plants
  misc_feature: Utility: Useful for making plants with increased biomass and foliage
  misc_feature: Utility: Useful for making smaller plants
MYTARKKIQKEKGLEPSEFEDSVAQAFFDLENGNQELKSDLKDLYINNAIQMDVTGSRKAVVIHVPYRLRKAFRKIHVRLVRELEKKFSGKDVVIVATRRIVRPPKKGSAVLRPRTRTLTAVHDGILEDVVYPAEIVGKRVRYRLDGSKIIKIFLDPKERNNTEYKLETCTAVYRRLCGKDVVFEYPMTENA

SEQ ID NO: 1741 - protein, 192 aa, Zea mays
  misc_feature (1)..(192): Ceres CLONE ID no. 283165
  misc_feature: Utility: Useful for making larger plants
  misc_feature: Utility: Useful for making plants with increased biomass and foliage
  misc_feature: Utility: Useful for making smaller plants
MYTARKKIQKDKGLEPSEFEDSVAQAFFDLENGNQELKSDLKDLYINGAIQLDVAGSRKAVVIHVPYRLRKAFRKIHVRIVRELEKKFSGKDVVIVATRRIVRPPKKGSAVQRPRTRTLTAVHDGILEDVVFPAEIVGKRVRYRLDGAKIIKIFLDPKERNNTEYKLDTYTTVYRRLCGKDVVFEYPMAENA

SEQ ID NO: 1742 - protein, 192 aa, Zea mays
  misc_feature (1)..(192): Public GI no. 55167942
  misc_feature: Utility: Useful for making larger plants
  misc_feature: Utility: Useful for making plants with increased biomass and foliage
  misc_feature: Utility: Useful for making smaller plants
MYTARRKIQKDKGLEPTEFEDTVAQAFFDLENGNQELKSDLKDLYINGAVQMDLPGNRKAVIIYVPYRLRKAYKKIHVRLVRELEKKFSGKDVVLVATRRIVRPPKKGSAVVRPRTRTLTAVHDGILEDVVYPAEIVGKRVRYHLDGRKIMKIFLDPKERNNTEYKLDTFSSVYRRLCGKDVVFDYPMTETA

SEQ ID NO: 1743 - protein, 192 aa, Zea mays
  misc_feature (1)..(192): Ceres CLONE ID no. 259723
  misc_feature: Utility: Useful for making larger plants
  misc_feature: Utility: Useful for making plants with increased biomass and foliage
  misc_feature: Utility: Useful for making smaller plants
MYTARKKIQKDKGLEPSEFEDSVAQAFFDLENGNQELKSDLKDLYIIGAIQLDVAGSRKAVVIHVPYRLRKAFRKIHVRIVRELEKKFSGKDVVIVATRRIVRPPKKGSAVQRPRTRTLTAVHDGILEDVVFPAEIVGKRVRYRLDGAKIIKIFLDPKERNNTEYKLDTYTTVYRRLCGKDVVFEYPMAENA

SEQ ID NO: 1744 - protein, 192 aa, Zea mays
  misc_feature (1)..(192): Public GI no. 22671664
  misc_feature: Utility: Useful for making larger plants
  misc_feature: Utility: Useful for making plants with increased biomass and foliage
  misc_feature: Utility: Useful for making smaller plants
MYTARRKIQKDKGLEPTEFEDTVAQAFFDLENGNQELKSDLKDLYINGAVQMDLPGNRKAVIIHVPYRLRKAYKKIHVRLVRELEKKFSGKDVVLVATRRIVRPPKKGSAVVRPRTRTLTAVHDGILEDVVYPAEIVGKRVRYHLDGRKIMKIFLDPKERNNTEYKLDTFSSVYRRLCGKDVVFDYPMTETA

SEQ ID NO: 1745 - DNA, 1481 bp, Arabidopsis thaliana
  misc_feature (1)..(1481): Ceres CLONE ID no. 156655
  misc_feature (1)..(1481): Also known as  Ceres CDNA ID no. 23371009
gcgttacactacaactctctatctctctctcttcttttctgctcatttttgggtaattcttctggttttatgttcttgttcctattactgactcacaatcagccaacgcaaatctttctttgaccatttttaatagattctcttagtcacttgttggatttcaaatgcaaagttgacctcatcttcttcttcttcgaggttttatacaagttactccataaaccttcgagcttccagcaactttggcttctctgttgtgaattattgcttattatatcctcaacacgaaatcaaaatgccaagaccaagagtttcagagttgtctcagaggcaagctccaaggctgaggtcatcgtcatctacttctgattccaatcattccaaccgtctgatcactacggatcaaagttttaagcccggtgttgaccgtaaatctcctcgaagcggtggacctaacagtgatccgcttggtcagaagaaacttgggggacgaatatcggatctagagtcgcagttaggacaagcgcaagaggaactgagattgctcaaggagcagttggctaatgctgaagctgtgaagaaacaagctcaagatgagcttcataagaagtccaagaaaccaaacccgctggctcgagtggaggaatctgcaactgaggctgagaggattgatagagacgaaatccctggtgatgtgcagaaagagactgatgtgtttgaggttcccgttgaaaagattgcagtagaagaagaagaactgagaagcggcaatgacgaagctgagaaattggttgcaaaggaagatgagataaagatgctgaaagctagactctatgacatggagaaagagcatgaatcactaggcaaagaaaacgagagcttgaagaatcagttgagcgattcagcttcagagatttctaatgtgaaagctaatgaagatgagatggtttcaaaggtgagtaggattggggaagagttagaagaaagcagagcaaagacggctcacctgaaggagaagcttgagtccatggaagaagcaaaagatgctttagaggctgagatgaagaagctcagggttcaaaccgagcagtggaggaaggcagcggatgctgcagcagcagttctttctggagagtttgagatgaatggtcgggatcgatctgggtcaactgagaagtattatgcaggtgggttctttgacccgtcagctgggttcatggatccaccgggaatggctgatgattatgatgatggactgggaagtggcaagaggaagagttctgggatgaagatgtttggtgagttgtggaggaagaaagggcaaaagtgagttacagattgtgtggagtgtcattcaagaaatggtgtgctcaccgtttctctcttttattttgctgtatttacctggaagtttttgtaagtgggtccgcttcatcagaagctaactatcaatccaaatcaattgcaaaaacaatttcatg

SEQ ID NO: 1746 - protein, 344 aa, Arabidopsis thaliana
  misc_feature (14)..(102): Pfam Name: DUF827; Pfam Description: Plant protein of unknown function (DUF827)
  misc_feature (14)..(102): Pfam Name: DUF827; Pfam Description: Plant protein of unknown function (DUF827)
  misc_feature: Utility: Useful for making larger plants
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making stronger plants
  misc_feature: Utility: Useful for making taller plants and plants with longer inflorescences
MPRPRVSELSQRQAPRLRSSSSTSDSNHSNRLITTDQSFKPGVDRKSPRSGGPNSDPLGQKKLGGRISDLESQLGQAQEELRLLKEQLANAEAVKKQAQDELHKKSKKPNPLARVEESATEAERIDRDEIPGDVQKETDVFEVPVEKIAVEEEELRSGNDEAEKLVAKEDEIKMLKARLYDMEKEHESLGKENESLKNQLSDSASEISNVKANEDEMVSKVSRIGEELEESRAKTAHLKEKLESMEEAKDALEAEMKKLRVQTEQWRKAADAAAAVLSGEFEMNGRDRSGSTEKYYAGGFFDPSAGFMDPPGMADDYDDGLGSGKRKSSGMKMFGELWRKKGQK

SEQ ID NO: 1747 - protein, 326 aa, Arabidopsis thaliana
  misc_feature (1)..(326): Ceres CLONE ID no. 1342938
  misc_feature: Utility: Useful for making larger plants
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making stronger plants
  misc_feature: Utility: Useful for making taller plants and plants with longer inflorescences
MPKPRLGIRGSELPQRQSPRLRTSLLSTSSDPHHLSRPITDRSPKLGLDRRSPRSGGPHTDPLSQKKLGSRISGLESQLGQAQEELRLLKQQLAKAEAAKKRAQEELHRKKSKKPNTPAPERDDIPGDGHQETDVFEVLDEKAKESEKTKNDELASKEDQINVLKARLYDLEKERVSLSEENETLKDQLKKTDTEMSCAKAKEDEIASKVSQIGEELEESNETTAKLKKKLESVEEAKETLEAEMKKLKVQTEQWRKAADAAAAVLSGGVEMNGRFSEQCGSMEKHFAGRFVGSPGMADDSDDGSGKRKSSGKKMFGDLWKKKGQK

SEQ ID NO: 1748 - protein, 377 aa, Zea mays
  misc_feature (1)..(377): Ceres CLONE ID no. 302736
  misc_feature: Utility: Useful for making larger plants
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making stronger plants
  misc_feature: Utility: Useful for making taller plants and plants with longer inflorescences
  misc_feature (89)..(89): Xaa is any aa, unknown, or other
  misc_feature (295)..(295): Xaa is any aa, unknown, or other
  misc_feature (296)..(296): Xaa is any aa, unknown, or other
  misc_feature (297)..(297): Xaa is any aa, unknown, or other
  misc_feature (299)..(299): Xaa is any aa, unknown, or other
MPRSRGNEPPLRTSQRAPLHLKTTACSEANGAHHRPVADRSSPRVSPRSPLPEKKHAAGTRVAELEGKLGKVQEELKKLREQLASAEAXKKDAQVALEEAKKRVGTKGSPASTTTTTPLSPPSPGVEIAKKTEELKLPQPAAEEESSINVPATDVFEVVRAESGDKENQSAAEVCEVVSCGGGKAAVDVAENEETEEEETKKMIGEDNSAAVESDGADKESPEVVELKAKLAEKDTEIAALTAENAELKKQAEEAAEAAKKAEEGPASRAAKAEHELKEGAAREARVGEQLRASXXXRXALDGELRRLRVQTEQWRKAAEAAAAVLGGDNHLTGLAGNGWGSPATMPDDGDDEGFGGKRKGAGIRVLGDLWKRKGSK

SEQ ID NO: 1749 - protein, 410 aa, Zea mays
  misc_feature (1)..(410): Public GI no. 51451351
  misc_feature: Utility: Useful for making larger plants
  misc_feature: Utility: Useful for making ornamental plants with modified flowers
  misc_feature: Utility: Useful for making ornamental plants with modified leaves
  misc_feature: Utility: Useful for making plants sterile and for genetic confinement
  misc_feature: Utility: Useful for making stronger plants
  misc_feature: Utility: Useful for making taller plants and plants with longer inflorescences
MHVKFFGELNDRAVFEMPHRTSPRAPVRSKTTAAAPAAAGSEHHRDRVVVGAGGGAARGTVCMVACLQKKPAGGGAAVSRVAELEAKLGKAEGQLAEMREQLAAAEKARKDARAALVESKKRFSAAKKRVATAGAASSSAAAEQTPPQAVSDEKCGVISPAGDVPEAAEPGDAQGEETKEMADDDEVNSVTAAIVGDLEGNKGGQEVEQLRTKLMEKDMEVYELKAKLIAMDAEADDLRASLATKGMEIDELRAKLTSKDADIAAVEADNAELMKMAEEASHAVKETATKARDTEHALRESAAREAARVAERLRASERAREALEAELQRGRAQSEQWRKAAEEAAAVLAAVEHGAGAPAADVEWRRHSSGAAAGERVAKDTDEHHVSGGKRNSGGAMRMLSELWKKKAQK

SEQ ID NO: 1750 - DNA, 621 bp, Arabidopsis thaliana
  misc_feature (1)..(621): Ceres CLONE ID no. 2273
  misc_feature (1)..(621): Also known as  Ceres CDNA ID no. 23356705
actagttagttgaaatggaggctttcaagcttcggatccaacgcacgtaatctctctctctctctctcttctctcttttttctttctctcttctttctctctgtaaaacttgtctaatggcagagatctgctgcgtcaaagagatccaagaagaagacgtggagaagatccgattaccgacccgacccgaattagacattcctgtctctgatcacgaagatccaacggtcaacgaagaagaagggtgcaagactccaacatcgtccgatcacaagattccggaggtgaagtatacgttatgtccaccggctccgagaaaaccaaaaccgaatcgatcttccggtacgaaacggaaattaacgccggttaatgttcttaaccgcataccgattgatctgagccgtgagatcgagatgttcttcgaggatttggaccgtaggatcaagaagtcacggaaacaataagaagattattgccttaattggtaatgatcgttcatttctaattcatgactgtgtggtggtaatttgatcctttgaatttttcttcattttttttttcttttttttttcgttttctgtataattaattagctaataacaataagaaaatttatgtacc

SEQ ID NO: 1751 - protein, 115 aa, Arabidopsis thaliana
  misc_feature: Utility: Useful for making lethal plants for genetic confinement systems
  misc_feature: Utility: Useful for making plants with increased biomass and foliage
  misc_feature: Utility: Useful for making smaller plants
MAEICCVKEIQEEDVEKIRLPTRPELDIPVSDHEDPTVNEEEGCKTPTSSDHKIPEVKYTLCPPAPRKPKPNRSSGTKRKLTPVNVLNRIPIDLSREIEMFFEDLDRRIKKSRKQ

SEQ ID NO: 1752 - protein, 129 aa, Brassica napus
  misc_feature (1)..(129): Ceres CLONE ID no. 963126
  misc_feature: Utility: Useful for making lethal plants for genetic confinement systems
  misc_feature: Utility: Useful for making plants with increased biomass and foliage
  misc_feature: Utility: Useful for making smaller plants
MDDLELLQDLSQFNFPATIKIPSKTSKDNKDGDGDNDEGFSCSTPTSQEHKIPSVHDSPPPPPRKPRALPSKPSPTAALVIRSCKRKLLVSAPEIIMNKEEIDRFFSSVYSDTSTTAKRRRRYLYCARR

SEQ ID NO: 1753 - protein, 129 aa, Brassica napus
  misc_feature (1)..(129): Ceres CLONE ID no. 1118497
  misc_feature: Utility: Useful for making lethal plants for genetic confinement systems
  misc_feature: Utility: Useful for making plants with increased biomass and foliage
  misc_feature: Utility: Useful for making smaller plants
MDDLELLQDLSQFNFPATIKIPSKTSKDNKDGDGDNDEVFSCSTPTSQEHKIPSVHDSPPPPPRKPRALPSKPSPTAALMIRSCKRKLLVSTPEIIMNKEEIDRFFSSVYSDTSTTAKRRRRYLYCARR

SEQ ID NO: 1754 - DNA, 528 bp, Arabidopsis thaliana
  misc_feature (1)..(528): Ceres CLONE ID no. 4043
  misc_feature (1)..(528): Also known as  Ceres CDNA ID no. 23364928
aaataacaaaaaaatggagattaacaaatttctggccgtagtcgtagtcgtcgtggtcctctactccgtcgaagcgacggcacaaggaggaagccctcagttgacggcttgtctgcacaaactgctgccgtgtcagccgtacatacactcattgaatccgcctcctccgccatcgtgttgcgggccaatgaaagagatcgtagagaaagacgcaccgtgtttatgcaccgcttttaacaatccggaggtgctcaaagccctaaacctcaccaaagagaacgctctcctacttcccaatgcatgtggagttaatcctgacgtttcactctgctccaaaatagccactccttcgcctattgcgtcgccgggatcaaccaatggaacttcttcagcttcaactatcagcttcaatcgatttagctttctgtctgcttttgtggcaatgatcttcttctgattatgtcattttttaatttataattatatgtgtgatgactgtgtaattcggtcatcagaatgtgtttaagt

SEQ ID NO: 1755 - protein, 147 aa, Arabidopsis thaliana
  misc_feature (33)..(106): Pfam Name: Tryp_alpha_amyl; Pfam Description: Protease inhibitor/seed storage/LTP family
  misc_feature (33)..(106): Pfam Name: Tryp_alpha_amyl; Pfam Description: Protease inhibitor/seed storage/LTP family
  misc_feature: Utility: Useful for making lethal plants for genetic confinement systems
  misc_feature: Utility: Useful for making ornamental plants with modified leaves
  misc_feature: Utility: Useful for making plants with altered leaf shape eg curled leaves
  misc_feature: Utility: Useful for making plants with increased biomass and foliage
  misc_feature: Utility: Useful for making smaller plants
MEINKFLAVVVVVVVLYSVEATAQGGSPQLTACLHKLLPCQPYIHSLNPPPPPSCCGPMKEIVEKDAPCLCTAFNNPEVLKALNLTKENALLLPNACGVNPDVSLCSKIATPSPIASPGSTNGTSSASTISFNRFSFLSAFVAMIFF

SEQ ID NO: 1756 - DNA, 527 bp, Arabidopsis thaliana
  misc_feature (1)..(527): Ceres CLONE ID no. 5198
  misc_feature (1)..(527): Also known as  Ceres CDNA ID no. 23388071
atatacaaaaacaaaacgtttagttgttggaaatggcagcgaaactccgcatttcctcttcttcgtttagccacagaactaatgattccaaaacctcatcatcttcttcatattcatcattgcttgctttgcctcaattcctctgtccaccatctccattaggattcccacagttcaagcttcacgccaaattaggtggacgagatggagaagtgaagcctaaagataagaagaagttcattaccaaagaggaagaaccagaacagtattggcaaagcgttggagaaagagaaggagagaatccgatgaagacgcctcttccttacattatcatcttcggtatgtcaacgccattcgtcatcttagccattgcttttgccaatggttggatcaaagttcccattcgttgatagcctttcttttttgcttctgctacacttgtgtaaggctgaatcttaaacatgttttcttatactcttcttcttcggctgtaaaaatagcaaaattaatagaatggatcatatgtt

SEQ ID NO: 1757 - protein, 125 aa, Arabidopsis thaliana
  misc_feature: Utility: Useful for making lethal plants for genetic confinement systems
  misc_feature: Utility: Useful for making ornamental plants with modified leaves
  misc_feature: Utility: Useful for making plants with increased biomass and foliage
  misc_feature: Utility: Useful for making smaller plants
MAAKLRISSSSFSHRTNDSKTSSSSSYSSLLALPQFLCPPSPLGFPQFKLHAKLGGRDGEVKPKDKKKFITKEEEPEQYWQSVGEREGENPMKTPLPYIIIFGMSTPFVILAIAFANGWIKVPIR

SEQ ID NO: 1758 - protein, 124 aa, Brassica napus
  misc_feature (1)..(124): Ceres CLONE ID no. 954882
  misc_feature: Utility: Useful for making lethal plants for genetic confinement systems
  misc_feature: Utility: Useful for making ornamental plants with modified leaves
  misc_feature: Utility: Useful for making plants with increased biomass and foliage
  misc_feature: Utility: Useful for making smaller plants
  misc_feature (27)..(27): Xaa is any aa, unknown, or other
  misc_feature (28)..(28): Xaa is any aa, unknown, or other
MAAKLHISSSFSHKANDSPTSSSSSYXXFLALPQFLCTPFSSGFAQFKLHAKLGGGDGEVKPKEKKKFITKEEEPEQYWQSAGEREGENPMKTPLPYIIIFGMSTPFVILAIAFANGWIKVPIR

SEQ ID NO: 1759 - protein, 118 aa, Brassica napus
  misc_feature (1)..(118): Public GI no. 34896996
  misc_feature: Utility: Useful for making lethal plants for genetic confinement systems
  misc_feature: Utility: Useful for making ornamental plants with modified leaves
  misc_feature: Utility: Useful for making plants with increased biomass and foliage
  misc_feature: Utility: Useful for making smaller plants
MAKVALSSLLAVGGAAAFAVQPSKKTGSGLFRNRVITVRRPRISANLGGDGEVKPAGNKKKFITREEEPEQYWQAAGERKGENPMKTPLPYIIIFGMSTPFVILAIAFANGWIKVPVR

SEQ ID NO: 1760 - protein, 119 aa, Zea mays
  misc_feature (1)..(119): Ceres CLONE ID no. 370168
  misc_feature: Utility: Useful for making lethal plants for genetic confinement systems
  misc_feature: Utility: Useful for making ornamental plants with modified leaves
  misc_feature: Utility: Useful for making plants with increased biomass and foliage
  misc_feature: Utility: Useful for making smaller plants
MAKAAPPLLAAGSRTAITAQQPSSRKGAAGTGLFCSRAIVSKRTRVTAKLGDGELKPAGKRKFITKEEEPEQYWQTAGEREGENPMMTPLPYIIIFGMSTPFVILAIAFANGWIKVPVR

SEQ ID NO: 1761 - protein, 119 aa, Zea mays
  misc_feature (1)..(119): Ceres CLONE ID no. 1577130
  misc_feature: Utility: Useful for making lethal plants for genetic confinement systems
  misc_feature: Utility: Useful for making ornamental plants with modified leaves
  misc_feature: Utility: Useful for making plants with increased biomass and foliage
  misc_feature: Utility: Useful for making smaller plants
MAKAAPPLLAAGSRTAITAQQPSSRKGAAGAGLFCSRVIVSKRARVTAKLGDGELKPAGKRKFITKEEEPEQYWQTAGEREGENPMMTPLPYIIIFGMSTPFVILAIAFANGWIKVPVR

SEQ ID NO: 1762 - protein, 115 aa, Glycine max
  misc_feature (1)..(115): Ceres CLONE ID no. 562212
  misc_feature: Utility: Useful for making lethal plants for genetic confinement systems
  misc_feature: Utility: Useful for making ornamental plants with modified leaves
  misc_feature: Utility: Useful for making plants with increased biomass and foliage
  misc_feature: Utility: Useful for making smaller plants
MAAKLTLSSPFSFKTSFLPKSPSFSLGLYSPRTNVTGVKVHAKLGGGDEQAKKGGKKKFITREEEPQQYWQTAGEREGENPMKTPLPYIIIFGMSTPFVILAIAFANGWIKVPVR

SEQ ID NO: 1763 - protein, 115 aa, Glycine max
  misc_feature (1)..(115): Ceres CLONE ID no. 1046446
  misc_feature: Utility: Useful for making lethal plants for genetic confinement systems
  misc_feature: Utility: Useful for making ornamental plants with modified leaves
  misc_feature: Utility: Useful for making plants with increased biomass and foliage
  misc_feature: Utility: Useful for making smaller plants
  misc_feature (99)..(99): Xaa is any aa, unknown, or other
MAAKLTLSSPLSFKTSFLPKSPSFSPGLCSPRTNVTGVKVHAKLGGGDEQAKNGGKKKFITREEEPQQYWQTAGEREGENPMKTPLPYIIIFGMSTPFXILAIAFANGWIKVPVR

SEQ ID NO: 1764 - protein, 134 aa, Zea mays
  misc_feature (1)..(134): Ceres CLONE ID no. 1520658
  misc_feature: Utility: Useful for making lethal plants for genetic confinement systems
  misc_feature: Utility: Useful for making ornamental plants with modified leaves
  misc_feature: Utility: Useful for making plants with increased biomass and foliage
  misc_feature: Utility: Useful for making smaller plants
  misc_feature (72)..(72): Xaa is any aa, unknown, or other
  misc_feature (73)..(73): Xaa is any aa, unknown, or other
  misc_feature (74)..(74): Xaa is any aa, unknown, or other
  misc_feature (75)..(75): Xaa is any aa, unknown, or other
  misc_feature (76)..(76): Xaa is any aa, unknown, or other
  misc_feature (77)..(77): Xaa is any aa, unknown, or other
  misc_feature (81)..(81): Xaa is any aa, unknown, or other
  misc_feature (82)..(82): Xaa is any aa, unknown, or other
  misc_feature (83)..(83): Xaa is any aa, unknown, or other
  misc_feature (99)..(99): Xaa is any aa, unknown, or other
MAKAAPPLLAAGSRTAITAQQPSSRKGAAGTGLFCSRAIVSKRTRVTAKLGDGELKPAGKRKFITKEEEPDXXXXXXRGEXXXGKNPMMTPLPYIIIFXHVHPLRHPRHRLRQWLDQGPCAMTVTRSASLNHRC

SEQ ID NO: 1765 - DNA, 1201 bp, Arabidopsis thaliana
  misc_feature (1)..(1201): Ceres CLONE ID no. 13767
  misc_feature (1)..(1201): Also known as  Ceres CDNA ID no. 23356776
actgaatatttcagtaaataatctcttcttagatctctccggcaatggcaattccgttgcctcttacctcttgctccccaatctcaacttcttcgtctatttcccgaacctccttcgtccctcttacacttcgcaatcgtactttcttctccaaccagaattacagtaggcgtgtacttatcagctgctcttcttctttgtcctcagacaatggttcatctccagactccatgaacggaaacgggaacgggaacgggagtagcttaaacgggcaatcatctttcccacgactgccttcctttgatggaacatccaaaccaccgcttaaatggagaagggttttactcaaagtcagtggagaagctcttgctggagacgaggagcaaaatatcgacccaaaggttactatggcgattgcaagggaagttgcagcagtgactcgacttggcattgaggttgctatagttgttggaggaggaaatatctttcgtggatctacctgggctgggtgcagtggccttgatcgctcctctgctgattatatcgggatgctggcaactgtgatgaatgcaatatttcttcaagcgacaatggagagtattggcatcccaacccgtgttcaaactgctttccgcatgtcggaagtcgcagagccttacataagaagacgagcaatcagacatctagaaaaaggaagggttgtaatatttgcagctggaacaggcaatccatttttcaccaccgatactgcagcggctcttcgatgtgctgaaattaatgcagaagtagtgctgaaagcaacaaatgttgatggcgtgttcgacgatgatcctaaaagaaacccaaacgctcgtctgcttgactcactaacttaccaagagatcacctcaaaggacctctctgtaatggatatgactgctatcactttgtgccaagaaaataacatcccagttgttgtattcaatctttcggaacctgggaacatcgccaaagcaatcaaaggagagagagttggtacattgataggaggaacttggaactccattgttacaacaacctcatgaagaagcctattctcaaaacacaaaacttattagagtatcttaggtcaggagaatcttgtaactcctgtatatattagtttgcagacaagttttacattctaggaatctgtctgaaatttttgaaagttaatcttttt

SEQ ID NO: 1766 - protein, 339 aa, Arabidopsis thaliana
  misc_feature (97)..(307): Pfam Name: AA_kinase; Pfam Description: Amino acid kinase family
  misc_feature (97)..(307): Pfam Name: AA_kinase; Pfam Description: Amino acid kinase family
  misc_feature: Utility: Useful for making lethal plants for genetic confinement systems
  misc_feature: Utility: Useful for making plants sterile and for genetic confinement
  misc_feature: Utility: Useful for making smaller plants
MAIPLPLTSCSPISTSSSISRTSFVPLTLRNRTFFSNQNYSRRVLISCSSSLSSDNGSSPDSMNGNGNGNGSSLNGQSSFPRLPSFDGTSKPPLKWRRVLLKVSGEALAGDEEQNIDPKVTMAIAREVAAVTRLGIEVAIVVGGGNIFRGSTWAGCSGLDRSSADYIGMLATVMNAIFLQATMESIGIPTRVQTAFRMSEVAEPYIRRRAIRHLEKGRVVIFAAGTGNPFFTTDTAAALRCAEINAEVVLKATNVDGVFDDDPKRNPNARLLDSLTYQEITSKDLSVMDMTAITLCQENNIPVVVFNLSEPGNIAKAIKGERVGTLIGGTWNSIVTTTS

SEQ ID NO: 1767 - protein, 351 aa, Arabidopsis thaliana
  misc_feature (1)..(351): Public GI no. 57900163
  misc_feature: Utility: Useful for making lethal plants for genetic confinement systems
  misc_feature: Utility: Useful for making plants sterile and for genetic confinement
  misc_feature: Utility: Useful for making smaller plants
MAAAAAAAVACGMSTSFLIRLSPSPPASSHVPLPRSPASSARPRRASSVSLSTAPRPRARAAGSDSPSNFGGQTSLMPPFSLMLDEGSRSKKPYRWQRVLLKVSGEALAGDHTENIDPKITMAIAREVASVTRLGVEVAIVVGGGNIFRGASWAGCSGLDRSSADYIGMLATVMNAIFLQATMESIGIPTRVQTAFRMSEVAEPYIRRRAVRHLEKGRVVIFAAGTGNPFFTTDTAAALRCAEINAEVVLKATNVDGVYDADPKRNPNARLLEAVSYHEVQTRDLSVMDMTAITLCQENNIPVVVFNLQKPGNIAKAIVGEKVGTFIGCTKDQDQIVGNALDQERRLVNEL

SEQ ID NO: 1768 - protein, 342 aa, Zea mays
  misc_feature (1)..(342): Ceres CLONE ID no. 289382
  misc_feature: Utility: Useful for making lethal plants for genetic confinement systems
  misc_feature: Utility: Useful for making plants sterile and for genetic confinement
  misc_feature: Utility: Useful for making smaller plants
MAASAAAAGPATFLPRLPSPRSPSPMLPPLGRRAHPVAAPLCLSAKRRACAAMGSSSSSNSGNQTSLMLPFSFTFDEDSSSSRRLYRWKRVLLKVSGEALAGNHTENIDPKITMAIAREVASVTKLGVEVAIVVGGGNIFRGASWAGCSGLDRSSADYIGMLATVMNAIFLQATMESIGIPTRVQTAFRMSEVAEPYIRRRAVRHLEKGRVVIFAAGTGNPFFTTDTAAALRCAEINAEVVLKATNVDGVYDADPRQNPNARLLETVSYHEVTTRDLSVMDMTAITLCQENNIPIVVFNLQEPGNIAKAIVGEKVGTFIGCTRDQELNGNTLVQERRLVNEA

SEQ ID NO: 1769 - protein, 331 aa, Glycine max
  misc_feature (1)..(331): Ceres CLONE ID no. 1168763
  misc_feature: Utility: Useful for making lethal plants for genetic confinement systems
  misc_feature: Utility: Useful for making plants sterile and for genetic confinement
  misc_feature: Utility: Useful for making smaller plants
MALYTHLISFSSSSFLHSPSPLCLPKPLFPSFTLTVGNSTSHTTSLAVRSSYSEMGSSPEPINFRKPGIPSMSHLRLSMNESSKPSFKWRRVLLKVSGEALAGDHSQNIDPKITMAIAREVAAVTRLGIEVALVVGGGNIFRGSSWAGSSGLDRSSADYIGMLATVMNAIFLQATMESIGIPTRVQTAFRMSEVAEPYIRRRAVRHLEKGRVVIFAAGTGNPFFTTDTAAALRCAEINAEVVLKATNVDGVFDEDPKRNPQARLHETLTYQEVTSKDLSVMDMTAITLCQENNIPVVVFNLNKPGNIEKAIKGERVGTLIGATWNSTVSRT

SEQ ID NO: 1770 - protein, 342 aa, Zea mays
  misc_feature (1)..(342): Ceres CLONE ID no. 243668
  misc_feature: Utility: Useful for making lethal plants for genetic confinement systems
  misc_feature: Utility: Useful for making plants sterile and for genetic confinement
  misc_feature: Utility: Useful for making smaller plants
MAASAAAAGPATFLPRLPSPRSPSPMLPPLGRRAHPVAAPLCLSAKRRACAAMGSSSSSNSGNQTSLMLPFSFTFDEDSSSSRRLYRWKRVLLKVSGEALAGNHTENIDPKITMAIAREVASVTKLGVEVAIVVGGGNIFRGASWAGCSGLDRSSADYIGMLATVMNAIFLQATMESIGIPTRVQTAFRMSEVAEPYIRRRAVRHLEKGRVVIFAAGTGNPFFTTDTAAALRCAEINAEVVLKATNVDGVYDADPRQNPNARLLETVSYHEVTTRDLSVMDMTAITLFQENNIPIVVFNLQEPGNIAKAIVGEKVGTFIGCTRDQELNGNTLVQERRLVNEA

SEQ ID NO: 1771 - protein, 352 aa, Triticum aestivum
  misc_feature (1)..(352): Ceres CLONE ID no. 579504
  misc_feature: Utility: Useful for making lethal plants for genetic confinement systems
  misc_feature: Utility: Useful for making plants sterile and for genetic confinement
  misc_feature: Utility: Useful for making smaller plants
MAAAAGVSPSSLLRLRLPSPHPAASLPSPSPALLRRRPLLSVAAAPQRASVAAAADSSNGNGSYSGNGSQALLMPPFSGLMLDESSRSKRPYKWQRVLLKVSGEALAGDHTENIDPKVTMAIAREVASVTKLGVEVAIVVGGGNIFRGASWAGCSGLDRSSADYIGMMATVMNAIFLQATMESIGIPTRVQTAFRISEVAEPYIRRRAIRHLEKGRVVIFAAGTGNPFFTTDTAAALRCAEINAEVVLKATNVDGVYDANPKHNPNARILETVSYNEVISRDLSVMDMTAVTLCQENNIPVVVFNLQNTGNIAKAIVGEKVGTFIGCTRNLEYRESTEGSLDQEDKILVSEW

SEQ ID NO: 1772 - protein, 312 aa, Glycine max
  misc_feature (1)..(312): Ceres CLONE ID no. 467253
  misc_feature: Utility: Useful for making lethal plants for genetic confinement systems
  misc_feature: Utility: Useful for making plants sterile and for genetic confinement
  misc_feature: Utility: Useful for making smaller plants
MSSGCISTSHWPWFKQLEQIVGNSLPAKFSDEDKAVISAGTSPRQSKRYGVATPSTGGPANSMKSKALSNSRWRRVVLKISGAALTGSDTCNIDPKVAMLVSREVAIASRLGVEVAIVVGGRNFFSGEAWVNVTGLERCTAYQVGMMATVMNSILLQSTLEKMGVQTRVQTSVAMQEFAEPYNRQRAIRHLEKGRVVIFGGIGFGAGTPLFSTDIAAALRASELNAEAVLKGTNVDGVYDCNSRDNNFTFEHISFRELGSRGVTSMDMSALTFCEENAIPVVVFNLLEPGNISKALCGEQVGTLIDQTGAIS

SEQ ID NO: 1773 - DNA, 913 bp, Arabidopsis thaliana
  misc_feature (1)..(913): Ceres CLONE ID no. 29150
  misc_feature (1)..(913): Also known as  Ceres CDNA ID no. 23480869
aaacaagtaaaccacaacaatggcgttgttctccccgccaatctcttcttcatctcttcaaaatcccaatttcatcccgaaattctcattctctctcctctccagtaaccgcttctctctcctctccgtcactcgagcttcctccgacagtggatcaacctctcccaccgccgccgtctccgtagaggctcctgagcccgtggaagtgatagttaaagagcctccccaatcaacaccagctgttaaaaaggaagaaaccgccaccgctaaaaatgttgccgtcgaaggtgaagagatgaaaacaacggagagtgttatcaaattccaagatgcgaggtggattaatggaacttgggatctgaaacaattcgagaaagatggaaaaaccgattgggattctgtaatcgttgctgaggcaaagagaagaaaatggctagaagagaatccagaaacaacgagtaacgacgagccagtgcttttcgatacatcgattattccatggtgggcttggattaagagataccacttacctgaagctgaactcttaaatggtcgtgcggcgatgataggattctttatggcttactttgtcgatagtcttactggagtaggacttgttgatcaaatggggaatttcttctgcaagacactattgtttgtggctgtggccggagttttgtttattcgtaagaatgaggatgtggataaactcaagaatttgtttgatgagactacattgtatgataagcaatggcaagcagcttggaaaaatgatgatgatgagtcattgggttctaagaagaagtgataacaaagattcttgctttctttttttgttgttgttgtaattaggagatgaacttaccaaatgtaatatcaagagatttgaacaatgtttcctcagattatcgtt

SEQ ID NO: 1774 - protein, 262 aa, Arabidopsis thaliana
  misc_feature: Utility: Useful for making lethal plants for genetic confinement systems
MALFSPPISSSSLQNPNFIPKFSFSLLSSNRFSLLSVTRASSDSGSTSPTAAVSVEAPEPVEVIVKEPPQSTPAVKKEETATAKNVAVEGEEMKTTESVIKFQDARWINGTWDLKQFEKDGKTDWDSVIVAEAKRRKWLEENPETTSNDEPVLFDTSIIPWWAWIKRYHLPEAELLNGRAAMIGFFMAYFVDSLTGVGLVDQMGNFFCKTLLFVAVAGVLFIRKNEDVDKLKNLFDETTLYDKQWQAAWKNDDDESLGSKKK

SEQ ID NO: 1775 - protein, 276 aa, Arabidopsis thaliana
  misc_feature (1)..(276): Ceres CLONE ID no. 36801
  misc_feature: Utility: Useful for making lethal plants for genetic confinement systems
MSISMALFSPPISSSLQNPNLIPKISTSLLSTKRFSLISVPRASSDNGTTSPVVKIPKPASVAVEEVPVKSPAESSSASENGAVGGEATDSSTETVIKYQNAKWVNGTWDLKQFEKDGKTDWDSVIVSEAKRRKWLEDNPETTSNDELVVFDTSIIPWWAWMKRYHLPEAELLNGRAAMIGFFMAYFVDSLTGVGLVDQMGNFFCKTLLFVAVAGVLFIRKNEDLDKLKDLFDETTLYDKQWQAAWKEPDSSDSFFKEVNKFLQSFIFLFLLCNNL

SEQ ID NO: 1776 - protein, 262 aa, Glycine max
  misc_feature (1)..(262): Ceres CLONE ID no. 470787
  misc_feature: Utility: Useful for making lethal plants for genetic confinement systems
MQSMSTTMASFSPPTHFSATPSSSKPRLVYKNNFFFSLRSRSLSLSPLKAAASENGVGTAVEPPPEQAVPVPEPSLPPVDNSSVGTNGSAVAVESEVVKVQSSFVDPRWVAGTWDLKQFQKNGTTDWDAVIDAEARRRKWLEDNPESSSNENPVVFDTSIVPWWAWMKRFHLPEAELLNGRAAMIGFFMAYFVDSLTGVGLVDQMSNFFCKTLLFVAVLGVLLIRKNEDLENLKKLFDETTLYDKQWQATWQDENSSTSKNE

SEQ ID NO: 1777 - DNA, 1190 bp, Arabidopsis thaliana
  misc_feature (1)..(1190): Ceres CLONE ID no. 34480
  misc_feature (1)..(1190): Also known as  Ceres CDNA ID no. 23384551
ctctttagcaaaaaatctcagaactcaaaaaaaaaacatccaacaccaaagacaatggagatgagtttgcgtctcgcttcatcttcaacctcaaacccaatttgtctactaaaccctggaaaaaaccttaatttcccaatccgaaaccatagaatccctaaaacttcgaaacccttttgcgttaggtcttcaatgagcttgtctaaaccacccagacaaaccttatctagtaactgggatgtatctagcttctccattgattccgttgctcaatctccttcaagactcccaagtttcgaagaactcgataccaccaacatgttgctccgtcaaagaatcgtctttttgggttctcaggttgatgatatgacggcggatttggttataagtcagctattgttactagatgctgaggactcagaaagagacattacgctttttatcaattcacccggtggatctattactgctgggatgggaatatatgatgcaatgaaacaatgtaaggcggatgtatctactgtttgcttagggttagctgcatctatgggtgcgtttcttcttgcttctggttcaaaagggaaacggtattgtatgcctaactctaaagttatgatccatcagccacttggtactgctggaggcaaagcaacggaaatgagcatacgtataagagaaatgatgtaccacaagattaaacttmacaaaatcttctctagaatcactgggaagcctgaatcagagatcgaaagtgacacagaccgtgataacttcttgaatccatgggaggcgaaagaatatggtttgatcgacgctgtaatcgatgatgggaaaccgggactaatcgctccaattggagatggtactcctcctcctaaaaccaaagtctgggatctttggaaagtcgaaggaaccaagaaagacaacactaacttgccatctgagcgctccatgacacagaatggttatgccgccattgaatagaactgttgttgcagcgtttacgccttttatatgttattctggtggtacctgtaaccatataacgttgcatttcctgtgtttgtaccatttctctgatagatttttggaataatttgaaggcaaaagatagattatttgttgtagaagaagctacaaaatttaatgattaaattgaatcatcaagccatgagaagctttgtgttttc

SEQ ID NO: 1778 - protein, 309 aa, Arabidopsis thaliana
  misc_feature (80)..(259): Pfam Name: CLP_protease; Pfam Description: Clp protease
  misc_feature (80)..(259): Pfam Name: CLP_protease; Pfam Description: Clp protease
  misc_feature: Utility: Useful for making lethal plants for genetic confinement systems
  misc_feature: Utility: Useful for making smaller plants
MEMSLRLASSSTSNPICLLNPGKNLNFPIRNHRIPKTSKPFCVRSSMSLSKPPRQTLSSNWDVSSFSIDSVAQSPSRLPSFEELDTTNMLLRQRIVFLGSQVDDMTADLVISQLLLLDAEDSERDITLFINSPGGSITAGMGIYDAMKQCKADVSTVCLGLAASMGAFLLASGSKGKRYCMPNSKVMIHQPLGTAGGKATEMSIRIREMMYHKIKLNKIFSRITGKPESEIESDTDRDNFLNPWEAKEYGLIDAVIDDGKPGLIAPIGDGTPPPKTKVWDLWKVEGTKKDNTNLPSERSMTQNGYAAIE

SEQ ID NO: 1779 - protein, 279 aa, Arabidopsis thaliana
  misc_feature (1)..(279): Public GI no. 17028170
  misc_feature: Utility: Useful for making lethal plants for genetic confinement systems
  misc_feature: Utility: Useful for making smaller plants
IPKRAKPFCVRSSMNMSGPRPRPRQTLSSNWDLSNFSVDSVAQSPSRLPSFEELDTTNMLLRQRIVFLGSQVDDMTADLVISQLLLLDAQDSERDITLFINSPGGSITAGMGIYDAMKQCKADVSTVCLGIAASMGAFLLASGSKGKRYCMPNSKVMIHQPLGSAGGKATEMSIRVREMMYHKIKLNKIFSRITGKPESEIEGDTDRDYFLNPWEAKEYGLVDAVIDDGKPGLVAPIGDGTPPPNTKVWDFWKVEGTKNDNKDLPTEQSRVQNGYATPE

SEQ ID NO: 1780 - protein, 313 aa, Arabidopsis thaliana
  misc_feature (1)..(313): Public GI no. 15864561
  misc_feature: Utility: Useful for making lethal plants for genetic confinement systems
  misc_feature: Utility: Useful for making smaller plants
MEMSLNLVSSSSSNHVFLFNPILSGKQLSFPSRHQRIPKRAKPFCVRSSMNLSGPRPRQTLSSDWDVSKFSVDSVAQSPSRLPSFEELDTTNMLLRQRIVFLGSQVDDMTADLVISQLLLLDAQDSERDITLFINSPGGSITAGMGIYDAMKQCKADVSTVCLGLAASMGAFLLASGSKGKRYCMPNSKVMIHQPLGSAGGKATEMSIRVREMMYHKIKLNKIFSRITGKPESEIEGDTDRDYFLNPWEAKEYGLVDAVIDDGKPGLVAPIGDGTPPPNTKVWDFWKVEGTKNDNKDLPTEQSRVQNGYATPE

SEQ ID NO: 1781 - protein, 311 aa, Brassica napus
  misc_feature (1)..(311): Ceres CLONE ID no. 1110310
  misc_feature: Utility: Useful for making lethal plants for genetic confinement systems
  misc_feature: Utility: Useful for making smaller plants
MSLNLVSSSSSNHVFLFNPILSGKQLSFPSRHQRIPKRAKPFCVRSSMNLSGPRPRQTLSSDWDVSKFSVDSVAQSPSRLPSFEELDTTNMLLRQRIVFLGSQVDDMTADLVISQLLLLDAQDSERDITLFINSPGGSITAGMGIYDAMKQCKADVSTVCLGLAASMGAFLLASGSKGKRYCMPNSKVMIHQPLGSAGGKATEMSIRVREMMYHKIKLNKIFSRITGKPESEIEGDTDRDYFLNPWEAKEYGLVDAVIDDGKPGLVAPIGDGTPPPNTKVWDFWKVEGTKNDNKDLPTEQSRVQNGYATPE

SEQ ID NO: 1782 - protein, 313 aa, Brassica napus
  misc_feature (1)..(313): Public GI no. 7657879
  misc_feature: Utility: Useful for making lethal plants for genetic confinement systems
  misc_feature: Utility: Useful for making smaller plants
  misc_feature (292)..(292): Xaa is any aa, unknown, or other
MEMSLNLVSSSSSNHVFLFNPILSGKQLSFPSRHQRIPKRAKPFCVRSSMNLSGPRPRQTLSSDWDVSKFSVDSVAQSPSRLPSFEELDTTNMLLRQRIVFLGSQVDDMTADLVISQLLLLDAQDSERDITLFINSPGGSITAGMGIYDAMKQCKADVSTVCLGLAASMGAFLLASGSKGKRYCMPNSKVMIHQPLGSAGGKATEMSIRVREMMYHKIKLNKIFSRITGKPESEIEGDTDRDYFLNPWEAKEYGLVDAVIDDGKPGLVAPIGDGTPPPNTKVWDFWKVEGTXNDNKDLPTEQSRVQNGYATPE

SEQ ID NO: 1783 - protein, 311 aa, Brassica napus
  misc_feature (1)..(311): Public GI no. 6069464
  misc_feature: Utility: Useful for making lethal plants for genetic confinement systems
  misc_feature: Utility: Useful for making smaller plants
MSLNLVSSSSSNRVFLFNPILSGKQVSLPSRHQRIPKRAKPFCVRSSMNLSGSRPRQTLSSNWDVSKFSVDSVAQSPSRLPSFEELDTTNMLLRQRIVFLGSQVDDMTADLVISQLLLLDAQDSERDITLFINSPGGSITAGMGIYDAMKQCKADVSTVCLGLAASMGAFLLASGSKGKRYCMPNSKVMIHQPLGSAGGKATEMSIRVREMMYHKIKLNKIFSRITGKPESEIEGDTDRDYFLNPWEAKEYGLVDAVIDDGKPGLVAPIGDGTPPPNTKVWDFWKVEGTKNDNKDLPTEQSRVQNGYATPE

SEQ ID NO: 1784 - protein, 308 aa, Brassica napus
  misc_feature (1)..(308): Public GI no. 56201842
  misc_feature: Utility: Useful for making lethal plants for genetic confinement systems
  misc_feature: Utility: Useful for making smaller plants
MAALPASPCSSSSSPSSLFLAPNPCCWKAAPRATVRASASAARRTLSSAWELPGPSAARPAARKPRLEELDTTNMLLRQRIVFLGSPVDDMSADLIISQLLLLDAEDKTKDIKLFINSPGGSITAGMGVYDAMKFCKADISTVCFGLAASMGAFLLAAGTKGKRFCMPNARIMIHQPSGGAGGKVTEMGLQIREMMYEKIKINKILSRITGKPEEQIDEDTKFDYFMSPWEAKDYGIVDSVIDEGKPGLVAPLAGAVPPPKSRVWYLWNASGPTRKIMKNLPSEEKLIQNGNGSASGDDGKFKEISTA

SEQ ID NO: 1785 - DNA, 1389 bp, Arabidopsis thaliana
  misc_feature (1)..(1389): Ceres CLONE ID no. 38625
  misc_feature (1)..(1389): Also known as  Ceres CDNA ID no. 23372163
aaaaaaatcccaaaaagcttcgttcttttttagtcatcatcatcttcttcttttcttcttcttcggttgctaaatcggagatggcgactgctctggtttctcctcttacttcacaactcaaccatgaagctgtctgttccaagtttgtgttacccaaatcgccgkkcatatcgggatctaagctcttttcatcgaacatgccttgctctactgttcctagacgcacaagaagatcacactgctttgcttctgctaaagatatgagctttgaccatatccctaaacaatttcgtggagacaatctcaaagacggagtgatgcagaacttcaagaacgtaccgcaatatttttacgggcttaattcagctcaaatggatatgttcatgacagaagatagccctgtccgtaggcaagcggaaaaagttacagaggaaagcatctcgtctagaaataactatttgaacaatggaggaatatggagtatatccggtatgaatgcagcagatgctagaagatatagcatgagtgtccagatgtacagaggtggaggtggcggcggaggatctgaaagaccaagaactgctcctccagatttgccttctttgctattggatgctcgcatatgctaccttggcatgccaatcgtacctgcagttactgagttactcgttgctcaatttatgtggttagactatgataacccaacaaagcccatctacctatatataaattcacccgggacccagaatgagaagatggaaactgttggatcagaaacagaggcttatgccatagccgatactatttcttattgcaaatcagatgtatacactatcaattgtggcatggcttttggtcaagcagcaatgcttctttctctcgggaaaaaaggttatcgtgccgtacaaccacattcatcaacadaattatatctgccaaaagtaaacagwtcgagtggagctgccatagacatgtggataaaggccaaggaacttgatgcaaataccgagtactacatcgagctgttagctaagggaacagggaaatccaaagagcagatcaacgaggacatcaagcgacctaaatatctccaagctcaagcagccattgactatggaattgcagacaagatagctgactcgcaggacagttctttcgagaaacgggattacgatgggacccttgcccagagagctatgagacctggaggaggcagtccagcagctccagccggactaagatgatcaattcccaccagaaagaaagaggttgaatcctaatttcctagtcactctggaatatgtagctcttacaatctataagcaaacacatgtggtagtaacatacaaaaaagtgttggcaaaaagggaaataacatcaaaagttatc

SEQ ID NO: 1786 - protein, 387 aa, Arabidopsis thaliana
  misc_feature (293)..(355): Pfam Name: CLP_protease; Pfam Description: Clp protease
  misc_feature: Utility: Useful for making lethal plants for genetic confinement systems
MATALVSPLTSQLNHEAVCSKFVLPKSPFISGSKLFSSNMPCSTVPRRTRRSHCFASAKDMSFDHIPKQFRGDNLKDGVMQNFKNVPQYFYGLNSAQMDMFMTEDSPVRRQAEKVTEESISSRNNYLNNGGIWSISGMNAADARRYSMSVQMYRGGGGGGGSERPRTAPPDLPSLLLDARICYLGMPIVPAVTELLVAQFMWLDYDNPTKPIYLYINSPGTQNEKMETVGSETEAYAIADTISYCKSDVYTINCGMAFGQAAMLLSLGKKGYRAVQPHSSTKLYLPKVNRSSGAAIDMWIKAKELDANTEYYIELLAKGTGKSKEQINEDIKRPKYLQAQAAIDYGIADKIADSQDSSFEKRDYDGTLAQRAMRPGGGSPAAPAGLR

SEQ ID NO: 1787 - protein, 372 aa, Glycine max
  misc_feature (1)..(372): Ceres CLONE ID no. 576522
  misc_feature: Utility: Useful for making lethal plants for genetic confinement systems
MSSFLSLSLSAPSLHDSSFLHGTKLFPFSRRVAPRRFNSSSAKCSLDHIPKQFRKENLKDGLMENYKNAPQSLYGLSPSQMDMFMTEDNPIRQQSERVTEESISSAKNYMDNGGMWSLSGMGKSDASKYSMSVSMYRGGRGTGRPKTAPPDLPSLLLDARICYLGMPIVPAVTELIVAQFMWLDYDNPSKPIYLYINSSGTLNEKNETVGSETEAYSIADMMSYVKADVYTVNCGMAFGQAAMLLSLGTKGYRAVQPNSSTKLYLPKVNRSSGAVIDMWIKAKELEANTEYYIELLAKGTGKSKEEIAKDVQRPKYLQAQDAIDYGIADKIIDSSSRDVAFEKRNYDEMLAQSRAMRRQGGGNPQAAPSGFR

SEQ ID NO: 1788 - protein, 386 aa, Glycine max
  misc_feature (1)..(386): Public GI no. 50932981
  misc_feature: Utility: Useful for making lethal plants for genetic confinement systems
MALALRCPAAASPSPAKSTFPPSSSPPPSRLPRRPPASCRCYYYGDGGGFRKNYDHIPKQFREENLKDGLMDNYKNVPQFLYGLSPAQIEMFMNDDNPYDRQSQRVTEESISASRSYDEFGMYNLSGMHEGPAGYSMGMGMGTMSMGRAGRGYRRMRSSAPDLPSLLLDSRIIFLGMPIVPAVTELIAAQFLWLDYDDRTKPIYLYINSTGTMDENNELVASETDAFAIADFINRSKSKVYTINLSMAYGQAAMLLSLGVKGKRGVLPNSITKLYLPKVHKSGGAAIDMWIKAKELDTNTDYYLELLSKGVGKPKEELAEFLKGPRYFRAQEAIDYGLADTILHSLDGSFKPKDLTAQLAKAQEMRQSGKRPAAGAGRWSTPSVPR

SEQ ID NO: 1789 - protein, 388 aa, Zea mays
  misc_feature (1)..(388): Ceres CLONE ID no. 381453
  misc_feature: Utility: Useful for making lethal plants for genetic confinement systems
MALALRCPPAATSSRSPFLPSTSPAPAGKVPRRPPASWRCLAYYGDGGFRKNYDHIPKQFREENLKDGLMDNYKHVPQFLYGLSAAQMEMFMNDDNPYNRQSQKVTEESVSAARSYDEFGMYTLSGMHEGPASYSMGMGMGGSMSMSMGRGGRGYRRMRSSAPDLPSLLLDSRIIFLGMPIVPAVTELIAAQFLWLDYDDRTKPIYLYINSTGTMDENNELVASETDAYAIADFINRSKSKVYTINLSMAYGQAAMLLSLGVKGKRGVLPNSITKLHLPKVHKSGGAAIDMWIKAKELDTNTDYYLELLSKGVGKPKEELAEFLRGPRYFRAQEALDYGLADTILHSLDGSFKPKDLTAQLAKAQAMRQSGKRAAAGAGRWSTPTAPR

SEQ ID NO: 1790 - protein, 385 aa, Triticum aestivum
  misc_feature (1)..(385): Ceres CLONE ID no. 764831
  misc_feature: Utility: Useful for making lethal plants for genetic confinement systems
MALALRCPAAASPSRAPFPNSSSHSQSAARPARRPAGGCRCQYYHGDAPPRSYDHIPKQFREENLKDGLMDNYKNVPQFLYGLSPSQMEMFTTDDNPYNRQSKKVTEESVAALRSYDEFGMYSLSGTHEGPANYSMGMGMPSMSMGRAGKGYRRMRSSAPDLPSLLLDSRIIFLGMPIVPAVTELIAAQFLWLDYDDRTKPIYLYINSTGTMDENNELVASETDAYAIADFINRSKAKVYTINLSMAYGQAAMLLSLGMKGKRGVLPNSITKLHLPKVHKSGGAAIDMWIKAKELETNTDYYLELVSQGVGKPKEELAEFLRGPRYFRAQEAIDYGLADTILHSLDGSFKPKDLTAQLAKAQEMRQSGKRAPAGAGRWSTPTAPR

SEQ ID NO: 1791 - DNA, 1304 bp, Arabidopsis thaliana
  misc_feature (1)..(1304): Ceres CLONE ID no. 39351
  misc_feature (1)..(1304): Also known as  Ceres CDNA ID no. 23655617
atctcctctgctaccttaagctgagagagtcacagtctcgtctctatctctcctctttgcctttttccactcactacacgccaaacccgacgacatggcagctacctctctcactgcccctccttctttctccggtctccgccgcatttctcccaagctcgacgctgccgccgtctcctcccaccaatccttcttccaccgcgtcaattcctctacccgtctcgtttcttcctcttcttcttctcatcgctctcccagaggtgttgttgccatggctggatccggaaagtttttcgttggaggaaactggaagtgtaacgggactaaggactccatcgccaagcttatctccgatctcaacagtgcaaccttggaagcagatgtagatgttgttgtgtcacctccatttgtctacatcgaccaggtcaaatcctcgttgacagaccgtattgacatatcaggtcagaactcttgggttgggaaaggtggagccttcactggtgaaatcagcgtggaacagctcaaagaccttggctgcaagtgggtcattcttgggcattccgaacggagacatgtcatcggagaaaaagatgagtttatcgggaagaaagctgcatatgcattgagtgagggtcttggagtgatagcttgtattggggaaaagctagaagagagggaagcaggcaagacgtttgatgtttgcttcgcgcaactgaaggcgtttgctgatgctgtgcctagctgggacaatatagttgttgcatacgagcctgtatgggcaattggaactggtaaagttgcatctcctcagcaagcacaagaagtccatgtagctgtccgcggttggctaaagaagaatgtctctgaggaagttgcttccaaaacgagaatcatatatggaggttctgtcaatggaggcaacagtgcagagcttgccaaagaagaagacattgatggatttcttgttggtggtgcctccttgaagggtcctgagtttgcaaccattgtgaactcagtcacgtcgaagaaagttgctgcttgattgagaactatcagtaacggaaatcgctagtctccatggaacagatgagatgagaaataaaagggaggttagcgaccttgttgttgttgttgtgttcttacatcttcttcttgaactaataatggaaaacagaaagaaaaaaaatgattcgtgagctctggtttgacagagagagataaaagggtctttgattaaagatctttgtaactaagctgtgattctttttttcaatttgagtaagcttgactcacgagtttcttct

SEQ ID NO: 1792 - protein, 315 aa, Arabidopsis thaliana
  misc_feature (66)..(305): Pfam Name: TIM; Pfam Description: Triosephosphate isomerase
  misc_feature (66)..(305): Pfam Name: TIM; Pfam Description: Triosephosphate isomerase
  misc_feature: Utility: Useful for making lethal plants for genetic confinement systems
  misc_feature: Utility: Useful for making plants sterile and for genetic confinement
  misc_feature: Utility: Useful for making plants with increased biomass and foliage
MAATSLTAPPSFSGLRRISPKLDAAAVSSHQSFFHRVNSSTRLVSSSSSSHRSPRGVVAMAGSGKFFVGGNWKCNGTKDSIAKLISDLNSATLEADVDVVVSPPFVYIDQVKSSLTDRIDISGQNSWVGKGGAFTGEISVEQLKDLGCKWVILGHSERRHVIGEKDEFIGKKAAYALSEGLGVIACIGEKLEEREAGKTFDVCFAQLKAFADAVPSWDNIVVAYEPVWAIGTGKVASPQQAQEVHVAVRGWLKKNVSEEVASKTRIIYGGSVNGGNSAELAKEEDIDGFLVGGASLKGPEFATIVNSVTSKKVAA

SEQ ID NO: 1793 - protein, 256 aa, Glycine max
  misc_feature (1)..(256): Ceres CLONE ID no. 1016565
  misc_feature: Utility: Useful for making lethal plants for genetic confinement systems
  misc_feature: Utility: Useful for making plants sterile and for genetic confinement
  misc_feature: Utility: Useful for making plants with increased biomass and foliage
MAGSGKFFVGGNWKCNGTKESISKLVSDLNAATLESDVDVVVAPPFIYIDQVKSSLTGRIEVSAQNTWIGKGGAFTGEISAEQLVDIGCQWVILGHSERRHVIGEDDEFIGKKAAYALSQNLKVMACIGELLEEREAGKTFDVCFKQMKAFADNITDWTNVVIAYEPVWAIGTGKVASPEQAQEVHAAVRDWLKTNVSADVASTVRIIYGGSVNAANCAELAKKEDIDGFLVGGASLKGPDFATICNSVTSKKVTA

SEQ ID NO: 1794 - protein, 304 aa, Zea mays
  misc_feature (1)..(304): Ceres CLONE ID no. 687466
  misc_feature: Utility: Useful for making lethal plants for genetic confinement systems
  misc_feature: Utility: Useful for making plants sterile and for genetic confinement
  misc_feature: Utility: Useful for making plants with increased biomass and foliage
  misc_feature (146)..(146): Xaa is any aa, unknown, or other
MAAAPSSLVSSHLSRLADLRRAAAPATPTVPQQLRVGCSRRRAQRVVAMAGSGKFFVGGNWKCNGTKDSVSKLVSELNAATLETDVDVVVAPPFIYIDQVKNSLTGRIEVSAQNVWIGKGGAYTGEISAEQLVDIGCQWVILGHSXRRHIIGENDEFIGKKAAYALSQNVKVIACIGELLEEREAGKTFEVCFEQMKAFADSISNWADVVIAYEPVWAIGTGKVATPEQAQEVHAAVRDWLTTNISPDVASSTRIIYGGSVNAANCAELSKKEDIDGFLVGGASLKAPDFATIINSVTAKKVAA

SEQ ID NO: 1795 - protein, 298 aa, Zea mays
  misc_feature (1)..(298): Ceres CLONE ID no. 343468
  misc_feature: Utility: Useful for making lethal plants for genetic confinement systems
  misc_feature: Utility: Useful for making plants sterile and for genetic confinement
  misc_feature: Utility: Useful for making plants with increased biomass and foliage
MAAAPSSLASSHLSPIAAVSTPAVPHQLRIGCSRRRAGRIVAMAGSGKFFVGGNWKCNGTKDSISKLVSELNAATLETDVDVVVAPPFIYIDQVKNSLTGRIEVSAQNVWIGKGGAYTGEISAEQLVDIGCQWVILGHSERRHIIGENDEFIGKKAAYALSHCVGVIACIGELLEEREAGKTFEVCFEQMKAFADSISNWADVVIAYEPVWAIGTGKVATPEQAQEVHAAVRDWLTTNISPDVASSTRIIYGGSVNAANCAELAKKEDIDGFLVGGASLKAPDFATIINSVTAKKVAA

SEQ ID NO: 1796 - protein, 253 aa, Zea mays
  misc_feature (1)..(253): Ceres CLONE ID no. 985017
  misc_feature: Utility: Useful for making lethal plants for genetic confinement systems
  misc_feature: Utility: Useful for making plants sterile and for genetic confinement
  misc_feature: Utility: Useful for making plants with increased biomass and foliage
MGRKFFVGGNWKCNGTTDQVEKIVKTLNEGQVPPSDVVEVVVSPPYVFLPVVKSQLRQEFHVAAQNCWVKKGGAFTGEVSAEMLVNLGVPWVILGHSERRALLGESNEFVGDKVAYALSQGLKVIACVGETLEQREAGSTMEVVAAQTKAIAEKIKDWSNVVVAYEPVWAIGTGKVATPAQAQEVHASLRDWLKTNVSPEVAESTRIIYGGSVTAANCKELAAQPDVDGFLVGGASLKPEFIDIINAATVKSA

SEQ ID NO: 1797 - protein, 250 aa, Zea mays
  misc_feature (1)..(250): Ceres CLONE ID no. 213850
  misc_feature: Utility: Useful for making lethal plants for genetic confinement systems
  misc_feature: Utility: Useful for making plants sterile and for genetic confinement
  misc_feature: Utility: Useful for making plants with increased biomass and foliage
MGRKFFVGGNWKCNGTADQVEKIVKTLNEGNVPSSDVVEVVVSPPYVFLPVVKSQLRQEFQVAAQNCWVKKGGAFTGEISAEMLVNLGVPWVILGHSERRALLGESNEFVGDKVAFALSQGLKVIACVGETLEEREAGSTMDVVAAQTKAIAEKIKDWSNVVLAYEPVWAIGTGKVATPAQAQEVHASLRDWVKINVSPEVSESTRIIYGGSVTAANCKELAAQPDVDGFLVGGASLKPEFIDIINAAAV

SEQ ID NO: 1798 - protein, 253 aa, Glycine max
  misc_feature (1)..(253): Ceres CLONE ID no. 463478
  misc_feature: Utility: Useful for making lethal plants for genetic confinement systems
  misc_feature: Utility: Useful for making plants sterile and for genetic confinement
  misc_feature: Utility: Useful for making plants with increased biomass and foliage
MGRKFFVGGNWKCNGTTEEVKKIVTTLNEAKVPGEDVVEVVVSPPFVFLPFVKSLLRPDFHVSAQNCWVRKGGAYTGEVSAEMLVNLGIPWVIIGHSERRQLLNESNEFVGDKVAYALQQGLKVIACIGETLEQREAGTTTAVVAEQTKAIAAKISNWDNVVLAYEPVWAIGTGKVATPAQAQEVHADLRKWVHDNVSAEVAASVRIIYGGSVNGGNCKELAAQPDVDGFLVGGASLKAEFVDIINAATVKKN

SEQ ID NO: 1799 - protein, 253 aa, Glycine max
  misc_feature (1)..(253): Ceres CLONE ID no. 1058593
  misc_feature: Utility: Useful for making lethal plants for genetic confinement systems
  misc_feature: Utility: Useful for making plants sterile and for genetic confinement
  misc_feature: Utility: Useful for making plants with increased biomass and foliage
  misc_feature (137)..(137): Xaa is any aa, unknown, or other
  misc_feature (140)..(140): Xaa is any aa, unknown, or other
  misc_feature (145)..(145): Xaa is any aa, unknown, or other
  misc_feature (148)..(148): Xaa is any aa, unknown, or other
  misc_feature (180)..(180): Xaa is any aa, unknown, or other
MGRKFFVGGNWKCNGTVEQVESIVNTLNAGQIASTDVVEVVVSPPYVFLPTVKGKLRPEIQVAAQNCWVKKGGAFTGEVSAEMLVNLGVPWVILGHSERRSLMGESSEFVGEKVAYALAQGLKVIACVGETLEQREXGSXMAVVXEQXKAIAGKIKDWTNVVVAYEPVWAIGTGKVATPXQAQEVHANLRDWLKTNVSPEVAESTRIIYGGSVTGASCKELAGQPDVDGFLVGGASLKPEFIDIINAATVKSA

SEQ ID NO: 1800 - DNA, 1119 bp, Arabidopsis thaliana
  misc_feature (1)..(1119): Ceres CLONE ID no. 153053
  misc_feature (1)..(1119): Also known as  Ceres CDNA ID no. 23370821
aactctgcaaaagaaaaaaaaactcagagcagaggagatcgagagagacaaagagagacaaagagagagagagagagagagagagagagagagagagagagatcttcaacaagcaatgtctatatccatggcgttattctctccgccgatctcttcctcacttcaaaaccctaatctcatccccaagatctcaacctctcttctctccaccaaacgtttctctctaatctccgtccctagagcttcctccgacaatggtacgacttcccccgtcgtgaaaattccgaagcctgcgtctgtagctgtagaggaagttccggttaaatctccggcggaaagctcctccgcttctgaaaacggcgccgttggaggtgaagcgactgattcgagtactgagacggtaatcaaatatcaaaatgcgaagtgggttaatggaacttgggatctgaaacagttcgagaaagatggcaaaactgattgggattctgttatcgtttctgaggcaaagaggagaaaatggcttgaagataacccggaaacaacgagtaacgacgagcttgttgtcttcgatacttcgattattccatggtgggcatggatgaagagataccatctacctgaagctgaacttctcaatggtcgtgctgcgatgatagggttcttcatggcttactttgttgatagtcttaccggagtaggacttgttgatcaaatggggaatttcttctgcaaaacactcttgtttgtggctgtagctggagttctcttcatccgtaagaatgaagatttagacaaacttaaggatctgttcgatgagactacgttatatgacaaacaatggcaagctgcatggaaagagccagattcatcaacagtttcttcaaagaagtgaacaagttcttacaatctttcattttcctttttttgttatgcaataatctgtgaatcagtgaaagtttatctctactgaactactgatcttcagattttgtaatctttctgctttaaaaatctctatgaagtagtctcaaagataatgtatcgaaggtctttgacttgtaaagcagacctatttcgttttgacgcttgataatttaatcaataagagatttttttttt

SEQ ID NO: 1801 - protein, 258 aa, Arabidopsis thaliana
  misc_feature: Utility: Useful for making lethal plants for genetic confinement systems
MSISMALFSPPISSSLQNPNLIPKISTSLLSTKRFSLISVPRASSDNGTTSPVVKIPKPASVAVEEVPVKSPAESSSASENGAVGGEATDSSTETVIKYQNAKWVNGTWDLKQFEKDGKTDWDSVIVSEAKRRKWLEDNPETTSNDELVVFDTSIIPWWAWMKRYHLPEAELLNGRAAMIGFFMAYFVDSLTGVGLVDQMGNFFCKTLLFVAVAGVLFIRKNEDLDKLKDLFDETTLYDKQWQAAWKEPDSSTVSSKK

SEQ ID NO: 1802 - protein, 170 aa, Arabidopsis thaliana
  misc_feature (1)..(170): Ceres CLONE ID no. 29150
  misc_feature: Utility: Useful for making lethal plants for genetic confinement systems
MKTTESVIKFQDARWINGTWDLKQFEKDGKTDWDSVIVAEAKRRKWLEENPETTSNDEPVLFDTSIIPWWAWIKRYHLPEAELLNGRAAMIGFFMAYFVDSLTGVGLVDQMGNFFCKTLLFVAVAGVLFIRKNEDVDKLKNLFDETTLYDKQWQAAWKNDDDESLGSKKK

SEQ ID NO: 1803 - protein, 170 aa, Arabidopsis thaliana; identical to SEQ ID NO: 1802
  misc_feature (1)..(170): Ceres CLONE ID no. 1334525
  misc_feature: Utility: Useful for making lethal plants for genetic confinement systems

SEQ ID NO: 1804 - protein, 262 aa, Glycine max; identical to SEQ ID NO: 1776
  misc_feature (1)..(262): Ceres CLONE ID no. 470787
  misc_feature: Utility: Useful for making lethal plants for genetic confinement systems

SEQ ID NO: 1805 - DNA, 1131 bp, Arabidopsis thaliana
  misc_feature (1)..(1131): Ceres CLONE ID no. 159318
  misc_feature (1)..(1131): Also known as  Ceres CDNA ID no. 23370821
acacattcaaactaactctgcaaaagaaaaaaaaactcagagcagaggagatcgagagagacaaagagagacaaagagagagagagagagagagagagagagagagagagagagatcttcaacaagcaatgtctatatccatggcgttattctctccgccgatctcttcctcacttcaaaaccctaatctcatccccaagatctcaacctctcttctctccaccaaacgtttctctctaatctccgtccctagagcttcctccgacaatggtacgacttcccccgtcgtgaaaattccgaagcctgcgtctgtagctgtagaggaagttccggttaaatctccggcggaaagctcctccgcttctgaaaacggcgccgttggaggtgaagcgactgattcgagtactgagacggtaatcaaatatcaaaatgcgaagtgggttaatggaacttgggatctgaaacagttcgagaaagatggcaaaactgattgggattctgttatcgtttctgaggcaaagaggagaaaatggcttgaagataacccggaaacaacgagtaacgacgagcttgttgtcttcgatacttcgattattccatggtgggcatggatgaagagataccatctacctgaagctgaacttctcaatggtcgtgctgcgatgatagggttcttcatggcttactttgttgatagtcttaccggagtaggacttgttgatcaaatggggaatttcttctgcaaaacactcttgtttgtggctgtagctggagttctcttcatccgtaagaatgaagatttagacaaacttaaggatctgttcgatgagactacgttatatgacaaacaatggcaagctgcatggaaagagccagattcatcaacagtttcttcaaagaagtgaacaagttcttacaatctttcattttcctttttttgttatgcaataatctgtgaatcagtgaaagtttatctctactgaactactgatcttcagattttgtaatctttctgctttaaaaatctctatgaagtagtctcaaagataatgtatcgaaggtctttgacttgtaaagcagacctatttcgttttgacgcttgataatttaatcaataagagattttttttt

SEQ ID NO: 1806 - protein, 258 aa, Arabidopsis thaliana; identical to SEQ ID NO: 1801
  misc_feature: Utility: Useful for making lethal plants for genetic confinement systems
  misc_feature: Utility: Useful for making smaller plants

SEQ ID NO: 1807 - protein, 101 aa, Brassica napus
  misc_feature (1)..(101): Ceres CLONE ID no. 872284
  misc_feature: Utility: Useful for making lethal plants for genetic confinement systems
  misc_feature: Utility: Useful for making smaller plants
MKRYHLPEAELLNGRAAMIGFFMAYFVDSLTGVGLVDQMGNFFCKTLLFVAVAGVLFIRKNEDLDKLKGLIEETTLYDKQWQAAWKEPESSSSSSTVSSKK

SEQ ID NO: 1808 - protein, 170 aa, Arabidopsis thaliana; identical to SEQ ID NO: 1802
  misc_feature (1)..(170): Ceres CLONE ID no. 29150
  misc_feature: Utility: Useful for making lethal plants for genetic confinement systems
  misc_feature: Utility: Useful for making smaller plants

SEQ ID NO: 1809 - protein, 170 aa, Arabidopsis thaliana; identical to SEQ ID NO: 1802
  misc_feature (1)..(170): Ceres CLONE ID no. 1334525
  misc_feature: Utility: Useful for making lethal plants for genetic confinement systems
  misc_feature: Utility: Useful for making smaller plants

SEQ ID NO: 1810 - protein, 262 aa, Glycine max; identical to SEQ ID NO: 1776
  misc_feature (1)..(262): Ceres CLONE ID no. 470787
  misc_feature: Utility: Useful for making lethal plants for genetic confinement systems
  misc_feature: Utility: Useful for making smaller plants

SEQ ID NO: 1811 - DNA, 1024 bp, Zea mays
  misc_feature (1)..(1024): Ceres CLONE ID no. 241379
  misc_feature (1)..(1024): Also known as  Ceres CDNA ID no. 23764183
ataaattcctccgctccccttcgccgcttcctgtcgcgccgccgctcccctcccaacccactagctcaaaaccctagagctctcgcctgctcgcctccgccgccggagcgagctccccatcttcatccgtcaaccatggcgacccagatcagcaagaagaagaagttcgtcagcgacggtgttttctacgccgagctcaatgagatgctgacgcgggagctggcggaggacggctactctggcgtggaggtgcgcgtcacgccgatgcgcacggagatcatcatccgcgccacgcgcacgcagaacgtgctcggcgagaagggccgtaggatcagggagctcacctccgtcgtccagaagaggttcaacttccctgagaatggcgttgagctttatgccgagaaggtcgtcaaccgtgggctctgtgccatcgcgcaggccgagtccctccgttacaagctcctcggtggccttgccgtccgcagggcttgctacggtgttcttcgttatgttatggagagtggtgccaagggttgtgaggtgatcgtgagtggaaagctcagggcccaaagagccaagtccatgaagttcaaggatggctacatgatctcatctggtcaaccagtgaacgagtacattgactcggctgtgagacacgttcttctcagacagggtgttcttggcatcaaggtgaagatcatgcttgactgggacccgaagggcaaggttggcccgatcactcctcttccggacctggtgaccatccacaccccgaaggacgaggacgagccgcgccctccggtcttggcacctcctgaggtgtaaggtcccaactgtgtccttgaaatggcagtttgatcgggtcctagataggtttctatcttacgataaggacaatgctaaggcagttggttaccttaatctttatggacagatgctatgtgttgcttctgtggcacttttgtttaagctaagttttgcggagacaagatacttatatatgttcccgatgaaattatggttc

SEQ ID NO: 1812 - protein, 229 aa, Zea mays
  misc_feature (45)..(102): Pfam Name: KH_2; Pfam Description: KH domain
  misc_feature (104)..(188): Pfam Name: Ribosomal_S3_C; Pfam Description: Ribosomal protein S3, C- terminal domain
  misc_feature: Utility: Useful for making lethal plants for genetic confinement systems
  misc_feature: Utility: Useful for making ornamental plants with modified flowers
  misc_feature: Utility: Useful for making ornamental plants with modified leaves
  misc_feature: Utility: Useful for making plants with altered leaf shape eg curled leaves
  misc_feature: Utility: Useful for making plants with increased biomass
  misc_feature: Utility: Useful for making plants with increased biomass and foliage
  misc_feature: Utility: Useful for making plants with modified flowers
  misc_feature: Utility: Useful for making smaller plants
  misc_feature: Utility: Useful for modifying plant architecture, ie amount of  branching
MATQISKKKKFVSDGVFYAELNEMLTRELAEDGYSGVEVRVTPMRTEIIIRATRTQNVLGEKGRRIRELTSVVQKRFNFPENGVELYAEKVVNRGLCAIAQAESLRYKLLGGLAVRRACYGVLRYVMESGAKGCEVIVSGKLRAQRAKSMKFKDGYMISSGQPVNEYIDSAVRHVLLRQGVLGIKVKIMLDWDPKGKVGPITPLPDLVTIHTPKDEDEPRPPVLAPPEV

SEQ ID NO: 1813 - protein, 227 aa, Triticum aestivum
  misc_feature (1)..(227): Ceres CLONE ID no. 1032471
  misc_feature: Utility: Useful for making lethal plants for genetic confinement systems
  misc_feature: Utility: Useful for making ornamental plants with modified flowers
  misc_feature: Utility: Useful for making ornamental plants with modified leaves
  misc_feature: Utility: Useful for making plants with altered leaf shape eg curled leaves
  misc_feature: Utility: Useful for making plants with increased biomass
  misc_feature: Utility: Useful for making plants with increased biomass and foliage
  misc_feature: Utility: Useful for making plants with modified flowers
  misc_feature: Utility: Useful for making smaller plants
  misc_feature: Utility: Useful for modifying plant architecture, ie amount of  branching
MATQISKKKKFVSDGVFYAELNEMLTRELAEDGYSGVEVRVTPMRTEIIIRATRTQNVLGEKGRRIRELTSVVQKRFNFLENGVELYAEKVVNRGLCAIAQAESLRYKLLGGLAVRRACYGVLRFVMESGAKGCEVIVSGKLRAQRAKSMKFKDGYMISSGQPVNEYIDAAVRHVLLRQGVLGIKVKIMLDWDPKGKLGPTTPLPDLVTIHPPKEENELRPPALVEV

SEQ ID NO: 1814 - protein, 232 aa, Glycine max
  misc_feature (1)..(232): Ceres CLONE ID no. 467335
  misc_feature: Utility: Useful for making lethal plants for genetic confinement systems
  misc_feature: Utility: Useful for making ornamental plants with modified flowers
  misc_feature: Utility: Useful for making ornamental plants with modified leaves
  misc_feature: Utility: Useful for making plants with altered leaf shape eg curled leaves
  misc_feature: Utility: Useful for making plants with increased biomass
  misc_feature: Utility: Useful for making plants with increased biomass and foliage
  misc_feature: Utility: Useful for making plants with modified flowers
  misc_feature: Utility: Useful for making smaller plants
  misc_feature: Utility: Useful for modifying plant architecture, ie amount of  branching
MSKKRKFVADGVFFAELNEVLTRELAEDGYSGVEVRVTPMRTEIIIRATRTQAVLGEKGRRIRELTSVVQKRFKFPENSVELYAEKVNNRGLCAIAQAESLRYKLLGGLAVRRACYGVLRFVMESGAKGCEVIVSGKLRAQRAKSMKFKDGYMIFSGQPVKDYIDSAVRHVLLRQGVLGIKVKIMLDWDPKGKQGPKTPLPDLVTIHTPKEEEEYARPAAVLATNIEVPVAS

SEQ ID NO: 1815 - protein, 232 aa, Zea mays
  misc_feature (1)..(232): Ceres CLONE ID no. 1600660
  misc_feature: Utility: Useful for making lethal plants for genetic confinement systems
  misc_feature: Utility: Useful for making ornamental plants with modified flowers
  misc_feature: Utility: Useful for making ornamental plants with modified leaves
  misc_feature: Utility: Useful for making plants with altered leaf shape eg curled leaves
  misc_feature: Utility: Useful for making plants with increased biomass
  misc_feature: Utility: Useful for making plants with increased biomass and foliage
  misc_feature: Utility: Useful for making plants with modified flowers
  misc_feature: Utility: Useful for making smaller plants
  misc_feature: Utility: Useful for modifying plant architecture, ie amount of  branching
MASTHAISKKRKFVAVGVFFAELNEMLTRELAEDGYSGVEVRVTPMRTEIIIRATRTQNVLGEKGRRIRELTSVVQKRFNFPEGGVELYAEKVNNRGLCAIAQAESLRYKLLGGLAVRRACYGVLRFVMESGAKGCEVIVSGKLRAQRAKSMKFKDGYMISSGHPVNLYIDSAVRHVLLRQGVLGIKVKIMLDWDPKGKQGPTMPLPDLVTIHVPKEEDEFLRPLAAEIQVA

SEQ ID NO: 1816 - protein, 219 aa, Glycine max
  misc_feature (1)..(219): Ceres CLONE ID no. 620092
  misc_feature: Utility: Useful for making lethal plants for genetic confinement systems
  misc_feature: Utility: Useful for making ornamental plants with modified flowers
  misc_feature: Utility: Useful for making ornamental plants with modified leaves
  misc_feature: Utility: Useful for making plants with altered leaf shape eg curled leaves
  misc_feature: Utility: Useful for making plants with increased biomass
  misc_feature: Utility: Useful for making plants with increased biomass and foliage
  misc_feature: Utility: Useful for making plants with modified flowers
  misc_feature: Utility: Useful for making smaller plants
  misc_feature: Utility: Useful for modifying plant architecture, ie amount of  branching
  misc_feature (64)..(64): Xaa is any aa, unknown, or other
  misc_feature (67)..(67): Xaa is any aa, unknown, or other
  misc_feature (89)..(89): Xaa is any aa, unknown, or other
  misc_feature (95)..(95): Xaa is any aa, unknown, or other
  misc_feature (96)..(96): Xaa is any aa, unknown, or other
  misc_feature (101)..(101): Xaa is any aa, unknown, or other
  misc_feature (211)..(211): Xaa is any aa, unknown, or other
MSKKRKFVADGVFFAELNEVLTRELAEDGYSGVEVRVTPMRTEIIIRATRTQAVLGEKGRRIRXLTXVVQKRFKFPENSVELYAEKVNXRGLCAXXQAESXRYKLLGGLAVRRACYGVLRFVMESGAKGCEVIVSGKLRAQRAKSMKFKDGYMISSGQPVKDYIDSAVRHVLLRQGVLGIKVKIMLDWDPKGKQGPKTPLPDLVTIHSPKXEEEYIQPA

SEQ ID NO: 1817 - protein, 207 aa, Arabidopsis thaliana
  misc_feature (1)..(207): Ceres CLONE ID no. 15190
  misc_feature: Utility: Useful for making lethal plants for genetic confinement systems
  misc_feature: Utility: Useful for making ornamental plants with modified flowers
  misc_feature: Utility: Useful for making ornamental plants with modified leaves
  misc_feature: Utility: Useful for making plants with altered leaf shape eg curled leaves
  misc_feature: Utility: Useful for making plants with increased biomass
  misc_feature: Utility: Useful for making plants with increased biomass and foliage
  misc_feature: Utility: Useful for making plants with modified flowers
  misc_feature: Utility: Useful for making smaller plants
  misc_feature: Utility: Useful for modifying plant architecture, ie amount of  branching
MRTEIIIRATRTQNVLGEKGRRIRELTSLVQKRFKFPVDSVELYAEKVNNRGLCAIAQAESLRYKLLGGLAVRRACYGVLRFVMESGAKGCEVIVSGKLRAARAKSMKFKDGYMVSSGQPTKEYIDAAVRHVLLRQGVLGIKVKIMLDWDPTGKSGPKTPLPDVVIIHAPKDDVVYSAPAQAAAPVTLVQEAPLTTVDYPEMIPPVA

SEQ ID NO: 1818 - protein, 249 aa, Zea mays
  misc_feature (1)..(249): Ceres CLONE ID no. 1383206
  misc_feature: Utility: Useful for making lethal plants for genetic confinement systems
  misc_feature: Utility: Useful for making ornamental plants with modified flowers
  misc_feature: Utility: Useful for making ornamental plants with modified leaves
  misc_feature: Utility: Useful for making plants with altered leaf shape eg curled leaves
  misc_feature: Utility: Useful for making plants with increased biomass
  misc_feature: Utility: Useful for making plants with increased biomass and foliage
  misc_feature: Utility: Useful for making plants with modified flowers
  misc_feature: Utility: Useful for making smaller plants
  misc_feature: Utility: Useful for modifying plant architecture, ie amount of  branching
  misc_feature (57)..(57): Xaa is any aa, unknown, or other
MATQISKKRKFVADGVFYAELNEVLTRELAEDGYSGVEVRVTPMRTEIIIRATRTQXVLGEKGRRIRELTSLVQKRFRFPQDSVELYAEKVANRGLCAIAQAESLRYKLLGGLAVRRACYGVLRFVMESGAKGCEVIVSGKLRAARAKSMKFKDGYMVSSGQPTKEYIDSAVRHVLLRQGVLGIKVKVMLDWDPKGVTGPKTPLPDVVIIHSPKEEEVNSAPAQVDAPAAFVPEAPLTAVDYPEMIPVA

SEQ ID NO: 1819 - protein, 206 aa, Arabidopsis thaliana
  misc_feature (1)..(206): Ceres CLONE ID no. 9568
  misc_feature: Utility: Useful for making lethal plants for genetic confinement systems
  misc_feature: Utility: Useful for making ornamental plants with modified flowers
  misc_feature: Utility: Useful for making ornamental plants with modified leaves
  misc_feature: Utility: Useful for making plants with altered leaf shape eg curled leaves
  misc_feature: Utility: Useful for making plants with increased biomass
  misc_feature: Utility: Useful for making plants with increased biomass and foliage
  misc_feature: Utility: Useful for making plants with modified flowers
  misc_feature: Utility: Useful for making smaller plants
  misc_feature: Utility: Useful for modifying plant architecture, ie amount of  branching
MRTEIIIRATRTQNVLGEKGRRIRELTSLVQKRFKFPVDSVELYAEKVNNRGLCAIAQAESLRYKLLGGLAVRRACYGVLRFVMESGAKGCEVIVSGKLRAARAKSMKFKDGYMVSSGQPTKEYIDSAVRHVLLRQGVLGIKVKVMLDWDPKGISGPKTPLPDVVIIHSPKEEEAIYAPAQVAAPAALVADAPLTAVDYPAMIPVA

SEQ ID NO: 1820 - protein, 206 aa, Zea mays
  misc_feature (1)..(206): Ceres CLONE ID no. 1062254
  misc_feature: Utility: Useful for making lethal plants for genetic confinement systems
  misc_feature: Utility: Useful for making ornamental plants with modified flowers
  misc_feature: Utility: Useful for making ornamental plants with modified leaves
  misc_feature: Utility: Useful for making plants with altered leaf shape eg curled leaves
  misc_feature: Utility: Useful for making plants with increased biomass
  misc_feature: Utility: Useful for making plants with increased biomass and foliage
  misc_feature: Utility: Useful for making plants with modified flowers
  misc_feature: Utility: Useful for making smaller plants
  misc_feature: Utility: Useful for modifying plant architecture, ie amount of  branching
  misc_feature (132)..(132): Xaa is any aa, unknown, or other
MRTEIIIRATRTQNVLGEKGRRIRELTSLVQKRFRFPQDSVELYAEKVANRGLCAIAQAESLRYKLLGGLAVRRACYGVLRFVMESGAKGCEVIVSGKLRAARAKSMKFKDGYMVSSGQPTKDYIDSAVRHXLLRQGVLGIKVKVMLDWDPKGINGPKTPLPDVVIIHAPKEEDVNSAPAQVAAPAALAPEAPLTAVDYPEMIPVA

SEQ ID NO: 1821 - protein, 206 aa, Arabidopsis thaliana
  misc_feature (1)..(206): Ceres CLONE ID no. 1208311
  misc_feature: Utility: Useful for making lethal plants for genetic confinement systems
  misc_feature: Utility: Useful for making ornamental plants with modified flowers
  misc_feature: Utility: Useful for making ornamental plants with modified leaves
  misc_feature: Utility: Useful for making plants with altered leaf shape eg curled leaves
  misc_feature: Utility: Useful for making plants with increased biomass
  misc_feature: Utility: Useful for making plants with increased biomass and foliage
  misc_feature: Utility: Useful for making plants with modified flowers
  misc_feature: Utility: Useful for making smaller plants
  misc_feature: Utility: Useful for modifying plant architecture, ie amount of  branching
  misc_feature (48)..(48): Xaa is any aa, unknown, or other
  misc_feature (111)..(111): Xaa is any aa, unknown, or other
MRTEIIIRATRTQNVLGEKGRRIRELTSLVQKRFKFPVDSVELYAEKXNKRGLCAIAQAESLRYKLLGGLAVRRACYGVLRFVMESGAKGCEVIVSGKLRAARAKSMKFKXGYMVSSGQPTKEYIDSAVRHVLLRQGVLGIKVKVMLDWDPKGISGPKTPLPDVVIIHSPKEEEAIYAPAQVAAPAALVADAPLTAVDYPAMIPVA

SEQ ID NO: 1822 - DNA, 1024 bp, Arabidopsis thaliana
  misc_feature (1)..(1024): Ceres CLONE ID no. 5220
  misc_feature (1)..(1024): Also known as  Ceres CDNA ID no. 23384579
acttcttctagtcttaaaataaaacaaacaaaaaaatcagtgttcggctctaacacgctcgacgaccatggcggtctcgtttaatacaacgcttcaccagccttctctgagtcccagctgtagcatcaagctttattctgggttaaagcctcaatctgcaagctttttggcaagtgggtatcagaatttgaataaggagttctatggaagagttcataagagtctgcaatctgggactggcaaagcgagcaggtcacgggtaaagatgatgccaataggaacaccgagagtgccctacagaaaccgtgaagaaggcacttggcaatgggttgatatatggaatgccctttatcgagagcgtgtaatcttcattggacaaaacattgatgaagagtttagcaaccagatattagcaaccatgttgtaccttgatactcttgatgactcgaggaggatttatatgtacctaaatggtccgggtggtgatcttactccaagtctagccatctatgatacaatgaagagcttgaaaagtccggttgggacacattgcgttgggcttgcttacaaccttgcaggttttcttcttgcggctggagaaaagggtcaccgatttgcgatgccattgtcaagaatcgccctccaatcaccagctggtgcagcccgtggccaggctgatgatatccaaaatgaagcaaaagagctttcaaggataagagactacctcttcaatgaactagccaagaatacaggccagcctgcggaaagggtcttcaaagacttgagccgggtgaaaaggttcaatgcagaggaagcaatcgagtatggacttattgataagattgttagaccaccgcgcatcaaagaagacgctcctcgccaagacgaaagcgcagggctaggctagtcttttttgtttgtttgttatgtcaaaagttttaatctttatgttattgtgattgtgattgttacctaaaaaaatcactgattattgttttttcattccaccgattttctgatttct

SEQ ID NO: 1823 - protein, 279 aa, Arabidopsis thaliana
  misc_feature (79)..(263): Pfam Name: CLP_protease; Pfam Description: Clp protease
  misc_feature: Utility: Useful for making lethal plants for genetic confinement systems
MAVSFNTTLHQPSLSPSCSIKLYSGLKPQSASFLASGYQNLNKEFYGRVHKSLQSGTGKASRSRVKMMPIGTPRVPYRNREEGTWQWVDIWNALYRERVIFIGQNIDEEFSNQILATMLYLDTLDDSRRIYMYLNGPGGDLTPSLAIYDTMKSLKSPVGTHCVGLAYNLAGFLLAAGEKGHRFAMPLSRIALQSPAGAARGQADDIQNEAKELSRIRDYLFNELAKNTGQPAERVFKDLSRVKRFNAEEAIEYGLIDKIVRPPRIKEDAPRQDESAGLG

SEQ ID NO: 1824 - protein, 285 aa, Glycine max
  misc_feature (1)..(285): Ceres CLONE ID no. 476857
  misc_feature: Utility: Useful for making lethal plants for genetic confinement systems
MAVVPYTTGSAPLLSPPSTSSVATKLYSGLKLQAASPFGAAKPNVTAEFYGKVHNTLHCRYANHNTSMARIRMMPIGTPKVPYRTPGEGTWQWVDVWNALYRERVIFIGQEIDEEFSNQILATMLYLDSIENSKKLYMYINGPGGDLTPSMAIYDTMQSLQSPVATHCVGYAYSLAAFLLAAGEKGNRSAMPLSRVALTSPAGAARGQADDIQNEANELLRIRDYLFNELAQKTGQPVEKITKDLSRMKRFNAQEALEYGLIDRIVRPPRIKADAPRKEAGTGLG

SEQ ID NO: 1825 - protein, 297 aa, Glycine max
  misc_feature (1)..(297): Public GI no. 55296987
  misc_feature: Utility: Useful for making lethal plants for genetic confinement systems
MALSAAAPANSSCFHPRAAAASAPSSLSVGTKVFVGLKAQTKLGSSESSCPNVTAGFYTAVNRRISLGLSNKRATRARISMMPVGTPRVPYRTPGEGTWQWLDIWNALYRERIIFIGDSIDEEFSNQVLASMLYLDSVDNTKKILLYINGPGGDLTPCMALYDTMLSLKSPIGTHCLGFAFNLAGFILAAGEKGSRTGMPLCRISLQSPAGAARGQADDIENEANELIRIKNYLYSKLSEHTGHPVDKIHEDLSRVKRFDAEGALEYGIIDRIIRPSRIKKEGSTAQKKDLRNLGLG

SEQ ID NO: 1826 - DNA, 1507 bp, Arabidopsis thaliana
  misc_feature (1)..(1507): Ceres CLONE ID no. 11214
  misc_feature (1)..(1507): Also known as  Ceres CDNA ID no. 23373243
gatctcatcgaagctcctctctcttacatatcatcacttcacatcaaccaaacctacttctgtctctctctctcgctctctatctctcacgctctcacagtagaagaaaaaattagaaaggttgtgagaatggcggctacagcagcttcaagcttgcaaattgctacacgaaggccgagcatgtcttcgcccagcaaagttcttaaagcaggaacctacattgttggtgccaatcctggaaacgcttcatgggataaactttcatgcactcgccaattatcaaaccttggatgtttgagaaacaacactgctgttccaacttgtaaaagaccgttttctttttccacaagggcaatgtctgaatccagtgaaaataaggctccttcagggcttccaattgatttgagagggaaaagagctttcattgctggtatagctgatgataatggctatggttgggccatagcaaaatctcttgctgctgctggagctgaaatattggttgggacttgggttcctgcacttaatatatttgagacaagcttgagacgtggaaaattcgaccagtcacgagtgttgccggatgggtcattgatggagattaagaaggtctatgctttggatgctgtgtttgacaatcctgaagatgtgcctgaagatgtgaaaacgaataagcgatatgcaggatcgtcaaactggaccgtacaggaagctgctgaatgtgtgaaaaaagattttggaagcattgacattcttgtccattcccttgcaaatggtccagaggttagcaaacctcttctggagacatcaaggaaaggctatctcgctgctatctctgcttcgagttactcctttgtttccttgctgaggcattttctgccaattatgaacccaggaggtgcttcaatatctcttacttacattgcatctgaaagaatcattcctgggtatggtggaggtatgagttctgccaaagctgcactagagagtgacacacgggtgcttgcatatgaagctggaaggaaatcaaacattagggtcaacaccatatctgcgggtcctttgggaagccgaccagcaaaagccattgggttcatagacaccatgattgagtattcctacaataatggacctattcagaaaacactgaccgcagatgaagttgggaatgcagcagccttcttggcatctccattggcctctgccataaccggtgcaaccatatatgtggacaatggtttgaatgcaatgggcgttgcactggacagccccgtgttcaaagaccttaacagcaagaattagagtcttgatcgacgactgaactcgagaaattccgtgttttcgtgagcttgcttgtttctttatgagttagtatgtacggcatatgttccccatcggctgtctttttttttctttctttaagagaataaattatggttctaggttgggtcatttagcaactatatatgtagtgatggattattattcctcttatgattgaaaattt

SEQ ID NO: 1827 - protein, 390 aa, Arabidopsis thaliana
  misc_feature: Utility: Useful for making ornamental plants with flowers and leaves fused
  misc_feature: Utility: Useful for making ornamental plants with modified flowers
  misc_feature: Utility: Useful for making ornamental plants with modified leaves
  misc_feature: Utility: Useful for making plants with altered leaf shape eg curled leaves
  misc_feature: Utility: Useful for making plants with increased biomass
  misc_feature: Utility: Useful for making smaller plants
  misc_feature (316)..(316): Xaa is any aa, unknown, or other
MAATAASSLQIATRRPSMSSPSKVLKAGTYIVGANPGNASWDKLSCTRQLSNLGCLRNNTAVPTCKRPFSFSTRAMSESSENKAPSGLPIDLRGKRAFIAGIADDNGYGWAIAKSLAAAGAEILVGTWVPALNIFETSLRRGKFDQSRVLPDGSLMEIKKVYALDAVFDNPEDVPEDVKTNKRYAGSSNWTVQEAAECVKKDFGSIDILVHSLANGPEVSKPLLETSRKGYLAAISASSYSFVSLLRHFLPIMNPGGASISLTYIASERIIPGYGGGMSSAKAALESDTRVLAYEAGRKSNIRVNTISAGPLGSRXAKAIGFIDTMIEYSYNNGPIQKTLTADEVGNAAAFLASPLASAITGATIYVDNGLNAMGVALDSPVFKDLNSKN

SEQ ID NO: 1828 - protein, 390 aa, Arabidopsis thaliana
  misc_feature (1)..(390): Public GI no. 21281125
  misc_feature: Utility: Useful for making ornamental plants with flowers and leaves fused
  misc_feature: Utility: Useful for making ornamental plants with modified flowers
  misc_feature: Utility: Useful for making ornamental plants with modified leaves
  misc_feature: Utility: Useful for making plants with altered leaf shape eg curled leaves
  misc_feature: Utility: Useful for making plants with increased biomass
  misc_feature: Utility: Useful for making smaller plants
MAATAASSLQIATRRPSMSSPSKILKAGTYIVGANPGNASWDKLSCTRQLSNLGCLRNHSAVPTCKRPFSFSTRAMSESSENKAPSGLPIDLRGKRAFIAGIADDNGYGWAIAKSLAAAGAEILVGTWVPALNIFETSLRRGKFDQSRVLPDGSLMEIKKVYALDAVFDNPEDVPEDVKTNKRYAGSSNWTVQEAAECVKKDFGSIDILVHSLANGPEVSKPLLETSRKGYLAAISASSYSFVSLLRHFLPIMNPGGASISLTYIASERIIPGYGGGMSSAKAALESDTRVLAYEAGRKSNIRVNTISAGPLGSRAAKAIGFIDTMIEYSYNNGPIQKTLTADEVGNAAAFLASPLASAITGATIYVDNGLNAMGVALDSPVFKDLNSKN

SEQ ID NO: 1829 - protein, 390 aa, Arabidopsis thaliana
  misc_feature (1)..(390): Public GI no. 7141083
  misc_feature: Utility: Useful for making ornamental plants with flowers and leaves fused
  misc_feature: Utility: Useful for making ornamental plants with modified flowers
  misc_feature: Utility: Useful for making ornamental plants with modified leaves
  misc_feature: Utility: Useful for making plants with altered leaf shape eg curled leaves
  misc_feature: Utility: Useful for making plants with increased biomass
  misc_feature: Utility: Useful for making smaller plants
MAATAASSLQIATRRPSMSSPSKILKAGTYIVGANPGNASWDKLSCTRQLSNLGCLRNHSAVPTCKRPFSFSTRAMSESSENKAPSGLPIDLRGKRAFIAGIADDNGYGWAIAKSLAAAGAEILVGTWVPALNIFETSLRRGKFDQSRVLPDGSLMEIKKVYALDAVFDNPEDVPEDVKTNKRYAGSSNWTVQEAAECVKKDFGSIDILVHSLANGPEVSKPLLETSRKGYLAAISASSYSFVSLLRHFLPIMNPGGASISLTYIASERIIPGYGGGMSSAKAALESDTRVLAYEAGRKSNIRVNTISAGPLGSRAAKAIGFIDTMIEYSYNNGPIQKTLTADEVGNAAAFLASPLASAITGATIYVDNGLNAMGRALDSPVFKDLNSKN

SEQ ID NO: 1830 - protein, 389 aa, Arabidopsis thaliana
  misc_feature (1)..(389): Ceres CLONE ID no. 36277
  misc_feature: Utility: Useful for making ornamental plants with flowers and leaves fused
  misc_feature: Utility: Useful for making ornamental plants with modified flowers
  misc_feature: Utility: Useful for making ornamental plants with modified leaves
  misc_feature: Utility: Useful for making plants with altered leaf shape eg curled leaves
  misc_feature: Utility: Useful for making plants with increased biomass
  misc_feature: Utility: Useful for making smaller plants
MAYSSFTLQIATRRPSMSSPSKILKAGTYIVGANPGNASWDKLSCTRQLSNLGCLRNHSAVPTCKRPFSFSTRAMSESSENKAPSGLPIDLRGKRAFIAGIADDNGYGWAIAKSLAAAGAEILVGTWVPALNIFETSLRRGKFDQSRVLPDGSLMEIKKVYALDAVFDNPEDVPEDVKTNKRYAGSSNWTVQEAAECVKKDFGSIDILVHSLANGPEVSKPLLETSRKGYLAAISASSYSFVSLLRHFLPIMNPGGASISLTYIASERIIPGYGGGMSSAKAALESDTRVLAYEAGRKSNIRVNTISAGPLGSRAAKAIGFIDTMIEYSYNNGPIQKTLTADEVGNAAAFLASPLASAITGATIYVDNGLNAMGVALDSPVFKDLNSKN

SEQ ID NO: 1831 - protein, 312 aa, Brassica napus
  misc_feature (1)..(312): Ceres CLONE ID no. 977208
  misc_feature: Utility: Useful for making ornamental plants with flowers and leaves fused
  misc_feature: Utility: Useful for making ornamental plants with modified flowers
  misc_feature: Utility: Useful for making ornamental plants with modified leaves
  misc_feature: Utility: Useful for making plants with altered leaf shape eg curled leaves
  misc_feature: Utility: Useful for making plants with increased biomass
  misc_feature: Utility: Useful for making smaller plants
MSESSENKASSGLPIDLRGKRAFIAGIADDNGYGWAIAKSLAAAGAEILVGTWVPALNIFETSLRRGKFDQSRVLPDGSLMEIKKVYPLDAVFDSPEDVPEDVKANKRYAGSSNWTVQEAAECVRKDFGTIDILVHSLANGPEVSKPLLETSRKGYLAAISASSYSFVSLLRHFLPIMNPGGASISLTYIASERIIPGYGGGMSSAKAALESDTRVLAFEAGRKQKIRVNTISAGPLGSRAAKAIGFIDTMIEYSYNNAPVQKTLTADEVGNAAAFLVSPLASAITGATIYVDNGLNSMGVAIDSPVFKDLK

SEQ ID NO: 1832 - protein, 386 aa, Brassica napus
  misc_feature (1)..(386): Public GI no. 14422257
  misc_feature: Utility: Useful for making ornamental plants with flowers and leaves fused
  misc_feature: Utility: Useful for making ornamental plants with modified flowers
  misc_feature: Utility: Useful for making ornamental plants with modified leaves
  misc_feature: Utility: Useful for making plants with altered leaf shape eg curled leaves
  misc_feature: Utility: Useful for making plants with increased biomass
  misc_feature: Utility: Useful for making smaller plants
MAATAASSLQFATIRPNISSKVVKAGTYIVGANPRNASSWDKLAFTRHLSKLGCLRNNSSLPTSKKSFSFSTKAMSESSENKASSGLPIDLRGKRAFIAGIADDNGYGWAIAKSLAAAGAEILVGTWVPALNIFETSLRRGKFDQSRVLPDGSLMEIKKVYPLDAVFDSPEDVPEDVKANKRYAGSSNWTVQEAAECVKKDFGTIDILVHSLANGPEVSKPLLETSRKGYLAAISASSYSFVSLLRHFLPIMNPGGASISLTYIASERIIPGYGGGMSSAKAALESDTRVLAFEAGRKQNIRVNTISAGPLGSRAAKAIGFIDTMIEYSYNNAPVQKTLTADEVGNAAAFLVSPLASAITGATIYVDNGLNSMGVAIDSPVFKDLK

SEQ ID NO: 1833 - protein, 385 aa, Brassica napus
  misc_feature (1)..(385): Public GI no. 14422255
  misc_feature: Utility: Useful for making ornamental plants with flowers and leaves fused
  misc_feature: Utility: Useful for making ornamental plants with modified flowers
  misc_feature: Utility: Useful for making ornamental plants with modified leaves
  misc_feature: Utility: Useful for making plants with altered leaf shape eg curled leaves
  misc_feature: Utility: Useful for making plants with increased biomass
  misc_feature: Utility: Useful for making smaller plants
MAATAASSLQFATIRPSISSKVVKAGTYIVGANPRNASWDKLACTRHLSKHGCLRNNSSLPTSKKSFSFSTKAMSESSENKASSGLPIDLRGKRAFIAGIADDNGYGWAIAKSLAAAGAEILVGTWVPALNIFETSLRRGKFDQSRVLPDGSLMEIKKVYPLDAVFDSPEDVPEDVKANKRYAGSSNWTVQEAAECVRKDFGTIDILVHSLANGPEVSKPLLETSRKGYLAAISASSYSFVSLLRHFLPIMNPGGASISLTYIASERIIPGYGGGMSSAKAALESDTRVLAFEAGRKQKIRVNTISAGPLGSRAAKAIGFIDTMIEYSYNNAPVQKTLTADEVGNAAAFLVSPLASAITGATIYVDNGLNSMGVAIDSPVFKDLK

SEQ ID NO: 1834 - protein, 374 aa, Brassica napus
  misc_feature (1)..(374): Ceres CLONE ID no. 1294554
  misc_feature: Utility: Useful for making ornamental plants with flowers and leaves fused
  misc_feature: Utility: Useful for making ornamental plants with modified flowers
  misc_feature: Utility: Useful for making ornamental plants with modified leaves
  misc_feature: Utility: Useful for making plants with altered leaf shape eg curled leaves
  misc_feature: Utility: Useful for making plants with increased biomass
  misc_feature: Utility: Useful for making smaller plants
MATTRPSISAASSKARTYVVGANPRNAYKIACTPHLSNLGCLRNDSALPASKKSFSFSTKAMSESSESKASSGLPIDLRGKRAFIAGIADDNGYGWAVAKSLAAAGAEILVGTWVPALNIFETSLRRGKFDQSRVLPDGSLMEIKKVYPLDAVFDNPEDVPEDVKANKRYAGSSNWTVQEAAECVRQDFGSIDILVHSLANGPEVSKPLLETSRKGYLAAISASSYSFVSLLSHFLPIMNPGGASISLTYIASERIIPGYGGGMSSAKAALESDTRVLAFEAGRKQNIRVNTISAGPLGSRAAKAIGFIDTMIEYSYNNAPIQKTLTADEVGNAAAFLVSPLASAITGATIYVDNGLNSMGVALDSPVFKDLNK

SEQ ID NO: 1835 - protein, 376 aa, Brassica napus
  misc_feature (1)..(376): Ceres CLONE ID no. 1117994
  misc_feature: Utility: Useful for making ornamental plants with flowers and leaves fused
  misc_feature: Utility: Useful for making ornamental plants with modified flowers
  misc_feature: Utility: Useful for making ornamental plants with modified leaves
  misc_feature: Utility: Useful for making plants with altered leaf shape eg curled leaves
  misc_feature: Utility: Useful for making plants with increased biomass
  misc_feature: Utility: Useful for making smaller plants
MATTRASISAASSKARTCIVGANPRNASWDKIACTPHLSNLGCLRNDSALPASKKSFSFSTKAMSEFSESKASSGLPIDLRGKRAFIAGIADDNGYGWAIAKSLAAAGAEILVGTWVPALNIFETSLRRGKFDQSRVLPDGSLMEIKKVYPLDAVFDTPDDVPEDVKANKRYAGSSNWTVQEAAECVRQDFGSIDILVHSLANGPEVSKPLLETTRKGYLAAISASSYSFVSLLSHFLPIMNPGGASISLTYIASERIIPGYGGGMSSAKAALESDTRVLAFEAGRKQNIRVNTISAGPLGSRAAKAIGFIDTMIEYSYNNAPIQKTLTADEVGNAAAFLVSPLASAITGATIYVDNGLNSMGVALDSPVFKDLNK

SEQ ID NO: 1836 - protein, 366 aa, Triticum aestivum
  misc_feature (1)..(366): Ceres CLONE ID no. 697140
  misc_feature: Utility: Useful for making ornamental plants with flowers and leaves fused
  misc_feature: Utility: Useful for making ornamental plants with modified flowers
  misc_feature: Utility: Useful for making ornamental plants with modified leaves
  misc_feature: Utility: Useful for making plants with altered leaf shape eg curled leaves
  misc_feature: Utility: Useful for making plants with increased biomass
  misc_feature: Utility: Useful for making smaller plants
MLAARPCVSASQSMLTSRPAVSRIDLTLVAGSFANCPRISCSRSLGSSRSGAVAVRAVSGEGSSSGLPIDLRGKRAFIAGVADDNGYGWAIAKALAAAGAEILVGTWVPALNIFETSLRRGKFDESRKLPDGSLMEIVKVYPLDAVYDSPEDVPEDVKTNKRYAGSSNWTVKEAAELVKKEYGSIDILVHSLANGPEVTKPLLETSRSGYLAAISASSYSFVSLLKHFLPIMNPGGASISLTYIASERTIPGYGGGMSSAKAALESDTKVLAFEAGRKGKIRVNTISAGPLGSRAAKAIGFIEKMIEYSYVNAPLQKELLADEVGNTAAFLVSPLASAITGSTVYVDNGLNTMGLAVDSPTVSSLL

SEQ ID NO: 1837 - protein, 361 aa, Zea mays
  misc_feature (1)..(361): Ceres CLONE ID no. 264627
  misc_feature: Utility: Useful for making ornamental plants with flowers and leaves fused
  misc_feature: Utility: Useful for making ornamental plants with modified flowers
  misc_feature: Utility: Useful for making ornamental plants with modified leaves
  misc_feature: Utility: Useful for making plants with altered leaf shape eg curled leaves
  misc_feature: Utility: Useful for making plants with increased biomass
  misc_feature: Utility: Useful for making smaller plants
MVAARPCISASPGILTARVAVSRTDCMLSTTATFPKISCSWPLRFKRNDVVVRAISEECGPQGLPIDLRGKRAFIAGVADDNGYGWAIAKALAAAGAEILVGTWVPALNIFETSLRRGKFDESRKLPDGSLMDIVKVYPLDAVYDSPDDVPEDVKSNKRYAGASNWTVKEVVESVRNDFGSIDILVHSLANGPEVTKPLLETSRRGYLAAISASSYSYVSLLQHFLPIMNPGGASISLTYIASERAIPGYGGGMSSAKAALESDTRVLAFEAGRKGKIRVNTISAGPLGSRAAKAIGFIEKMIEYSYVNAPLQKELLADEVGNTAAFLVSSLASAITGSTVYVDNGLNTMGLAIDSPTITS

SEQ ID NO: 1838 - protein, 361 aa, Zea mays; identical to SEQ ID NO: 1837
  misc_feature (1)..(361): Ceres CLONE ID no. 272165
  misc_feature: Utility: Useful for making ornamental plants with flowers and leaves fused
  misc_feature: Utility: Useful for making ornamental plants with modified flowers
  misc_feature: Utility: Useful for making ornamental plants with modified leaves
  misc_feature: Utility: Useful for making plants with altered leaf shape eg curled leaves
  misc_feature: Utility: Useful for making plants with increased biomass
  misc_feature: Utility: Useful for making smaller plants

SEQ ID NO: 1839 - protein, 366 aa, Zea mays
  misc_feature (1)..(366): Ceres CLONE ID no. 338740
  misc_feature: Utility: Useful for making ornamental plants with flowers and leaves fused
  misc_feature: Utility: Useful for making ornamental plants with modified flowers
  misc_feature: Utility: Useful for making ornamental plants with modified leaves
  misc_feature: Utility: Useful for making plants with altered leaf shape eg curled leaves
  misc_feature: Utility: Useful for making plants with increased biomass
  misc_feature: Utility: Useful for making smaller plants
MQMIATRPSIPAYRQILGSTSALSAFGRSICSRTGFAISSKATSAGPLVSSNCKRVVVRAMSQRGAQGLPIDLTGKRAFIAGVADDNGYGWAIAKALAAAGAEILVGTWVPALNIFETSLRRGKFDESRKLPDGSLMEIAKVYPLDAVYDTPEDVPEDVKANKRYAGASNWTVKEVVETVKNDFGSIDILVHSLANGPEVTKSLLETSRRGYLAAISASSYSYVSLLQHFLPIMNPGGASISLTYIASERIIPGYGGGMSSAKAALESDTRVLAYEAGRKGKIRVNTISAGPLGSRAAKAIGFIEKMIEYSYVNAPLQKELLADEVGNTAAFLVSPLASAITGSTIYVDNGLNTMGLALDSPTLST

SEQ ID NO: 1840 - protein, 392 aa, Glycine max
  misc_feature (1)..(392): Ceres CLONE ID no. 472119
  misc_feature: Utility: Useful for making ornamental plants with flowers and leaves fused
  misc_feature: Utility: Useful for making ornamental plants with modified flowers
  misc_feature: Utility: Useful for making ornamental plants with modified leaves
  misc_feature: Utility: Useful for making plants with altered leaf shape eg curled leaves
  misc_feature: Utility: Useful for making plants with increased biomass
  misc_feature: Utility: Useful for making smaller plants
  misc_feature (302)..(302): Xaa is any aa, unknown, or other
MAATSFSGMQFAMSRSCIPASQKIADAGAVVLGGKSKIGSWNKLASACHIASVQPFRRGFTSSSIKSVKSDTKALFEFSAQSADSGLSIDLKGKRAFIAGVADDNGYGWAIAKALAAAGAEILVGTWVPALNIFESSLRRGKFDISRILPDGSMMEITKVYPLDAVFDNPDDVPEDIKTNKRYAGSSKWTVQEVAESVKEDFGSIDILVHSLANGPEVTKPLLETSRNGYLAAISASSYSYVSLLKHFLPILNPGGSSISLTYIASERIIPGYGGGMSSAKAALESDTRVLAFEAGRKRKIXVNTISAGPPRSRAAKAIGFIDMMIDYSSANAPLQKEVLAEEVGYTAAFLASPLASAITGTVLYVDNGLNAMGVGVDSPIFKDLNIPKDQH

SEQ ID NO: 1841 - DNA, 589 bp, Glycine max
  misc_feature (1)..(589): Ceres CLONE ID no. 563522
  misc_feature (1)..(589): Also known as  Ceres CDNA ID no. 23692537
aagagtcacactcacaccactttgttttaggttaatattgtgaaagagagatcatgagcaaaagagtaaggagtccaaggttggagcttaggctgaacttgtccccaccaagggcagcagcaacctcaattatatcttcttcggagctgtcgcccacagagtcatcgatgtcgtcgccggtgtcggttcaatcgttggagagctcgtgtgtatcctccgaggctgaagagacaagggcaatgcttctcgtgggctgtcctcggtgcctcatgtatgttatgttgtcggaggttgatcccaaatgccccaagtgcaagagtactgtgttgcttgacttcctcaacaacgaggaaaacaacaataccaagaagagtagcagcgagtgatgatgagacatgtgaagaacagtagctacatgcatcaccgagaaaaagtttgttttctgttattgttggatttccgttttttggttaattagagcagagattggctttttcctatctctgaagttttaattttctgtgaaatttggctgtttcttactgtacgtgtacaagacaaattaagggaagagaatttaaattagttt

SEQ ID NO: 1842 - protein, 110 aa, Glycine max
  misc_feature: Utility: Useful for making ornamental plants with modified color
  misc_feature: Utility: Useful for making ornamental plants with modified leaves
  misc_feature: Utility: Useful for making plants sterile and for genetic confinement
  misc_feature: Utility: Useful for making plants with increased biomass and foliage
  misc_feature: Utility: Useful for making stronger plants
MSKRVRSPRLELRLNLSPPRAAATSIISSSELSPTESSMSSPVSVQSLESSCVSSEAEETRAMLLVGCPRCLMYVMLSEVDPKCPKCKSTVLLDFLNNEENNNTKKSSSE

SEQ ID NO: 1843 - protein, 67 aa, Brassica napus
  misc_feature (1)..(67): Ceres CLONE ID no. 1116523
  misc_feature: Utility: Useful for making ornamental plants with modified color
  misc_feature: Utility: Useful for making ornamental plants with modified leaves
  misc_feature: Utility: Useful for making plants sterile and for genetic confinement
  misc_feature: Utility: Useful for making plants with increased biomass and foliage
  misc_feature: Utility: Useful for making stronger plants
  misc_feature (63)..(63): Xaa is any aa, unknown, or other
MSLVRSPSRSNTTSPSSCVSSETYQEEMETTISMVLVGCPRCLMYVMLSQDDPKCPKCKSTVXLDFL

SEQ ID NO: 1844 - protein, 119 aa, Brassica napus
  misc_feature (1)..(119): Ceres CLONE ID no. 973582
  misc_feature: Utility: Useful for making ornamental plants with modified color
  misc_feature: Utility: Useful for making ornamental plants with modified leaves
  misc_feature: Utility: Useful for making plants sterile and for genetic confinement
  misc_feature: Utility: Useful for making plants with increased biomass and foliage
  misc_feature: Utility: Useful for making stronger plants
MSLRNKNGPKLELKLNLSPPPSQANLMSLVRSPSRSNTTSPSSCVSSETYQEEMETTISMLLVGCPRCLMYVMLSQDDPKCPKCKSTVLLDFLHQDVSAATTAPADITKRNKTWWNFFV

SEQ ID NO: 1845 - protein, 99 aa, Arabidopsis thaliana
  misc_feature (1)..(99): Ceres CLONE ID no. 104017
  misc_feature: Utility: Useful for making ornamental plants with modified color
  misc_feature: Utility: Useful for making ornamental plants with modified leaves
  misc_feature: Utility: Useful for making plants sterile and for genetic confinement
  misc_feature: Utility: Useful for making plants with increased biomass and foliage
  misc_feature: Utility: Useful for making stronger plants
MVRSPSRSATTSPTSPPSSCVSSEMNQDEPSVRYSTSPETTSMVLVGCPRCLMYVMLSEDDPKCPKCKSTVLLDFLHENATNANANAAAASSGRKTRRN

SEQ ID NO: 1846 - protein, 122 aa, Arabidopsis thaliana
  misc_feature (1)..(122): Public GI no. 21536580
  misc_feature: Utility: Useful for making ornamental plants with modified color
  misc_feature: Utility: Useful for making ornamental plants with modified leaves
  misc_feature: Utility: Useful for making plants sterile and for genetic confinement
  misc_feature: Utility: Useful for making plants with increased biomass and foliage
  misc_feature: Utility: Useful for making stronger plants
MSRRSPKLELKLNLSPPTSSQRRMVRSPSRSATTSPTSPPSSCVSSEMNQDEPSVRYSTSPETTSMVLVGCPRCLMYVMLSEDDPKCPKCKSTVLLDFLHENATNANANAAAASSGRKTRRN

SEQ ID NO: 1847 - protein, 118 aa, Brassica napus
  misc_feature (1)..(118): Ceres CLONE ID no. 946814
  misc_feature: Utility: Useful for making ornamental plants with modified color
  misc_feature: Utility: Useful for making ornamental plants with modified leaves
  misc_feature: Utility: Useful for making plants sterile and for genetic confinement
  misc_feature: Utility: Useful for making plants with increased biomass and foliage
  misc_feature: Utility: Useful for making stronger plants
MSRRNRSGPKLELKLNLSPPPSQGEQMSMVRSPSRSNTASPNSCVSSEPSQEEMETPISMVLVGCPRCLMYVMLSQDEPKCPKCKSTVLLDFFHENASVDTTAPAVTTKRNKSLITNI

SEQ ID NO: 1848 - protein, 93 aa, Arabidopsis thaliana
  misc_feature (1)..(93): Ceres CLONE ID no. 35419
  misc_feature: Utility: Useful for making ornamental plants with modified color
  misc_feature: Utility: Useful for making ornamental plants with modified leaves
  misc_feature: Utility: Useful for making plants sterile and for genetic confinement
  misc_feature: Utility: Useful for making plants with increased biomass and foliage
  misc_feature: Utility: Useful for making stronger plants
MNQEAASNLGLDLKLNISPSLDSSLLTESSSSSLCSEEAEGGGGEAKSMVVVGCPNCIMYIITSLENDPRCPRCNSHVLLDFLTGNHSKKSTS

SEQ ID NO: 1849 - protein, 93 aa, Arabidopsis thaliana; identical to SEQ ID NO: 1848
  misc_feature (1)..(93): Public GI no. 20466099
  misc_feature: Utility: Useful for making ornamental plants with modified color
  misc_feature: Utility: Useful for making ornamental plants with modified leaves
  misc_feature: Utility: Useful for making plants sterile and for genetic confinement
  misc_feature: Utility: Useful for making plants with increased biomass and foliage
  misc_feature: Utility: Useful for making stronger plants

SEQ ID NO: 1850 - protein, 93 aa, Arabidopsis thaliana
  misc_feature (1)..(93): Public GI no. 21593032
  misc_feature: Utility: Useful for making ornamental plants with modified color
  misc_feature: Utility: Useful for making ornamental plants with modified leaves
  misc_feature: Utility: Useful for making plants sterile and for genetic confinement
  misc_feature: Utility: Useful for making plants with increased biomass and foliage
  misc_feature: Utility: Useful for making stronger plants
MNQEAASNLGLDLKLNISPSLDSSLLTESSLSSLCSEEAEGGGGEAKSMVVVGCPNCIMYIITSLENDPRCPRCNSHVLLDFLTGNHSKKSTS

SEQ ID NO: 1851 - protein, 85 aa, Zea mays
  misc_feature (1)..(85): Ceres CLONE ID no. 1276697
  misc_feature: Utility: Useful for making ornamental plants with modified color
  misc_feature: Utility: Useful for making ornamental plants with modified leaves
  misc_feature: Utility: Useful for making plants sterile and for genetic confinement
  misc_feature: Utility: Useful for making plants with increased biomass and foliage
  misc_feature: Utility: Useful for making stronger plants
MADEESSPSSCLSSENEHGLQWSNSPEATSMVLAACPRCFIYVMLPQDDPRCPQCKSPVLLDFLQDNNNNSKNNSNNSSRRSRRG

SEQ ID NO: 1852 - protein, 115 aa, Zea mays
  misc_feature (1)..(115): Ceres CLONE ID no. 988038
  misc_feature: Utility: Useful for making ornamental plants with modified color
  misc_feature: Utility: Useful for making ornamental plants with modified leaves
  misc_feature: Utility: Useful for making plants sterile and for genetic confinement
  misc_feature: Utility: Useful for making plants with increased biomass and foliage
  misc_feature: Utility: Useful for making stronger plants
MSRSNRKSSRGLDLKLNLSLPATGDSSRRAMADEESSPSSCLSSENEHGLQWSNSPEATSMVLAACPRCFIYVMLPQDDPRCPQCKSPVLLDFLQDNNNNSKNNSNNSSRRSRRG

SEQ ID NO: 1853 - protein, 84 aa, Triticum aestivum
  misc_feature (1)..(84): Ceres CLONE ID no. 631994
  misc_feature: Utility: Useful for making ornamental plants with modified color
  misc_feature: Utility: Useful for making ornamental plants with modified leaves
  misc_feature: Utility: Useful for making plants sterile and for genetic confinement
  misc_feature: Utility: Useful for making plants with increased biomass and foliage
  misc_feature: Utility: Useful for making stronger plants
MADEESSPSSCLSSENEHGLQWSNSPEATSMVLAACPRCFIYVMLPQDDPRCPQCKSPVLLDFLQDSGNNNNNTNSNSRKSRRG

SEQ ID NO: 1854 - protein, 83 aa, Zea mays
  misc_feature (1)..(83): Ceres CLONE ID no. 457248
  misc_feature: Utility: Useful for making ornamental plants with modified color
  misc_feature: Utility: Useful for making ornamental plants with modified leaves
  misc_feature: Utility: Useful for making plants sterile and for genetic confinement
  misc_feature: Utility: Useful for making plants with increased biomass and foliage
  misc_feature: Utility: Useful for making stronger plants
MVMADEESSPSSCLSSENEHGLQWSNSPEATSMVLAACPRCFIYVMLPQDDPWCPQCKSPVLLDFLQDNSNNSNNSSRRSRKG

SEQ ID NO: 1855 - protein, 111 aa, Zea mays
  misc_feature (1)..(111): Ceres CLONE ID no. 370255
  misc_feature: Utility: Useful for making ornamental plants with modified color
  misc_feature: Utility: Useful for making ornamental plants with modified leaves
  misc_feature: Utility: Useful for making plants sterile and for genetic confinement
  misc_feature: Utility: Useful for making plants with increased biomass and foliage
  misc_feature: Utility: Useful for making stronger plants
MSRSNKKSSRGLDLKLNLSLPATGDSSGMVMADEESSPSSCLSSENEHGLQWSNSPEATSMVLAACPRCFIYVMLPQDDPWCPQCKSPVLLDFLQDNSNNSNNSSRRSRKG

SEQ ID NO: 1856 - protein, 68 aa, Triticum aestivum
  misc_feature (1)..(68): Ceres CLONE ID no. 938645
  misc_feature: Utility: Useful for making ornamental plants with modified color
  misc_feature: Utility: Useful for making ornamental plants with modified leaves
  misc_feature: Utility: Useful for making plants sterile and for genetic confinement
  misc_feature: Utility: Useful for making plants with increased biomass and foliage
  misc_feature: Utility: Useful for making stronger plants
MEVDGHNDSGSSSPSSCVSSDGSPGSKSPMVIGACTRCLMYCMVAKKDYPTCINCKQPCLVDLLQNGG

SEQ ID NO: 1857 - protein, 85 aa, Triticum aestivum
  misc_feature (1)..(85): Ceres CLONE ID no. 685517
  misc_feature: Utility: Useful for making ornamental plants with modified color
  misc_feature: Utility: Useful for making ornamental plants with modified leaves
  misc_feature: Utility: Useful for making plants sterile and for genetic confinement
  misc_feature: Utility: Useful for making plants with increased biomass and foliage
  misc_feature: Utility: Useful for making stronger plants
MEVDGHDDSGSSSPSSCVSSDGSPGSKSPMVIGACTRCLMYCMVAKKDYPTCINCKQPCLVDLLQNGGAGAGASGDGDKKRGKRK

SEQ ID NO: 1858 - protein, 83 aa, Zea mays
  misc_feature (1)..(83): Ceres CLONE ID no. 395326
  misc_feature: Utility: Useful for making ornamental plants with modified color
  misc_feature: Utility: Useful for making ornamental plants with modified leaves
  misc_feature: Utility: Useful for making plants sterile and for genetic confinement
  misc_feature: Utility: Useful for making plants with increased biomass and foliage
  misc_feature: Utility: Useful for making stronger plants
MVMADEESSPSSCLSSENEHGLQWSNSPEATSMVLAACPRCFIYVMLPQDDPWCPQCNSPVLLDFLQDNSNNSNNSSRRSRKG

SEQ ID NO: 1859 - protein, 116 aa, Zea mays
  misc_feature (1)..(116): Public GI no. 50924115
  misc_feature: Utility: Useful for making ornamental plants with modified color
  misc_feature: Utility: Useful for making ornamental plants with modified leaves
  misc_feature: Utility: Useful for making plants sterile and for genetic confinement
  misc_feature: Utility: Useful for making plants with increased biomass and foliage
  misc_feature: Utility: Useful for making stronger plants
MSRSNKKSSRGIDLKLNLSLPARGDSSSRRAMAADEESSPSSCLSSENEHGLQWSNSPEATSMVLAACPRCFIYVMLPQDDPRCPQCKSPVILDFLQQDNGNNNANSNSSRKTRRG

SEQ ID NO: 1860 - DNA, 820 bp, Arabidopsis thaliana
  misc_feature (1)..(820): Ceres CLONE ID no. 21563
  misc_feature (1)..(820): Also known as  Ceres CDNA ID no. 23462620
aatcaaatcaaatctgtgtttcattctcttctccactgaaacgcgtttgaaggagaagggtcaaagggatctgatcctatcactttcgctgggaaaaacacgaaatcgaaggaagaatcaatcatgggtttcatcggataaactgtagattccatcaaatctatcaagatccgtcaagttctcactcaggctatcactctcggtatgatcgttacatctgcattgataatttggaaggcattgatatgtgtcactggcagtgaatcaccagtggttgttgttctctctgaaagtatggaacctggctttcagagaggagatatattgttcttgcggatgactgatgagcctattcgagcaggcgagattgttgtgttcagtgttgatggtcgtgaaattcccattgttcatcgagcaatcaaagttcatgagagaggagatactaaagcagttgatgttctaacaaaaggtgacaacaatgacattgatgacattggtctctatgctgaaggacagctttggcttcacaggcatcatatcatgggcagagctgttggattcttgccttatgttggatgggttactattatcatgacagaaaagcctatcatcaagtatatactcattggtgcattgggtttgctcgttataacatcgaaagactaagactacataacaagctggtcgttggtaaggaggtagcttctgcaacgctcgggtcatcatctttgtagccatcatctttgaaactgtagaatcatataaacctcaacttataattatagacacttttatctttaaatcagctacgttttgtggc

SEQ ID NO: 1861 - protein, 153 aa, Arabidopsis thaliana
  misc_feature (25)..(97): Pfam Name: Peptidase_S24; Pfam Description: Peptidase S24-like
  misc_feature: Utility: Useful for making ornamental plants with modified flowers
  misc_feature: Utility: Useful for making plants with increased biomass and foliage
  misc_feature: Utility: Useful for making smaller plants
MIVTSALIIWKALICVTGSESPVVVVLSESMEPGFQRGDILFLRMTDEPIRAGEIVVFSVDGREIPIVHRAIKVHERGDTKAVDVLTKGDNNDIDDIGLYAEGQLWLHRHHIMGRAVGFLPYVGWVTIIMTEKPIIKYILIGALGLLVITSKD

SEQ ID NO: 1862 - protein, 153 aa, Arabidopsis thaliana
  misc_feature (1)..(153): Ceres CLONE ID no. 103157
  misc_feature: Utility: Useful for making ornamental plants with modified flowers
  misc_feature: Utility: Useful for making plants with increased biomass and foliage
  misc_feature: Utility: Useful for making smaller plants
MIVTSALIIWKALMCVTGSESPVVVVLSGSMEPGFKRGDILFLHMSKDPIRAGEIVVFNVDGRDIPIVHRVIKVHERENTGEVDVLTKGDNNYGDDRLLYAEGQLWLHRHHIMGRAVGFLPYVGWVTIIMTEKPIIKYILIGALGLLVITSKD

SEQ ID NO: 1863 - protein, 180 aa, Glycine max
  misc_feature (1)..(180): Ceres CLONE ID no. 528914
  misc_feature: Utility: Useful for making ornamental plants with modified flowers
  misc_feature: Utility: Useful for making plants with increased biomass and foliage
  misc_feature: Utility: Useful for making smaller plants
MGWIGETVDSIKSLQIRQVLTQAVSLGMIVTSALIIWKALMCVTGSESPVVVVLSGSMEPGFKRGDILFLHMSKDPIRAGEIVVFNVDGREIPIVHRVIKVHEREDTGEVDVLTKGDNNYGDDRLLYAHGQLWLQRHHIMGRAVGFLPYVGWVTIIMTEKPIIKYILIGALGLLVITSKD

SEQ ID NO: 1864 - protein, 180 aa, Glycine max
  misc_feature (1)..(180): Public GI no. 20465737
  misc_feature: Utility: Useful for making ornamental plants with modified flowers
  misc_feature: Utility: Useful for making plants with increased biomass and foliage
  misc_feature: Utility: Useful for making smaller plants
MGWIGETVDSIKSIQIRQLFTQAISLGMIVTSALIIWKALMCVTGSESPVVVVLSGSMEPGFKRGDILFLHMSKDPIRAGEIVVFNVDGRDIPIVHRVIKVHERENTGEVDVLTKGDNNYGDDRLLYAEGQLWLHRHHIMGRAVGFLPYVGWVTIIMTEKPIIKYILIGALGLLVITSKD

SEQ ID NO: 1865 - protein, 180 aa, Glycine max
  misc_feature (1)..(180): Public GI no. 62318522
  misc_feature: Utility: Useful for making ornamental plants with modified flowers
  misc_feature: Utility: Useful for making plants with increased biomass and foliage
  misc_feature: Utility: Useful for making smaller plants
MGWIGETVDSIKSIQIRQLFTQAISLGMIVTSALIIWKALMCVTGSESPVVVVLSGSMEPGFKRGDILFLHMSKDPVRAGEIVVFNVDGRDIPIVHRVIKVHERENTGEVDVLTKGDNNYGDDRLLYAEGQLWLHRHHIMGRAVGFLPYVGWVTIIMTEKPIIKYILIGALGLLVITSKD

SEQ ID NO: 1866 - protein, 180 aa, Glycine max
  misc_feature (1)..(180): Public GI no. 55296017
  misc_feature: Utility: Useful for making ornamental plants with modified flowers
  misc_feature: Utility: Useful for making plants with increased biomass and foliage
  misc_feature: Utility: Useful for making smaller plants
MGFIGDTIESIRSMQVRQVLAQIISLGMIVTSALIIWKGLIVVTGSESPVVVVLSGSMEPGFKRGDILFLHMSKDPIRTGEIVVFNVDGREIPIVHRVIKVHERQESAEVDILTKGDNNFGDDRLLYAHGQLWLQQHHIMGRAVGFLPYVGWVTIIMTEKPIIKYLLIGALGLLVITSKE

SEQ ID NO: 1867 - protein, 162 aa, Zea mays
  misc_feature (1)..(162): Ceres CLONE ID no. 1589040
  misc_feature: Utility: Useful for making ornamental plants with modified flowers
  misc_feature: Utility: Useful for making plants with increased biomass and foliage
  misc_feature: Utility: Useful for making smaller plants
  misc_feature (140)..(140): Xaa is any aa, unknown, or other
MQIRPVVAQIITLGMILTSALILWKGFVVVTGSESPVVVVLSGSMEPGFRKGDVLFLHMNKDPVRTGDIVVFNVEGRDIPIVHRVIKVHERHDTVDSDILTKGDNNPGDDRVLYAHGQLWLQRQHIIGRGCGYLPYAGWXTIVMTEKPVPQYLLMVHWGCWW

SEQ ID NO: 1868 - DNA, 914 bp, Arabidopsis thaliana
  misc_feature (1)..(914): Ceres CLONE ID no. 6397
  misc_feature (1)..(914): Also known as  Ceres CDNA ID no. 23373703
acttcattagtctccaagaagaaaacatctctcactctctaaaatacacactctcatcaaaaaccttctcttcggttcagaagcattcaagaatccattatgagctcatctgattccgttaataacggcgttaactcacggatgtacttccgtaacccgagtttcagcaacgttatcttaaacgataactggagcgacttgccgttaagtgtcgacgattctcaagacatggctatttacaacactctccgtgatgccgttagctccgcctggacaccatccgttcctcccgttacctctccggcggaggaagataagcctccggcgacgaaggcgagtggctcacacgcgccgaggcagaaggggatgcagtacagaggagtgaggaggaggccgtgggggaaattcgcggcggagattagggatccgaagaagaacggagctagggtttggctcgggacttacgagacgccggaggacgcggcggtggcgtacgaccgagcggcgtttcagctcagaggatcgaaagctaagctgaattttccgcatttgattggttcttgtaagtatgagccggttaggattaggcctcgccgtcgctcgccggaaccgtcagtctccgatcagttaacgtcggagcagaagagggaaagccacgtggatgacggcaagtctagtttggttgtaccggagttggatttcacggtggatcagttttacttcgatggtagtttattaatggaccaatcagaatgttcttattctgataatcggatataattagttttaagattaagcaaaatttgtccaacgagttttgctgtatgaaatatctatcgatgactcaacaggttttgatcatgatcatatgtaatgtgatggaaattaaatattgacgtttgtttttttcttcc

SEQ ID NO: 1869 - protein, 226 aa, Arabidopsis thaliana
  misc_feature (90)..(154): Pfam Name: AP2; Pfam Description: AP2 domain
  misc_feature: Utility: Useful for making ornamental plants with modified flowers
  misc_feature: Utility: Useful for making plants sterile and for genetic confinement
MSSSDSVNNGVNSRMYFRNPSFSNVILNDNWSDLPLSVDDSQDMAIYNTLRDAVSSAWTPSVPPVTSPAEEDKPPATKASGSHAPRQKGMQYRGVRRRPWGKFAAEIRDPKKNGARVWLGTYETPEDAAVAYDRAAFQLRGSKAKLNFPHLIGSCKYEPVRIRPRRRSPEPSVSDQLTSEQKRESHVDDGKSSLVVPELDFTVDQFYFDGSLLMDQSECSYSDNRI

SEQ ID NO: 1870 - protein, 237 aa, Arabidopsis thaliana
  misc_feature (1)..(237): Public GI no. 57012876
  misc_feature: Utility: Useful for making ornamental plants with modified flowers
  misc_feature: Utility: Useful for making plants sterile and for genetic confinement
MYQPISTEFPVYHRTSSFSSLMPCLTDTWGDLPLKVDDSEDMVIYGLLSDALTTGWTPFNLTSTEIKAEPREEIEPATSPVPSVAPPAETTTAQAVVPKGRHYRGVRQRPWGKFAAEIRDPAKNGARVWLGTYETAEEAALAYDKAAYRMRGSKALLNFPHRIGLNEPEPVRLTVKRRSPEPASSSISPASENSLPKRRRKAVAAKQAELEVQSRSNVMQVGCQMEQFPVGEQLLVS

SEQ ID NO: 1871 - protein, 234 aa, Arabidopsis thaliana
  misc_feature (1)..(234): Public GI no. 3342211
  misc_feature: Utility: Useful for making ornamental plants with modified flowers
  misc_feature: Utility: Useful for making plants sterile and for genetic confinement
MDQQLPPTNFPVDFPVYRRNSSFSRLIPCLTEKWGDLPLKVDDSEDMVIYGLLKDALSVGWSPFNFTAGEVKSEPREEIESSPEFSPSPAETTAAPAAETPKGRHYRGVRQRPWGKFAAEIRDPAKNGARVWLGTYETAEEAAIAYDKAAYRMRGSKAHLNFPHRIGLNEPEPVRVTAKRRASPEPASSSGNGSMKRRRKAVQKCDGEMASRSSVMQVGCQIEQLTGVHQLLVI

SEQ ID NO: 1872 - DNA, 1139 bp, Arabidopsis thaliana
  misc_feature (1)..(1139): Ceres CLONE ID no. 14555
  misc_feature (1)..(1139): Also known as  Ceres CDNA ID no. 23396049
aattttgaattgagcgaggtttcaaagttcaaaactatcacaactagtcttgatcaattctatataagatctgtgatcttggttgaagaaaagaatcgtcgtaggttgatatttaacaaggaatggcaaaggaagggggcttgggagagaactcaagatggagtcttggaggcatgaccgctcttgtcactggtggctctaaaggcatcggggaagctgtggtggaggaactagccatgttgggagcaaaagtccacacgtgtgccagagacgaaactcagcttcaagaacgcttacgtgaatggcaagcaaaagggtttcaggtcaccacttctgtctgcgacgtctcttctcgtgaccaacgagtgaaactcatggaaactgtttcctctctctaccaaggaaaactcaacatcctcgtcaacaatgtgggaacgtcaatattcaagccgaccacagagtatacagcagaagatttctcttttgtaatggctacaaatctcgagtcagctttccatctctcacagcttgcccacccattgttaaaagcctctggctcagggagcatcgtgctcatatcctctgctgctggagtcgtgcatgtcaatgttggatccatctatggagcaaccaaaggagccatgaatcagctggctagaaacttagcttgcgaatgggcgagcgacaacataaggacgaactctgtttgtccttggtatatcacaactcctttaagtaacgattttttcgatgaagagtttaagaaagaagcggtgcgtacgacaccaatggggcgtgttggagaagcaaatgaagtctcaccgcttgtggcatttctttgtcttccttcagcttcttatattactggtcagaccatttgcgttgacggcggtgccactgttaacggtttttccttcaagactatgccataaaacacatatgcatgtgtttggatcatattttcaataatttaaacttacgggttatatacatcgtcaatatgtaataaatgtaatttagatgtgtccacatgttctgtttctaagagattcttagatatttatgcttgcgtggtgaacaagagttcactctccggatggaccgcatccataatctatgaatttgggaattatattacc

SEQ ID NO: 1873 - protein, 269 aa, Arabidopsis thaliana
  misc_feature (18)..(186): Pfam Name: adh_short; Pfam Description: short chain dehydrogenase
  misc_feature: Utility: Useful for making ornamental plants with modified flowers
  misc_feature: Utility: Useful for making plants with altered leaf shape eg curled leaves
  misc_feature: Utility: Useful for making plants with increased biomass
  misc_feature: Utility: Useful for making plants with increased biomass and foliage
  misc_feature: Utility: Useful for making shorter plants and plants with modified flowers
  misc_feature: Utility: Useful for making smaller plants
  misc_feature: Utility: Useful for modifying plant architecture, ie amount of  branching
MAKEGGLGENSRWSLGGMTALVTGGSKGIGEAVVEELAMLGAKVHTCARDETQLQERLREWQAKGFQVTTSVCDVSSRDQRVKLMETVSSLYQGKLNILVNNVGTSIFKPTTEYTAEDFSFVMATNLESAFHLSQLAHPLLKASGSGSIVLISSAAGVVHVNVGSIYGATKGAMNQLARNLACEWASDNIRTNSVCPWYITTPLSNDFFDEEFKKEAVRTTPMGRVGEANEVSPLVAFLCLPSASYITGQTICVDGGATVNGFSFKTMP

SEQ ID NO: 1874 - protein, 253 aa, Arabidopsis thaliana
  misc_feature (1)..(253): Ceres CLONE ID no. 1339647
  misc_feature: Utility: Useful for making ornamental plants with modified flowers
  misc_feature: Utility: Useful for making plants with altered leaf shape eg curled leaves
  misc_feature: Utility: Useful for making plants with increased biomass
  misc_feature: Utility: Useful for making plants with increased biomass and foliage
  misc_feature: Utility: Useful for making shorter plants and plants with modified flowers
  misc_feature: Utility: Useful for making smaller plants
  misc_feature: Utility: Useful for modifying plant architecture, ie amount of  branching
MNALVTGGTKGIGEAVVEELSILGARVHTCARDETQLQERLREWQEKGFQVTTSICDVSLREQREKLMETVSSLFQGKLNILVNNVGTLMLKPTTEYTAEEFSFLMATNLDSAFHISQLAHPLLKASGSGSIVLMSSIAGVVHVGVGSIYGATKGAMNQLARNLACEWASDNIRTNAICPWLITTPLISDLLSVEEMKKEAEERTPMGRVGEANEVSPLVAFLCLPAASYITGQVICVDGGLTVNGFSYQPHA

SEQ ID NO: 1875 - protein, 262 aa, Arabidopsis thaliana
  misc_feature (1)..(262): Public GI no. 34146804
  misc_feature: Utility: Useful for making ornamental plants with modified flowers
  misc_feature: Utility: Useful for making plants with altered leaf shape eg curled leaves
  misc_feature: Utility: Useful for making plants with increased biomass
  misc_feature: Utility: Useful for making plants with increased biomass and foliage
  misc_feature: Utility: Useful for making shorter plants and plants with modified flowers
  misc_feature: Utility: Useful for making smaller plants
  misc_feature: Utility: Useful for modifying plant architecture, ie amount of  branching
MDKRWSLQGMNALVTGGTKGIGEAVVEELSILGARVHTCARDETQLQERLREWQEKGFQVTTSICDVSLREQREKLMETVSSLFQGKLNILVNNVGTLMLKPTTEYTAEEFSFLMATNLDSAFHISQLAHPLLKASGSGSIVLMSSIAGVVHVGVGSIYGATKGAMNQLARNLACEWASDNIRTNAICPWLITTPLISDLLSVEEMKKEAEERTPMGRVGEANEVSPLVAFLCLPAASYITGQVICVDGGLTVNGFSYQPHA

SEQ ID NO: 1876 - protein, 268 aa, Arabidopsis thaliana
  misc_feature (1)..(268): Public GI no. 3980415
  misc_feature: Utility: Useful for making ornamental plants with modified flowers
  misc_feature: Utility: Useful for making plants with altered leaf shape eg curled leaves
  misc_feature: Utility: Useful for making plants with increased biomass
  misc_feature: Utility: Useful for making plants with increased biomass and foliage
  misc_feature: Utility: Useful for making shorter plants and plants with modified flowers
  misc_feature: Utility: Useful for making smaller plants
  misc_feature: Utility: Useful for modifying plant architecture, ie amount of  branching
MAKAEENLRDKCRWSLGGMTALVTGGSKGLGEAVVEELAMLGARVHTCARNETQLQECVREWQAKGFEVTTSVCDVSSRDQREKLMENVASIFQGKLNILVNNAGTGITKPTTEYTAQDYSFLMATNLDSAFHLSQLAHPLLKASGSGSIVLMSSTAGVVHINVGSIYGATKGAMNQLAKNLACEWARDNIRVNSVCPWFIATPLYLNDEELKKEVERKTPMGRVGNANEVSSLVAFLCFPAASYITGQTICVDGGFTVNCFSFKPVL

SEQ ID NO: 1877 - protein, 253 aa, Arabidopsis thaliana
  misc_feature (1)..(253): Ceres CLONE ID no. 2618
  misc_feature: Utility: Useful for making ornamental plants with modified flowers
  misc_feature: Utility: Useful for making plants with altered leaf shape eg curled leaves
  misc_feature: Utility: Useful for making plants with increased biomass
  misc_feature: Utility: Useful for making plants with increased biomass and foliage
  misc_feature: Utility: Useful for making shorter plants and plants with modified flowers
  misc_feature: Utility: Useful for making smaller plants
  misc_feature: Utility: Useful for modifying plant architecture, ie amount of  branching
MTALVTGGSKGIGEAVVEELATLGARIHTCARDETQLQESLRKWQAKGFQVTTSVCDVSSRDKREKLMETVSTIFEGKLNILVNNVGTCIVKPTLQHTAEDFSFTMATNLESAFHLSQLAHPLLKASGSGSIVLISSVSGVVHVNGASIYGVSKGAMNQLGRNLACEWASDNIRTNSVCPWFIETPLVTESLSNEEFRKEVESRPPMGRVGEVNEVSSLVAFLCLPAASYITGQTICVDGVFTVNGFSFKPLP

SEQ ID NO: 1878 - protein, 271 aa, Arabidopsis thaliana
  misc_feature (1)..(271): Public GI no. 3980399
  misc_feature: Utility: Useful for making ornamental plants with modified flowers
  misc_feature: Utility: Useful for making plants with altered leaf shape eg curled leaves
  misc_feature: Utility: Useful for making plants with increased biomass
  misc_feature: Utility: Useful for making plants with increased biomass and foliage
  misc_feature: Utility: Useful for making shorter plants and plants with modified flowers
  misc_feature: Utility: Useful for making smaller plants
  misc_feature: Utility: Useful for modifying plant architecture, ie amount of  branching
MAKTGESLRDKPRWSLVGMTALVTGGSKGIGEAVVEELATLGARIHTCARDETQLQESLRKWQAKGFQVTTSVCDVSSRDKREKLMETVSTIFEGKLNILVNNVGTCIVKPTLQHTAEDFSFTMATNLESAFHLSQLAHPLLKASGSGSIVLISSVSGVVHVNGASIYGVSKGAMNQLGRNLACEWASDNIRTNSVCPWFIETPLVTESLSNEEFRKEVESRPPMGRVGEVNEVSSLVAFLCLPAASYITGQTICVDGGFTVNGFSFKPLP

SEQ ID NO: 1879 - protein, 271 aa, Arabidopsis thaliana
  misc_feature (1)..(271): Public GI no. 21554716
  misc_feature: Utility: Useful for making ornamental plants with modified flowers
  misc_feature: Utility: Useful for making plants with altered leaf shape eg curled leaves
  misc_feature: Utility: Useful for making plants with increased biomass
  misc_feature: Utility: Useful for making plants with increased biomass and foliage
  misc_feature: Utility: Useful for making shorter plants and plants with modified flowers
  misc_feature: Utility: Useful for making smaller plants
  misc_feature: Utility: Useful for modifying plant architecture, ie amount of  branching
MAKTGESLRDKPRWSLVGMTALVTGGSKGIGEAVVEELATLGARIHTCARDETQLQESLRKWQAKGFQVTTSVCDVSSRDKREKLMETVSTIFEGKLNILVNNVGTCIVKPTLQHTAEDFSFTMATNLESAFHLSQLAHPLLKASGSGSIVLISSVSGVVHVNGASIYGVSKGAMNQLGRNLACEWASDNIRTNSVCPWFIETPLVTESLSNEEFRKEVESRPPMGRVGEVNEVSSLVAFLCLPAASYITGQTICVDGVFTVNGFSFKPLP

SEQ ID NO: 1880 - protein, 250 aa, Glycine max
  misc_feature (1)..(250): Ceres CLONE ID no. 480984
  misc_feature: Utility: Useful for making ornamental plants with modified flowers
  misc_feature: Utility: Useful for making plants with altered leaf shape eg curled leaves
  misc_feature: Utility: Useful for making plants with increased biomass
  misc_feature: Utility: Useful for making plants with increased biomass and foliage
  misc_feature: Utility: Useful for making shorter plants and plants with modified flowers
  misc_feature: Utility: Useful for making smaller plants
  misc_feature: Utility: Useful for modifying plant architecture, ie amount of  branching
MTALVTGGSKGIGYAIVEELAQLGATVHTCARNEAELNESLNEWNTKGYRVTGSVCDVASRAERQDLIARVSNEFNGKLNILVNNVGTNVPKHTLDVTEEDFSFLINTNLESAYHLSQLAHPLLKASEAANIIFISSIAGVLSIGIGSTYGATKGAMNQLTKNLACEWAKDNIRTNCVAPGPIKTPLGDKHFKNEKLLNAFISQTPLGRIGEAEEVSSLVAFLCLPAASYITGQTICVDGGLTVNGLYIN

SEQ ID NO: 1881 - protein, 251 aa, Glycine max
  misc_feature (1)..(251): Ceres CLONE ID no. 1371320
  misc_feature: Utility: Useful for making ornamental plants with modified flowers
  misc_feature: Utility: Useful for making plants with altered leaf shape eg curled leaves
  misc_feature: Utility: Useful for making plants with increased biomass
  misc_feature: Utility: Useful for making plants with increased biomass and foliage
  misc_feature: Utility: Useful for making shorter plants and plants with modified flowers
  misc_feature: Utility: Useful for making smaller plants
  misc_feature: Utility: Useful for modifying plant architecture, ie amount of  branching
MTALVTGGSKGIGYAIVEELAQLGATVHTCARNEAELNKSLNEWNTKGYRVTGSVCDVASRAERQDLIARVSNEFNGKLNILVNNVGTNIQKETLDFTEEDFTFLVNTNLESCFHLSQLAHPLLKASEAANIILISSIAGVVASNIVSVVYGATKGAMNQMTKHLACEWAKDNIRTNCVAPGPIRTPLGDKHFKEEKLNNSLIARTPLGRIGEAEEVSSLVAFLCLPAASYITGQTICVDGGFTVNGLYIS

SEQ ID NO: 1882 - DNA, 632 bp, Arabidopsis thaliana
  misc_feature (1)..(632): Ceres CLONE ID no. 4067
  misc_feature (1)..(632): Also known as  Ceres CDNA ID no. 23359077
cgtcttcgagattgatctgatttgctttgttgttttctttctgctacaagtagataaaaaatggcatggcgcagtgcagcacgctctttcgtctccgctacagctagagctccgtctctccgatctccgccgccaacgcttccccgcctccgtccttcccaatcctctttgccccgccgccgatttgcctctttcactaatcccaggaatttgggagagctaggatgcacagagtcattcttgcctctgtacaatgttgtggctgcagcgagactcacatctcaccttaatgttaatctgcgagctttctgcgaactctctaacggtacttgagaatgcacaaagtggatacatcagttatcttgcagcagttggagacttgagaaaaggggtgtaccaagaagaactcattggttgttttgtgttccattaggaaccaaaaactatatacattatttcgatcttacttcacttttgacaatttccagttttagaatatctggatttctcttcatatttcttgttgtttagcccaatggctttaaatacttgagggtagattcagcaaattcttgaagaaccattgtttcatcgttgtatttataatgttatgaactcccttcgggtttccc

SEQ ID NO: 1883 - protein, 90 aa, Arabidopsis thaliana
  misc_feature: Utility: Useful for making ornamental plants with modified flowers
  misc_feature: Utility: Useful for making plants sterile and for genetic confinement
  misc_feature: Utility: Useful for making plants with increased biomass and foliage
  misc_feature: Utility: Useful for making stronger plants
  misc_feature: Utility: Useful for making taller plants and plants with longer inflorescences
MAWRSAARSFVSATARAPSLRSPPPTLPRLRPSQSSLPRRRFASFTNPRNLGELGCTESFLPLYNVVAAARLTSHLNVNLRAFCELSNGT

SEQ ID NO: 1884 - protein, 90 aa, Brassica napus
  misc_feature (1)..(90): Ceres CLONE ID no. 1117707
  misc_feature: Utility: Useful for making ornamental plants with modified flowers
  misc_feature: Utility: Useful for making plants sterile and for genetic confinement
  misc_feature: Utility: Useful for making plants with increased biomass and foliage
  misc_feature: Utility: Useful for making stronger plants
  misc_feature: Utility: Useful for making taller plants and plants with longer inflorescences
  misc_feature (7)..(7): Xaa is any aa, unknown, or other
  misc_feature (8)..(8): Xaa is any aa, unknown, or other
MAWRSAXXAARSFVSATARAPSLRPPPATLPRLRPSQSSLPRRRFTNPRNLGELGCTQSLLPLHNVVASARLISHLNLNVRAFCELPNGT

SEQ ID NO: 1885 - protein, 94 aa, Brassica napus
  misc_feature (1)..(94): Ceres CLONE ID no. 873165
  misc_feature: Utility: Useful for making ornamental plants with modified flowers
  misc_feature: Utility: Useful for making plants sterile and for genetic confinement
  misc_feature: Utility: Useful for making plants with increased biomass and foliage
  misc_feature: Utility: Useful for making stronger plants
  misc_feature: Utility: Useful for making taller plants and plants with longer inflorescences
MAWRSAGSAARSFVSATARAPSLRPPPATLPRLRPSQSSLPRRRFTNPRNLGELGCTQSLLPLHNVVASARLISHLNLNVRAFCELPNGNGKDG

SEQ ID NO: 1886 - protein, 93 aa, Arabidopsis thaliana
  misc_feature (1)..(93): Ceres CLONE ID no. 41682
  misc_feature: Utility: Useful for making ornamental plants with modified flowers
  misc_feature: Utility: Useful for making plants sterile and for genetic confinement
  misc_feature: Utility: Useful for making plants with increased biomass and foliage
  misc_feature: Utility: Useful for making stronger plants
  misc_feature: Utility: Useful for making taller plants and plants with longer inflorescences
MAWRNAGSAARSFVSATARSPSLRSPTTALPRLRPPQSSLPSRRFTFSSPSRNLGALGCTQSFLPLYSVVATSQLTSHLNVNLRAFCELSNGT

SEQ ID NO: 1887 - protein, 101 aa, Arabidopsis thaliana
  misc_feature (1)..(101): Ceres CLONE ID no. 1345188
  misc_feature: Utility: Useful for making ornamental plants with modified flowers
  misc_feature: Utility: Useful for making plants sterile and for genetic confinement
  misc_feature: Utility: Useful for making plants with increased biomass and foliage
  misc_feature: Utility: Useful for making stronger plants
  misc_feature: Utility: Useful for making taller plants and plants with longer inflorescences
MAWRNAGSAARSFVSATARSPSLRSPTTALPRLRPPQSSLPSRRFTFSSPSRNLGALGCTQSFLPLYSVVATSQLTSHLNVNLRAFCELSNGTFQRTCQDR

SEQ ID NO: 1888 - protein, 93 aa, Arabidopsis thaliana; identical to SEQ ID NO: 1886
  misc_feature (1)..(93): Public GI no. 30679289
  misc_feature: Utility: Useful for making ornamental plants with modified flowers
  misc_feature: Utility: Useful for making plants sterile and for genetic confinement
  misc_feature: Utility: Useful for making plants with increased biomass and foliage
  misc_feature: Utility: Useful for making stronger plants
  misc_feature: Utility: Useful for making taller plants and plants with longer inflorescences

SEQ ID NO: 1889 - protein, 97 aa, Arabidopsis thaliana
  misc_feature (1)..(97): Public GI no. 21554019
  misc_feature: Utility: Useful for making ornamental plants with modified flowers
  misc_feature: Utility: Useful for making plants sterile and for genetic confinement
  misc_feature: Utility: Useful for making plants with increased biomass and foliage
  misc_feature: Utility: Useful for making stronger plants
  misc_feature: Utility: Useful for making taller plants and plants with longer inflorescences
MAWRNAGSAARSFVSATARSPSLRSPTTALPRLRPPQSSLPSRRFTFSSPSRNLGALGCTQSFLPLYSVVATSQLTSHLNVNLRAFCELSNGIGKDG

SEQ ID NO: 1890 - protein, 93 aa, Brassica napus
  misc_feature (1)..(93): Ceres CLONE ID no. 1090313
  misc_feature: Utility: Useful for making ornamental plants with modified flowers
  misc_feature: Utility: Useful for making plants sterile and for genetic confinement
  misc_feature: Utility: Useful for making plants with increased biomass and foliage
  misc_feature: Utility: Useful for making stronger plants
  misc_feature: Utility: Useful for making taller plants and plants with longer inflorescences
MAWRNAGSTARSFVSAAARAPSLRSPTAALPRLRPSPSSLPGRRSSFSLPSRNIGALGCTQSFLPLYSVVAASQLTSHLNVNLRAFCELSNGT

SEQ ID NO: 1891 - protein, 95 aa, Brassica napus
  misc_feature (1)..(95): Ceres CLONE ID no. 971413
  misc_feature: Utility: Useful for making ornamental plants with modified flowers
  misc_feature: Utility: Useful for making plants sterile and for genetic confinement
  misc_feature: Utility: Useful for making plants with increased biomass and foliage
  misc_feature: Utility: Useful for making stronger plants
  misc_feature: Utility: Useful for making taller plants and plants with longer inflorescences
MAWRNAGSTARSFVSAAARAPSLRSPTAALPRLRPSPSSLPGRRSSFSLPSRNIGALGCTQSFLPLYSVVAASQLTSHLNVNLRAFCELSNAIKR

SEQ ID NO: 1892 - protein, 93 aa, Brassica napus
  misc_feature (1)..(93): Ceres CLONE ID no. 966070
  misc_feature: Utility: Useful for making ornamental plants with modified flowers
  misc_feature: Utility: Useful for making plants sterile and for genetic confinement
  misc_feature: Utility: Useful for making plants with increased biomass and foliage
  misc_feature: Utility: Useful for making stronger plants
  misc_feature: Utility: Useful for making taller plants and plants with longer inflorescences
  misc_feature (37)..(37): Xaa is any aa, unknown, or other
  misc_feature (43)..(43): Xaa is any aa, unknown, or other
MAWRNARSAARSFAAATARAPSLRTPTTALPRLRPSXSSSPGXRFSFSSPSRNLGALGCTQSFLPLYSVVAASQLTSHLNVNLRAFCELPNGT

SEQ ID NO: 1893 - protein, 98 aa, Glycine max
  misc_feature (1)..(98): Ceres CLONE ID no. 719050
  misc_feature: Utility: Useful for making ornamental plants with modified flowers
  misc_feature: Utility: Useful for making plants sterile and for genetic confinement
  misc_feature: Utility: Useful for making plants with increased biomass and foliage
  misc_feature: Utility: Useful for making stronger plants
  misc_feature: Utility: Useful for making taller plants and plants with longer inflorescences
MAFRSGSLSRSLMSTARASLRPAAPSSTLPRLRPPPLAAPRVQSRRFSMPASRNLGQLGCTHSLLPLGITCMTSHIAVSARACCELSHGTFRRSCQDR

SEQ ID NO: 1894 - protein, 89 aa, Glycine max
  misc_feature (1)..(89): Ceres CLONE ID no. 708048
  misc_feature: Utility: Useful for making ornamental plants with modified flowers
  misc_feature: Utility: Useful for making plants sterile and for genetic confinement
  misc_feature: Utility: Useful for making plants with increased biomass and foliage
  misc_feature: Utility: Useful for making stronger plants
  misc_feature: Utility: Useful for making taller plants and plants with longer inflorescences
MAWRCGSLSRSVLSAARTIPTRSSISPLSPSLRSHLLHSRRPLNTLPRTVGILVCTHSLMPLHSADASARLTSHISVESRACCELSQGT

SEQ ID NO: 1895 - DNA, 712 bp, Arabidopsis thaliana
  misc_feature (1)..(712): Ceres CLONE ID no. 4734
  misc_feature (1)..(712): Also known as  Ceres CDNA ID no. 23384140
aatatttgaagtgtattcaaaaccccaaaacacttttctcattctcttctctattttcttcttgctctctagtttttctttcttcttggtcgtttcctttcagcataaaaaccttataaaatcataaaagcttacacctacttgccacatagacatagccgatctcattatatctctatttctatttctcaatagaacttgtttgagctagtgtgagagaagtaaagaaagagagaagaatccacaacttagttagggtcttttcttgccacattgttgaacatgtcgaacagaagatcaaggcaatcttcaagtgctccaaggatctccgataatcaaatgattgacctcgtatctaagctccgtcaaattttgccggagattggtcaacgacgtcgttctgataaggcatcagcctcgaaagtattgcaagagacatgcaattacatacgaaatttgaacagagaagttgacaatctgagcgagcgtttgtctcagcttctcgaatctgtcgatgaagatagccctgaagccgccgttattagaagcctactcatgtaatcttttttgttcttttgtttgtttttgacaagcctatccatgtaatcttaaatgatcgctctataataattatatttttaacataatcgtcttattatgtaaaattcaaagagatgggcttgatctttaatgacatacgaatttcataggg

SEQ ID NO: 1896 - protein, 92 aa, Arabidopsis thaliana
  misc_feature: Utility: Useful for making ornamental plants with modified flowers
  misc_feature: Utility: Useful for making plants with enhanced abiotic stress tolerance
MSNRRSRQSSSAPRISDNQMIDLVSKLRQILPEIGQRRRSDKASASKVLQETCNYIRNLNREVDNLSERLSQLLESVDEDSPEAAVIRSLLM

SEQ ID NO: 1897 - protein, 92 aa, Brassica napus
  misc_feature (1)..(92): Ceres CLONE ID no. 951040
  misc_feature: Utility: Useful for making ornamental plants with modified flowers
  misc_feature: Utility: Useful for making plants with enhanced abiotic stress tolerance
MSNRRSRQSSSAPRISDDQIIDLVTKLRQILPEIGQRRRSDKVSASKVLQETCNYIRNLNREVDNLSERLAQLLESVDEDSPQAAVIRSLLM

SEQ ID NO: 1898 - protein, 92 aa, Brassica napus
  misc_feature (1)..(92): Public GI no. 9294226
  misc_feature: Utility: Useful for making ornamental plants with modified flowers
  misc_feature: Utility: Useful for making plants with enhanced abiotic stress tolerance
MSNRRSRQTSNASRISDDQMIDLVSKLRQFLPEIHERRRSDKVSASKVLQETCNYIRKLHREVDNLSDRLSQLLDSVDEDSPEAAVIRSLLM

SEQ ID NO: 1899 - protein, 91 aa, Triticum aestivum
  misc_feature (1)..(91): Ceres CLONE ID no. 703180
  misc_feature: Utility: Useful for making ornamental plants with modified flowers
  misc_feature: Utility: Useful for making plants with enhanced abiotic stress tolerance
MSSRRSRQQSASTRISDDQIIDLVSKLRQLVPEIRDRRSDKVSASKVLQETCNYIRSLHREVDDLSERLSQLLATIDADSPEAAIIRSLIN

SEQ ID NO: 1900 - protein, 91 aa, Glycine max; identical to SEQ ID NO: 1899
  misc_feature (1)..(91): Ceres CLONE ID no. 560681
  misc_feature: Utility: Useful for making ornamental plants with modified flowers
  misc_feature: Utility: Useful for making plants with enhanced abiotic stress tolerance

SEQ ID NO: 1901 - DNA, 565 bp, Arabidopsis thaliana
  misc_feature (1)..(565): Ceres CLONE ID no. 13391
  misc_feature (1)..(565): Also known as  Ceres CDNA ID no. 23396186
atttcaagctcagaccaaactaaacaaactcgtctacatttgaagaactcaaaaacaagatcaaagaaggaagatcattaatggcggaaccaaaacaaagctctctttctgaggtgaagacaaatgtgattggaagcagaaaagaagagaaggaatcgatgtttcatgggaaagagactcatggaagaagtgaagacattgatgagaagacaagggttgatgatgttaaaggacctggtgttctcgggcgtatgatggaagaaatggaagccattgttgacgctgttactcctaacaaaagttctgacaagtaaaatgattagtatcgtttctagttcctaagatccggtcacaaactatatacttctgttgtaagaactgtaaccaccccctttgcttaataaagacacgagcttttagattcttgacaacaccatatctatagatttcaatgaagagattaagaacacaaaatcaaaagaatgactctctttttattagtctaggaaaattcctcaaaacctaaactctcaatgtattctacaactctctcaaaggctatgtt

SEQ ID NO: 1902 - protein, 77 aa, Arabidopsis thaliana
  misc_feature: Utility: Useful for making ornamental plants with modified flowers
  misc_feature: Utility: Useful for making plants sterile and for genetic confinement
  misc_feature: Utility: Useful for modifying plant architecture, ie amount of  branching
MAEPKQSSLSEVKTNVIGSRKEEKESMFHGKETHGRSEDIDEKTRVDDVKGPGVLGRMMEEMEAIVDAVTPNKSSDK

SEQ ID NO: 1903 - DNA, 671 bp, Arabidopsis thaliana
  misc_feature (1)..(671): Ceres CLONE ID no. 28643
  misc_feature (1)..(671): Also known as  Ceres CDNA ID no. 23371583
cttccaaagccgctgcgaaactcgtcgattttcaaaaccggagctcagagactgatctcggaaagtaaatcgcagccatggcggaaaaagctgtcactatcaagaccagaaacttcatgaccaacaggcttctcgccagaaagcaattcgttattgatgttcttcatcctggaagagccaatgtttcaaaggctgagcttaaggagaaattggcgaggatgtatgaggttaaggacccaaatgctatcttctgtttcaagttcagaactcactttggaggtggtaaatcttctggatatggtttgatctatgatactgtcgagaacgctaagaagtttgagcctaagtacagacttatcaggaatggacttgacaccaagattgagaaatcaaggaaacagatcaaggagaggaagaacagggcgaagaagatccgtggtgttaagaagaccaaggctggtgatgccaagaagaagtaagacgtttgaagaggacagaagcagcaatatggtttttgttctgcatcactcctttgaagccatgtttgctattagacatcttctaattatttctcgattttgtgcttctttttgtcacacttgctctattttggtttggatcttgttttagagaaacatgtggttaagattttgtttgaatacattgatttt

SEQ ID NO: 1904 - protein, 133 aa, Arabidopsis thaliana
  misc_feature (24)..(107): Pfam Name: Ribosomal_S24e; Pfam Description: Ribosomal protein S24e
  misc_feature (24)..(107): Pfam Name: Ribosomal_S24e; Pfam Description: Ribosomal protein S24e
  misc_feature: Utility: Useful for making ornamental plants with modified flowers
  misc_feature: Utility: Useful for making plants sterile and for genetic confinement
  misc_feature: Utility: Useful for making taller plants and plants with longer inflorescences
MAEKAVTIKTRNFMTNRLLARKQFVIDVLHPGRANVSKAELKEKLARMYEVKDPNAIFCFKFRTHFGGGKSSGYGLIYDTVENAKKFEPKYRLIRNGLDTKIEKSRKQIKERKNRAKKIRGVKKTKAGDAKKK

SEQ ID NO: 1905 - protein, 133 aa, Arabidopsis thaliana
  misc_feature (1)..(133): Public GI no. 18377454
  misc_feature: Utility: Useful for making ornamental plants with modified flowers
  misc_feature: Utility: Useful for making plants sterile and for genetic confinement
  misc_feature: Utility: Useful for making taller plants and plants with longer inflorescences
MAEKAVTIRTRNFMTNRLLARKQFVIDVLHPGRANVSKAELKEKLARMYEVKDPNAIFCFKFRTHFGGGKSSGYGLIYDTVENAKKFEPKYRLIRNGLDTKIEKSRKQIKERKNRAKKIRGVKKTKAGDTKKK

SEQ ID NO: 1906 - protein, 131 aa, Arabidopsis thaliana
  misc_feature (1)..(131): Ceres CLONE ID no. 27627
  misc_feature: Utility: Useful for making ornamental plants with modified flowers
  misc_feature: Utility: Useful for making plants sterile and for genetic confinement
  misc_feature: Utility: Useful for making taller plants and plants with longer inflorescences
MAEKAVTIRTRNFMTNRLLARKQFVIDVLHPGRANVSKAELKEKLARMYEVKDPNAIFCFRTHFGGGKSSGYGLIYDTVENAKKFEPKYRLIRNGLDTNIEKSRKQIKERKNRAKKIRGVKKTKAGDAKKK

SEQ ID NO: 1907 - protein, 133 aa, Arabidopsis thaliana
  misc_feature (1)..(133): Ceres CLONE ID no. 25350
  misc_feature: Utility: Useful for making ornamental plants with modified flowers
  misc_feature: Utility: Useful for making plants sterile and for genetic confinement
  misc_feature: Utility: Useful for making taller plants and plants with longer inflorescences
MAEKAVTIRTRKFMTNRLLSRKQFVIDVLHPGRANVSKAELKEKLARMYEVKDPNAIFVFKFRTHFGGGKSSGFGLIYDTVESAKKFEPKYRLIRNGLDTKIEKSRKQIKERKNRAKKIRGVKKTKAGDAKKK

SEQ ID NO: 1908 - protein, 133 aa, Arabidopsis thaliana; identical to SEQ ID NO: 1907
  misc_feature (1)..(133): Public GI no. 21554374
  misc_feature: Utility: Useful for making ornamental plants with modified flowers
  misc_feature: Utility: Useful for making plants sterile and for genetic confinement
  misc_feature: Utility: Useful for making taller plants and plants with longer inflorescences

SEQ ID NO: 1909 - protein, 156 aa, Brassica napus
  misc_feature (1)..(156): Ceres CLONE ID no. 1123729
  misc_feature: Utility: Useful for making ornamental plants with modified flowers
  misc_feature: Utility: Useful for making plants sterile and for genetic confinement
  misc_feature: Utility: Useful for making taller plants and plants with longer inflorescences
SFFSPLPTNERTNELKASQRDLTMAEKAVTIRTRKFMTNRLLSRKQFVIDVLHPGRANVSKAELKEKLARMYEVKDPNAIFVFKFRTHFGGGKSSGFGLIYDNVESAKKFEPKYRLIRNGLDTKIEKSRKQIKERKNRAKKIRGVKKTKAGDPKKK

SEQ ID NO: 1910 - protein, 133 aa, Zea mays
  misc_feature (1)..(133): Ceres CLONE ID no. 1372632
  misc_feature: Utility: Useful for making ornamental plants with modified flowers
  misc_feature: Utility: Useful for making plants sterile and for genetic confinement
  misc_feature: Utility: Useful for making taller plants and plants with longer inflorescences
MAEKAVTIRTRKFMTNRLLSRKQFVIDVLHPGRANVSKAELKEKLARMYEVKDPNAIFVFKFRTHFGGGKSSGFGLIYDNVESAKKFEPKYRLIRNGLDTKIEKSRKQIKERKNRAKKIRGVKKTKAGDPKKK

SEQ ID NO: 1911 - protein, 133 aa, Zea mays; identical to SEQ ID NO: 1910
  misc_feature (1)..(133): Ceres CLONE ID no. 1374198
  misc_feature: Utility: Useful for making ornamental plants with modified flowers
  misc_feature: Utility: Useful for making plants sterile and for genetic confinement
  misc_feature: Utility: Useful for making taller plants and plants with longer inflorescences

SEQ ID NO: 1912 - protein, 153 aa, Zea mays
  misc_feature (1)..(153): Ceres CLONE ID no. 1421186
  misc_feature: Utility: Useful for making ornamental plants with modified flowers
  misc_feature: Utility: Useful for making plants sterile and for genetic confinement
  misc_feature: Utility: Useful for making taller plants and plants with longer inflorescences
FRSRSERVANRRELGGIAAAMAEKAVTIRTRKFMTNRLLSRKQFVIDVLHPGRANVSKAELKEKLARMYEVKDPNAIFVFKFRTHFGGGKSSGFGLIYDNVESAKKFEPKYRLIRNGLDTKIEKSRKQIKERKNRAKKIRGVKKTKAGDPKKK

SEQ ID NO: 1913 - protein, 133 aa, Brassica napus
  misc_feature (1)..(133): Ceres CLONE ID no. 1078224
  misc_feature: Utility: Useful for making ornamental plants with modified flowers
  misc_feature: Utility: Useful for making plants sterile and for genetic confinement
  misc_feature: Utility: Useful for making taller plants and plants with longer inflorescences
MSEKAVTIRTRKFMTNRLLSRKQFVIDVLHPGRANVSKAELKEKLARMYEVKDPNAIFVFKFRTHFGGGKSSGFGLIYDNVESAKKFEPKYRLIRNGLDTKIEKSRKQIKERKNRAKKIRGVKKTKAGDPKKK

SEQ ID NO: 1914 - protein, 156 aa, Brassica napus
  misc_feature (1)..(156): Ceres CLONE ID no. 1039916
  misc_feature: Utility: Useful for making ornamental plants with modified flowers
  misc_feature: Utility: Useful for making plants sterile and for genetic confinement
  misc_feature: Utility: Useful for making taller plants and plants with longer inflorescences
YPPLSSLPVIFSLSLSQSAKIATMAEKAVTIRARKFMTNRLLSRKQFVIDVLHPGRANVSKAELKEKLARMYEVKDPNAIFVFKFRTHFGGGKSSGFGLIYDNVESAKKFEPKYRLIRNGLDTKIEKSRKQIKERKNRAKKIRGVKKTKAGDPKKK

SEQ ID NO: 1915 - protein, 132 aa, Glycine max
  misc_feature (1)..(132): Ceres CLONE ID no. 1051017
  misc_feature: Utility: Useful for making ornamental plants with modified flowers
  misc_feature: Utility: Useful for making plants sterile and for genetic confinement
  misc_feature: Utility: Useful for making taller plants and plants with longer inflorescences
  misc_feature (49)..(49): Xaa is any aa, unknown, or other
  misc_feature (52)..(52): Xaa is any aa, unknown, or other
  misc_feature (123)..(123): Xaa is any aa, unknown, or other
MAEKAVTIRTRKFMTNRLLSRKQFVIDVLHPGRANVSKAELKEKLARMXEVXDPNAIFVFKFRTHFGGGKSSGFGLIYDNVESAKKFEPKYRLIRNGLDTKIEKSRKQIKERKNRAKKIRGVXKTKAGDPKK

SEQ ID NO: 1916 - protein, 133 aa, Glycine max
  misc_feature (1)..(133): Public GI no. 445612
  misc_feature: Utility: Useful for making ornamental plants with modified flowers
  misc_feature: Utility: Useful for making plants sterile and for genetic confinement
  misc_feature: Utility: Useful for making taller plants and plants with longer inflorescences
MADKAVTIRTRKFMTNRLLARKQFIIDVLHPGRANVSKAELKEKLARMYEVKDTNAIFVFKFRTHFGGGKSTGFGLIYDSVENAKKYEPKYRLIRNGLDTKVEKSRKQMKERKNRAKKVRGVKKIKAGDAKKK

SEQ ID NO: 1917 - DNA, 701 bp, Triticum aestivum
  misc_feature (1)..(701): Ceres CLONE ID no. 733804
  misc_feature (1)..(701): Also known as  Ceres CDNA ID no. 23398793
atgcacaacttgtcttccctctcttccaacaccacttcttcttagttcctctccgtccctgtctgccaccacttctgtctctcaaacttgtctcactccaaccataaaccctcactgtcttgggctctctctgccaagcatccaattcctaagtacatccgatcactcacatttgcagtgatgtcgagccgtaggtcaaggtcaaggcagtccggctcgtcgaggatcaccgacgagcaaatcagcgaccttgtctccaagttgcaggacctccttcccgaggcgcgtctccggggcaatgatagagtgccatcttcaagggtgctgcaggagacgtgcacctacatcaggagcttgcaccgggaggtggacgacctgagcgagaggctgtcggagctgctggcgacctcggacatgagcagcgcgcaagcggccatcatccgcagcttgctgatgtagagccggctcccatgcagtgcgcaggcgcctcgtcgctgtcttgctgagcgcacaagcctgaatttgagcgtttgtagcctagggagcgatctttaattagtaccggagttgcaggttacctacttaatccgcgtgtgtgcgctgtcgtcgtgtcatcatcgtyttaatcaggcccatcttttttgtgtgtgtacttaaatcaagtcgttaaatcaaaccccgcccgtggttggtgcaagttg

SEQ ID NO: 1918 - protein, 92 aa, Triticum aestivum
  misc_feature: Utility: Useful for making ornamental plants with modified flowers
  misc_feature: Utility: Useful for making plants tolerant to low nitrogen
MSSRRSRSRQSGSSRITDEQISDLVSKLQDLLPEARLRGNDRVPSSRVLQETCTYIRSLHREVDDLSERLSELLATSDMSSAQAAIIRSLLM

SEQ ID NO: 1919 - protein, 92 aa, Glycine max
  misc_feature (1)..(92): Ceres CLONE ID no. 653656
  misc_feature: Utility: Useful for making ornamental plants with modified flowers
  misc_feature: Utility: Useful for making plants tolerant to low nitrogen
MSSRRSRSRQTSSSRNITDDQINDLVSKLQQLLPEIRDRRSDKVSASKVLQETCNYIRSLHREVDDLSERLSELLATTDTAQAAIIRNLLMQ

SEQ ID NO: 1920 - protein, 92 aa, Glycine max
  misc_feature (1)..(92): Ceres CLONE ID no. 663844
  misc_feature: Utility: Useful for making ornamental plants with modified flowers
  misc_feature: Utility: Useful for making plants tolerant to low nitrogen
MSSRRSRSRQTSSSRNITDDQINDLVSKLQQLLPEIRDRRSDKVSASKVLQETCNYIRSLHREVGDLSERLSELLDTTDTAQAAIIRNLLMQ

SEQ ID NO: 1921 - protein, 94 aa, Glycine max
  misc_feature (1)..(94): Public GI no. 28416803
  misc_feature: Utility: Useful for making ornamental plants with modified flowers
  misc_feature: Utility: Useful for making plants tolerant to low nitrogen
MSSRRSSRSRQSGSSRISDDQISDLVSKLQHLIPELRRRRSDKVSASKVLQETCNYIRNLHREVDDLSDRLSELLASTDDNSAEAAIIRSLLNY

SEQ ID NO: 1922 - protein, 94 aa, Arabidopsis thaliana
  misc_feature (1)..(94): Ceres CLONE ID no. 18200
  misc_feature: Utility: Useful for making ornamental plants with modified flowers
  misc_feature: Utility: Useful for making plants tolerant to low nitrogen
MSSRRSSRSRQSGSSRISDDQISDLVSKLQHLIPELRRRRSDKVSASKVLQETCNYIRNLHREVDDLSDRLSELLASTDDNSAETAIIRSLLNY

SEQ ID NO: 1923 - protein, 90 aa, Glycine max
  misc_feature (1)..(90): Ceres CLONE ID no. 1247092
  misc_feature: Utility: Useful for making ornamental plants with modified flowers
  misc_feature: Utility: Useful for making plants tolerant to low nitrogen
MSGRRSRSRQSSGISEDQINDLIIKLQQLLPELRNSRRSDKVSASRVLQETCNYIRNLHREVDDLSERLSELLANTDTAQAALIRSLLTQ

SEQ ID NO: 1924 - protein, 91 aa, Glycine max; identical to SEQ ID NO: 1899
  misc_feature (1)..(91): Ceres CLONE ID no. 560681
  misc_feature: Utility: Useful for making ornamental plants with modified flowers
  misc_feature: Utility: Useful for making plants tolerant to low nitrogen

SEQ ID NO: 1925 - protein, 91 aa, Glycine max; identical to SEQ ID NO: 1899
  misc_feature (1)..(91): Ceres CLONE ID no. 562428
  misc_feature: Utility: Useful for making ornamental plants with modified flowers
  misc_feature: Utility: Useful for making plants tolerant to low nitrogen

SEQ ID NO: 1926 - protein, 88 aa, Glycine max
  misc_feature (1)..(88): Public GI no. 31431968
  misc_feature: Utility: Useful for making ornamental plants with modified flowers
  misc_feature: Utility: Useful for making plants tolerant to low nitrogen
MSGRRASGRITDDEINELISKLQSLLPESSRRRGATSRSPATKLLKEMCSYIKSLHREVDDLSERLSELMATMDSNSPQADIIRSLLR

SEQ ID NO: 1927 - protein, 74 aa, Zea mays
  misc_feature (1)..(74): Ceres CLONE ID no. 486120
  misc_feature: Utility: Useful for making ornamental plants with modified flowers
  misc_feature: Utility: Useful for making plants tolerant to low nitrogen
MNELVSKLQALLPSSRRRRGSGQASTAKLLKETCSYIKSLQREVDDLSDRLSDLLSTMDHNSPAAEIIRSILRS

SEQ ID NO: 1928 - protein, 89 aa, Zea mays
  misc_feature (1)..(89): Ceres CLONE ID no. 503296
  misc_feature: Utility: Useful for making ornamental plants with modified flowers
  misc_feature: Utility: Useful for making plants tolerant to low nitrogen
MSSRRPSSRGNISEDEINELISKLQALLPSSRRRGSGQASTTKLLKETCSYIKSLHREVDDLSDRLSDLMATMDHNSPGAEIIRSILRS

SEQ ID NO: 1929 - DNA, 620 bp, Arabidopsis thaliana
  misc_feature (1)..(620): Ceres CLONE ID no. 9221
  misc_feature (1)..(620): Also known as  Ceres CDNA ID no. 23416919
gttgtcttcagctgtgtacagaatcaagtttccaagagagaaagagagtaaaagcaaattaacaaaggaagactctgattcaccgagaaggttttggcttaaagatgacgaacactcgcgcgatctacgccgtcatcgcgatcctggcgatagtaatctcagccgtggaatcaaccggagacttcggagattcgctagatttcgtgagagccggatcttcatcgctcttctctggatgcacaggatcgatcgcagagtgtatagcggaagaagaagagatggagttcgattcagacataagccggcgtatattagcacagaagaagtacattagctacggtgctatgaggaggaacagtgtgccttgttcacggcgtggtgcgtcgtactacaactgccagcgtggagctcaggcgaatccttacagccgtggatgcagcaccatcactaggtgcaggcgttgaagaagatgagtcacttgaatttcctattttgcccctttctttttgtgtctctgtctctcttctcgattttcatttttttaattatttttattttccgggatatatgggtttgattttacacattgaaaaaaaacttctactatagtctttgatttg

SEQ ID NO: 1930 - protein, 119 aa, Arabidopsis thaliana
  misc_feature (55)..(119): Pfam Name: RALF; Pfam Description: Rapid ALkalinization Factor (RALF)
  misc_feature: Utility: Useful for making ornamental plants with modified leaves
  misc_feature: Utility: Useful for making plants with altered leaf shape eg curled leaves
  misc_feature: Utility: Useful for making plants with increased biomass and foliage
  misc_feature: Utility: Useful for making smaller plants
MTNTRAIYAVIAILAIVISAVESTGDFGDSLDFVRAGSSSLFSGCTGSIAECIAEEEEMEFDSDISRRILAQKKYISYGAMRRNSVPCSRRGASYYNCQRGAQANPYSRGCSTITRCRR

SEQ ID NO: 1931 - protein, 119 aa, Brassica napus
  misc_feature (1)..(119): Ceres CLONE ID no. 975562
  misc_feature: Utility: Useful for making ornamental plants with modified leaves
  misc_feature: Utility: Useful for making plants with altered leaf shape eg curled leaves
  misc_feature: Utility: Useful for making plants with increased biomass and foliage
  misc_feature: Utility: Useful for making smaller plants
MNSRAIYAVVAILAIVISAVDASGFGFGHSLDFVRTGSSTLFSGCEGSIAECIAEEEEMEFDSDISRRILAQKKYVSYGAMRKNSVPCSRRGASYYNCQRGAQANPYRRGCSTITRCRR

SEQ ID NO: 1932 - protein, 107 aa, Glycine max
  misc_feature (1)..(107): Ceres CLONE ID no. 706764
  misc_feature: Utility: Useful for making ornamental plants with modified leaves
  misc_feature: Utility: Useful for making plants with altered leaf shape eg curled leaves
  misc_feature: Utility: Useful for making plants with increased biomass and foliage
  misc_feature: Utility: Useful for making smaller plants
MANTYSWLFLAICATLLLLLSSSPTADAGALGMEMTWIPSMPMEEEFQLDSEISRRILATTKYISYGALQRNTVPCSRRGASYYNCQPGAQANPYSRGCSAITRCRS

SEQ ID NO: 1933 - protein, 107 aa, Glycine max
  misc_feature (1)..(107): Ceres CLONE ID no. 588880
  misc_feature: Utility: Useful for making ornamental plants with modified leaves
  misc_feature: Utility: Useful for making plants with altered leaf shape eg curled leaves
  misc_feature: Utility: Useful for making plants with increased biomass and foliage
  misc_feature: Utility: Useful for making smaller plants
MANSYTWLFLAISATLLLLLSSSPTADAGALGMEMTWIPSMPMEEEFQLDSEISRRILATTKYISYGALQRNTVPCSRRGASYYNCQPGAQANPYSRGCSAITRCRS

SEQ ID NO: 1934 - protein, 115 aa, Glycine max
  misc_feature (1)..(115): Public GI no. 16566316
  misc_feature: Utility: Useful for making ornamental plants with modified leaves
  misc_feature: Utility: Useful for making plants with altered leaf shape eg curled leaves
  misc_feature: Utility: Useful for making plants with increased biomass and foliage
  misc_feature: Utility: Useful for making smaller plants
MGVPSGLILCVLIGAFFISMAAAGDSGAYDWVMPARSGGGCKGSIGECIAEEEEFELDSESNRRILATKKYISYGALQKNSVPCSRRGASYYNCKPGAQANPYSRGCSAITRCRS

SEQ ID NO: 1935 - protein, 116 aa, Arabidopsis thaliana
  misc_feature (1)..(116): Ceres CLONE ID no. 5455
  misc_feature: Utility: Useful for making ornamental plants with modified leaves
  misc_feature: Utility: Useful for making plants with altered leaf shape eg curled leaves
  misc_feature: Utility: Useful for making plants with increased biomass and foliage
  misc_feature: Utility: Useful for making smaller plants
MRGLSTKPVAIIIAILTVHFLFAAVTSQSSGDFVPIESKCNGTIAECSLSTAEEEFEMDSEINRRILATTKYISYGALRRNTVPCSRRGASYYNCRRGAQANPYSRGCSAITRCRR

SEQ ID NO: 1936 - protein, 115 aa, Arabidopsis thaliana
  misc_feature (1)..(115): Public GI no. 42374767
  misc_feature: Utility: Useful for making ornamental plants with modified leaves
  misc_feature: Utility: Useful for making plants with altered leaf shape eg curled leaves
  misc_feature: Utility: Useful for making plants with increased biomass and foliage
  misc_feature: Utility: Useful for making smaller plants
MGVPSGLILCVLIGAFFISMATAGDSGAYDWVMPARSGRGCNGSIGECMAEEDEFELDSESNRRILATKKYISYGALQKNSVPCSRRGASYYNCKPGAQANPYSRGCSAITRCRS

SEQ ID NO: 1937 - protein, 120 aa, Arabidopsis thaliana
  misc_feature (1)..(120): Public GI no. 28628203
  misc_feature: Utility: Useful for making ornamental plants with modified leaves
  misc_feature: Utility: Useful for making plants with altered leaf shape eg curled leaves
  misc_feature: Utility: Useful for making plants with increased biomass and foliage
  misc_feature: Utility: Useful for making smaller plants
MAKWSSWFLISATILILMAMGLSSTVQGSGDHHLGWIPATRSSVCKGSIAECMAEDGEEFEMDTEINRRILATTKYVSYGALQRNNVPCSRRGASYYNCQRGAQANPYSRGCSRITRCRS

SEQ ID NO: 1938 - protein, 114 aa, Arabidopsis thaliana
  misc_feature (1)..(114): Public GI no. 37695573
  misc_feature: Utility: Useful for making ornamental plants with modified leaves
  misc_feature: Utility: Useful for making plants with altered leaf shape eg curled leaves
  misc_feature: Utility: Useful for making plants with increased biomass and foliage
  misc_feature: Utility: Useful for making smaller plants
MGVPSYLIVCVLVGAFFISMAAAGDNGSYDWMVPARSGECKGSIAECMAEEDEFALDSESNRRILATKKYISYGALQKNSVPCSRRGASYYNCKPGAQANPYTRGCSAITRCRS

SEQ ID NO: 1939 - protein, 120 aa, Glycine max
  misc_feature (1)..(120): Ceres CLONE ID no. 628637
  misc_feature: Utility: Useful for making ornamental plants with modified leaves
  misc_feature: Utility: Useful for making plants with altered leaf shape eg curled leaves
  misc_feature: Utility: Useful for making plants with increased biomass and foliage
  misc_feature: Utility: Useful for making smaller plants
MGSSTTFCAFFLVCTILSVHVAQSSSSTLDLDTFFLPLKSGCRGSVAECSLLAGDDDTEFLMESESNRRILAGRSYISYGALRRNTVPCSRRGASYYNCRPGAQANPYSRGCSAITRCRR

SEQ ID NO: 1940 - protein, 118 aa, Glycine max
  misc_feature (1)..(118): Ceres CLONE ID no. 628130
  misc_feature: Utility: Useful for making ornamental plants with modified leaves
  misc_feature: Utility: Useful for making plants with altered leaf shape eg curled leaves
  misc_feature: Utility: Useful for making plants with increased biomass and foliage
  misc_feature: Utility: Useful for making smaller plants
MGSSTFCAFFLLCAILAVHVAQSSSSTLDLDAFFLPLKSGCRGSVAKCSLLAGDDAEFLMESESNRRILAGRSYISYGALRRNTVPCSRRGASYYNCRPGAQANPYSRGCSAITRCRR

SEQ ID NO: 1941 - protein, 128 aa, Glycine max
  misc_feature (1)..(128): Public GI no. 28628205
  misc_feature: Utility: Useful for making ornamental plants with modified leaves
  misc_feature: Utility: Useful for making plants with altered leaf shape eg curled leaves
  misc_feature: Utility: Useful for making plants with increased biomass and foliage
  misc_feature: Utility: Useful for making smaller plants
MARLNSFFLISATVLILMVMGWPSTVQGNGDHHHHHLGWIPTTATTRSSICDKGSLAECMAEEDGEEFGMDTEINRRILATSRYVSYGALQKNNVPCSRRGASYYNCKNGAQANPYSRGCSRITRCRG

SEQ ID NO: 1942 - protein, 122 aa, Zea mays
  misc_feature (1)..(122): Ceres CLONE ID no. 1061370
  misc_feature: Utility: Useful for making ornamental plants with modified leaves
  misc_feature: Utility: Useful for making plants with altered leaf shape eg curled leaves
  misc_feature: Utility: Useful for making plants with increased biomass and foliage
  misc_feature: Utility: Useful for making smaller plants
MAGVRSLVLLLLVLAVALSASASSIAGGDHLQLGLLSGGAGRGECRGTVAECGGEDAEGELGSASAEAHRRVLQGRGYISYGALRRGTVPCNRRGASYYNCRPGAQANPYHRGCSRITRCRG

SEQ ID NO: 1943 - DNA, 1221 bp, Arabidopsis thaliana
  misc_feature (1)..(1221): Ceres CLONE ID no. 11929
  misc_feature (1)..(1221): Also known as  Ceres CDNA ID no. 23386200
accacatcaattctctcatatctctctctcactttcgaatatatcttaagataacagagacacatactcttaagtttggtgaagaataagaagacaatgacgaaggaagtggttggtgataagagatctttctccgggaaagactatcaagacccaccacctgaacctctattcgacgctactgagcttgggaagtggtctttctacagagctctcatcgctgagttcatagccactctccttttcctctatgtcactattatgactgtcatcggttacaagagccagaccgatccagccctgaatcctgaccagtgtacaggcgttggcgtccttggtatcgcatgggcctttggtggcatgatcttcatcctcgtctactgcaccgccggcatctctggtgggcatattaatccggcagtgacttttgggctgttgttggctcggaaagtgacgttggtgagagcagtgatgtacatggtggctcagtgcctcggtgccatttgtggtgtggctttggtcaaggccttccagtctgcttacttcacccgctacggtggtggcgcaaatggtctctctgacggttacagcatcggcaccggtgttgcagccgagatcattggtacattcgtcttagtctacaccgtcttctctgccactgatcccaagaggagtgcgcgtgactctcacgttcctgtattggctccattgccaattggatttgcagtgttcatcgttcacttagctacaatcccaatcacgggcactggtatcaaccctgcaagaagtctcggagctgcaatcatctacaacaaggacaaagcttgggaccatcattggatattctgggtgggtccgtttgctggtgcagccatcgcagctttctaccatcagtttgtgttgagggctggtgcgattaaggcgctcgggtctttcaggagccagcctcacgtttaactttgatatgctcttccctgagtacatcaaagagagaaaaagagaagataataagagaggcttgtaattttatcttgtgtagacggttggagccaagtgacgtgtagtactagtatctaatttctagctttggtgaggagagatattttgaagtgtcgcttgcgggccaactttgaattgctacttctatgattaaatctatgtctctactccttgactattaagattgctctatttattagtactaaatattccttatatatg

SEQ ID NO: 1944 - protein, 286 aa, Arabidopsis thaliana
  misc_feature (30)..(265): Pfam Name: MIP; Pfam Description: Major intrinsic protein
  misc_feature: Utility: Useful for making ornamental plants with modified leaves
  misc_feature: Utility: Useful for making plants with altered leaf shape eg curled leaves
MTKEVVGDKRSFSGKDYQDPPPEPLFDATELGKWSFYRALIAEFIATLLFLYVTIMTVIGYKSQTDPALNPDQCTGVGVLGIAWAFGGMIFILVYCTAGISGGHINPAVTFGLLLARKVTLVRAVMYMVAQCLGAICGVALVKAFQSAYFTRYGGGANGLSDGYSIGTGVAAEIIGTFVLVYTVFSATDPKRSARDSHVPVLAPLPIGFAVFIVHLATIPITGTGINPARSLGAAIIYNKDKAWDHHWIFWVGPFAGAAIAAFYHQFVLRAGAIKALGSFRSQPHV

SEQ ID NO: 1945 - protein, 253 aa, Arabidopsis thaliana
  misc_feature (1)..(253): Ceres CLONE ID no. 7108
  misc_feature: Utility: Useful for making ornamental plants with modified leaves
  misc_feature: Utility: Useful for making plants with altered leaf shape eg curled leaves
MGELKSWSFYRALIAEFIATLLFLYVTVATVIGHKKQTGPCDGVGLLGIAWAFGGMIFVLVYCTAGISGGHINPAVTFGLFLARKVSLVRALGYMIAQCLGAICGVGFVKAFMKTPYNTLGGGANTVADGYSKGTALGAEIIGTFVLVYTVFSATDPKRSARDSHIPVLAPLPIGFAVFMVHLATIPITGTGINPARSFGAAVIYNNEKAWDDQWIFWVGPFLGALAAAAYHQYILRASAIKALGSFRSNATN

SEQ ID NO: 1946 - protein, 288 aa, Zea mays
  misc_feature (1)..(288): Ceres CLONE ID no. 275791
  misc_feature: Utility: Useful for making ornamental plants with modified leaves
  misc_feature: Utility: Useful for making plants with altered leaf shape eg curled leaves
MGKEVDVSTLEAGGVRDRDYADPPPAPLIDIDELGKWSLYRAVIAEFVATLLFLYITVATVIGYKHQTDASASGPDAACSGVGILGIAWAFGGMIFILVYCTAGISGGHINPAVTFGLFLARKVSLVRALLYMAAQSLGAICGVALVKGFQSGFYARYGGGANEVSAGYSTGTGLAAEIIGTFVLVYTVFSATDPKRNARDSHVPVLAPLPIGFAVFMVHLATIPITGTGINPARSLGAAVVYNNSKAWSDQWIFWVGPFIGAAIAALYHQIVLRASARGYGSFRSNA

SEQ ID NO: 1947 - protein, 263 aa, Arabidopsis thaliana
  misc_feature (1)..(263): Ceres CLONE ID no. 33231
  misc_feature: Utility: Useful for making ornamental plants with modified leaves
  misc_feature: Utility: Useful for making plants with altered leaf shape eg curled leaves
MEELRKWPLYRAVIAEFVATLLFLYVSILTVIGYKAQTDATAGGVDCGGVGILGIAWAFGGMIFVLVYCTAGISGGHINPAVTVGLFLARKVSLVRTVLYIVAQCLGAICGCGFVKAFQSSYYTRYGGGANELADGYNKGTGLGAEIIGTFVLVYTVFSATDPKRNARDSHVPVLAPLPIGFAVFMVHLATIPITGTGINPARSFGAAVIYNNEKAWDDQWIFWVGPMIGAAAAAFYHQFILRAAAIKALGSFGSFGSFRSFA

SEQ ID NO: 1948 - protein, 253 aa, Zea mays
  misc_feature (1)..(253): Ceres CLONE ID no. 1379318
  misc_feature: Utility: Useful for making ornamental plants with modified leaves
  misc_feature: Utility: Useful for making plants with altered leaf shape eg curled leaves
  misc_feature (102)..(102): Xaa is any aa, unknown, or other
MGELKSWSFYRALIAEFIATLLFLYVTVATVIGHKKQTGPCDGVGLLGIAWAFGGMIFVLVYCTAGISGGHINPAVTFGLFLARKVSLVRAVGYMIAQCLGXICGVGFVKAFMKTPYNTLGGGANTVADGYSTGTALGAEIIGTFVLVYTVFSATDPKRSARDSHIPVLAPLPIGFAVFMVHLATIPITGTGINPARSFGAAVIYNNEKAWDDHWIFWVGPFVGALAAAAYHQYILRAAAVKALASFRSSATN

SEQ ID NO: 1949 - protein, 253 aa, Arabidopsis thaliana
  misc_feature (1)..(253): Ceres CLONE ID no. 39154
  misc_feature: Utility: Useful for making ornamental plants with modified leaves
  misc_feature: Utility: Useful for making plants with altered leaf shape eg curled leaves
MGELKSWSFYRALIAEFIATLLFLYVTVATVIGHKKQTGPCDGVGLLGIAWAFGGMIFVLVYCTAGISGGHINPAVTFGLFLARKVSLVRALGYMIAQCLGAICGVGFVKAFMKTPYNTLGGGANTVADGYSKGTALGAEIIGTFVLVYTVFSATDPKRSARDSHIPVLAPLPIGFAVFMVHLATIPITGTGINPARSFGAAVIYNNEKAWDDQWIFWVGPFLGALAAAAYHQYILRASAIKAFGSFRSNATN

SEQ ID NO: 1950 - protein, 285 aa, Arabidopsis thaliana
  misc_feature (1)..(285): Ceres CLONE ID no. 25220
  misc_feature: Utility: Useful for making ornamental plants with modified leaves
  misc_feature: Utility: Useful for making plants with altered leaf shape eg curled leaves
MAKDVEGPEGFQTRDYEDPPPTPFFDADELTKWSLYRAVIAEFVATLLFLYITVLTVIGYKIQSDTKVGGVDCGGVGILGIAWAFGGMIFILVYCTAGISGGHINPAVTFGLFLARKVSLIRAVLYMVAQCLGAICGVGFVKAFQSSYYDRYGGGANSLADGYNTGTGLAAEIIGTFVLVYTVFSATDPKRNARDSHVPVLAPLPIGFAVFMVHLATIPITGTGINPARSFGAAVIYNKSKPWDDHWIFWVGPFIGAAIAAFYHQFVLRASGSKSLGSFRSAANV

SEQ ID NO: 1951 - protein, 285 aa, Glycine max
  misc_feature (1)..(285): Ceres CLONE ID no. 546486
  misc_feature: Utility: Useful for making ornamental plants with modified leaves
  misc_feature: Utility: Useful for making plants with altered leaf shape eg curled leaves
  misc_feature (3)..(3): Xaa is any aa, unknown, or other
  misc_feature (6)..(6): Xaa is any aa, unknown, or other
  misc_feature (24)..(24): Xaa is any aa, unknown, or other
MAXDLXTEIQSGLPHKDYHDPPPXPFYDPAELRKWSFFRALIAEFVATLLFLYVTILTVIGYNHQTATAAEPCSGVGVLGIAWAFGGMIFVLVYCTAGISGGHINPAVTFGLFLARKVSLTRAVGYMVAQVLGAISGVGLVKALQKSYYNRYKGGVNMLADGYSKGTGLGAEIIGTFILVYTVFSATDPKRVARDSHVPVLAPLPIGFAVFMVHLATIPITGTGINPARSLGPAVIFNNEKAWDDQWIFWVGPFIGAALAAFYHQSVLMAQAAKALGSFRSSSNL

SEQ ID NO: 1952 - protein, 284 aa, Triticum aestivum
  misc_feature (1)..(284): Ceres CLONE ID no. 909689
  misc_feature: Utility: Useful for making ornamental plants with modified leaves
  misc_feature: Utility: Useful for making plants with altered leaf shape eg curled leaves
METGGGGDFAAKDYTDPPPAPLIDAAELASWSLYRAVIAEFIATLLFLYITVATVIGYKHQTDPAVNSAADAACGGVGVLGIAWAFGGMIFVLVYCTAGISGGHINPAVTFGLFLARKVSLVRALLYMIAQCLGAMCGVGLVKAFRAPTSSGTAAAPTRSPPATPRAPASLRRSSGTFVLVYTVFSATDPKRSARDSHVPVLAPLPIGFAVFMVHLATIPITGTGINPARSLGAAVIYNKDKAWDDQWIFWVGPMIGAAIAAFYHQYILRAGAIKALGSFRSNA

SEQ ID NO: 1953 - protein, 292 aa, Triticum aestivum
  misc_feature (1)..(292): Ceres CLONE ID no. 868632
  misc_feature: Utility: Useful for making ornamental plants with modified leaves
  misc_feature: Utility: Useful for making plants with altered leaf shape eg curled leaves
MEGKEEDVRLGANRYSEHQPIGTAAQGGGADKKDYKEPPPAPFFEAGELTSWSFYRAGIAEFLATFLFLYISVLTVMGVVGNPSGSKCGTVGIQGIAWSFGGMIFVLVYCTAGISGGHINPAVTFGLFLARKLSLTRAVFYIVMQCLGAICGAGVVKGFQTTLYQGNGGGANSVAPGYTKGDGLGAEIVGTFVLVYTVFSATDAKRSARDSHVPILAPLPIGFAVFLVHLATIPITGTGINPARSLGAAIIYNKKQAWDDHWIFWVGPFIGAALAAIYHVVVIRAIPFKSRD

SEQ ID NO: 1954 - DNA, 796 bp, Arabidopsis thaliana
  misc_feature (1)..(796): Ceres CLONE ID no. 12071
  misc_feature (1)..(796): Also known as  Ceres CDNA ID no. 23366608
aacctattagagtttccttcctccaacaaaccatctttataagactccaaaatggagggtaagagatcacaaggacaaggttacatgaaaaagaagtcttaccttgtggaagaagatatggagactgatacggatgaagaagaggaagtaggtagggatagagttagagggtctagaggtagcatcaatcgtggtggctcgttgcggctttgccaagtagatagatgcacagctgatatgaaagaggcaaaactgtatcaccggagacacaaagtgtgtgaagttcatgcaaaggcatcttctgtctttctctcaggacttaaccaacgcttttgtcaacaatgcagtaggtttcatgacctccaagagtttgatgaagctaagagaagttgtaggaggcgcttagctggacacaatgagcgaagaaggaagagctctggtgagagtacttatggagaaggatcaggtcggagaggaatcaatggtcaggtggtgatgcagaatcaagaaagatcaagggtagagatgacacttcctatgccaaactcatcattcaagcgaccacagattagatagagaagctgtctgctctctctcttctgtcatctaaacttctctcttagaatcctaaaattgtggtatctaacaatgttatagagaaataaataactaccactctctctagtactctctaatgttatcagctatatgcaaacgctaagactatacttgaaccttgagtgttatcttgtatgtttcaaagatatggctaatgatatgtgtaatacttctacct

SEQ ID NO: 1955 - protein, 174 aa, Arabidopsis thaliana
  misc_feature (53)..(131): Pfam Name: SBP; Pfam Description: SBP domain
  misc_feature: Utility: Useful for making ornamental plants with modified leaves
  misc_feature: Utility: Useful for making smaller plants
  misc_feature: Utility: Useful for making stronger plants
MEGKRSQGQGYMKKKSYLVEEDMETDTDEEEEVGRDRVRGSRGSINRGGSLRLCQVDRCTADMKEAKLYHRRHKVCEVHAKASSVFLSGLNQRFCQQCSRFHDLQEFDEAKRSCRRRLAGHNERRRKSSGESTYGEGSGRRGINGQVVMQNQERSRVEMTLPMPNSSFKRPQIR

SEQ ID NO: 1956 - protein, 138 aa, Glycine max
  misc_feature (1)..(138): Ceres CLONE ID no. 538817
  misc_feature: Utility: Useful for making ornamental plants with modified leaves
  misc_feature: Utility: Useful for making smaller plants
  misc_feature: Utility: Useful for making stronger plants
MDGSWSEGKRSMSYKEEDEYEEEEEEEVSEYGDDGKKKRVVSNKRGSKAGGSVPPSCQVDGCNADLSEAKPYHRRHKVCEYHAKAPAVVIGDQHQRFCQQCSRFHELSEFDDSKRSCRRRLAGHNERRRKNASEYHGL

SEQ ID NO: 1957 - protein, 169 aa, Glycine max
  misc_feature (1)..(169): Public GI no. 55419652
  misc_feature: Utility: Useful for making ornamental plants with modified leaves
  misc_feature: Utility: Useful for making smaller plants
  misc_feature: Utility: Useful for making stronger plants
MQEEEEEGVGGDHGFPDDEKKKKGYGRRGAAGGGGGVSPPACQVEKCGLDLSDAKRYHRRHKVCEIHAKAPFVVVAGLRQRFCQQCSRFHELPEFDEAKRSCRRRLAGHNERRRKSSAESSSAAESSNRRGMMISAQLKESHYLADDQRARVNPMAIHGSSSFKRSQIR

SEQ ID NO: 1958 - protein, 134 aa, Glycine max
  misc_feature (1)..(134): Public GI no. 30577630
  misc_feature: Utility: Useful for making ornamental plants with modified leaves
  misc_feature: Utility: Useful for making smaller plants
  misc_feature: Utility: Useful for making stronger plants
MEASRAEGKRSFMEEEEDQEEEEEEEEKREMSTSSSRRASGSGGSTPPTCQVENCNADLTDAKHYHRRHKVCESHAKAPIVYVAGGQKRFCQQCSRFHDLSEFDEYKKSCRKRLAGHNERRRKSSSDFHREGSN

SEQ ID NO: 1959 - protein, 131 aa, Glycine max
  misc_feature (1)..(131): Public GI no. 1183866
  misc_feature: Utility: Useful for making ornamental plants with modified leaves
  misc_feature: Utility: Useful for making smaller plants
  misc_feature: Utility: Useful for making stronger plants
MDTSKGEGKRVIKLPGSQEQGEEEDDIGEDSKKTRALTPSGKRASGSTQRSCQVENCAAEMTNAKPYHRRHKVCEFHAKAPVVLHSGLQQRFCQQCSRFHELSEFDEAKRSCRRRLAGHNERRRKSSHDTH

SEQ ID NO: 1960 - protein, 175 aa, Glycine max
  misc_feature (1)..(175): Public GI no. 62856979
  misc_feature: Utility: Useful for making ornamental plants with modified leaves
  misc_feature: Utility: Useful for making smaller plants
  misc_feature: Utility: Useful for making stronger plants
MNLGKVDGSCYQKMVKKEAEEDQVSDEELVESGVEEEKKKKGVVGSGGKRCCQAEKCTADLSDGKQYHKRHKVCEHHAKAQVVLVGGMRQRFCQQCSRFHELSEFDETKRSCRRRLAGHNERRRENTAESHAEGSSRKGTGTHQLKDIVCGQVDDRGRIQITIHENSTYKHFQIR

SEQ ID NO: 1961 - DNA, 645 bp, Arabidopsis thaliana
  misc_feature (1)..(645): Ceres CLONE ID no. 13625
  misc_feature (1)..(645): Also known as  Ceres CDNA ID no. 23359269
aaaagacacgtccttttttgcgttactattattctcctcctttctctccaattattctctgagctgtaataacataaacaaaaaaaagattctctcgatcaaacttgccggcgtccatggaagatttcggccgtcaacgaccatacggagacggagggatgcagatccagccttaccacggtaatcaaggcggtgatttcaggagctatagcgcatcgtacgggacgagggagaacaatatatacgatgtgaaaaaggagaaatcgatagcaagatccaagtcttggggaataacggatccggagctccagaggaagaaacgggtcgcgagttataagatgtatggtgttgaaggcaaagtcaaaggctcttttagaaacagtttcagatggcttaagcagaggtacacacaggtcgtctatggttggtggtgattcttttttcatctttttctataatttttacttttttactttgtttttcttcttcttgagctttgttttgaattttgattttctcaagtaattatgattgtgctctctctctctctttcttatgtatctttgtgtttgtgtgttgtaatcttgaatgtaactgtggtggcttcatcgcaacaaaattatatatgatcatttattagtttct

SEQ ID NO: 1962 - protein, 105 aa, Arabidopsis thaliana
  misc_feature: Utility: Useful for making ornamental plants with modified leaves
  misc_feature: Utility: Useful for making plants tolerant to low nitrogen
  misc_feature: Utility: Useful for making plants with altered leaf shape eg curled leaves
  misc_feature: Utility: Useful for making plants with increased biomass and foliage
  misc_feature: Utility: Useful for making smaller plants
  misc_feature: Utility: Useful for making stronger plants
MEDFGRQRPYGDGGMQIQPYHGNQGGDFRSYSASYGTRENNIYDVKKEKSIARSKSWGITDPELQRKKRVASYKMYGVEGKVKGSFRNSFRWLKQRYTQVVYGWW

SEQ ID NO: 1963 - protein, 106 aa, Brassica napus
  misc_feature (1)..(106): Ceres CLONE ID no. 873093
  misc_feature: Utility: Useful for making ornamental plants with modified leaves
  misc_feature: Utility: Useful for making plants tolerant to low nitrogen
  misc_feature: Utility: Useful for making plants with altered leaf shape eg curled leaves
  misc_feature: Utility: Useful for making plants with increased biomass and foliage
  misc_feature: Utility: Useful for making smaller plants
  misc_feature: Utility: Useful for making stronger plants
MEDYNRQRAYGDTGMQIQPYHGGGPGTGDFRSYSTSYATENNIYNIKKEKSIARSKSWGITDPELQRKKRVASYKMYSVEGKVKGSFRKSFRWLKQRYTQVVYGWW

SEQ ID NO: 1964 - protein, 129 aa, Glycine max
  misc_feature (1)..(129): Ceres CLONE ID no. 608685
  misc_feature: Utility: Useful for making ornamental plants with modified leaves
  misc_feature: Utility: Useful for making plants tolerant to low nitrogen
  misc_feature: Utility: Useful for making plants with altered leaf shape eg curled leaves
  misc_feature: Utility: Useful for making plants with increased biomass and foliage
  misc_feature: Utility: Useful for making smaller plants
  misc_feature: Utility: Useful for making stronger plants
MEDFNNYNKSRSHGNNGQMMQQMERYYGGAPPQPTRPYDLRSYSVSSYTQAPNNYNNKDLKMMKKGKSMSSRTSSISKSWSFVTDPEIQRKKRVASYKMYSVEGKVKGSFRKSFRWVKDRYCQVVYGWW

SEQ ID NO: 1965 - protein, 122 aa, Glycine max
  misc_feature (1)..(122): Ceres CLONE ID no. 663726
  misc_feature: Utility: Useful for making ornamental plants with modified leaves
  misc_feature: Utility: Useful for making plants tolerant to low nitrogen
  misc_feature: Utility: Useful for making plants with altered leaf shape eg curled leaves
  misc_feature: Utility: Useful for making plants with increased biomass and foliage
  misc_feature: Utility: Useful for making smaller plants
  misc_feature: Utility: Useful for making stronger plants
MEEFRSKSYGDGRMQIEAYRGANIQDLRCYSASYASSVHPTTTTTTTTQTQMGGNNNNEAKFKKGKSTNGSTSKSWSFSDPELQRKKRVASYKVYAVEGKLKGSLRKSFKWLKDRCNRVVYG

SEQ ID NO: 1966 - protein, 158 aa, Glycine max
  misc_feature (1)..(158): Ceres CLONE ID no. 855086
  misc_feature: Utility: Useful for making ornamental plants with modified leaves
  misc_feature: Utility: Useful for making plants tolerant to low nitrogen
  misc_feature: Utility: Useful for making plants with altered leaf shape eg curled leaves
  misc_feature: Utility: Useful for making plants with increased biomass and foliage
  misc_feature: Utility: Useful for making smaller plants
  misc_feature: Utility: Useful for making stronger plants
NIVVSAPHQYQSIKKTRKSSLKNKHGLPLLAANLRLFVPNPTMEEFRSKSYGDGRMQIEAYRGTNMQDLRCYSASYASSVHPTTTQQTQMGNNDAKFKKGKSTNGSTSKSWSFSDPELQRKKRVASYKVYAVEGKLKGSLRKSFKWFKDRCNRVVYGW

SEQ ID NO: 1967 - protein, 117 aa, Glycine max
  misc_feature (1)..(117): Ceres CLONE ID no. 647910
  misc_feature: Utility: Useful for making ornamental plants with modified leaves
  misc_feature: Utility: Useful for making plants tolerant to low nitrogen
  misc_feature: Utility: Useful for making plants with altered leaf shape eg curled leaves
  misc_feature: Utility: Useful for making plants with increased biomass and foliage
  misc_feature: Utility: Useful for making smaller plants
  misc_feature: Utility: Useful for making stronger plants
MEFRSKSCRDARLQIESYCGGKVSPTSMQDLRCYSANNAASSAYAHQIGSKEVKVKKGKTSATKPSKSWSFTDPELQRKKRVAGYKIYAAEGKMKGSLRKSFRWIKNTYTQALYGWW

SEQ ID NO: 1968 - protein, 117 aa, Zea mays
  misc_feature (1)..(117): Ceres CLONE ID no. 1524364
  misc_feature: Utility: Useful for making ornamental plants with modified leaves
  misc_feature: Utility: Useful for making plants tolerant to low nitrogen
  misc_feature: Utility: Useful for making plants with altered leaf shape eg curled leaves
  misc_feature: Utility: Useful for making plants with increased biomass and foliage
  misc_feature: Utility: Useful for making smaller plants
  misc_feature: Utility: Useful for making stronger plants
MDRSKSYAGGRMQIEPYYDGGGARPDFRSYSYSAGGSGMGTSSYAYQYEYSGAGAGEEMKRSKSKRRWLALADPDMERKRRVAAYKAYGVEGKMKGSFRKSFKWIKDRYLNLVYGWS

SEQ ID NO: 1969 - protein, 131 aa, Triticum aestivum
  misc_feature (1)..(131): Ceres CLONE ID no. 686525
  misc_feature: Utility: Useful for making ornamental plants with modified leaves
  misc_feature: Utility: Useful for making plants tolerant to low nitrogen
  misc_feature: Utility: Useful for making plants with altered leaf shape eg curled leaves
  misc_feature: Utility: Useful for making plants with increased biomass and foliage
  misc_feature: Utility: Useful for making smaller plants
  misc_feature: Utility: Useful for making stronger plants
NFPFSSPKRSSTGGFAMAAADYDRAYRPYAPSSAADYDRPYRNEIVPYGDRRIDLVVKPPPPTRSPPPPLPVTKSGGGGGIGSAWCFSDPEVKRRRRVASYKAYSVEGKVKASFRRGFRWIKDKCTGFIHG

SEQ ID NO: 1970 - protein, 163 aa, Zea mays
  misc_feature (1)..(163): Ceres CLONE ID no. 225086
  misc_feature: Utility: Useful for making ornamental plants with modified leaves
  misc_feature: Utility: Useful for making plants tolerant to low nitrogen
  misc_feature: Utility: Useful for making plants with altered leaf shape eg curled leaves
  misc_feature: Utility: Useful for making plants with increased biomass and foliage
  misc_feature: Utility: Useful for making smaller plants
  misc_feature: Utility: Useful for making stronger plants
FLLPLPTKPSLTITSRRVVVVVISLASASTARSPIACWPALLAMDRSKSYAGGRMQIEPYYGGGGGGGGGARADFRSYSYSAGGTGPSSYSYNQYEYGGPGAGEEEVKQSKSKRRWLADPDMDRKRRVAAYKAYGVEGRVKGSLRKSFRWVKDRYLDLVYGWS

SEQ ID NO: 1971 - DNA, 747 bp, Arabidopsis thaliana
  misc_feature (1)..(747): Ceres CLONE ID no. 16865
  misc_feature (1)..(747): Also known as  Ceres CDNA ID no. 23368049
attcgcttccgtttcttaaagcataaaaaccaaaactttctctttcgttttgctttcttccaagcatctgcaggagtgaatcgcaaaaccaaatttggaggattctttctgaggggtttctcagtgagaaaatggcttcgaaacggatcttgaaggagctgaaggatctccagaaagaccctccaacctcctgcagtgcaggtccagttgctgaagacatgtttcattggcaagctacaattatgggtcctgcagagagtccgtattcaggcggtgtgtttctcgttaccattcacttccctccggactatcctttcaagccaccaaaggttgcatttaggacgaaggtgtttcaccctaatatcaacagcaacggaagcatttgccttgacattttgaaagaacaatggagccctgccctcaccatttcgaaggtgttgctttcgatatgttcgctgttaacggatccaaatccagatgacccgttagtgccagagattgcacacatgtacaaaaccgacagagccaagtacaaggctactgctagaaactggactcagaagtatgccatgggctaaacaaagattcgtatgcttcagcacctgtttatgctcttatatctgtttatttctttttcttgttttaactctaataaaaatgtctaaaaatatcaacttttttcgtctgtactatatgtttatggttttattatcatcatctttatctgaaatttgaagatggaattcc

SEQ ID NO: 1972 - protein, 148 aa, Arabidopsis thaliana
  misc_feature (5)..(142): Pfam Name: UQ_con; Pfam Description: Ubiquitin-conjugating enzyme
  misc_feature: Utility: Useful for making ornamental plants with modified leaves
  misc_feature: Utility: Useful for making plants sterile and for genetic confinement
MASKRILKELKDLQKDPPTSCSAGPVAEDMFHWQATIMGPAESPYSGGVFLVTIHFPPDYPFKPPKVAFRTKVFHPNINSNGSICLDILKEQWSPALTISKVLLSICSLLTDPNPDDPLVPEIAHMYKTDRAKYKATARNWTQKYAMG

SEQ ID NO: 1973 - protein, 134 aa, Parthenium argentatum
  misc_feature (1)..(134): Ceres CLONE ID no. 1605695
  misc_feature: Utility: Useful for making ornamental plants with modified leaves
  misc_feature: Utility: Useful for making plants sterile and for genetic confinement
MASKRILKELKDLQKDPPTSCSAGPLAEDMFHWQATIMGPSDSPYSGGVFLVSIHFPPDYPFKPPKVAFRTKVFHPNINSNGSICLDILKEQWSPALTISKVLLSICSLLTDPNPDDPLVPEIAHMYKTDKPKY

SEQ ID NO: 1974 - protein, 148 aa, Zea mays
  misc_feature (1)..(148): Ceres CLONE ID no. 437144
  misc_feature: Utility: Useful for making ornamental plants with modified leaves
  misc_feature: Utility: Useful for making plants sterile and for genetic confinement
MASKRILKELKDLQKDPPTSCSAGPVGEDMFHWQATIMGPSDSPFAGGVFLVNIHFPPDYPFKPPKVSFRTKVFHPNINSNGSICLDILKEQWSPALTISKVLLSICSLLTDPNPDDPLVPEIAHMYKTDRAKYESTARSWTQKYAMG

SEQ ID NO: 1975 - protein, 148 aa, Zea mays
  misc_feature (1)..(148): Ceres CLONE ID no. 1380019
  misc_feature: Utility: Useful for making ornamental plants with modified leaves
  misc_feature: Utility: Useful for making plants sterile and for genetic confinement
  misc_feature (128)..(128): Xaa is any aa, unknown, or other
  misc_feature (129)..(129): Xaa is any aa, unknown, or other
MASKRILKELKDLHKDPPSSCSAGPVAEDMFHWQATIMGPSDSPYSGGVFLVTIHFPPDYPFKPPKVAFRTKVFHPNVNSNGSICLDILKEQWSPALTISKVLLSICSLLTDPNPDDPLVPEIAHMYXXDRAKYESTARSWTQKYAMG

SEQ ID NO: 1976 - protein, 148 aa, Triticum aestivum
  misc_feature (1)..(148): Ceres CLONE ID no. 1031152
  misc_feature: Utility: Useful for making ornamental plants with modified leaves
  misc_feature: Utility: Useful for making plants sterile and for genetic confinement
MASKRILKELKDLQKDPPTSCSAGPVGEDMFHWQATIMGPSDSPFTGGLFLVNIHFPPDYPFKPPKVSFRTKVFHPNINSNGSICLDILKEQWSPALTISKVLLSICSLLTDPNPDDPLVPEIAHMYKTDRAKYESTARSWTQKYAMG

SEQ ID NO: 1977 - protein, 148 aa, Zea mays; identical to SEQ ID NO: 1976
  misc_feature (1)..(148): Ceres CLONE ID no. 1431307
  misc_feature: Utility: Useful for making ornamental plants with modified leaves
  misc_feature: Utility: Useful for making plants sterile and for genetic confinement

SEQ ID NO: 1978 - protein, 148 aa, Zea mays
  misc_feature (1)..(148): Ceres CLONE ID no. 350577
  misc_feature: Utility: Useful for making ornamental plants with modified leaves
  misc_feature: Utility: Useful for making plants sterile and for genetic confinement
MASKRILKELKDLQKDPPTSCSAGPAGEDMFHWQATIMGPPDSPYAGGVFLVNIHFPPDYPFKPPKVSFKTKVFHPNINSNGSICLDILKEQWSPALTISKVLLSICSLLTDPNPDDPLVPEIAHMYKTDRPKYEATARSWTQKYAMG

SEQ ID NO: 1979 - protein, 147 aa, Triticum aestivum
  misc_feature (1)..(147): Ceres CLONE ID no. 617835
  misc_feature: Utility: Useful for making ornamental plants with modified leaves
  misc_feature: Utility: Useful for making plants sterile and for genetic confinement
MASKRIQKELKDLQKDPPTSCSAGPVGEDMFHWQATIMGPSDSPYSGGVFLVTIHFPPDYPFKPPKVAFRTKVFHPNINSNGSICLDILKDQWSPALTISKVLLSICSLLYDPNPDDPLVPEIAHMYKTDRHKYESTARTWTQRYAM

SEQ ID NO: 1980 - protein, 148 aa, Zea mays
  misc_feature (1)..(148): Ceres CLONE ID no. 1521928
  misc_feature: Utility: Useful for making ornamental plants with modified leaves
  misc_feature: Utility: Useful for making plants sterile and for genetic confinement
MASKRILKELKDLQKDPPTSCSAGPAGEDMFHWQATIMGPPDSPYAGGVFLVNIHFPPDYPFKPPKVSFKTKVFHPNINSNGSICLDILKEQWSPALTISKVLLSICSLLTDPNPDDPLVPEIAHMYKTDRPKYESTARSWTQKYAMG

SEQ ID NO: 1981 - protein, 148 aa, Zea mays
  misc_feature (1)..(148): Ceres CLONE ID no. 1437721
  misc_feature: Utility: Useful for making ornamental plants with modified leaves
  misc_feature: Utility: Useful for making plants sterile and for genetic confinement
MASKRILKELKDLQKDPPTSCSAGPSGEDMFHWQATIMGPPDSPYAGGVFLVNIHFPPDYPFKPPKVSFKTKVFHPNINSNGSICLDILKEQWSPALTISKVLLSICSLLTDPNPDDPLVPEIAHMYKTDRSKYETTARSWTQKYAMG

SEQ ID NO: 1982 - protein, 148 aa, Zea mays
  misc_feature (1)..(148): Ceres CLONE ID no. 702116
  misc_feature: Utility: Useful for making ornamental plants with modified leaves
  misc_feature: Utility: Useful for making plants sterile and for genetic confinement
MASKRILKELKDLQKDPPTSCSAGPAGEDMFHWQATIMGPPDSPYAGGVFLVNIHFPPDYPFKPPKVSFKTKVFHPNINSNGSICLDILKEQWSPALTISKVLLSICSLLTDSNPDDPLVPEIAHMYKTDRPKYESTARSWTQKYAMG

SEQ ID NO: 1983 - protein, 148 aa, Zea mays; identical to SEQ ID NO: 1982
  misc_feature (1)..(148): Ceres CLONE ID no. 1591070
  misc_feature: Utility: Useful for making ornamental plants with modified leaves
  misc_feature: Utility: Useful for making plants sterile and for genetic confinement

SEQ ID NO: 1984 - protein, 143 aa, Zea mays
  misc_feature (1)..(143): Ceres CLONE ID no. 256705
  misc_feature: Utility: Useful for making ornamental plants with modified leaves
  misc_feature: Utility: Useful for making plants sterile and for genetic confinement
MAPIFADMAKKSPTSCSAGPAGEDMFHWQATIMGPPDSPYAGGVFLVNIHFPPDYPFKPPKVSFKTKVFHPNINSNGSICLDILKEQWSPALTISKVLLSICSLLTDPNPDDPLVPEIAHMYKTDRPKYEATARSWTQKYAMG

SEQ ID NO: 1985 - protein, 148 aa, Zea mays
  misc_feature (1)..(148): Ceres CLONE ID no. 1357060
  misc_feature: Utility: Useful for making ornamental plants with modified leaves
  misc_feature: Utility: Useful for making plants sterile and for genetic confinement
MASKRINKELRDLQRDPPVSCSAGPVGDDMFHWQATIMGPTDSPFSGGVFLVSIHFPPDYPFKPPKVSFRTKVYHPNINSNGSICLDILKEQWSPALTISKVLLSICSLLTDPNPDDPLVPEIAHTYKTDRVKYESTARSWTQKYAMG

SEQ ID NO: 1986 - protein, 148 aa, Zea mays
  misc_feature (1)..(148): Ceres CLONE ID no. 1531983
  misc_feature: Utility: Useful for making ornamental plants with modified leaves
  misc_feature: Utility: Useful for making plants sterile and for genetic confinement
MALRRIIKELKDLQRDPPTSCSAGPVSDDMFHWQATIMGPSDSPYSGGVFLVAIHFPPDYPFKPPKVAFKTKVFHPNINSNGSICLDILKEQWSPALTVSKVLLSVCSLLTDPNPDDPLVPEIAHMCKTDRLRYESTARGWTHKYAMG

SEQ ID NO: 1987 - protein, 148 aa, Zea mays
  misc_feature (1)..(148): Ceres CLONE ID no. 376667
  misc_feature: Utility: Useful for making ornamental plants with modified leaves
  misc_feature: Utility: Useful for making plants sterile and for genetic confinement
MANKRIQKELMDLQKDPPTSCSAGPAGEDLFHWQATIMGPSDSPYAGGVFFVNIHFPPDYPFKPPKVNFQTKVYHPNINSNGSICLDILKEQWSPALTISKVLLSISSLLTDPNPDDPLVPEIAHMYKNQRPRYEETARAWTQKYAMG

SEQ ID NO: 1988 - DNA, 836 bp, Arabidopsis thaliana
  misc_feature (1)..(836): Ceres CLONE ID no. 18246
  misc_feature (1)..(836): Also known as  Ceres CDNA ID no. 23366868
acaatcgctggactctgctactgcgaagaacaacaaattccttgtttatcatggcgaattccggcgaagagaagttgaagctctactcttactggagaagctcgtgtgctcatcgtgtccgtatcgccctcgctttgaaagggcttgattatgagtatataccagtgaatttgctcaagggtgatcaattcgattcagatttcaagaagatcaatccaatgggaactgtaccagctctggtggatggagatgttgtgattaatgattcttttgcgataataatgtatctggatgagaagtaccctgagccacctttgttacctcgtgacctccataaacgagctgtgaattaccaggcaatgagtattgtcttgtctggcatacagcctcatcaaaatctggctgttattaggtatatcgaggaaaagataaatgtggaggagaagactgcttgggttaataatgctatcacaaaaggatttacagctctcgagaaactgttggtgaattgcgctgggaaacttgcgactggtgatgaaatttacctggctgatctctttctagcaccacagatccacggagcaatcaacagattccagattaacatggaaccatacccaaatcttgcaaaatgttacgaatcatacaaggaactgcctgtgtttcaaaatgcactaccggaaaagcagccagatgctccttcttccaccaactgattccgtgaacccgtaagctacgctcagcttaataaaacctcagacaacaacaacaatgatgagagtaataccttgtactcgtacatgtatcatataaaccagttacatcttagttcctcc

SEQ ID NO: 1989 - protein, 221 aa, Arabidopsis thaliana
  misc_feature (9)..(82): Pfam Name: GST_N; Pfam Description: Glutathione S-transferase, N-terminal domain
  misc_feature (98)..(203): Pfam Name: GST_C; Pfam Description: Glutathione S-transferase, C-terminal domain
  misc_feature: Utility: Useful for making ornamental plants with modified leaves
  misc_feature: Utility: Useful for making plants sterile and for genetic confinement
  misc_feature: Utility: Useful for making plants with increased biomass and foliage
MANSGEEKLKLYSYWRSSCAHRVRIALALKGLDYEYIPVNLLKGDQFDSDFKKINPMGTVPALVDGDVVINDSFAIIMYLDEKYPEPPLLPRDLHKRAVNYQAMSIVLSGIQPHQNLAVIRYIEEKINVEEKTAWVNNAITKGFTALEKLLVNCAGKLATGDEIYLADLFLAPQIHGAINRFQINMEPYPNLAKCYESYKELPVFQNALPEKQPDAPSSTN

SEQ ID NO: 1990 - protein, 224 aa, Zea mays
  misc_feature (1)..(224): Ceres CLONE ID no. 1376280
  misc_feature: Utility: Useful for making ornamental plants with modified leaves
  misc_feature: Utility: Useful for making plants sterile and for genetic confinement
  misc_feature: Utility: Useful for making plants with increased biomass and foliage
MANLGEEKKGKLKLYSYWRSSCAHRVRIALSLKGLEYEYIPVNLLKGEQSDPDFKKINPMGTVPALVDGDVVISDSLAIIMYLDEKYPEPPLLPPDLHKRAVNFQAASIVLSGIQPHQNLGVIKFIEEKINSEEKTAWVTNAITKGFTALEKLLVSCAGKHATGDEVYLADLFLAPQIYGAINRFQINMEPYPTLAKCYESYKDLPAFQNAAPEKQPDAPASTS

SEQ ID NO: 1991 - protein, 213 aa, Zea mays
  misc_feature (1)..(213): Ceres CLONE ID no. 340652
  misc_feature: Utility: Useful for making ornamental plants with modified leaves
  misc_feature: Utility: Useful for making plants sterile and for genetic confinement
  misc_feature: Utility: Useful for making plants with increased biomass and foliage
MLYSYWRSSCSHRARIALNLKGVDYEYKAVNLLKGEQSDPEFVKLNPMKFVPALVDGSSVIGDSYAITLYLEDKYPEPPLLPQDLQKKALNHQIASIVASGIQPLHNLTVLRFIDQKVGAGESVLWTQQQIERGFTAIENLIQLKGCAGKYATGDEVQLADVFLAPQIYAAIERTKIDMSNYPTLARLHSEYMSHPAFEAALPGKQPDAPSSS

SEQ ID NO: 1992 - protein, 215 aa, Triticum aestivum
  misc_feature (1)..(215): Ceres CLONE ID no. 695982
  misc_feature: Utility: Useful for making ornamental plants with modified leaves
  misc_feature: Utility: Useful for making plants sterile and for genetic confinement
  misc_feature: Utility: Useful for making plants with increased biomass and foliage
MSAATGKPILYSKWFSSCSHRVRIALNLKGVDFEYRATNPMTDPDYEKINPVKFVPAFVDGDFVVSDSFAIILYMEDKYPQCPLLPRDLKKKALNLQIASIVCSSIQPLQSHAVIGSYLGTMDTNESLQMVQHYIDKGFRAIEKLLEGCDSKYATGDEVQMADVFLAPQIHAGVTRFQIDMSKYPILARLQDTYNEHPAFQAALPANQPDAPPSQ

SEQ ID NO: 1993 - protein, 212 aa, Zea mays
  misc_feature (1)..(212): Ceres CLONE ID no. 295402
  misc_feature: Utility: Useful for making ornamental plants with modified leaves
  misc_feature: Utility: Useful for making plants sterile and for genetic confinement
  misc_feature: Utility: Useful for making plants with increased biomass and foliage
MATEKPILYNAWISSCSHRVRIALNLKGVDYEYKSVNPRTDPDYEKINPIKYIPALVDGDIVVSDSLAISLYLEDKYPEHPLLPKDLKRKALNLQIANIVCSSIQPLQGYAVIGLHEGRMSPDEGLHIVQSYIDKGFRAIEKLLEGCESKYATGDDVQLADVFLEPQIHAGINRFQIDMSMYPILERLHDAYMQIPAFQAALPKNQPDAPSS

SEQ ID NO: 1994 - DNA, 1153 bp, Arabidopsis thaliana
  misc_feature (1)..(1153): Ceres CLONE ID no. 31044
  misc_feature (1)..(1153): Also known as  Ceres CDNA ID no. 23356964
aaccatctctctaaagcttcttctctcataacaatggcaagacaaatcaacatagagagtagtgtttctcaagttacctttatctcctccgccatccccgccgtatcttcctcctcctccatcaccgcttccgcctcattgtcctcttcacctactacatcttcctcttcttcgtcatcaacaaattctaacttcattgaggaagacaactctaaaagaaaagcatctcgaagatcattgtcatcgttagtctccgttgaagacgatgatgatcaaaacggtggaggtgggaaacggcgaaagaccaacggtggagataaacatccgacgtatagaggagtgaggatgaggagttggggaaaatgggtgtcggagattagagagccgagaaagaaatcaagaatctggctcgggacttatccaacggmtgagatggcagctcgagctcatgacgtagcggctttagccattaaaggtacaacggcttacctcaattttcccaagttagccggcgagcttcctcgtccagtcacaaattctcctaaagacattcaagccgccgcctctttagcggccgttaactggcaagattcggtcaacgatgtgagtaattctgaagtggctgaaatagttgaagccgagccgagtcgaaccgtggtggctcagttgttttcttcggacacaagcacgacgacgacgactcagagtcaagagtattcggaagcttcgtgtgcttcgacttcggcgtgtacggacaaagacagtgaggaagagaagctgtttgatttgccggatttgtttaccgatgagaatgagatgatgatacgaaacgatgcgttttgctactactcgtccacgtggcagctttgtggagccgatgctgggtttcggcttgaagagccgttttttctatctgaatgactaaagtacccctctcgagagagctctcactaacactttattagtttgccatttacttcttcttcattttctctatttacgtttgatatttttttttctttccaacttgagtgatattgattttttgtaaagaaacaatttcttttttttttcctagcaaaatcgtgtttgtgtaatataaatgtggtgataacatgttgaaatattgcagaataatataatgtagccttac

SEQ ID NO: 1995 - protein, 295 aa, Arabidopsis thaliana
  misc_feature (98)..(161): Pfam Name: AP2; Pfam Description: AP2 domain
  misc_feature (98)..(161): Pfam Name: AP2; Pfam Description: AP2 domain
  misc_feature: Utility: Useful for making ornamental plants with modified leaves
  misc_feature: Utility: Useful for making smaller plants
MARQINIESSVSQVTFISSAIPAVSSSSSITASASLSSSPTTSSSSSSSTNSNFIEEDNSKRKASRRSLSSLVSVEDDDDQNGGGGKRRKTNGGDKHPTYRGVRMRSWGKWVSEIREPRKKSRIWLGTYPTAEMAARAHDVAALAIKGTTAYLNFPKLAGELPRPVTNSPKDIQAAASLAAVNWQDSVNDVSNSEVAEIVEAEPSRTVVAQLFSSDTSTTTTTQSQEYSEASCASTSACTDKDSEEEKLFDLPDLFTDENEMMIRNDAFCYYSSTWQLCGADAGFRLEEPFFLSE

SEQ ID NO: 1996 - protein, 263 aa, Triticum aestivum
  misc_feature (1)..(263): Ceres CLONE ID no. 902699
  misc_feature: Utility: Useful for making ornamental plants with modified leaves
  misc_feature: Utility: Useful for making smaller plants
MESDAGENLFGTFSSSTTSITASSSSSPTSSTTTSSNSCTKHDSKISPPQNQNTPNSKKRQRSDDNENKHHPSYRGVRMRAWGKWVSEIREPRKKSRIWLGTYPTAEMAARAHDVAALAVKGHSAFLNFPNLAQDLPRPTTTSPKDIQAAAAKAATTTFFDDEIVNHCQAEKAEQNHGEQQASPSTLCMMDNSTEAEQIQAEQASSTQESSSSHSTADEETLFDLPDLFPDGNSGLFSYSSCWHLCAVDSGFRLEEQFLWENF

SEQ ID NO: 1997 - protein, 274 aa, Glycine max
  misc_feature (1)..(274): Ceres CLONE ID no. 709819
  misc_feature: Utility: Useful for making ornamental plants with modified leaves
  misc_feature: Utility: Useful for making smaller plants
TTIIKVSTMRKRINMESDADFNSFATSSSSTTPSIFFDTNTSSTSSSSTSPTSNSESCTKEHSKTPQNDSTTSQTSLENGKDSKGCKKRQIDNSNQNHHPTYRGVRMRNWGKWVSEIREPRKKSRIWLGTYPTAEMAARAHDVAALAIKGHSAYLNFPELAQELPRPVSTSPKDIQAAAAKAANTAFEEVRHCQITEEEAEQNQAEQASSSTLSMDNPQEPSSSHSTIDDDTLFDLPDLFPDGNNGLCSFSSSWHLCAVDSGFRLEESFFYENH

SEQ ID NO: 1998 - protein, 289 aa, Glycine max
  misc_feature (1)..(289): Public GI no. 37536842
  misc_feature: Utility: Useful for making ornamental plants with modified leaves
  misc_feature: Utility: Useful for making smaller plants
MAMAKELQETSSSSSSSAASTSSCSSAVTDAWSSPARPNAVAGGKRKKEVVGEADEAAGGGAGEEEEEEAEAAAAGKSSAATKKRKRSSDGKHPVYRGVRMRAWGKWVSEIREPRKKSRIWLGTFPTADMAARAHDVAALAIKGRAAHLNFPDLAGVLPRAASASPKDVQAAAALAAAFTTSPSSSPSSSLSADDVAPCVVHADADEQPAAAAKNDDDDGSTTAPVAAAAAAAAADEQQLFDLPDLLFDIQDGPFGFPAMWAPLADVDEVNAELRLEEPLLWDLGVTDA

SEQ ID NO: 1999 - protein, 281 aa, Glycine max
  misc_feature (1)..(281): Public GI no. 21908034
  misc_feature: Utility: Useful for making ornamental plants with modified leaves
  misc_feature: Utility: Useful for making smaller plants
MAQELHETSSCSATTTSSCTTSCCSSTVTDSSSSPPSPAAANAAPATRKRQALEAEAEAEAGGEEEEEEEEGCAGNKAAPAKKRPRGSEGKHPTFRGVRMRAWGKWVSEIREPRKKSRIWLGTFPTAEMAARAHDVAALAIKGRAAHLNFPDLAGALPRAASAAPKDVQAAAALAAAFTSPSSEPGAGAHEEPAAKDGAAPEEAAADAQAPVPVALPPPAASRPGTPSSGVEDERQLFDLPDLLLDIRDGFGRFPPMWAPLTDVEDVVNAELRLEEPLLWE

SEQ ID NO: 2000 - protein, 281 aa, Glycine max
  misc_feature (1)..(281): Public GI no. 25990951
  misc_feature: Utility: Useful for making ornamental plants with modified leaves
  misc_feature: Utility: Useful for making smaller plants
MAQELHETSSCSATTTSSCTTSCCSSTVTDSSSSPPSPAAANAAPATRKRQALEAEAEAEAGGEEEEEEEEGCAGNKAAPAKKRPRGSEGKHPTFRGVRMRAWGKWVSEIREPRKKSRIWLGTFPTAEMAARAHDVAALAIKGRAAHLNFPDLAGALPRAASAAPKDVQAAAALAAAFTSPSSEPGAGAHEEPAAKDGAAPEEAAADAQAPVPVALPPPAASRPGTPSSGVEDERQLFDLPDLLLDIRDGFGRFPPMWAPLTDVEEVVNAELRLEEPLLWE

SEQ ID NO: 2001 - DNA, 1259 bp, Arabidopsis thaliana
  misc_feature (1)..(1259): Ceres CLONE ID no. 38635
  misc_feature (1)..(1259): Also known as  Ceres CDNA ID no. 24419571
gatcggtcccttttgttttatcgttttagggtttgtagctcctttctctttttttcttttctcaatttcccccaaattaaaaaaaaactctctctttcagagatttacaaatttcatttctccaaatccgaaaccccaaagtgaatatttttccttctgggtttcttttgtttgcctggaaacatttgtctcagattttgattttgaccggagtactcatattctccggcgatttctccggcgacatcgtctgtgaaatggagggaattactcatccaatacctcgtactgttgaagaggtctttagcgacttcagaggtcgacgagctggtcttattaaagctctcactaatgatatggtgaagttttaccaaacgtgtgatcctgagaaggagaatttgtgtctctatggacttccaaatgagacatgggaggttaatctacccgttgaggaagttcctcctgagcttcctgaaccagctttaggcatcaatttcgctagagacggaatgcaagaaaaggactgggtatctttggtcgcagttcacagtgattcatggctgctttctgttgcattttactttggtgcacgtttcggatttggcaagaatgagaggaagaggctgttccagatgattaatgagctgccaaccattttcgaagttgtgagcggcaatgcaaagcagtccaaggatctatctgttaacaacaataatagcaaaagcaaacctagtggcgtcaagtctcgccaatccgaatctctcacaaaggttgcaaagatgtcatctccaccgccaaaagaagaagaagaagaagaagatgagagtgaagatgagagtgaagacgatgaacaaggtgcggtttgtggtgcttgtggagacaactacggtacagatgagttctggatttgctgcgacgcctgtgagaaatggttccatggaaaatgtgtgaagataacacctgcaaaagcagaacacatcaagcattacaaatgcccaacttgcagtaacaagagagccagaccttgaagttaaataaccaaattataagaaggtaaagtgagttaggagaaaattgtgaaagaagaaggtgaagtttccagtttataagaaatgccagtaaaagggactagaagatgtaagcaggtaaaaaatatttgtattgcttaatctttattgttggattgagactatttacagttggtgatgtcttttcttttctttttttttggatttttgttgttgttaatgttaattcta

SEQ ID NO: 2002 - protein, 256 aa, Arabidopsis thaliana
  misc_feature (202)..(252): Pfam Name: PHD; Pfam Description: PHD-finger
  misc_feature: Utility: Useful for making ornamental plants with modified leaves
  misc_feature: Utility: Useful for making plants with altered leaf shape eg curled leaves
MEGITHPIPRTVEEVFSDFRGRRAGLIKALTNDMVKFYQTCDPEKENLCLYGLPNETWEVNLPVEEVPPELPEPALGINFARDGMQEKDWVSLVAVHSDSWLLSVAFYFGARFGFGKNERKRLFQMINELPTIFEVVSGNAKQSKDLSVNNNNSKSKPSGVKSRQSESLTKVAKMSSPPPKEEEEEEDESEDESEDDEQGAVCGACGDNYGTDEFWICCDACEKWFHGKCVKITPAKAEHIKHYKCPTCSNKRARP

SEQ ID NO: 2003 - protein, 244 aa, Zea mays
  misc_feature (1)..(244): Ceres CLONE ID no. 1375513
  misc_feature: Utility: Useful for making ornamental plants with modified leaves
  misc_feature: Utility: Useful for making plants with altered leaf shape eg curled leaves
MEVITHPTPRTVDEVFTDFRGRRAGLIKALTTDMVKFYQTCDPEKENLCLYGLPNETWEVNLPVEEVPPELPEPALGINFARDGMQEKDWVSLVAVHSDSWLLSVAFYFGARFGFGKNERKKLFQMINELPTIFEIVTGNAKQSKDLSGNNNTSSKSKSNGLKVPKMSSPPPKEEDESEDEDEDDEQGAVCGACGDSDGTDEFWICCDACEKWFHGKCVKITPAKAEHIKHYKCPSCSNKRARP

SEQ ID NO: 2004 - protein, 252 aa, Arabidopsis thaliana
  misc_feature (1)..(252): Ceres CLONE ID no. 96978
  misc_feature: Utility: Useful for making ornamental plants with modified leaves
  misc_feature: Utility: Useful for making plants with altered leaf shape eg curled leaves
MEGIQHPIPRTVEEVFSDFRGRRAGLIKALSTDVQKFYHQCDPEKENLCLYGLPNETWEVNLPVEEVPPELPEPALGINFARDGMQEKDWISLVAVHSDSWLISVAFYFGARFGFGKNERKRLFQMINDLPTIFEVVTGNAKQSKDQSANHNSSRSKSSGGKPRHSESHTKASKMSPPPRKEDESGDEDEDDEQGAVCGACGDNYGGDEFWICCDACEKWFHGKCVKITPAKAEHIKHYKCPSCTTSKKMKA

SEQ ID NO: 2005 - protein, 252 aa, Arabidopsis thaliana; identical to SEQ ID NO: 2004
  misc_feature (1)..(252): Public GI no. 30017229
  misc_feature: Utility: Useful for making ornamental plants with modified leaves
  misc_feature: Utility: Useful for making plants with altered leaf shape eg curled leaves

SEQ ID NO: 2006 - protein, 252 aa, Glycine max
  misc_feature (1)..(252): Ceres CLONE ID no. 1242841
  misc_feature: Utility: Useful for making ornamental plants with modified leaves
  misc_feature: Utility: Useful for making plants with altered leaf shape eg curled leaves
MEGVPHPIPRTVEEVFTDFKGRRAGLIKALTTDVEKFYQQCDPEKENLCLYGFPNETWEVNLPVEEVPPELPEPALGINFARDGMQEKDWLSLVAVHSDSWLLAVAFYFGARFGFGKNERKRLFQMINDLPTIFELVTGSAKQSKDQPAAHNNGSKCKSSGKSHQSESQAKGMKMSAPPKEEDESGEEEEEDDEQGATCGACGDNYGTDEFWICCDMCERWFHGKCVKITPAKAEHIKQYKCPSCSNKRVRV

SEQ ID NO: 2007 - protein, 257 aa, Glycine max
  misc_feature (1)..(257): Public GI no. 12651665
  misc_feature: Utility: Useful for making ornamental plants with modified leaves
  misc_feature: Utility: Useful for making plants with altered leaf shape eg curled leaves
MEGMAQHPVPRTVEEVFSDYKGRRAGLIKALTTDVEKFYQLVDPEKENLCLYGFPNETWEVNLPVEEVPPELPEPALGINFARDGMQEKDWLSLVAVHSDSWLLAVAFYFGARFGFGKNDRKRLFQMINDLPTVFELATGTAKQSKDQLTAHNNGSNSKYKSSGKSRQSESQTKGVKMSAPVKEEVDSGEEEEEDDDEQGATCGACGDNYGTDEFWICCDMCEKWFHGKCVKITPAKAEHIKQYKCPGCSIKKPRIG

SEQ ID NO: 2008 - DNA, 1209 bp, Arabidopsis thaliana
  misc_feature (1)..(1209): Ceres CLONE ID no. 39155
  misc_feature (1)..(1209): Also known as  Ceres CDNA ID no. 23382069
aaattaaaacaaaaaaaacttagaagagaaacaatctcatcgctcagtgactgattcagatgaccagtgtctccgtcgccgtcgtagctcctccgcatcgttgcccattctctagtcatctgaatctgaacaagctttctcttcaaattcctagaaccggctggcggaggaaacagctagggtttgctttagcttctactgcggcttcagaatcaccatcggaagctacatatgatccggagctccgtttagttttcgagctcgctaccgattccgagttatatgagcttgagaaaatcctttttggtcccagctacttcagccctttgctgaaatcaatcccaaacaaaggaggaggtgaccggcttatgataggccaagacattgaagtgcgagatggttttatcgaagctcttgaatcgagattcttgtttctagctgcagatgctcgttcaacactcaggggttggaggccttcatacagaaacgttttacttgcggtgagaaataatttgaatattccctgctccagccaattgccaaccgaagacctagaagcagagatttttctttatcttgtcgacaatttctcgagtgaagcatcaggggtttttccaggcatgtgggaaaattctgaagtctcagaggcagagggaagcttagaactcgggctcagtaaatggaaagttgaactacttgccgcactacaagtgggtgctacagaggtccaatctatgattctgaagggtggtggcatgatcacattcgccaaagtttatcagttgttggctaagaaactatctggaaaagtattccttgaagctgccaactaccagattaggaaagagatgctaaaaaagggtgggcagtttgctgccattaacttggaatctcgagcagctctgttagcagcgaagcatggatttgcaggggctgcatccagatacattggcttaaaaacagcgatgcaattacttggccccatgatgtgggggacattactggctgacttagtgattcagatgctcgagactgactacgctagaatcctaagagcaatttacgcatttgcacagattcggatcaccaggacatacaggctaccttgtaaatgaagtaacagtttgttttctcaatctcagtgtccctacgaactatgtcggtaaacaatgtttttcacactcgtataattcgcttgtggttgaaacc

SEQ ID NO: 2009 - protein, 351 aa, Arabidopsis thaliana
  misc_feature: Utility: Useful for making ornamental plants with modified leaves
  misc_feature: Utility: Useful for making smaller plants
MTSVSVAVVAPPHRCPFSSHLNLNKLSLQIPRTGWRRKQLGFALASTAASESPSEATYDPELRLVFELATDSELYELEKILFGPSYFSPLLKSIPNKGGGDRLMIGQDIEVRDGFIEALESRFLFLAADARSTLRGWRPSYRNVLLAVRNNLNIPCSSQLPTEDLEAEIFLYLVDNFSSEASGVFPGMWENSEVSEAEGSLELGLSKWKVELLAALQVGATEVQSMILKGGGMITFAKVYQLLAKKLSGKVFLEAANYQIRKEMLKKGGQFAAINLESRAALLAAKHGFAGAASRYIGLKTAMQLLGPMMWGTLLADLVIQMLETDYARILRAIYAFAQIRITRTYRLPCK

SEQ ID NO: 2010 - protein, 237 aa, Glycine max
  misc_feature (1)..(237): Ceres CLONE ID no. 676435
  misc_feature: Utility: Useful for making ornamental plants with modified leaves
  misc_feature: Utility: Useful for making smaller plants
  misc_feature (10)..(10): Xaa is any aa, unknown, or other
  misc_feature (173)..(173): Xaa is any aa, unknown, or other
  misc_feature (215)..(215): Xaa is any aa, unknown, or other
  misc_feature (231)..(231): Xaa is any aa, unknown, or other
MIGVDLGLRXQFIAALESRFFFLAADARSTLRGWRPSYRNVLLQIRKKLNIPCSTQLSTHDLELEIFLHLLHCNSTEEESSQGQATLQHGLSQWKVQSKVGAQDIPSILLKGGGVFTLSKIYQLLARKLSGKVLVEAANYQVKKELVKKGGQLAMINLESRAAMLAAKQGFLXAASRYLGFRSVVTLLGPVLWGTFLADLVIQMLGTDYARILRXIYALAQIRVIRTYRLXSEVTDE

SEQ ID NO: 2011 - DNA, 742 bp, Arabidopsis thaliana
  misc_feature (1)..(742): Ceres CLONE ID no. 107988
  misc_feature (1)..(742): Also known as  Ceres CDNA ID no. 23389578
atcttgtgatcatcccaagacaaaaccagagaaaaagacctttctgtttttttaagaagtctttatatttttttttttgtcggagaatcttataagcatggcttcaggaggatcaaagtcggcagctttcatgcttctgatgctgaatcttggtctctatttcgtcatcaccatcatcgcttcttgggctgttaatcacggcatagagagaactcgcgagtctgcgtcgacactgtcacttccggcgaagatattcccgatatacttcccggtggggaacatggcgaccggttttttcgtaatattcacgttaatcgccggcgtcgtcggaatggccacatcactcaccggaatcatcaacgttcttcaatgggactctccgaatctccactccgccgcggcttcctctctaatctcctggtctctcactctcctcgccatgggattggcctgcaaggagatcaacataggctggaccgaagccaatctaagaactcttgaagttctgactataattgtgagtgctactcagttgttgtgcaccggagctattcatgctggagtcggagaaacagtcgcctccggagaaaggcctcatcttgggagagtttgagtttcatgattcttcttaaaagcggttttacatttgcttcagatcgtgtaatttgtgtgttgtgtcttgtgtgtgtttattcttttgttttgtttgattattatgatcatgtaaaatgattagtttatg

SEQ ID NO: 2012 - protein, 171 aa, Arabidopsis thaliana
  misc_feature (15)..(156): Pfam Name: AWPM-19; Pfam Description: AWPM-19-like family
  misc_feature: Utility: Useful for making ornamental plants with modified leaves
  misc_feature: Utility: Useful for making plants sterile and for genetic confinement
  misc_feature: Utility: Useful for making plants with altered leaf shape eg curled leaves
MASGGSKSAAFMLLMLNLGLYFVITIIASWAVNHGIERTRESASTLSLPAKIFPIYFPVGNMATGFFVIFTLIAGVVGMATSLTGIINVLQWDSPNLHSAAASSLISWSLTLLAMGLACKEINIGWTEANLRTLEVLTIIVSATQLLCTGAIHAGVGETVASGERPHLGRV

SEQ ID NO: 2013 - protein, 170 aa, Brassica napus
  misc_feature (1)..(170): Ceres CLONE ID no. 948896
  misc_feature: Utility: Useful for making ornamental plants with modified leaves
  misc_feature: Utility: Useful for making plants sterile and for genetic confinement
  misc_feature: Utility: Useful for making plants with altered leaf shape eg curled leaves
MASGGSKSAAFMLLLLNLGLYFVVTIIAAWAVNHGIERARESASVLSLPAKIFPIYFPVGNMATGFFVIFTLIAGVVGMATSLTGIMNVLEWDSPNLHSAAASSLISWSLTLLAMGLACKEINIGWTEANLRTLEVMTIIVSGTQLLCTGAIHVGVGETVDAVRPHVGRA

SEQ ID NO: 2014 - protein, 169 aa, Brassica napus
  misc_feature (1)..(169): Public GI no. 50878365
  misc_feature: Utility: Useful for making ornamental plants with modified leaves
  misc_feature: Utility: Useful for making plants sterile and for genetic confinement
  misc_feature: Utility: Useful for making plants with altered leaf shape eg curled leaves
MATGGPSSMSAGLLFLNLVLYVVVAVIAGWAINYSIDESFNSLQGVSPPVRLFPIYFPIGNLATGFFVIFALLAGVVGVSTSLTGLHDVSQGYPASMMSAAAASIVTWTLTLLAMGLACKEISIGWRPPSLRALETFTIILAGTQLLCAGSLHAGAHVAIIQNPMVSRV

SEQ ID NO: 2015 - protein, 163 aa, Triticum aestivum
  misc_feature (1)..(163): Ceres CLONE ID no. 685420
  misc_feature: Utility: Useful for making ornamental plants with modified leaves
  misc_feature: Utility: Useful for making plants sterile and for genetic confinement
  misc_feature: Utility: Useful for making plants with altered leaf shape eg curled leaves
MASGLLFLNLIMYVVVAVIAGWAVNYSIEDSAHSLRGASPPVRLFPVYFPMGNLATGFFVIFALLAGAVGISTSLTGLRDVTEGYPASMMSAAASALVTWTLTLLAMGLACKEISIGLRPPSLRALETFTIILAGTQLLCVGSLHAGANAAIVQTPMGVRARV

SEQ ID NO: 2016 - protein, 169 aa, Zea mays
  misc_feature (1)..(169): Ceres CLONE ID no. 705978
  misc_feature: Utility: Useful for making ornamental plants with modified leaves
  misc_feature: Utility: Useful for making plants sterile and for genetic confinement
  misc_feature: Utility: Useful for making plants with altered leaf shape eg curled leaves
  misc_feature (105)..(105): Xaa is any aa, unknown, or other
MGSALLSLNLIMYVVVAVIAGWAINYSIDESRNSLKGATPPVRLFPIYFPIGNLATGFFVIFALVTGVVGISTSLAGLHEVSQGYPASMMSAAASALVTWTLTVXRHGASVQGDQPQREAREPAHLGGVHHHPDRHAAALRRVAPRRRARGHPGDAYRRQSLAEVRDDS

SEQ ID NO: 2017 - DNA, 987 bp, Arabidopsis thaliana
  misc_feature (1)..(987): Ceres CLONE ID no. 109912
  misc_feature (1)..(987): Also known as  Ceres CDNA ID no. 23362001
ataactaacctcccctctctctctctctttctctctgctttcttggtatggctgctgacgtcagctctctcgtacggatactgagtaggttcaaggatgatcggacggttgtaaaagattccaccggaccaagatccacggtggcgctcatgacacgcgatctcctcggaatcggcggttgtgtgggtggaggaggaggaggagacgaacagtcgctggagcttgaccttgacgtccaagtccctaacggatgggaaaaacgtctcgacttaaagtcagggaaagtgtatctgcaacaacaatgcaattcaacgagctcgtcatcatcgtctcatcatcatcatcatcatcacgaagaccaaaccaaccaaacagttccaagatttcaagatttgaatgtgccaccgatttccgataagtttccggcgaaaccattgttaagcctcttcgacgatgacgacgacacaagccttgaactgaagctagttccgtcttctatctctcgtcctcttcctcctcctctgtcttctttttctccaaatcagtctctctcgtatctatcgagtgtttgcacactagataaggtgaaattggctttggaaagggcggagaaagatacaaagaaacgccaatctcctgaagatgacggcgtttacgatggaaccgcttctgccaccgtcgcggcgtctcaggtggcggctggatgtccagggtgtttatcgtacgtgtttgtggcaaagaacaatccgaaatgcccgaggtgtcattcgtttgttcctttgcctgccatgaagaagcctaagattgatcttaacatttcgatgtgaaaaaaactttgggggatagaattgaatggttttattttgtaggttcgatttctgtaaatgatagataaaatcagggggtttcattgaaaagaaattaaatgcagaaaggaagagatggatgttattttgtaaattgttatgtaatggattttctttgatg

SEQ ID NO: 2018 - protein, 259 aa, Arabidopsis thaliana
  misc_feature: Utility: Useful for making ornamental plants with modified leaves
  misc_feature: Utility: Useful for making plants with altered leaf shape eg curled leaves
  misc_feature: Utility: Useful for making plants with increased biomass and foliage
MAADVSSLVRILSRFKDDRTVVKDSTGPRSTVALMTRDLLGIGGCVGGGGGGDEQSLELDLDVQVPNGWEKRLDLKSGKVYLQQQCNSTSSSSSSHHHHHHHEDQTNQTVPRFQDLNVPPISDKFPAKPLLSLFDDDDDTSLELKLVPSSISRPLPPPLSSFSPNQSLSYLSSVCTLDKVKLALERAEKDTKKRQSPEDDGVYDGTASATVAASQVAAGCPGCLSYVFVAKNNPKCPRCHSFVPLPAMKKPKIDLNISM

SEQ ID NO: 2019 - protein, 245 aa, Brassica napus
  misc_feature (1)..(245): Ceres CLONE ID no. 966236
  misc_feature: Utility: Useful for making ornamental plants with modified leaves
  misc_feature: Utility: Useful for making plants with altered leaf shape eg curled leaves
  misc_feature: Utility: Useful for making plants with increased biomass and foliage
  misc_feature (188)..(188): Xaa is any aa, unknown, or other
  misc_feature (198)..(198): Xaa is any aa, unknown, or other
  misc_feature (200)..(200): Xaa is any aa, unknown, or other
  misc_feature (201)..(201): Xaa is any aa, unknown, or other
  misc_feature (202)..(202): Xaa is any aa, unknown, or other
  misc_feature (225)..(225): Xaa is any aa, unknown, or other
  misc_feature (243)..(243): Xaa is any aa, unknown, or other
MTADVSSLVRLLSRYNDDRTTVKDSARQGSSVALMTRDLLGSGSCRGGGGGDQSLELDLDLKVPNGWEKRLDLKSGKVYLQQQNSTTSSHHRRAEQSNQTFRKFQDLNFPSKSPVRPLLSLFDDTSLELKLVTSSSSSPASSSSSSLCVSSTSSSFQSVCTLDKVKSALERAGRVSSGTLKKRKSPEXEDVCDQTASXAXXXPVAVGCPGCLSYVLVMKNDPKCXRCHSFVALPAVKRPKIDXNI

SEQ ID NO: 2020 - DNA, 1160 bp, Arabidopsis thaliana
  misc_feature (1)..(1160): Ceres CLONE ID no. 154718
  misc_feature (1)..(1160): Also known as  Ceres CDNA ID no. 23376572
atcttttcttacaaagactttttgacatctccccctccagctattatatagtctccttttttcttttctgcattcacataatattgcccctatatagtttacacaacatcatacccaccaacatatataatcttgatcatagagagataaacagaggccgctatcaagaacaagactaagaacaagacttcactaggagtacaagtatgggaagagcaccgtgttgtgacaaagcaaacgtgaagaaagggccttggtctcctgaggaagatgcaaaactcaaatcttacattgaaaatagtggcaccggaggcaattggatcgctttgcctcaaaagattggtttaaagagatgtggaaagagttgcaggctgaggtggcttaactatcttagaccaaacatcaaacacggtggcttctctgaggaagaagaaaacatcatttgtagcctttaccttacaattggtagcaggtggtctataatcgctgctcaattgccgggacgaacagacaacgatataaaaaactattggaacacgaggctcaagaagaaactcattaacaaacaacgcaaggagcttcaagaagcttgtatggagcagcaagagatgatggtgatgatgaagagacaacaccaacaacaacaaatccaaacttcttttatgatgagacaagaccaaacaatgttcacatggccactacatcatcataatgttcaagttccagctcttttcatgaatcaaaccaactcgttttgcgaccaagaagatgttaagccagtgctcatcaagaacatggtcaagatcgaagatcaagaactggagaaaacaaaccctcatcatcatcaagattcaatgacaaacgcttttgatcatctctctttctctcaactcttgttagatcctaatcataaccacttaggatcaggagagggtttctccatgaactctatcttgagcgccaacacaaactctccattgcttaacacaagtaatgataatcagtggttcgggaatttccaggccgaaaccgtaaacttgttctcaggagcctccacaagtacttcggcagatcaaagcactataagttgggaagacataagctctcttgtttattctgattcaaagcaatttttttaattataataatatattattctt

SEQ ID NO: 2021 - protein, 310 aa, Arabidopsis thaliana
  misc_feature (14)..(62): Pfam Name: Myb_DNA-binding; Pfam Description: Myb-like DNA-binding domain
  misc_feature (14)..(62): Pfam Name: Myb_DNA-binding; Pfam Description: Myb-like DNA-binding domain
  misc_feature: Utility: Useful for making ornamental plants with modified leaves
  misc_feature: Utility: Useful for making plants sterile and for genetic confinement
  misc_feature: Utility: Useful for making plants with increased biomass and foliage
  misc_feature: Utility: Useful for making smaller plants
MGRAPCCDKANVKKGPWSPEEDAKLKSYIENSGTGGNWIALPQKIGLKRCGKSCRLRWLNYLRPNIKHGGFSEEEENIICSLYLTIGSRWSIIAAQLPGRTDNDIKNYWNTRLKKKLINKQRKELQEACMEQQEMMVMMKRQHQQQQIQTSFMMRQDQTMFTWPLHHHNVQVPALFMNQTNSFCDQEDVKPVLIKNMVKIEDQELEKTNPHHHQDSMTNAFDHLSFSQLLLDPNHNHLGSGEGFSMNSILSANTNSPLLNTSNDNQWFGNFQAETVNLFSGASTSTSADQSTISWEDISSLVYSDSKQFF

SEQ ID NO: 2022 - protein, 309 aa, Arabidopsis thaliana
  misc_feature (1)..(309): Public GI no. 2832408
  misc_feature: Utility: Useful for making ornamental plants with modified leaves
  misc_feature: Utility: Useful for making plants sterile and for genetic confinement
  misc_feature: Utility: Useful for making plants with increased biomass and foliage
  misc_feature: Utility: Useful for making smaller plants
MGRAPCCDKANVKKGPWSPEEDAKLKSYIENSGTGGNWIALPQKIGLKRCGKSCRLRWLNYLRPNIKHGGFSEEEENIICSLYLTIGSRWSIIAAQLPGRTDNDIKNYWNTRLKKKLINKQRKELQEACMEQQEMMVMMKRQHQQQQIQTSFMMRQDQTMFTWPLHHHNVQVPALFRIKPTRFATKKMLSQCSSRTWSRSKIKNWRKQTSSSSRFNDNAFDHLSFSQLLLDPNHNHLGSGEGFSMNSILSANTNSPLLNTSNDNQWFGNFQAETVNLFSGASTSTSADQSTISWEDISSLVYSDSKQFF

SEQ ID NO: 2023 - protein, 321 aa, Arabidopsis thaliana
  misc_feature (1)..(321): Public GI no. 50872446
  misc_feature: Utility: Useful for making ornamental plants with modified leaves
  misc_feature: Utility: Useful for making plants sterile and for genetic confinement
  misc_feature: Utility: Useful for making plants with increased biomass and foliage
  misc_feature: Utility: Useful for making smaller plants
MGRAPCCDKASVKKGPWSPEEDAKLKSYIEQNGTGGNWIALPQKIGLKRCGKSCRLRWLNYLRPNIKHGGFSEEEDRIILSLYISIGSRWSIIAAQLPGRTDNDIKNYWNTRLKKKLFGKQSRKDQRQQQHLARQAAAAASDLQIKQEASRGANEADGLAAGANYTWHHHHAMAVPVHPMSAPMVVEGGRVGDDVDESIRKLLFKLGGNPFAASPAPPCIPPPPMYEEAPSFVPPLAHGVPLNEGGMQCSSVLPALELDENFHFNHVKLDGLECLFGMGDHQNMRWNEVSPLVCPNNAVASSSQGMQQYCLVEEPADLGMQ

SEQ ID NO: 2024 - DNA, 1085 bp, Zea mays
  misc_feature (1)..(1085): Ceres CLONE ID no. 226122
  misc_feature (1)..(1085): Also known as  Ceres CDNA ID no. 23747788
aactctctctctctctctctctatctgtctgcccgtggcgtgctccactgattcttcttcttcttctacctcccggcctcctcccccttcttctttgcctgccttattagtatctcgcctcacaccacacagctagcagacagccagacacgcgctgctttctgatctctccccggatcggaggctcctcccaacataccaccctgccagccgcgccgccacgtccacgccggccggccaccaagcaagcatggatatggtttcgcagtccgagcacctgtgctacgtccgctgcacctactgcaacaccgtgctcgcggttggggttccatgcaagaggctgatggacacggtgactgtcaagtgcggccactgcaacaacctctcctacctcagtccacggccccccatggtgcagccgctctcgccgactgatcaccctttggggccattccagtgtcagggaccctgcaacgactgcaggaggaaccaaccgctgccgctggcttcgccgtcatcaactgagctaagcccgagaatgcccttcgtagtcaagcccccggagaagaaacaccgcctcccatctgctdataatcgcttcatgagggaggagattcagcgcatcaaagctgcgaagccagatatccctcacagggaggccttcagcatggctgccaagaattgggcaaagtgtgacccgcgctgctcgacggctgcctctaccgaaacttctaacagcgctcctgctgagcctagagttgtgcccactccccagttaactgagccacgctttgacctggaggatagggccaaggggcaagtcattgagagcttcgacatcttcaagcatattgagcgcagcatctagaggtcgttcgatgccgctgttgtagcccagtatcgatcgagtaccatcagctatatgtataacctatcccgtatcgccgtcgtcgcctcgcaatcatgcatccccatcctgtacttttacccccgtacgtgttactgttgctgttattctcgttatggttggattgtacgcaccatttaattatgaacagctgctacctatatatataatatttgcc

SEQ ID NO: 2025 - protein, 205 aa, Zea mays
  misc_feature (1)..(156): Pfam Name: YABBY; Pfam Description: YABBY protein
  misc_feature: Utility: Useful for making ornamental plants with modified leaves
  misc_feature: Utility: Useful for making plants sterile and for genetic confinement
  misc_feature: Utility: Useful for making plants with increased biomass and foliage
  misc_feature: Utility: Useful for modifying fruit shape, composition and seed yield
MDMVSQSEHLCYVRCTYCNTVLAVGVPCKRLMDTVTVKCGHCNNLSYLSPRPPMVQPLSPTDHPLGPFQCQGPCNDCRRNQPLPLASPSSTELSPRMPFVVKPPEKKHRLPSAYNRFMREEIQRIKAAKPDIPHREAFSMAAKNWAKCDPRCSTAASTETSNSAPAEPRVVPTPQLTEPRFDLEDRAKGQVIESFDIFKHIERSI

SEQ ID NO: 2026 - protein, 152 aa, Zea mays
  misc_feature (1)..(152): Ceres CLONE ID no. 425913
  misc_feature: Utility: Useful for making ornamental plants with modified leaves
  misc_feature: Utility: Useful for making plants sterile and for genetic confinement
  misc_feature: Utility: Useful for making plants with increased biomass and foliage
  misc_feature: Utility: Useful for modifying fruit shape, composition and seed yield
MVQPLSPTDHPLGPFQCQGPCSECRRNQPLPLASPTSTDLTPRMPFVVKPPEKKHRLPSAYNRFMREEIQRIKAAKPDIPHREAFSMAAKNWAKCDPRCSTTASTATSNSAPEAARVVPTPHVTEPRFDLEDRAKEHVIESFDIFKQIERTI

SEQ ID NO: 2027 - protein, 112 aa, Triticum aestivum
  misc_feature (1)..(112): Ceres CLONE ID no. 888225
  misc_feature: Utility: Useful for making ornamental plants with modified leaves
  misc_feature: Utility: Useful for making plants sterile and for genetic confinement
  misc_feature: Utility: Useful for making plants with increased biomass and foliage
  misc_feature: Utility: Useful for modifying fruit shape, composition and seed yield
  misc_feature (104)..(104): Xaa is any aa, unknown, or other
MDLVSPSEHLCYVRCTYCNTVLALQVGVPCKRLMDTVTVKCGHCNNLSFLSPRPPPMVQPLSPNDHHHPMGPFQGWTDCRRNQPLPPLASPTSSDASPRAPFVXKPPEKKHR

SEQ ID NO: 2028 - protein, 194 aa, Triticum aestivum
  misc_feature (1)..(194): Public GI no. 40645413
  misc_feature: Utility: Useful for making ornamental plants with modified leaves
  misc_feature: Utility: Useful for making plants sterile and for genetic confinement
  misc_feature: Utility: Useful for making plants with increased biomass and foliage
  misc_feature: Utility: Useful for modifying fruit shape, composition and seed yield
MDLVSPSEHLCYVRCTYCNTVLAVGVPCKRLMDTVTVKCGHCNNLSFLSPRPPMVQPLSPTDHPLGPFQGPCTDCRRNQPLPLVSPTSNEGSPRAPFVVKPPEKKHRLPSAYNRFMREEIQRIKAAKPDIPHREAFSMAAKNWAKCDPRCSSTVSTSNSNPEPRVVAAPIPHQERANEQVVESFDIFKQMERSG

SEQ ID NO: 2029 - protein, 166 aa, Triticum aestivum
  misc_feature (1)..(166): Public GI no. 58891213
  misc_feature: Utility: Useful for making ornamental plants with modified leaves
  misc_feature: Utility: Useful for making plants sterile and for genetic confinement
  misc_feature: Utility: Useful for making plants with increased biomass and foliage
  misc_feature: Utility: Useful for modifying fruit shape, composition and seed yield
VPQSEHLCYVRCNFCNTVLAVGIPCKRLLETVTVKCGHCSNLSFLSTRPPLQGQCLDPQTSLTLQSFCGDFRKGTQFPSPSSSTSSEPSSPKAPFVVKPPEKKHRLPSAYNRFMKEEIQRIKAANPEIPHREAFSAAAKNWARYIPNSPAASSVCGSSSNEQNDNV

SEQ ID NO: 2030 - protein, 170 aa, Triticum aestivum
  misc_feature (1)..(170): Public GI no. 58891235
  misc_feature: Utility: Useful for making ornamental plants with modified leaves
  misc_feature: Utility: Useful for making plants sterile and for genetic confinement
  misc_feature: Utility: Useful for making plants with increased biomass and foliage
  misc_feature: Utility: Useful for modifying fruit shape, composition and seed yield
VPQSEHLCYVRCNFCNTVLAVGIPCKRLLETVTVKCGHCSNLSFLSTRPPLQGQCLDPQTSLTLQSFCGDFRKGTQFPSPSSSTSSEPSSPKAPFVVKPPEKKHRLPSAYNRFMKEEIQRIKAANPEIPHREAFSAAAKNWARYIPNSPAASSVCGSSSNGFYENFAGTK

SEQ ID NO: 2031 - protein, 165 aa, Triticum aestivum
  misc_feature (1)..(165): Public GI no. 41745674
  misc_feature: Utility: Useful for making ornamental plants with modified leaves
  misc_feature: Utility: Useful for making plants sterile and for genetic confinement
  misc_feature: Utility: Useful for making plants with increased biomass and foliage
  misc_feature: Utility: Useful for modifying fruit shape, composition and seed yield
MDMANQSSSEHLCYVRCNFCSTVLAVGIPCKRLMDTVTVKCGHCSNLSFLSTRPPIQGQYYDHQTSLHHQSLCSEFKKGGSSSFSSSTSSEPLSPKAPFVVKPPEKKHRLPSAYNRFMKEEIQRIKAANPEIPHREAFSAAAKNWARYIPNTPPPVPVTTSNHNI

SEQ ID NO: 2032 - protein, 165 aa, Glycine max
  misc_feature (1)..(165): Ceres CLONE ID no. 545652
  misc_feature: Utility: Useful for making ornamental plants with modified leaves
  misc_feature: Utility: Useful for making plants sterile and for genetic confinement
  misc_feature: Utility: Useful for making plants with increased biomass and foliage
  misc_feature: Utility: Useful for modifying fruit shape, composition and seed yield
MDLVPPSEHLCYVRCNFCNTVLAVGIPCKRLLDTVTVKCGHCSNLSFLSTRPPSSQSQSVDHTLSLQGFYSNAKKGQASSSSSSPTTSNESVSPKAASFVVKPPEKKHRLPSAYNRFMKEEIQRIKAANPEIPHREAFSAAAKNWARFIPNSPTSSVSATKVNAD

SEQ ID NO: 2033 - protein, 162 aa, Glycine max
  misc_feature (1)..(162): Public GI no. 58891129
  misc_feature: Utility: Useful for making ornamental plants with modified leaves
  misc_feature: Utility: Useful for making plants sterile and for genetic confinement
  misc_feature: Utility: Useful for making plants with increased biomass and foliage
  misc_feature: Utility: Useful for modifying fruit shape, composition and seed yield
MDLAQTSEHLCYVRCSFCNTVLAVGIPFKRLLDTVTVKCGHCSNLSFLSTRPPLQGQCFDHQTALQHQAFFSDYKKGQSSSSFSSSSSEPSSPKAPFVVKPPEKKHRLPSAYNRFMKEEIQRIKAANPEIPHREAFSAAAKNWARYIPNTPNGPLSESRNNA

SEQ ID NO: 2034 - protein, 186 aa, Glycine max
  misc_feature (1)..(186): Public GI no. 58891059
  misc_feature: Utility: Useful for making ornamental plants with modified leaves
  misc_feature: Utility: Useful for making plants sterile and for genetic confinement
  misc_feature: Utility: Useful for making plants with increased biomass and foliage
  misc_feature: Utility: Useful for modifying fruit shape, composition and seed yield
MNLEEKSVMDSQAPTQSEHLCYVRCNFCNTVLAVGIPCKRMLDTVTVKCGHCSNLSFLSVRPPLHGQCLDHQVNLTLQTQSFCGNELKKGSSSSSSSSSTSSDQPSSPKAPFVVKPPEKKHRLPSAYNRFMKEEIQRIKAANPEIPHREAFSAAAKNWARYIPNSPPGSISAGSSSINGFDFGEMK

SEQ ID NO: 2035 - protein, 196 aa, Glycine max
  misc_feature (1)..(196): Public GI no. 60649824
  misc_feature: Utility: Useful for making ornamental plants with modified leaves
  misc_feature: Utility: Useful for making plants sterile and for genetic confinement
  misc_feature: Utility: Useful for making plants with increased biomass and foliage
  misc_feature: Utility: Useful for modifying fruit shape, composition and seed yield
MDFLPGSTDHLCYVRCNFCDTLLAVGVPCRRLMDTVTVKCGHCSHLSFLSARPLLQNQSLELLSTQNFCGDNKKSQQSSSSSPLTPNQQVVPKVPNVVKPPEKKHRLPSAYNRFMKEEIKRIKAGNPEIPHREAFSMAAKNWARFDPQLLHGSTTSTQIEKQVKPNQEIHEMVTAGGRVKQEDMRQLQAAARSQIT

SEQ ID NO: 2036 - protein, 174 aa, Glycine max
  misc_feature (1)..(174): Public GI no. 58891028
  misc_feature: Utility: Useful for making ornamental plants with modified leaves
  misc_feature: Utility: Useful for making plants sterile and for genetic confinement
  misc_feature: Utility: Useful for making plants with increased biomass and foliage
  misc_feature: Utility: Useful for modifying fruit shape, composition and seed yield
MDLIPSPEHLCYVRCNFCSTVLAVGIPCKRTLDTVTVKCGHCGNISFLSTRPPIQGQCLDHQVDAFQSFRNEYRKGQSSSSSSSTSCGQPTSPNEPNYVVKPPERKHRLPSAYNRYMKEEIQRIKSANPEIPHREAFSSAAKNWAKYVPHSQAGTVSGGKKNERVPAKESLDGA

SEQ ID NO: 2037 - protein, 173 aa, Arabidopsis thaliana
  misc_feature (1)..(173): Ceres CLONE ID no. 9132
  misc_feature: Utility: Useful for making ornamental plants with modified leaves
  misc_feature: Utility: Useful for making plants sterile and for genetic confinement
  misc_feature: Utility: Useful for making plants with increased biomass and foliage
  misc_feature: Utility: Useful for modifying fruit shape, composition and seed yield
MTASRASPQAEHLYYVRCSICNTILAVGIPLKRMLDTVTVKCGHCGNLSFLTTTPPLQGHVSLTLQMQSFGGSDYKKGSSSSSSSSTSSDQPPSPSPPFVVKPPEKKQRLPSAYNRFMRDEIQRIKSANPEIPHREAFSAAAKNWATYIPNSPTSITSGGHNMIHGLGFGEKK

SEQ ID NO: 2038 - protein, 164 aa, Brassica napus
  misc_feature (1)..(164): Ceres CLONE ID no. 953501
  misc_feature: Utility: Useful for making ornamental plants with modified leaves
  misc_feature: Utility: Useful for making plants sterile and for genetic confinement
  misc_feature: Utility: Useful for making plants with increased biomass and foliage
  misc_feature: Utility: Useful for modifying fruit shape, composition and seed yield
MANSPTAAEQLCYIPCNFCNIVLAVSVPCSSLFDIVTVRCGHCTNLWSVNMAAALQSLSRPNFQVTPYATPEYGSSSRGHTKISSRISARTISEQRIVNRPPEKRQRVPSAYNQFIKEEIQRIKANNPDISHREAFSTAAKNWAHFPHIHFGLMLESNKQAKLA

SEQ ID NO: 2039 - DNA, 1681 bp, Glycine max
  misc_feature (1)..(1681): Ceres CLONE ID no. 691319
  misc_feature (1)..(1681): Also known as  Ceres CDNA ID no. 23404488
aaaagggtgtccaaagaaggaatcacacaagagaaattttgggtggatcttggtaatttaaatttggtccaaaaatagtaagaaaaaaaaaccatagttcatttaattttcatgtccttgctaacggtggcgcaccaaagggggtcaggtgagtttatccggttcacggaaagtcatggcggtggtggcgatgacgtcagtggtgacggtgaacatggttgtggacatgatgatggaagtggtgctggaggttcactagggttgaattttaaccaagtgatgcaacaaggtgaggtgacaatgcaaggtggttcattggtttcagggtataacaggggtgatccagagttgagagaaatagtttcagctttgacacacgtggtgtcttcagggtctggccagaggagcaccgaattgacccagcaaagtggttttcctatgatgtctgcttcttctctttcacgtttgtctgctttctcttcttcttctccttctccttcttctggagcctcttgggttggccacaaaagaggcagagaagaagaagagaatagtacttcacataacttgatgcaacaacaacaacaaagtgctccaagactcttcagaaacattggtgacttcatggtgccttctcaaggagactcatcatcagtgacagaagaagcccccacctccacaactacaactgtaaccgccgtcactgaaaacccaccaggaggtggggaaaggaggagaaagtacagaggagtgaggcagaggccatggggaaaatgggcagcagaaatccgtgatccacacaaagcagcaagagtttggctaggcacatttgacacagaagaagcagcagcaagagcctatgatgaagctgcattgaggttcagaggcaacagagcaaagcttaacttccctgaaaatgtaagagcagttccacccattcaaccttttcaagccaccactaggctaaccgtttctgattccaccacctctcaattccggccactctccgcggtggcgccacccttcattcagcagccacagattcagggctcctctgacttgatcagagactacttgcaatactctcagcttctacagagtgattttcaacagcaacaaatacaacaacaacagcagcagcagcggcagcagcagcagcggcagcggcagcagcggcagcagcagcagcaacaacaacaacaaccatctagtttgcttcagcagttgtactataatgcacaatttgcttcacttcaatcaccttcaatgctatcatcatctccttcattttcttcttctgtgtctccagcaccattcccattattcacaacctctgcttctttccccttgttttcaagtcaacaaatgggctatttccagccaccggaaagccgcaatcccgctggcggcgtgccggagtttccaacgtccacatggtcggataccagtagccagccaccaccttctggttgatacagtgttttagtttccttcatattttcctttttcttttttctttctttcattcttagcataaaaaaaaaagacttgttatacttatttcttttttcaagggtgaaactatgatatagttttttttaagtatttttggtactattctcgtatcagaattagagtttcagtaatttatgttgatattcaatacaaatctttattatgt

SEQ ID NO: 2040 - protein, 453 aa, Glycine max
  misc_feature (209)..(272): Pfam Name: AP2; Pfam Description: AP2 domain
  misc_feature: Utility: Useful for making ornamental plants with modified leaves
  misc_feature: Utility: Useful for making plants with increased biomass
  misc_feature: Utility: Useful for making plants with increased biomass and foliage
  misc_feature: Utility: Useful for making smaller plants
MSLLTVAHQRGSGEFIRFTESHGGGGDDVSGDGEHGCGHDDGSGAGGSLGLNFNQVMQQGEVTMQGGSLVSGYNRGDPELREIVSALTHVVSSGSGQRSTELTQQSGFPMMSASSLSRLSAFSSSSPSPSSGASWVGHKRGREEEENSTSHNLMQQQQQSAPRLFRNIGDFMVPSQGDSSSVTEEAPTSTTTTVTAVTENPPGGGERRRKYRGVRQRPWGKWAAEIRDPHKAARVWLGTFDTEEAAARAYDEAALRFRGNRAKLNFPENVRAVPPIQPFQATTRLTVSDSTTSQFRPLSAVAPPFIQQPQIQGSSDLIRDYLQYSQLLQSDFQQQQIQQQQQQQRQQQQRQRQQRQQQQQQQQQPSSLLQQLYYNAQFASLQSPSMLSSSPSFSSSVSPAPFPLFTTSASFPLFSSQQMGYFQPPESRNPAGGVPEFPTSTWSDTSSQPPPSG

SEQ ID NO: 2041 - protein, 331 aa, Zea mays
  misc_feature (1)..(331): Ceres CLONE ID no. 1475648
  misc_feature: Utility: Useful for making ornamental plants with modified leaves
  misc_feature: Utility: Useful for making plants with increased biomass
  misc_feature: Utility: Useful for making plants with increased biomass and foliage
  misc_feature: Utility: Useful for making smaller plants
MCCAPKVANAEGRGPCRCCAGGEEDDEDGQQPAAAWRMLSGYERSREASMMVDALATVVAGGATPPATAGARQQQVSPEGQWWSDYYAGDVTPPPSLPAPAAHEHGAARIPATAASPSSSSQAPSPSSTGSGTPRRRYRGVRQRPWGKWAAEIRDPHKAARVWLGNFDTAEAAARAYDVAALRFRGSRAKLNFPESATLAAPPPTAAAAAVPPPPSPPPQRPEALLESQALALAGGREYSEYARFLQCPADPPRLYDQAPAATVPSAASGSASSSFPVLFRFGGGGESSGAASSQWWTQGSRSVSQEGAGSPPASWADSAWWPAPPRDPPR

SEQ ID NO: 2042 - protein, 391 aa, Zea mays
  misc_feature (1)..(391): Public GI no. 30725634
  misc_feature: Utility: Useful for making ornamental plants with modified leaves
  misc_feature: Utility: Useful for making plants with increased biomass
  misc_feature: Utility: Useful for making plants with increased biomass and foliage
  misc_feature: Utility: Useful for making smaller plants
MCVLKVANQEDNVGKKAESIRDDDHRTLSEIDQWLYLFAAEDDHHRHSFPTQQPPPSSSSSSLISGFSREMEMSAIVSALTHVVAGNVPQHQQGGGEGSGEGTSNSSSSSGQKRRREVEEGGAKAVKAANTLTVDQYFSGGSSTSKVREASSNMSGPGPTYEYTTTATASSETSSFSGDQPRRRYRGVRQRPWGKWAAEIRDPFKAARVWLGTFDNAESAARAYDEAALRFRGNKAKLNFPENVKLVRPASTEAQPVHQTAAQRPTQSRNSGSTTTLLPIRPASNQSVHSQPLMQSYNLSYSEMARQQQQFQQHHQQSLDLYDQMSFPLRFGHTGGSMMQSTSSSSSHSRPLFSPAAVQPPPESASETGYLQDIQWPSDKTSNNYNNSPSS

SEQ ID NO: 2043 - DNA, 458 bp, Arabidopsis thaliana
  misc_feature (1)..(458): Ceres CLONE ID no. 256148
  misc_feature (1)..(458): Also known as  Ceres CDNA ID no. 23365263
atcaaagcttgtgcaggataagatgagccccacactgtggatgtatagtgaagactctgtaaggtgaatgaacataggaaggtgaaagctcgaaggagaatctctgaagaatcaaagccagagccatctttgcttccaacagagcgaagttctgaccgatgcaaatcctcggtccccacccgaaaggcaagaagcagacctggttctttgttgcctttgcgatcccttctttgaacctctcgggcttgaactccgctgcatcatcgccccaaagcttagtgtcacggtggattagcagaacaggcatatggacttgaatacagcctggtagtgtcatatcacctagctttatctctttgtgagtcgctctgttcatctggattactggaggatatagcctcaggacttcatatataatcattgtcatctgtaggaacaaaatcatcaaaacaaaattg

SEQ ID NO: 2044 - protein, 52 aa, Arabidopsis thaliana
  misc_feature: Utility: Useful for making ornamental plants with modified leaves
  misc_feature: Utility: Useful for making plants sterile and for genetic confinement
  misc_feature: Utility: Useful for making plants with altered leaf shape eg curled leaves
  misc_feature: Utility: Useful for making plants with increased biomass and foliage
MQILGPHPKGKKQTWFFVAFAIPSLNLSGLNSAASSPQSLVSRWISRTGIWT

SEQ ID NO: 2045 - DNA, 1270 bp, Arabidopsis thaliana
  misc_feature (1)..(1270): Ceres CLONE ID no. 641
  misc_feature (1)..(1270): Also known as  Ceres CDNA ID no. 23389172
acttgccaaaaacctcactcttaaccattaacaatgtcgtctccggcgactactatcaccttctttttcttcttcactctctcatccttcttctacatcacttcttcactccagaacaacaacaacaacaacaacaaacacacagcaaccgttaactccttaaatatcccctccgccgcggcggagattacgctagtaaacccaaagcttccgccgcggagtctctccctcacatcctccaaaaaattcgaaggatcttcaaatctagtccacctccgttaccacatgggaccagtcctctcatcttctccgatcaacatctacgttatctggtacggacaatggtcacgcccacacaaatccctaatcagagatttcctcaattctatctccgacgctaaagcaccttctccctccgtatccgaatggtggcgcaccgcttctctctacacagatcaaaccggatccaacgtctctagatccgttttaatcgccggagaatactccgattctaaatactcccacggccaacaccttactcgtctcacgattcaggaagtcatcgcctccgccgccagatccgcttcctttccggtggatcataaaaacggaatgtatctagttctgacgtcacacgacgtcacgatgcaagatttttgccgcgccgtttgtggatttcactatttcactttcccgtcgatggttggttacactatgccttacgcttgggttggtcaatcgggaaaacaatgtcccgaggtttgtgcttatccgtttgctttaccgggttacatgggacacggtggtcccggagagctccggccaccgaacggagagactggagtagatgggatggttagtgtgattggtcatgagttagctgaagttgtatcgaatccgttgattaatgcttggtacgccggagaagatccgacggctccgacggagatcggtgatttgtgtgagggattgtacggaagcggcggaggaggagggtatattggtcaagttatgagagatagagaagggaagacttttaatatgaatggtaaaggaggaagaaagtttttagttcaatggatttggaaccctaatttgaaagcttgctctggtcctaactctgtcgactaataaaacgaagaagaaggttaatgatggtgatttgtggtaatcactgagataatgatgaaataactcgttaggttttagaagtgtaacattattttacttatgatttcttatatatataaagttttaaagaatgcttttc

SEQ ID NO: 2046 - protein, 365 aa, Arabidopsis thaliana
  misc_feature (81)..(362): Pfam Name: Phi_1; Pfam Description: Phosphate-induced protein 1 conserved region
  misc_feature: Utility: Useful for making plants sterile and for genetic confinement
  misc_feature (220)..(220): Xaa is any aa, unknown, or other
MSSPATTITFFFFFTLSSFFYITSSLQNNNNNNNKHTATVNSLNIPSAAAEITLVNPKLPPRSLSLTSSKKFEGSSNLVHLRYHMGPVLSSSPINIYVIWYGQWSRPHKSLIRDFLNSISDAKAPSPSVSEWWRTASLYTDQTGSNVSRSVLIAGEYSDSKYSHGQHLTRLTIQEVIASAARSASFPVDHKNGMYLVLTSHDVTMQDFCRAVCGFHYFTXPSMVGYTMPYAWVGQSGKQCPEVCAYPFALPGYMGHGGPGELRPPNGETGVDGMVSVIGHELAEVVSNPLINAWYAGEDPTAPTEIGDLCEGLYGSGGGGGYIGQVMRDREGKTFNMNGKGGRKFLVQWIWNPNLKACSGPNSVD

SEQ ID NO: 2047 - protein, 281 aa, Glycine max
  misc_feature (1)..(281): Ceres CLONE ID no. 620977
  misc_feature: Utility: Useful for making plants sterile and for genetic confinement
MGPVLSSPINIYLIWYGKWPQSQKLLIKDFLNSISDHRAAPSPSVSDWWRTVSLYTDQTGANISRSVSIAGEYSDLRYSHGTHLTRLSVQEVIATAVQAKPFPVDHRNGIYLILTAEDVTMEDFCRAVCGFHYFTFPSKVGYTLPYAWVGNSGKQCPEVCAYPFAVPGYMGGGGPGHLTPPNGDVGVDGMVSVIGHELAELSSNPLVNAWYAGEDPTAPTEIGDLCEGLYGTGGGGGYIGSVMKDGEGRTFNLNGRNGRKFLVQWIWSPVLKACAGPNALD

SEQ ID NO: 2048 - protein, 340 aa, Zea mays
  misc_feature (1)..(340): Ceres CLONE ID no. 338717
  misc_feature: Utility: Useful for making plants sterile and for genetic confinement
MQHLAAVLLVLAATTALPPGAAAWRPWPPRDNATAAAGLGASKRLEGSSEFVKLEYHMGPVLASAITVHPIWYGPWPAAQKRTIRAFLRSLSPSAAIPSPSVSAWWRTVRLYPDQTSANVSASVSLGAEKSDARMSRGARLSRMDIQAVVRDAVTARTRPLPVDASGGVYLVLTSPDVAVDDFCGQVCGFHYFTFASVVGSTLPYAWVGNSARRCPEVCAYPFAVPAYVRGRRPESPPNGDVGVDGMVSVIAHELAEMASNPLANAWYAGGDPSFPTEIADLCEGIYGTGGGGAYTGQLLTDARSGAAYNVNGVGGRRFLVQWVWNPVLSYCSGPNALDQ

SEQ ID NO: 2049 - protein, 331 aa, Triticum aestivum
  misc_feature (1)..(331): Ceres CLONE ID no. 697370
  misc_feature: Utility: Useful for making plants sterile and for genetic confinement
MGTLLPCHPTLTLLPLLFAAAIVGVRCAPVYRPEYLVDGNQLVNMQYHMGPVVSGAPTNLFLIWYGRWEAPAQAVLRDFLASLSAPAPFPAVSDWWARTPRLYTDQSGANVTATFAIAGEHSDAGYSHGASLKRIDMQSIIRTAVVAYPDPLPLDPYNGVYLVLSSPDVQVEEFCRAMCGFHYFTFASVVGVTVPYAWVGNSGSQCPGRCAYPFAAPEYGASGQGVLRPPNGDPGVDGMVIVLGHELAELATNPLVNAWYAGDTPTAPTEIADLCLGVYGDGGGAGGFVGNVSHAADGSSYNVNGVNGRRFLVQWLWNPVLGACYGPNSSN

SEQ ID NO: 2050 - DNA, 1486 bp, Arabidopsis thaliana
  misc_feature (1)..(1486): Ceres CLONE ID no. 3819
  misc_feature (1)..(1486): Also known as  Ceres CDNA ID no. 23458679
gaattgtctcgttgtcctcctcactttcatcagccgttttgaatctccggcgacttgacagagaagaacaaggaagaagactaagagagaaagtaagagataatccaggagattcattctccgttttgaatcttcctcaatctcatcttcttccgctctttctttccaagctcataaaaaatggctgaggctgatgatattcaaccaatcgtgtgtgacaatggtaccggtatggtgaaggctggatttgcaggagatgatgctcccagggctgtttttcccagtgttgttggtaggccaagacatcatggtgtcatggttgggatgaaccagaaggatgcatatgttggtgatgaagcacaatccaagagaggtattcttaccttgaagtatcctattgagcatggtgttgttagcaactgggatgatatggaaaagatctggcatcacactttctacaatgagcttcgtattgctcctgaagagcaccctgttcttcttaccgaggctcctcttaacccaaaggccaacagagagaagatgactcaaatcatgtttgagacctttaactctcccgctatgtatgtcgccatccaagctgttctctccttgtacgccagtggtcgtacaaccggtattgtgctggattctggtgatggtgtgtctcacactgtgccaatctacgagggtttctctcttcctcatgccatcctccgtcttgaccttgctggacgtgaccttactgattacctcatgaagatccttacagagagaggttacatgttcaccacaacagcagagcgggaaattgtaagagacatcaaggagaagctctcctttgttgctgttgactacgagcaggagatggaaacctcaaagaccagctcttccatcgagaagaactatgaattacccgatgggcaagtcatcacgattggtgctgagagattcagatgcccagaagtcttgttccagccctcgtttgtgggaatggaagctgctggaatccacgagacaacctataactcaatcatgaagtgtgatgtggatatcaggaaggatctgtacggtaacattgtgctcagtggtggaaccactatgttctcaggtatcgctgaccgtatgagcaaagaaatcacagcacttgcaccaagcagcatgaagattaaggtcgttgcaccacctgaaaggaagtacagtgtctggatcggtggttccattcttgcttccctcagcacattccagcagatgtggatctccaaggccgagtatgatgaggcaggtccaggaatcgttcacagaaaatgtttctaagctctcaagatcaaaggcttaaaaagctggggttttatgaatgggatcaaagtttctttttttcttttatatttgcttctccatttgtttgtttcatttccctttttgttttcgtttctatgatgcacttgtgtgtgacaaactctctgggtttttacttacgtctgcgttt

SEQ ID NO: 2051 - protein, 377 aa, Arabidopsis thaliana
  misc_feature (8)..(377): Pfam Name: Actin; Pfam Description: Actin
  misc_feature: Utility: Useful for making plants sterile and for genetic confinement
  misc_feature: Utility: Useful for making smaller plants
MAEADDIQPIVCDNGTGMVKAGFAGDDAPRAVFPSVVGRPRHHGVMVGMNQKDAYVGDEAQSKRGILTLKYPIEHGVVSNWDDMEKIWHHTFYNELRIAPEEHPVLLTEAPLNPKANREKMTQIMFETFNSPAMYVAIQAVLSLYASGRTTGIVLDSGDGVSHTVPIYEGFSLPHAILRLDLAGRDLTDYLMKILTERGYMFTTTAEREIVRDIKEKLSFVAVDYEQEMETSKTSSSIEKNYELPDGQVITIGAERFRCPEVLFQPSFVGMEAAGIHETTYNSIMKCDVDIRKDLYGNIVLSGGTTMFSGIADRMSKEITALAPSSMKIKVVAPPERKYSVWIGGSILASLSTFQQMWISKAEYDEAGPGIVHRKCF

SEQ ID NO: 2052 - protein, 360 aa, Zea mays; identical to SEQ ID NO: 500
  misc_feature (1)..(360): Ceres CLONE ID no. 338602
  misc_feature: Utility: Useful for making plants sterile and for genetic confinement
  misc_feature: Utility: Useful for making smaller plants

SEQ ID NO: 2053 - protein, 360 aa, Zea mays; identical to SEQ ID NO: 500
  misc_feature (1)..(360): Ceres CLONE ID no. 299306
  misc_feature: Utility: Useful for making plants sterile and for genetic confinement
  misc_feature: Utility: Useful for making smaller plants

SEQ ID NO: 2054 - protein, 360 aa, Arabidopsis thaliana
  misc_feature (1)..(360): Ceres CLONE ID no. 122726
  misc_feature: Utility: Useful for making plants sterile and for genetic confinement
  misc_feature: Utility: Useful for making smaller plants
MVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDSLMKILTERGYMFTTTAEREIVRDIKEKLAYVALDYEQELETAKSSSSVEKNYELPDGQVITIGAERFRCPEVLFQPSLIGMEAPGIHETTYNSIMKCDVDIRKDLYGNIVLSGGSTMFPGIADRMSKEITALAPSSMKIKVVAPPERKYSVWIGGSILASLSTFQQMWISKSEYDESGPSIVHRKCF

SEQ ID NO: 2055 - protein, 360 aa, Zea mays; identical to SEQ ID NO: 504
  misc_feature (1)..(360): Ceres CLONE ID no. 292789
  misc_feature: Utility: Useful for making plants sterile and for genetic confinement
  misc_feature: Utility: Useful for making smaller plants

SEQ ID NO: 2056 - protein, 360 aa, Brassica napus; identical to SEQ ID NO: 506
  misc_feature (1)..(360): Ceres CLONE ID no. 1073372
  misc_feature: Utility: Useful for making plants sterile and for genetic confinement
  misc_feature: Utility: Useful for making smaller plants

SEQ ID NO: 2057 - protein, 360 aa, Zea mays; identical to SEQ ID NO: 504
  misc_feature (1)..(360): Ceres CLONE ID no. 327971
  misc_feature: Utility: Useful for making plants sterile and for genetic confinement
  misc_feature: Utility: Useful for making smaller plants

SEQ ID NO: 2058 - protein, 360 aa, Zea mays
  misc_feature (1)..(360): Ceres CLONE ID no. 227487
  misc_feature: Utility: Useful for making plants sterile and for genetic confinement
  misc_feature: Utility: Useful for making smaller plants
MVKAGFAGDDAPRAVFPSIVGRPRHTGVMVGMGQKDAYVGDEAQSKRGILTLKYPIEHGIVNNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDSLMKILTERGYSFTTTAEREIVRDIKEKLAYVALDYDQELENAKSSSSVEKSYELPDGQVITIGAERFRCPEVLFQPSFIGMEAPGIHETTYNSIMKCDVDIRKDLYGNIVLSGGTTMFPGIADRMSKEITALAPSSMKIKVVAPPERKYSVWIGGSILASLSTFQQMWISKAEYDESGPAIVHRKCF

SEQ ID NO: 2059 - protein, 360 aa, Zea mays; identical to SEQ ID NO: 505
  misc_feature (1)..(360): Ceres CLONE ID no. 996136
  misc_feature: Utility: Useful for making plants sterile and for genetic confinement
  misc_feature: Utility: Useful for making smaller plants

SEQ ID NO: 2060 - protein, 360 aa, Arabidopsis thaliana; identical to SEQ ID NO: 503
  misc_feature (1)..(360): Ceres CLONE ID no. 116045
  misc_feature: Utility: Useful for making plants sterile and for genetic confinement
  misc_feature: Utility: Useful for making smaller plants

SEQ ID NO: 2061 - protein, 360 aa, Zea mays; identical to SEQ ID NO: 501
  misc_feature (1)..(360): Ceres CLONE ID no. 331439
  misc_feature: Utility: Useful for making plants sterile and for genetic confinement
  misc_feature: Utility: Useful for making smaller plants

SEQ ID NO: 2062 - protein, 360 aa, Zea mays; identical to SEQ ID NO: 501
  misc_feature (1)..(360): Ceres CLONE ID no. 230603
  misc_feature: Utility: Useful for making plants sterile and for genetic confinement
  misc_feature: Utility: Useful for making smaller plants

SEQ ID NO: 2063 - protein, 360 aa, Zea mays; identical to SEQ ID NO: 501
  misc_feature (1)..(360): Ceres CLONE ID no. 219282
  misc_feature: Utility: Useful for making plants sterile and for genetic confinement
  misc_feature: Utility: Useful for making smaller plants

SEQ ID NO: 2064 - protein, 360 aa, Arabidopsis thaliana; identical to SEQ ID NO: 503
  misc_feature (1)..(360): Ceres CLONE ID no. 25785
  misc_feature: Utility: Useful for making plants sterile and for genetic confinement
  misc_feature: Utility: Useful for making smaller plants

SEQ ID NO: 2065 - protein, 360 aa, Arabidopsis thaliana; identical to SEQ ID NO: 507
  misc_feature (1)..(360): Ceres CLONE ID no. 41421
  misc_feature: Utility: Useful for making plants sterile and for genetic confinement
  misc_feature: Utility: Useful for making smaller plants

SEQ ID NO: 2066 - protein, 377 aa, Zea mays; identical to SEQ ID NO: 502
  misc_feature (1)..(377): Ceres CLONE ID no. 294922
  misc_feature: Utility: Useful for making plants sterile and for genetic confinement
  misc_feature: Utility: Useful for making smaller plants

SEQ ID NO: 2067 - protein, 360 aa, Zea mays; identical to SEQ ID NO: 508
  misc_feature (1)..(360): Ceres CLONE ID no. 1549130
  misc_feature: Utility: Useful for making plants sterile and for genetic confinement
  misc_feature: Utility: Useful for making smaller plants

SEQ ID NO: 2068 - protein, 360 aa, Zea mays; identical to SEQ ID NO: 510
  misc_feature (1)..(360): Ceres CLONE ID no. 223048
  misc_feature: Utility: Useful for making plants sterile and for genetic confinement
  misc_feature: Utility: Useful for making smaller plants

SEQ ID NO: 2069 - DNA, 1111 bp, Arabidopsis thaliana
  misc_feature (1)..(1111): Ceres CLONE ID no. 3853
  misc_feature (1)..(1111): Also known as  Ceres CDNA ID no. 23618114
acttcctttcacgatccaaaacaaaacacaagaaaatgcaacaaaatcttctccatctctgaactcaaaaactcattcactgagaaaaatggagacccttctctcccctcgtgcgctctctcctcctctcaatcccaaacctttgtcccttcaccagaccaaacccacttcacattcattgtctctctcaaaacccaccaccttctccggtcctaaacacctctccacccggttcactaaaccggaatcaagaaactggttaatagatgcaaagcaaggactagctgctttagctttatctctaactctcactttctcacctgttggcactgctttagcctctgagttcaatatcctcaacgatggtccacctaaagaaacttacgtagtcgatgacgctggtgttcttagtcgagtgacgaagtcagatcttaagaagcttttgtctgatcttgaatacagaaagaaactgagactcaatttcatcactgtccgaaagctcaccagtaaagcagatgcgtttgagtatgcagaccaggttttggaaaaatggtatccttctattgaagaaggtaacaataagggtattgttgttttgataacaagtcagaaggaaggagctattactggtggtcctgcttttattgaagctgttggtgaaaacattcttgatgctaccgtctccgaaaatcttcccgtactagcaacggacgaaaaatacaacgaggcggtatatagcagtgcgaaaaggttggttgcagctatagacggtcaaccagatcccgggggtccaaccgtaaaggatagcaagagagaatcaaatttcaagacgaaagaagaaaccgatgagaagcgaggacagttcagtcttgtcgttggaggattacttgtaattgcctttgtagttcccatggcacaatactttgcttatgtctccaggaagtaagtaagtaaactcggttcactctcgtaaaccaaaccgatcaggtcagaactttgatttacctcggttatttggttatggtttcttggtaaattggtttatttgaacaatataagtaaataataacagaaaactaaagaatgaatgaaaccatccgattgtaacggc

SEQ ID NO: 2070 - protein, 285 aa, Arabidopsis thaliana
  misc_feature (105)..(229): Pfam Name: DUF477; Pfam Description: Domain of unknown function (DUF477)
  misc_feature (105)..(229): Pfam Name: DUF477; Pfam Description: Domain of unknown function (DUF477)
  misc_feature: Utility: Useful for making plants sterile and for genetic confinement
METLLSPRALSPPLNPKPLSLHQTKPTSHSLSLSKPTTFSGPKHLSTRFTKPESRNWLIDAKQGLAALALSLTLTFSPVGTALASEFNILNDGPPKETYVVDDAGVLSRVTKSDLKKLLSDLEYRKKLRLNFITVRKLTSKADAFEYADQVLEKWYPSIEEGNNKGIVVLITSQKEGAITGGPAFIEAVGENILDATVSENLPVLATDEKYNEAVYSSAKRLVAAIDGQPDPGGPTVKDSKRESNFKTKEETDEKRGQFSLVVGGLLVIAFVVPMAQYFAYVSRK

SEQ ID NO: 2071 - protein, 293 aa, Glycine max
  misc_feature (1)..(293): Ceres CLONE ID no. 478120
  misc_feature: Utility: Useful for making plants sterile and for genetic confinement
MGTIFPPHSLSPLLNIKPSPSRILLAPCPQPKSNSLFCSKPIVSSLRKNQTSSPKPSSGTSWLAHAQQGLAALAISLALNFSPVLFNGNALASEFDVLNEGPPKDSYVFDDAGVLSRVTRSDLKQLLSDLESRKNFRINFITVRKLTSKADAFEYADQVLERWYPSVEEGNNKGIVVLVTSQKEGAVTGGPAFVEAVGEKILDATVSENLPVLATDEKYNEAIFSTAKRLAAAIDGLPDPGGPTVKDNKRESNFKTKEETEEKRGQFTLVVGGLLVIAFVVPMAQYYAYVSKK

SEQ ID NO: 2072 - protein, 290 aa, Zea mays
  misc_feature (1)..(290): Ceres CLONE ID no. 375711
  misc_feature: Utility: Useful for making plants sterile and for genetic confinement
METLLSPSTLFTLPLRGSSRRPSLAASVSSRPTVSCSSALKRPQAGAVAASSHGDGVGRNWMSFLHHGLAAAALSLAIGLTPAPAPAVASEFDVLNDGAPVDSYVVDDAGVLSRVTKSDVKRLARDLEARKNIRLNFITVRKLTSKADAFEYADQVLEKWYPTIEEGNNKGIVVLVTSQKEGAVTGGPAFIQAVGDQILDATVSENLPVLATDEKYNEAILSTAKRLAAAIDGLPDTGGPSFKENKRESNFKTKEETEEKRGQFTLVVGGLLVIAVVVPMAQYYAYVSKK

SEQ ID NO: 2073 - protein, 299 aa, Zea mays
  misc_feature (1)..(299): Public GI no. 50878369
  misc_feature: Utility: Useful for making plants sterile and for genetic confinement
METLLSPSTLLSPLRGSKKKPASPAASASSSSSSPARSVVSCALRRQQPPPQAVAAWRGDGGRGGGVGSWATFLQHGLAAAALSLAISMAPAPAPAVASEFDVLNGGPPEDTYVVDDAGVLSRVTKSDVKRLVRDLESRKNIRINFITVRKLTSKADAFEYADQVLEKWYPTVEEGNNKGIVVLVTSQKEGAITGGPAFVQAVGDEILDSTVSENLPVLATDEKYNEAIYTTAKRLAAAIDGLPDPGGPTFKDNKRESNFKTKEETEEKRGQFTLVVGGLLVIAFVVPMAQYYAYISKK

SEQ ID NO: 2074 - DNA, 853 bp, Arabidopsis thaliana
  misc_feature (1)..(853): Ceres CLONE ID no. 8133
  misc_feature (1)..(853): Also known as  Ceres CDNA ID no. 23388875
cacgggagattttttcttcttctccacttttcgccaccatttcttctccttctctttctctctctctatctaaattcggtggaaggtccaacctcagactatgaccggcggagactggattcacgaggctatgggtgatgattcattagtggcggaggctctgatctgtctcctccatgccgagccgtcacttcctgacacgaagagcggcggcgcgtcggatctcaagctgaagtggagcgtgcgtcagcggaggaccaaggcggcgacgttaaggaagaagggagatcatgatacgcgtgctagtcccacgaccccactttcatggagcggcgcaacctcttttagcggcggtggaggcggtgctgctgctgccgttgatggatttgaggagtcaagtggcgttgtgaaactgtctgaggccgttagatctaagataactcaaacgagtgttacaacaagccctttcaagagatcaagaaagaaaaagacacttgctcaacttaaagaggaggagagtgtgctcttaaaggaaaggaatggcttgagaaatgaactcgcaactatgcaggatctgctcaagcaacaaagagcaagaaatgagtctttaaagaaactccaggctgagtcacaaaagaatgatgattcctccttcttgctccctgaccttaatatagctctggataacaactcgagccctgaaagtctctatggaaccagctgatatataactacgacacaattttcacatcaatattcttttgtcagtgacacgttctctagactacgcgtaactatgtaactatacgatttggataagaatttatagataggtaatagtcgtcccctttcc

SEQ ID NO: 2075 - protein, 207 aa, Arabidopsis thaliana
  misc_feature: Utility: Useful for making plants sterile and for genetic confinement
  misc_feature: Utility: Useful for making plants with altered leaf shape eg curled leaves
  misc_feature: Utility: Useful for making smaller plants
  misc_feature: Utility: Useful for modifying plant structure, ie increased branching
MTGGDWIHEAMGDDSLVAEALICLLHAEPSLPDTKSGGASDLKLKWSVRQRRTKAATLRKKGDHDTRASPTTPLSWSGATSFSGGGGGAAAAVDGFEESSGVVKLSEAVRSKITQTSVTTSPFKRSRKKKTLAQLKEEESVLLKERNGLRNELATMQDLLKQQRARNESLKKLQAESQKNDDSSFLLPDLNIALDNNSSPESLYGTS

SEQ ID NO: 2076 - protein, 233 aa, Brassica napus
  misc_feature (1)..(233): Ceres CLONE ID no. 966755
  misc_feature: Utility: Useful for making plants sterile and for genetic confinement
  misc_feature: Utility: Useful for making plants with altered leaf shape eg curled leaves
  misc_feature: Utility: Useful for making smaller plants
  misc_feature: Utility: Useful for modifying plant structure, ie increased branching
  misc_feature (148)..(148): Xaa is any aa, unknown, or other
MTTVKDEWVAAAMTDDQMVVELLLRLKHAGTVAAENPETNLRWGIRQRRSRSSRFGGGVTLKKGVDSVRGSPKTPLSWSGGSGSGGASASPSAEDTSRQASCSTSAGSGSKAFPTNEITSCFPKRLKNKKSTSELKHEENLKLKERLXLEKEIASLRATFDQQNVMNQRLKRIKLDLNSGHVKNETPVDLIRKSQGESKPCRMEGKTATSESLFFLPDLNITPSEDELLYGTS

SEQ ID NO: 2077 - protein, 248 aa, Glycine max
  misc_feature (1)..(248): Ceres CLONE ID no. 584341
  misc_feature: Utility: Useful for making plants sterile and for genetic confinement
  misc_feature: Utility: Useful for making plants with altered leaf shape eg curled leaves
  misc_feature: Utility: Useful for making smaller plants
  misc_feature: Utility: Useful for modifying plant structure, ie increased branching
MSDDHWIKVAMADDSLVVDLLLRLHRPPPPPPPCLNLHWTVRQRRSRSAHNKAESTRASPTTPLSWSGATSASGGNLDGYEEYSRPSKPTQTSRSKVANPSETTTTRKTRRKKTLAELKAEEDLLLKERRNLKKELAFLRLTVEKHRATNESIKRKKLDFESRQNSSAAATASEVSGKAVNGSFQFVKAECHPSNSVSHDDSPVCAANVSPKAQDNIGNQESTFVLPDLNLPVDEDISANIMHYIELS

SEQ ID NO: 2078 - protein, 238 aa, Glycine max
  misc_feature (1)..(238): Ceres CLONE ID no. 466978
  misc_feature: Utility: Useful for making plants sterile and for genetic confinement
  misc_feature: Utility: Useful for making plants with altered leaf shape eg curled leaves
  misc_feature: Utility: Useful for making smaller plants
  misc_feature: Utility: Useful for modifying plant structure, ie increased branching
MCDDHWVKVAMADDSLVVDLLLRLHRSPPPPPCLNLHWTVRQRRSRSAHNKAESTRASPTTPLSWSGATSASGGNLDGYEESKPSQTSRSKVANPSETATTRKTRRKKTLTELKEEEDLLLKERRNLEKELASLRLTIQKHRATNESIKRLKLDFESRQNSSAAATASEVSGKAVNGPFQFVKSECHPSNSVTHDDSPVCAANASPKAQDNIGNRESTFVLPDLNLPADEDINANVMH

SEQ ID NO: 2079 - DNA, 712 bp, Arabidopsis thaliana
  misc_feature (1)..(712): Ceres CLONE ID no. 15343
  misc_feature (1)..(712): Also known as  Ceres CDNA ID no. 23390013
aatcaaaaccgagttcaattcactaaaccaatgaaaatgcaagcagttcttgttatcttggttttctccggtttactttcggttaagacagcgttagcagcacaacatgtgatcggcggtagccaaggctgggaacaatccgttgattttgattcttggtcttctgatcaatctttcaaagtcggcgaccaaattgtttttaagtattcaggactacacagcgttgtggagctaggaagtgaaacggcatacaagagttgtgacctgggaacatcagttaactccttaagctctggaaacgacgtcgttaagctttccaaaaccggtactcgttacttcgtttgtggaaccgttggacattgcgaacaaggcatgaagatcaaagtcaacgttgttgactccaaatccggttcctctccttcaggttcgggttcgggttcagattcagggtcgggttctaaatctagttcgggtgatgggctacgtgcttccattgggtacatgttcgttgttggatcgttggttattggtcttatttgggcttactaataattgtctagggcttttttgtaatgtatcgaatatatttggtggggagagaataaatatttttggaattattaattcgtacttgttgttgtattttatatagttcggatatttgcatttctgatctaattttctatatatatcttgtttttcatgttttctc

SEQ ID NO: 2080 - protein, 172 aa, Arabidopsis thaliana
  misc_feature (34)..(115): Pfam Name: Cu_bind_like; Pfam Description: Plastocyanin-like domain
  misc_feature: Utility: Useful for making plants sterile and for genetic confinement
MKMQAVLVILVFSGLLSVKTALAAQHVIGGSQGWEQSVDFDSWSSDQSFKVGDQIVFKYSGLHSVVELGSETAYKSCDLGTSVNSLSSGNDVVKLSKTGTRYFVCGTVGHCEQGMKIKVNVVDSKSGSSPSGSGSGSDSGSGSKSSSGDGLRASIGYMFVVGSLVIGLIWAY

SEQ ID NO: 2081 - protein, 156 aa, Triticum aestivum
  misc_feature (1)..(156): Ceres CLONE ID no. 773730
  misc_feature: Utility: Useful for making plants sterile and for genetic confinement
  misc_feature (141)..(141): Xaa is any aa, unknown, or other
MAILSTASAAIYNVGEPGGAWDLSTNYGTWASSRNFKADDQIVFKYSPQAHDVLEVSKADYDSCSTASPITTLNSGNDVVTLTASGTRYFICGFPGHCAGGMKVKIDVMSGFSSPAPASGPSASNAPPPTPASAATNVEAXGFGLAVLLAVAGLMA

SEQ ID NO: 2082 - protein, 171 aa, Triticum aestivum
  misc_feature (1)..(171): Ceres CLONE ID no. 729952
  misc_feature: Utility: Useful for making plants sterile and for genetic confinement
MAAARTILLAMAAMAILSTTSAAIYNVGEPGGAWDLSTNYGTWASSRNFHPNDQIIFKYSPQAHDVLEVSKADYDSCSAASTIATLNSGNDVVSLTATGTRYFLCGYPGHCAGGMKVKIDVVPRSSSSSPAPSSGPSASSAPPPAPVAAATSMEATGFGLTILLAVAGLMA

SEQ ID NO: 2083 - protein, 167 aa, Zea mays
  misc_feature (1)..(167): Ceres CLONE ID no. 276252
  misc_feature: Utility: Useful for making plants sterile and for genetic confinement
MVAAAAVLLALAAVATEVAAAGTTYTVGAPDGLWDMQTDYAQWVKSKTFRPGDTITFTYSPELHDVVEVTRAGYDACSSANNISAFRTGNDAVPLTAVGTRYFLCGLTGHCGNGMKIRVDVVAAAASPSAPGPAAAAAAPPTTSSPCNVGVVAASLLLLLLHAVVSY

SEQ ID NO: 2084 - DNA, 791 bp, Arabidopsis thaliana
  misc_feature (1)..(791): Ceres CLONE ID no. 22007
  misc_feature (1)..(791): Also known as  Ceres CDNA ID no. 23386366
aattagttttggttagtacctgcaggttcttggtttttaaagtcaaagtctcttttgtgcttctcgtaaagagcgatcatgaaagtgcttctcggtcttttgcttctcttgtccttgaccaattcttcaagtgcaatttactgtctctgtaaagatgggataggagacacagagcttcaaacatcaatagactatgcatgtggaaccttagctgattgtaatcctatacatgataagggtacttgttatcaaccagacaccatcaaaagccactgtgattgggctgtgaatagctacttccaaaacgcagctcaagtccctggaagctgcaatttctctggcactgccactaccaatccaaacccaccttccaatttggctaatggttgcatctatccgtcaagccctagctctactaggtctcctccatcaacaacaccaccaacgggaacaactcccacaaacggaaccactccatttccgggaactccatttccaggaacaccgttcccgggaactcctccggtgtttggtccaaccggagtcttcaacccaagcaacccaggcagtggtgcttcaagtttgggcacctcctctgttttcacactctgtttttcattactagcctttctatggggctctgatgtaaggttcggatttagccacgtgtagagactaaaagacatccacttgtgttagtctttgattctattttgggtggaacaagaagcttaggcgtttgttgagctttcgtctatgtaaaggttgctctaatagaaagaatcttgagt

SEQ ID NO: 2085 - protein, 197 aa, Arabidopsis thaliana
  misc_feature (20)..(106): Pfam Name: X8; Pfam Description: X8 domain
  misc_feature: Utility: Useful for making plants sterile and for genetic confinement
  misc_feature: Utility: Useful for making smaller plants
MKVLLGLLLLLSLTNSSSAIYCLCKDGIGDTELQTSIDYACGTLADCNPIHDKGTCYQPDTIKSHCDWAVNSYFQNAAQVPGSCNFSGTATTNPNPPSNLANGCIYPSSPSSTRSPPSTTPPTGTTPTNGTTPFPGTPFPGTPFPGTPPVFGPTGVFNPSNPGSGASSLGTSSVFTLCFSLLAFLWGSDVRFGFSHV

SEQ ID NO: 2086 - protein, 198 aa, Triticum aestivum
  misc_feature (1)..(198): Ceres CLONE ID no. 700212
  misc_feature: Utility: Useful for making plants sterile and for genetic confinement
  misc_feature: Utility: Useful for making smaller plants
MEAPLLVAALLLLSSTLVVSEFCVCRSEQPQAALQKTIDYACGAGADCNSIHEQGPCYNPNNVVSHCSWAANSYFQKKRAMGATCDFGGTALVVSTDPSSSGCSYPSSASAAGTSTTPTGTGTGIGGTTGGTPGTFTPGAGTSTGGMGGTGTGTDTTTGFGGLGPTGTSNMDTAAAGLHPRSGAPAFLAVLLSFLAFA

SEQ ID NO: 2087 - protein, 191 aa, Triticum aestivum
  misc_feature (1)..(191): Public GI no. 50939031
  misc_feature: Utility: Useful for making plants sterile and for genetic confinement
  misc_feature: Utility: Useful for making smaller plants
MEAVVVAALVLLMSSSLVASWCVCRSDQPQAALQKTIDYACGAGADCNSIHEQGQCFNPNTVVAHCSWAANSYFQRNRAMGATCDFTGTATLTTSDPVSGCSFPASAGAGTSTTPTMGGTTGTMTPGTFTPGTGMGTTTGTGMGTGTTTGTGLGGLGPTGTSSMDTAAAGLHLRAGLATFCTVLLSFVAIA

SEQ ID NO: 2088 - DNA, 834 bp, Arabidopsis thaliana
  misc_feature (1)..(834): Ceres CLONE ID no. 23771
  misc_feature (1)..(834): Also known as  Ceres CDNA ID no. 23367513
ttccactttaaatcaggaacaaacccttcactgcgccagtgttgtgcggctctgcgaatcttcgaaaatgggtgcgtacaagtatgtatctgagctatggaggaagaagcagtccgatgtgatgagattcctccagagggttaggtgctgggaatacagacagcaaccttcgattgttcgtctcgtcaggcctactcgtcctgataaggctcgtcgtttgggttacaaggccaagcagggctttgttgtgtaccgtgtccgtgtgagacgtggtggacgcaagaggccagtgcctaagggtattgtgtatggtaagccaacaaaccagggagtgacacaactcaagttccagcgtagcaagcggtctgttgctgaggagcgtgctggcaggaaattgggtggtctcagagttgtcaactcttactggctcaatgaggattcgacctacaagtactacgagatcatcttggttgacccagcacacaatgctgtgcgtaatgacccgagaatcaactggatctgcaacccagttcacaagcaccgtgagctcagaggacttacctcagagggaaagaagaacagaggtctccgcggaaagggtcacaacaaccacaagaaccgtccatctcgcagggctacatggaagaaaaacaactctctcagccttcgtcgttaccgttgattgccttttgcttttattattactgttatcatcttctaggttccatgttgttgcacttttatctctctcaggatgacttgtttttgcaaattttggaaactatacaattgtgctttgaacctaaattttatatttgctttgcttttttgtcg

SEQ ID NO: 2089 - protein, 204 aa, Arabidopsis thaliana
  misc_feature (2)..(193): Pfam Name: Ribosomal_L15e; Pfam Description: Ribosomal L15
  misc_feature: Utility: Useful for making plants sterile and for genetic confinement
  misc_feature: Utility: Useful for making plants with increased biomass
  misc_feature: Utility: Useful for making smaller plants
MGAYKYVSELWRKKQSDVMRFLQRVRCWEYRQQPSIVRLVRPTRPDKARRLGYKAKQGFVVYRVRVRRGGRKRPVPKGIVYGKPTNQGVTQLKFQRSKRSVAEERAGRKLGGLRVVNSYWLNEDSTYKYYEIILVDPAHNAVRNDPRINWICNPVHKHRELRGLTSEGKKNRGLRGKGHNNHKNRPSRRATWKKNNSLSLRRYR

SEQ ID NO: 2090 - protein, 213 aa, Zea mays
  misc_feature (1)..(213): Ceres CLONE ID no. 1429265
  misc_feature: Utility: Useful for making plants sterile and for genetic confinement
  misc_feature: Utility: Useful for making plants with increased biomass
  misc_feature: Utility: Useful for making smaller plants
  misc_feature (21)..(21): Xaa is any aa, unknown, or other
  misc_feature (23)..(23): Xaa is any aa, unknown, or other
  misc_feature (25)..(25): Xaa is any aa, unknown, or other
  misc_feature (27)..(27): Xaa is any aa, unknown, or other
  misc_feature (28)..(28): Xaa is any aa, unknown, or other
  misc_feature (29)..(29): Xaa is any aa, unknown, or other
  misc_feature (32)..(32): Xaa is any aa, unknown, or other
  misc_feature (33)..(33): Xaa is any aa, unknown, or other
  misc_feature (35)..(35): Xaa is any aa, unknown, or other
  misc_feature (36)..(36): Xaa is any aa, unknown, or other
  misc_feature (37)..(37): Xaa is any aa, unknown, or other
  misc_feature (38)..(38): Xaa is any aa, unknown, or other
  misc_feature (40)..(40): Xaa is any aa, unknown, or other
  misc_feature (42)..(42): Xaa is any aa, unknown, or other
  misc_feature (47)..(47): Xaa is any aa, unknown, or other
  misc_feature (50)..(50): Xaa is any aa, unknown, or other
  misc_feature (52)..(52): Xaa is any aa, unknown, or other
  misc_feature (53)..(53): Xaa is any aa, unknown, or other
  misc_feature (82)..(82): Xaa is any aa, unknown, or other
  misc_feature (83)..(83): Xaa is any aa, unknown, or other
  misc_feature (86)..(86): Xaa is any aa, unknown, or other
  misc_feature (121)..(121): Xaa is any aa, unknown, or other
  misc_feature (122)..(122): Xaa is any aa, unknown, or other
SNCDAGNQQWGRTSTCLSYGXRXSXMXXXLFXXLXXXXIXQXPSIVXLVXPXXPDKARRLGYKAKQGFVVYRVRVRRGGRKXXVPXGIVYGKPTNQGVTQLKFQRSKRSVAEERAGRKLSXXRVVNSYWLNEDSTYKYYEIILVDPAHNAIRNDPRINWICNPVHKHRELRGLTSEGKKNRGLRGKGHNNHKNRPSRRATWKKNNSLSLRRYR

SEQ ID NO: 2091 - protein, 186 aa, Glycine max
  misc_feature (1)..(186): Ceres CLONE ID no. 1050058
  misc_feature: Utility: Useful for making plants sterile and for genetic confinement
  misc_feature: Utility: Useful for making plants with increased biomass
  misc_feature: Utility: Useful for making smaller plants
MRFLQRVRCWEYRQQPSIVRLTRSTRPDKARRLGFKAKQGYVIYRVRVRRGGRKRPVPKGIVYGKPTNQGVTQLKFQRSKRSVAEERAGRKLGGLRVLNSYWVNEDSTYKYFEVILVDVAHSAVRNDPRINWLCNPVHKHRELRGLTSAGKSNRGLRGRGHLYHKNRPSRRATWKRNNTLSLRRYR

SEQ ID NO: 2092 - protein, 204 aa, Zea mays
  misc_feature (1)..(204): Ceres CLONE ID no. 312541
  misc_feature: Utility: Useful for making plants sterile and for genetic confinement
  misc_feature: Utility: Useful for making plants with increased biomass
  misc_feature: Utility: Useful for making smaller plants
MGAYKYVSELWRRKQSDVMRFVQRVRCWEYRQQPAIVRLTRPTRPDKARRLGFKAKQGYVVYRVRVRRGGRKRPVPKGIVYGKPKHQGITQLKFQRNKRSVAEERAGRKLGGLRVLNSYWVNEDSTYKYFEIILVDVAHTAIRNDPRINWLCNPVHKHRELRGLTSAGKKFRGLRGKGHTHHKNRPSRRATWKRNQTLSLRRYR

SEQ ID NO: 2093 - protein, 204 aa, Zea mays; identical to SEQ ID NO: 2092
  misc_feature (1)..(204): Ceres CLONE ID no. 1544938
  misc_feature: Utility: Useful for making plants sterile and for genetic confinement
  misc_feature: Utility: Useful for making plants with increased biomass
  misc_feature: Utility: Useful for making smaller plants

SEQ ID NO: 2094 - protein, 204 aa, Zea mays
  misc_feature (1)..(204): Ceres CLONE ID no. 210309
  misc_feature: Utility: Useful for making plants sterile and for genetic confinement
  misc_feature: Utility: Useful for making plants with increased biomass
  misc_feature: Utility: Useful for making smaller plants
MGAYKYVSELWRRKQSDVMRFVQRMRCWEYRQQPAIVRLTRPTRPDKARRLGYKAKQGYVVYRVRVRRGGRKRPVPKGIVYGKPKHQGITQLKFQRNKRSVAEERAGRKLGGLRVLNSYWVNEDSTYKYFEIILVDVAHTTIRNDPRINWLCNPVHKHRELRGLTSAGKKFRGLRGKGHTHHKNRPSRRATWKRNQTLSLRRYR

SEQ ID NO: 2095 - protein, 204 aa, Zea mays
  misc_feature (1)..(204): Ceres CLONE ID no. 291474
  misc_feature: Utility: Useful for making plants sterile and for genetic confinement
  misc_feature: Utility: Useful for making plants with increased biomass
  misc_feature: Utility: Useful for making smaller plants
MGAYKYVSELWRRKQSDVMRFVQRVRCWEYRQQPSIVRLTRPTRPDKARRLGYKAKQGYVVYRVRVKRGGRKRPVPKGIVYGKPKHQGITQLKFQRNKRSVAEERAGRKLGGLRVLNSYWVNEDSTYKYFEIILVDVAHKAIKTDPRINWLCNPVHKHRELRGLTSAGKKYRGLRGKGHTHHKNRPSRRATWKRNQTLSLRRYR

SEQ ID NO: 2096 - protein, 204 aa, Zea mays
  misc_feature (1)..(204): Ceres CLONE ID no. 221519
  misc_feature: Utility: Useful for making plants sterile and for genetic confinement
  misc_feature: Utility: Useful for making plants with increased biomass
  misc_feature: Utility: Useful for making smaller plants
  misc_feature (6)..(6): Xaa is any aa, unknown, or other
MGAYKXVSELWRRKQSDVMRFVQRVRCWEYRQQPSIVRLTRPTRPDKARRLGYKAKQGYVVYRVRVKRGGRKRPVPKGIVYGKPKHQGITQLKFQRNKRSVAEERAGRKLGGLRVLNSYWVNEDSTYKYFEIILVDVAHKAIKTDPRINWLCNPVHKHRELRGLTSAGKKYRGLRGKGHTHHKNRPSRRATWKRNQTLSLRRYR

SEQ ID NO: 2097 - protein, 186 aa, Zea mays
  misc_feature (1)..(186): Ceres CLONE ID no. 297035
  misc_feature: Utility: Useful for making plants sterile and for genetic confinement
  misc_feature: Utility: Useful for making plants with increased biomass
  misc_feature: Utility: Useful for making smaller plants
MRFVQRVRCWEYRQQPAIVRLTRPTRPDKARRLGYKAKQGYVVYRVRVKRGGRKRPVPKGIVYGKPKHQGITQLKFQRNKRSVAEERAGRKLGGLRVLNSYWVNEDSTYKYFEIILVDVAHTAIRKDPRINWLCNPVHKHRELRGLTSAGKKFRGLRGKGHTHHKNRPSRRATWKRNQTLSLRRYR

SEQ ID NO: 2098 - protein, 204 aa, Zea mays
  misc_feature (1)..(204): Ceres CLONE ID no. 1064683
  misc_feature: Utility: Useful for making plants sterile and for genetic confinement
  misc_feature: Utility: Useful for making plants with increased biomass
  misc_feature: Utility: Useful for making smaller plants
MGAYKFVSELWRRKQSDVMRFVQRVRCWEYRQQPAIVRITRPTRPDRARRLGFKAKQGYVFYRVRVKRGGRKRPVPKGIVYGKPKHQGITQLKFQRNKRSVAEERAGRKLGGLRVLNSYWVNEDSTYKYFEIILVDVAHKAIKTDPRINWLCNPVHKHRELRGLTSAGKKFRGLRGKGHTHHKNRPSRRATWKRNQTLSLRRYR

SEQ ID NO: 2099 - DNA, 1252 bp, Arabidopsis thaliana
  misc_feature (1)..(1252): Ceres CLONE ID no. 24644
  misc_feature (1)..(1252): Also known as  Ceres CDNA ID no. 23369467
aacaagaacacagtaacgcaatcacagactccacagtccaaggagttttgcatactcaccaagccacaatcatttctctcttctctatctctctggttttgaatcggcgacgactgagtcaactcggtgttgttactggtttcgtcgtatgtgttgtaactgattaagttgatggatccgagtgggatgatgaacgaaggaggaccgtttaatctagcggagatctggcagtttccgttgaacggagtttcaaccgccggagattcttctagaagaagcttcgttggaccgaatcagttcggtgatgctgatctaaccacatctgctaacggtgatccagcgcgtatgagtcacgcgttgtctcaggcggttattgaaggtatctccggcgcttggaaacggagggaagatgagtctaagtcggcgaagatcgtctccaccattggcgctagtgaaggtgagaacaaaagacagaagatagatgaagtgtgtgatgggaaagcagaagcagaatcgctaggaacagagacggaacaaaagaagcaacagatggaaccaacgaaagattatattcatgttcgagctagaagaggtcaagctactgatagtcacagtttagctgaaagagcgagaagagagaaaataagtgagcggatgaaaatcttgcaagatcttgttccgggatgtaacaaggttattggaaaagcacttgttctagatgagataattaactatatacaatcattgcaacgtcaagttgagttcttatcgatgaagcttgaagcagtcaactcaagaatgaaccctggtatcgaggtttttccaccaaaagagtttggtcagcaagcgtttgagaatccggagatacagttcgggtcgcagtctacgagggaatacagtagaggagcatcaccagagtggttgcatatgcagataggatcaggtggtttcgaaagaacgtcttgataaagaaacaacacttggtcatcatcttactacaaataagatctaaaagctctaatatcccgagaagaaaaagcatacatacatataaatctcattctcattataggtttaaatatatggatgtgaatatacacatcatattgttgttctaaagaaagcaaaatagaaaagaagatatagttagtttcgacatcaagaaaaaacaagctgggaagggtttaaagtagaaaaaaactcttgtaaaagaaagaacgtttgttgttataaaattgtatctcatttttac

SEQ ID NO: 2100 - protein, 264 aa, Arabidopsis thaliana
  misc_feature (143)..(193): Pfam Name: HLH; Pfam Description: Helix-loop-helix DNA-binding domain
  misc_feature (143)..(193): Pfam Name: HLH; Pfam Description: Helix-loop-helix DNA-binding domain
  misc_feature: Utility: Useful for making plants sterile and for genetic confinement
  misc_feature: Utility: Useful for making smaller plants
  misc_feature: Utility: Useful for making taller plants
MDPSGMMNEGGPFNLAEIWQFPLNGVSTAGDSSRRSFVGPNQFGDADLTTSANGDPARMSHALSQAVIEGISGAWKRREDESKSAKIVSTIGASEGENKRQKIDEVCDGKAEAESLGTETEQKKQQMEPTKDYIHVRARRGQATDSHSLAERARREKISERMKILQDLVPGCNKVIGKALVLDEIINYIQSLQRQVEFLSMKLEAVNSRMNPGIEVFPPKEFGQQAFENPEIQFGSQSTREYSRGASPEWLHMQIGSGGFERTS

SEQ ID NO: 2101 - DNA, 1161 bp, Arabidopsis thaliana
  misc_feature (1)..(1161): Ceres CLONE ID no. 27197
  misc_feature (1)..(1161): Also known as  Ceres CDNA ID no. 23385579
tcggctaatccttggtccgtgctaagatcttagatcgatttctaaagtcttcgtcttcttcttcttctgataactagatttttcaatcttctgaagctttaattttttcatagccatggctaatcgttatgatccaaatcctttcgctgaggaagaagaagtcaatcctttcgctaatgctagaggagttccacctgcgtcgaattcgagactttcgcctttgcctccagagcctgttggtttcgattatggtcgaaccgtagacattcctcttgacagagctggtacacaggatttgaagaagaaagagaaggaactccaagccaaagaagctgagctaaaacgacgagagcaggacctcaaacggaaagaagatgctgctgcacgagctggaatcgttatcgaagtgaaaaactggccgcctttcttcccgcttatccaccatgatattgcaaatgaaattccggttcatctccaaagactacagtatgttacctttgcaacgtatttggggttggttctttgtcttttctggaatatcatcgccgttactacagcttggatcaaaggagaaggagtgacgatatggcttcttgccttaatttacttcatagcgggtgttccaggaggctatgtgttatggtatcgaccactctaccgtgccttcagaactgatagtgcattgagctttggatggtttttcttgttctatatgctccacattgctttctgcgtctttgctgcagttgctccacctgtcgtcttcaaaggaaaatctcttgctgggatcttacctgcaatagatgtcttaagcggtcaagcaattgttgggatattctacttcattgggtttgcatttttctgcctcgaatcagtggttagcatctgggttatacagcaagtgtatatgtacttccgaggcagcgggaaacaagatcaaatgagacgggaagcagcgagaggagccttgagagccgctgtttgagagttctccttgtaacattctggtttgtgtatgcactgtttcttttttcagattttcttgaagtctctctctctctctctctctctgctctataaacaaaaaaaaaaagatttaatttttcctttgtacctttatgtcatgtaaatttgtttgttcaaaaatcagagttcagattc

SEQ ID NO: 2102 - protein, 289 aa, Arabidopsis thaliana
  misc_feature (97)..(271): Pfam Name: SCAMP; Pfam Description: SCAMP family
  misc_feature: Utility: Useful for making plants sterile and for genetic confinement
  misc_feature: Utility: Useful for making smaller plants
MANRYDPNPFAEEEEVNPFANARGVPPASNSRLSPLPPEPVGFDYGRTVDIPLDRAGTQDLKKKEKELQAKEAELKRREQDLKRKEDAAARAGIVIEVKNWPPFFPLIHHDIANEIPVHLQRLQYVTFATYLGLVLCLFWNIIAVTTAWIKGEGVTIWLLALIYFIAGVPGGYVLWYRPLYRAFRTDSALSFGWFFLFYMLHIAFCVFAAVAPPVVFKGKSLAGILPAIDVLSGQAIVGIFYFIGFAFFCLESVVSIWVIQQVYMYFRGSGKQDQMRREAARGALRAAV

SEQ ID NO: 2103 - protein, 291 aa, Brassica napus
  misc_feature (1)..(291): Ceres CLONE ID no. 980747
  misc_feature: Utility: Useful for making plants sterile and for genetic confinement
  misc_feature: Utility: Useful for making smaller plants
MAGRYDRNPFDEGDEVNPFANPGSVPAASSSRLSPLPPEPAGFGFGRTVDVPLDRPGSGAQDLKKKEKELQAKEAELKRREQDLKRKEDAAARAGIVIEVKNWPPLFPLIHHDIANEIPIRLQRLQYIAFSTYLGLVLALFWNVIAVTTAWIKGEGVTIWLLALIYFISGVPGGYVLWYRPLYRAFRNDSALSFGWFFLFYMLHIAFCVFAAVAPPVVFKGKSLAGILPALDMLSSQALVGIFYFIGFAFFCLESVVSIWVIQQVYMYFRGSGKADEMKRDAARGAMRAAV

SEQ ID NO: 2104 - protein, 291 aa, Glycine max; identical to SEQ ID NO: 2103
  misc_feature (1)..(291): Ceres CLONE ID no. 1075340
  misc_feature: Utility: Useful for making plants sterile and for genetic confinement
  misc_feature: Utility: Useful for making smaller plants

SEQ ID NO: 2105 - protein, 291 aa, Glycine max
  misc_feature (1)..(291): Public GI no. 15220305
  misc_feature: Utility: Useful for making plants sterile and for genetic confinement
  misc_feature: Utility: Useful for making smaller plants
MGGRYDRNTFDEQDEVNPFANPGSVPAASNSRLSPLPPEPAGFGYGRTVDIPLDRPGSGAQDLKKKEKELQAKEADLRRREQDLKRKQDAAARAGIVIEAKNWPTFFPLIHHDIANEILVRLQRLQYIAFATYLGLVLALFWNIIAVTTAWIKGEGVTIWLLAVIYFISGVPGGYVLWYRPLYRAFRSDSAFNFGWFFLFYMLHILFCLFAAVAPPIVFKGKSLAGILPAIDVLSAQALVGIFYFIGFGLFCLESVVSIWVIQQVYMYFRGSGKADDMRRDAARGAMRAAI

SEQ ID NO: 2106 - protein, 288 aa, Glycine max
  misc_feature (1)..(288): Ceres CLONE ID no. 580349
  misc_feature: Utility: Useful for making plants sterile and for genetic confinement
  misc_feature: Utility: Useful for making smaller plants
MAGRYDSNPFDEEEVNPFYNPGSVPAATNSRLSPLKPEPVDYNYGFGATVDIPLDSSTDLKKKEKELQAKETELRKREQEVRRREEAASRAGIVLEEKNWPPFFPIIHHDIANEIPIHLQKLQYVAFTTLLGLVLCLFWNVIAVTAAWIKGEGVKIWFLAIIYFIAGVPGAYVLWYRPLYRAFRNESALKFGWFFMFYLLHIGFCILAAVAPPIVFKGKSLTGILAAIDVLGDHALIGIFYFIGFGLFCVETLISIWVIQQVYMYFRGSGKAAEMKREAARGALRAAI

SEQ ID NO: 2107 - protein, 286 aa, Glycine max
  misc_feature (1)..(286): Public GI no. 50902072
  misc_feature: Utility: Useful for making plants sterile and for genetic confinement
  misc_feature: Utility: Useful for making smaller plants
MAGRYDRNPFDEDDVNPFAGGSVPPASNSRMPPLPHEPGFYNDRGATVDIPLDSTKDMKKKEKELQAKEAELNKRESELRRREEAASRAGIVIEEKNWPPFFPIIHHDISNEIPIHLQRMQYLAFSSLLGLAACLFWNIIATTAAWIKGAGVMIWLLAIIYFISGVPGAYVLWYRPLYNAMRTESALKFGWFFLFYLIHILFCIWSAVAPPFPFKGKSLAGILPAIDVIGNNAIVGIFYFIGFGLFCLESLLSVVVIQQVYMYFRGSGKAAEMKREAARGAMRSAF

SEQ ID NO: 2108 - protein, 282 aa, Zea mays
  misc_feature (1)..(282): Ceres CLONE ID no. 219387
  misc_feature: Utility: Useful for making plants sterile and for genetic confinement
  misc_feature: Utility: Useful for making smaller plants
MAGKHGRNGFDDDNVNPFAGGSVPPATNSRLSPLSHEPADFYNVDIPLDSSKDLKKKEKELQAMEAELNKRERELKRKEEAASRAGVVIEEKNWPPFFPLIHHDISNEIPIHLQRMQYLAFSSFLGLIACLFWNVIATTTAWIKGEGVMIWLLAIIYFISGAPGAYVLWYRPLYNAMRTESALKFGWFFLFYMIHIIFCVWAAVAPPFPFKGKSLAGILPAIDVISKNAIVGIFYFVGFGLFCLESLLSIGVIQQVYMYFRGSGKAAEMKREAARSALSSAF

SEQ ID NO: 2109 - protein, 282 aa, Zea mays; identical to SEQ ID NO: 2108
  misc_feature (1)..(282): Ceres CLONE ID no. 325927
  misc_feature: Utility: Useful for making plants sterile and for genetic confinement
  misc_feature: Utility: Useful for making smaller plants

SEQ ID NO: 2110 - protein, 287 aa, Triticum aestivum
  misc_feature (1)..(287): Ceres CLONE ID no. 699286
  misc_feature: Utility: Useful for making plants sterile and for genetic confinement
  misc_feature: Utility: Useful for making smaller plants
MAGRYDRNPFDEDDVNPFAGGGVPPASNSRMPPLPHEPAGFYNDRAATVDIPLGSSKDLKQKEKELQSKEAELNKRERELKRREEAAARAGIVIETKNWPPFMPIIHHDISNEIPIHLQRMQYLAFCSLLGLTLCLFWNIIATTAAWIKGAGVVIWLLAIIYFISGVPGAYVLWYRPLYNAMRTESALKFGWFFLLYLIHIIFCIWSAVSPPFPFKGKSIAGFLPAIDVIGSNVIVGIFYFVGFGLFCLEALLSIVVIQQVYMYFRGSGKAAQMRQEAARGAMRSAF

SEQ ID NO: 2111 - DNA, 967 bp, Arabidopsis thaliana
  misc_feature (1)..(967): Ceres CLONE ID no. 33802
  misc_feature (1)..(967): Also known as  Ceres CDNA ID no. 13593739
aagcagaggagttatactttactacttactaatctctccctctctctatctgactctttgatcggaaaaaatggcggagaaaaatgcgagcgcggtggacggtgcaattagggttagtggaatgcagttttcttacgatgttcaagatcctattttcttcgattttaatctcgatcttcccgctggatctcgttgcctcttggttggtgccaatggatctgggaaaaccacattattgaagattttggctggaaagcatatggttggaggaaagaatgttgtacaagtgctggatcgctcagcatttcatgatacagagcttgtttgtagtggtgatttgtcttaccttggaggatcatggagtaaaactgctggttctgctggtgatattccacttcaaggagacttctcagcagaacatatgatatttggagttgaagggattgatcctttcagaagagagaaattgattgatcttcttgatatcaatcttcaatggcgtatgcataaggtttctgatggacagagacgtcgagtgcaaatatgtatgggtcttttacatccattcaaggtgttactactggatgaggttactgttgacctcgacgttgttgctaggatggatttgttggagttctttaaagaagaatgtgaacagagaggagctacaattgtatatgcaactcatattttcgacgggctcgagacatgggctagtcatctggcttatattaatggaggagagctgaaactctcggccaaattagatgagatcaaggatctcaagacctcaccaaatctgctctctgttgttgaagcttggctccggtctgaaaccaaagttgagaaaaagacgaagaasaaacctgttgttacctctccatttatgtcgtctagacaaatggcatattaccgatgaatcttaacttgtttatgagatcagtaagaataagagcactgcttctac

SEQ ID NO: 2112 - protein, 282 aa, Arabidopsis thaliana
  misc_feature (142)..(224): Pfam Name: ABC_tran; Pfam Description: ABC transporter
  misc_feature (40)..(60): Pfam Name: NACHT; Pfam Description: NACHT domain
  misc_feature (40)..(60): Pfam Name: NACHT; Pfam Description: NACHT domain
  misc_feature (142)..(224): Pfam Name: ABC_tran; Pfam Description: ABC transporter
  misc_feature: Utility: Useful for making plants sterile and for genetic confinement
  misc_feature: Utility: Useful for making smaller plants
MAEKNASAVDGAIRVSGMQFSYDVQDPIFFDFNLDLPAGSRCLLVGANGSGKTTLLKILAGKHMVGGKNVVQVLDRSAFHDTELVCSGDLSYLGGSWSKTAGSAGDIPLQGDFSAEHMIFGVEGIDPFRREKLIDLLDINLQWRMHKVSDGQRRRVQICMGLLHPFKVLLLDEVTVDLDVVARMDLLEFFKEECEQRGATIVYATHIFDGLETWASHLAYINGGELKLSAKLDEIKDLKTSPNLLSVVEAWLRSETKVEKKTKKKPVVTSPFMSSRQMAYYR

SEQ ID NO: 2113 - protein, 277 aa, Brassica napus
  misc_feature (1)..(277): Ceres CLONE ID no. 979847
  misc_feature: Utility: Useful for making plants sterile and for genetic confinement
  misc_feature: Utility: Useful for making smaller plants
  misc_feature (143)..(143): Xaa is any aa, unknown, or other
  misc_feature (223)..(223): Xaa is any aa, unknown, or other
MARSDGAIRVSGMQFSYDVQDPIFFDFSLDLPAGSRCLLVGANGSGKTTLLKILAGKHMVGGKNIVQVLNRSAFHDTDLVCSGDLSYLGGSWSKTAGSAGEIPLQGDFSAEHMIFGVEGIDPVRREKLIDLLDINLKWRMHKXSDGQRRRVQICMGLLQPFKVLLLDEVTVDLDVVARMDLLEFFKEECEQRGATIVYATHIFDGLETWASHLAYIHGGELKXSAKLKEIKDLETSPNLLSVVENWLRSETKVEKKTKKKPVATSPFMSSRQMAYYR

SEQ ID NO: 2114 - protein, 290 aa, Brassica napus
  misc_feature (1)..(290): Public GI no. 18379174
  misc_feature: Utility: Useful for making plants sterile and for genetic confinement
  misc_feature: Utility: Useful for making smaller plants
MAEKDATASGDDAIRVSGMQFAYEVEDPIFFDFNLDLPAGSRCLLVGANGSGKTTLLKILAGKHMVGGKNVVQVLSRSAFHDTQLVCSGDLSYLGGSWSKTVGSAGEVPLQGDFSAEHMIFGVEGTDPVRREKLIDLLDINLQWRMHKVSDGQKRRVQICMGLLHPFKVLLLDEVTVDLDVVARMDLLEFFKEECDQRGATIVYATHIFDGLETWATHLAYIQDGELNRLSKMTDIEELKTSPNLLSVVESWLRSEIKLVKKKKKPVAPWKPSPFDNSPFRSSRHMAYYR

SEQ ID NO: 2115 - protein, 283 aa, Glycine max
  misc_feature (1)..(283): Ceres CLONE ID no. 603261
  misc_feature: Utility: Useful for making plants sterile and for genetic confinement
  misc_feature: Utility: Useful for making smaller plants
MAAENEDSCGIRVTGMQFSYDVQQPPLFLDFNLNVSPGSRCLLVGANGSGKTTLLKILAGKHMVGGRDVVRVLSGSAFHDTQLVCSGDLAYLGGSWSKNVGSAGEIPLQGDFSAEHMIFGVEGADPERRDKLIELLDIDLQWRMHKVSDGQRRRVQICLGLLHPYKVLLLDEVTVDLDVVTRMDLLDFFKEECEQREAIIVYATHIFDGLETWATHLAYIQDGELRRAEKISNVKELKSSTNLLSVVEAWLRAETKLEKKNPVQKTSVASSPFFSSRHMAYYR

SEQ ID NO: 2116 - protein, 292 aa, Glycine max
  misc_feature (1)..(292): Public GI no. 51964500
  misc_feature: Utility: Useful for making plants sterile and for genetic confinement
  misc_feature: Utility: Useful for making smaller plants
MAGGEDEGWRRSGIEVSALQFDYDGQPPLFARFNLRIAPGSRCLLIGANGSGKTTLLKILAGKHMVGGRDVVRVLNGSAFHDTQLVCNGDLSYLGGSWSRAIGSAGDVPLQGDFSAEHMIFGVDGVDPVRREKLVDLLDIDLQWRMHKVSDGQRRRVQICMGLLHPYKVLLLDEITVDLDVVTRMDLLDFFKEECEQREATIVYATHIFDGLESWATDIAYIQEGELRKSAKYSDVEELKSAKNLLSVVESWLRSETKLPKKEHPRPETQPRRSSPFDASPFRSSRHMAYYR

SEQ ID NO: 2117 - DNA, 1000 bp, Arabidopsis thaliana
  misc_feature (1)..(1000): Ceres CLONE ID no. 34210
  misc_feature (1)..(1000): Also known as  Ceres CDNA ID no. 23369157
gaatgttcaaaagctgccagattgagaatatttcgtccgtcgttgaaacttgagaatagaggcgaatctggttcgagttagggttccaattgaaaagtttgaagctccttttgactctctctctcttctagatctcgacaactctaacctcttcgatttggtggatcttgagaaattgattttagttcaaagcttctgatggctaaaaaggagagacctagacctgagaagttgtctgtgtatctttatatacctaatattgttgggtatatgagagttctcttgaactgtgttgcttttgctgtgtgtttctccaacaagccacttttctctgtcctttatttcttcagcttttgttgtgatgctgtggatggctgggtggctcgtagattcaaccaagtttcaacatttggagctgttcttgacatggtcacagatagagttagcacagcttgtcttctcgtgattctctctcaaatctacaggcctagtttggtcttcctctcattgctggctttagatattgctagtcattggctgcagatgtacagtacgtttctagcagggaagagcagccataaggatgtgaaagacagcacaagctggctttttagactctactatggaaaccggatatttatgtgttactgctgtgtttcttgcgaggttctgtatatcatccttcttctcattgcaaagaaccaatctgaaaatctcctgaatgtcgtagttgctacattaacacagatttcaccactctcttttctcctggctttgacattgttcggttggtcgatgaagcagaccattaatgtcattcagatgaaaactgctgcagacgtttgtgtactgtatgatttagagaagcagcagaagccttgatcatcttcctttgtctcaacctgaaactcttttttttctttcatttttgttctcttttcactgtggatgtagataattgtttttaatgaaatgaagaaatattgatttgccttttgac

SEQ ID NO: 2118 - protein, 227 aa, Arabidopsis thaliana
  misc_feature (45)..(206): Pfam Name: CDP-OH_P_transf; Pfam Description: CDP-alcohol phosphatidyltransferase
  misc_feature (45)..(206): Pfam Name: CDP-OH_P_transf; Pfam Description: CDP-alcohol phosphatidyltransferase
  misc_feature: Utility: Useful for making plants sterile and for genetic confinement
MAKKERPRPEKLSVYLYIPNIVGYMRVLLNCVAFAVCFSNKPLFSVLYFFSFCCDAVDGWVARRFNQVSTFGAVLDMVTDRVSTACLLVILSQIYRPSLVFLSLLALDIASHWLQMYSTFLAGKSSHKDVKDSTSWLFRLYYGNRIFMCYCCVSCEVLYIILLLIAKNQSENLLNVVVATLTQISPLSFLLALTLFGWSMKQTINVIQMKTAADVCVLYDLEKQQKP

SEQ ID NO: 2119 - protein, 227 aa, Arabidopsis thaliana
  misc_feature (1)..(227): Public GI no. 21745398
  misc_feature: Utility: Useful for making plants sterile and for genetic confinement
MAKKERPRPEKLSVYLYIPNIVGYMRVLLNCVAFAVCFSNKTLFSLLYFFSFCCDAVDGWCARRFNQVSTFGAVLDMVTDRVSTACLLVVLSQVYRPSLVFLSLLALDIASHWLQMYSTFLAGKSSHKDVKDSTSWLFRLYYGNRIFMCYCCVSCEVLYIILLLIAKNQTENLLNVVVSTLTQISPLSLLLALTIFGWSMKQTVNIIQMKTAADVCVLYDIEKQQKP

SEQ ID NO: 2120 - protein, 225 aa, Arabidopsis thaliana
  misc_feature (1)..(225): Ceres CLONE ID no. 27810
  misc_feature: Utility: Useful for making plants sterile and for genetic confinement
MAKQRPATLSVYLYIPNIVGYMRVLLNCIAFSVCFSNKTLFSLLYFFSFCCDAVDGWCARKFNQVSTFGAVLDMVTDRVSTACLLVILSQIYRPSLVFLSLLALDIASHWLQMYSTFLSGKTSHKDVKDSTSWLFRLYYGNRMFMGYCCVSCEVLYIILLLIATNQTENLMNVVVKSLMQISPLSLLLALSIFGWSIKQIINVIQMKTAADVCVLYDIEKQHKKP

SEQ ID NO: 2121 - protein, 225 aa, Arabidopsis thaliana; identical to SEQ ID NO: 2120
  misc_feature (1)..(225): Public GI no. 21555401
  misc_feature: Utility: Useful for making plants sterile and for genetic confinement

SEQ ID NO: 2122 - protein, 225 aa, Arabidopsis thaliana
  misc_feature (1)..(225): Public GI no. 27311653
  misc_feature: Utility: Useful for making plants sterile and for genetic confinement
MAKQRPATLSVYLYIPNIVGYMRVLLNCIAFSVCFSNKTLFSLLYFFSFCCDAVDGWCARKFNQVSTFGAVLDMVTDRVSTACLLVILSQIYRPSLVFLSLLALDIASHWLQMYSTFLSGKTSHKDVKDSTSWLFRLYYGNRMFMGYSCVSCEVLYIILLLIATNQTENLMNVVVKSLMQISPLSLLLALSIFGWSIKQIINVIQMKTAADVCVLYDIEKQHKKP

SEQ ID NO: 2123 - protein, 227 aa, Glycine max
  misc_feature (1)..(227): Ceres CLONE ID no. 581207
  misc_feature: Utility: Useful for making plants sterile and for genetic confinement
MAKKPGPRSSKLSVYLYIPNIIGYIRVLLNCFAFSQCLSNKILFSILYFLSFVCDAVDGWCARKFNQVSTFGAVLDMVTDRISTACLLVVLSQLYKPGLSFLSLLALDIASHWLQMYSTFLTGKTSHKDVKDSSSWLFRAYYGNRMFMAYCCVSCEVLYLILFYLAENQTEKLVDVISSNLQKISFLSLLMGTSLFGWAVKQIINVIQMKTAADACVLYDIEKEHKN

SEQ ID NO: 2124 - protein, 218 aa, Zea mays
  misc_feature (1)..(218): Ceres CLONE ID no. 306792
  misc_feature: Utility: Useful for making plants sterile and for genetic confinement
MPSVYLYIPNIIGYFRIIINFIAFAVCYSNKALFAVLYFFSFVLDGVDGWFARKFNQASTFGAVLDMVTDRVSTACLLALLSQFYRPGLVFLILLGLDITSHWFQMYSSFLSGKTSHKDVKHTGNWLLKLYYGYRPFMAFCCVSCEVLYIILFLFADEKSTSLLSACKGLLNQSPIIILVFISTLVGWAVKQVTNVIQMKTAADACVVYDLKRSKRKA

SEQ ID NO: 2125 - protein, 218 aa, Zea mays; identical to SEQ ID NO: 2124
  misc_feature (1)..(218): Ceres CLONE ID no. 321760
  misc_feature: Utility: Useful for making plants sterile and for genetic confinement

SEQ ID NO: 2126 - protein, 215 aa, Zea mays
  misc_feature (1)..(215): Ceres CLONE ID no. 284101
  misc_feature: Utility: Useful for making plants sterile and for genetic confinement
MPSVYLYIPNIIGYFRIIINFIAFAVCYSNKALFAILYFISFVLDGVDGWFARKFNQASTFGAVLDMVTDRVSTACLLALLSQFYRPGLVFLILLGLDITSHWFQMYSSFLSGKTSHKDVKHTGNWLLKLYYGYRPFMAFCCVSCEVLYIFLFLFADEESTSLLSVCKGILNQSPVVILVFVSTLVGWAVKQATNVIQMKTAADACVVYDLKRSK

SEQ ID NO: 2127 - protein, 215 aa, Zea mays
  misc_feature (1)..(215): Public GI no. 34577127
  misc_feature: Utility: Useful for making plants sterile and for genetic confinement
MPSVYLYIPNIIGYFRIIINFIAFAVCYSNKALFAILYFISFVLDGVDGWFARKFNQASTFGAVLDMVTDRVSTACLLALLSQFYRPGLAFLILLGLDITSHWFQMYSSFLSGKTSHKDVKHTGNWLLKLYYGYRPFMAFCCVSCEVLYIFLFLFADEESTSLLSVCKGILNQSPVVILVFVSTLVGWAVKQATNVIQMKTAADACVVYDLKRSK

SEQ ID NO: 2128 - protein, 223 aa, Zea mays
  misc_feature (1)..(223): Public GI no. 50904897
  misc_feature: Utility: Useful for making plants sterile and for genetic confinement
MAQPSSKKTPSVYLYIPNIIGYFRIIINFIAFAVCYSNRVLFAILYFFSFFCDGLDGWFARKFNQASTFGAVLDMVTDRVSTACLLALLSQFYRPGLVFLMLLGLDITSHWFQMYSSFLSGKTSHKDVKDTGNWLLKLYYGHRPFMAFCCVASEVLYIVLFLFADEKSTSLLNVCGNLLKQSPLTVFVFISTLVGWALKQVINVIQMKSAADACVVFDLKRGK

SEQ ID NO: 2129 - protein, 223 aa, Zea mays
  misc_feature (1)..(223): Public GI no. 13661020
  misc_feature: Utility: Useful for making plants sterile and for genetic confinement
MAQPSSKKTPSVYLYIPNIIGYFRIIINFIAFAVCYSNRVLFAILYFFSFFCDGLDGWFARKFNQASTFGAVLDMVTDRVSTACLLALLSQFYRPGLVFLMLLGLDITSHWFQMYSSFLSGKTSHKDVKDTGNWLLKLYYGHRPFMAFCCVASEVLYIVLFLFADEKSTSLLNVCGNLLKQSPLTVFFFISTLVGWALKQVINVIQMKSAADACVVFDLKRGK

SEQ ID NO: 2130 - DNA, 1497 bp, Arabidopsis thaliana
  misc_feature (1)..(1497): Ceres CLONE ID no. 38757
  misc_feature (1)..(1497): Also known as  Ceres CDNA ID no. 23556383
atctctctctctctctttttattttctttctttcttaattcatctaaactctctctgcttttgcttttcgtaattccttacatttcactcaatattaatccccagaatctccgatccacccacaaatttagcaattttctgagatttgatcatttgggtcaccaaaaaatcttgtctttttgatctgggtttaacgccaataatcatatgggaaacattagcagcagcggcggtgaaggtagacgccgtcgacggcgaaaccatacggcggctccaccaccacctcctcctcctccttcttcttctcttcctccaccacctctacctacagaaatccaagctaatcccatcgttttcgctgccgttactccctatcctaatcctaatcctaatccggtttaccagtaccctgcttcttactaccaccatcctcccccgggagccatgcctcttccgccgtacgaccaccacctccaacatcatccaccgcatccttaccacaaccactcttgggctcccgtggcgatggccagatacccttatgctggtcacatgatggctcaaccgactccttacgttgaacaccagaaagccgtcacgattcgtaacgacgttaatctcaagaaggagtctcttaggcttgaacccgacccggataatccgggtcgctttctcgtctcctttacgtttgatgcaaccgtctccggaaggattagtgtcattttctttgctaaagaatccgaagattgcaaactcacagcgacaaaggaagatatactgccacctatcactctagatttcgagaaaggacttggtcagaagtttaaacaatcatctggttctggtatagacttttcggtctttgaggacgttgagctgttcaaggcggccgcagacacagagatctatccattagcggttaaggcagaagcagctccctcaggtggtgagaatgaagaagaagaaaggtcggggtcgaagaatgcgcagattactcaagcggtttatgagaaggataaaggagagattaagattagagtggtgaagcagatactatgggttaatggaacgagatatgagttgcaggagatttatgggattgggaatacagttgagggggatgatgattcagctgatgatgctaatgatcctggtaaagaatgtgttatatgtttgtctgaaccacgagacaccactgttcttccatgtcgacatatgtgtatgtgtagcggatgtgctaaggtattgaggtttcagacaaatcgatgccccatttgcaggcaacctgttgaaaggcttttggagataaaagttcacggtaacaacggaagcgggaataacaccggacagggagaaacagttgaacaagagtagctaaacacggccgagtatggattgaaatgccatcgaaatattagtagtatatgcatgtttgatccttgtatgttaacaacaaaatgtgtgattgtcaattcataatatagagattacgaaacc

SEQ ID NO: 2131 - protein, 388 aa, Arabidopsis thaliana
  misc_feature (319)..(357): Pfam Name: zf-C3HC4; Pfam Description: Zinc finger, C3HC4 type (RING finger)
  misc_feature (319)..(357): Pfam Name: zf-C3HC4; Pfam Description: Zinc finger, C3HC4 type (RING finger)
  misc_feature: Utility: Useful for making plants sterile and for genetic confinement
  misc_feature: Utility: Useful for making plants with increased biomass and foliage
  misc_feature: Utility: Useful for making smaller plants
MGNISSSGGEGRRRRRRNHTAAPPPPPPPPSSSLPPPPLPTEIQANPIVFAAVTPYPNPNPNPVYQYPASYYHHPPPGAMPLPPYDHHLQHHPPHPYHNHSWAPVAMARYPYAGHMMAQPTPYVEHQKAVTIRNDVNLKKESLRLEPDPDNPGRFLVSFTFDATVSGRISVIFFAKESEDCKLTATKEDILPPITLDFEKGLGQKFKQSSGSGIDFSVFEDVELFKAAADTEIYPLAVKAEAAPSGGENEEEERSGSKNAQITQAVYEKDKGEIKIRVVKQILWVNGTRYELQEIYGIGNTVEGDDDSADDANDPGKECVICLSEPRDTTVLPCRHMCMCSGCAKVLRFQTNRCPICRQPVERLLEIKVHGNNGSGNNTGQGETVEQE

SEQ ID NO: 2132 - protein, 425 aa, Arabidopsis thaliana
  misc_feature (1)..(425): Public GI no. 31430853
  misc_feature: Utility: Useful for making plants sterile and for genetic confinement
  misc_feature: Utility: Useful for making plants with increased biomass and foliage
  misc_feature: Utility: Useful for making smaller plants
MGNMGSSGGHRRRNNGHGRHHHHGQPTAPPPPPQQQQQEVAPNRYVFAAASPYPPQYPNPNLPQYYPQYGNFYPPPPPSMPGPLPAPYDHHHRGGGPAQPPPPPPPPQPIHAAGEFPPAMLQQHPHYHGWGGNFSYGPPTQPPAPAPPYVEHQKAVTIRNDVNLKKETLRVEPDDECPGRFLITFTFDATVAGSMTVYFFAKEELNCNLTATKEDLLKPVTVTFKEGLGQKFRQPSGTGIDFSLFEDAELFKEGEMDVYPLAVKAETTFSIGQFSEGEEQKSQTPNSQITQAVFERKENGDYHVRVVKQILWVNGTRYELQEIYGIGNSVEGDTEGNDPGKECVICLSEPRDTTVLPCRHMCMCSECAKVLRYQTNRCPICRQPVERLLEIKVNNKGEEQQQQQIPQPPPPPSTAPPHQQQESQA

SEQ ID NO: 2133 - protein, 303 aa, Triticum aestivum
  misc_feature (1)..(303): Ceres CLONE ID no. 570295
  misc_feature: Utility: Useful for making plants sterile and for genetic confinement
  misc_feature: Utility: Useful for making plants with increased biomass and foliage
  misc_feature: Utility: Useful for making smaller plants
MGNAGSSGRPNLPPPRPHLHGVPPPYYHQYPPWRPGAAAPPPVPFPTHVERHRAVAVSAGVNVKGHTLRLERDDDGGGHLLAFSFDADAPGSITVYFFAQEADDSVLKGTKENLLKPVTVTFKEGHGQEFRQPSGTGIKLSMFEESELTKVGEDHVFPLALKVEVGVPSNQELGREHDAEDSKSLAKFAVFVKKDSAEYGINIVQQILWVNGTRYVLQEIYGIGNRNTADRNVNEDDSGKECVVCLTEPRDTTVLPCRHMCLCRECAQTLRFQTNKCPMCRQPVESLLEIKVDSTPRHQGGDQ

SEQ ID NO: 2134 - protein, 313 aa, Triticum aestivum
  misc_feature (1)..(313): Public GI no. 34914816
  misc_feature: Utility: Useful for making plants sterile and for genetic confinement
  misc_feature: Utility: Useful for making plants with increased biomass and foliage
  misc_feature: Utility: Useful for making smaller plants
MGNIASSGGASPRPPPPHLEAYRHGVPPPYYHSYPRPPPGAAAPPPVPVPAHVERHRAVAVSVGVNVKGDTLRLVPDDDDDDGRSLLLAFSFDADGPGSITVCFFAQEDKCALKTAKENLLQPVTVPFKEGRGQEFKQPSGSGIDVSRFEESELTNVGEGGVFPVAFKVQMDVSGNQESEGAHETEQSKYLVKYAIFVKKDNAEYGVHVVQQILWVNGIRYVLQEIYGIGNTADKNAHEDDSGKECVVCLSEPRDTAVLPCRHMCLCRECAQVLKYQTNKCPICRQPVEGLREIEVDNKPIPQQGSQQLTAPQ

SEQ ID NO: 2135 - DNA, 1707 bp, Arabidopsis thaliana
  misc_feature (1)..(1707): Ceres CLONE ID no. 38785
  misc_feature (1)..(1707): Also known as  Ceres CDNA ID no. 23370076
gttgattataattagacttcttcatttactctctctctgacttaaaacatttattttttcttcttcttgttctctctctctttctctcatcactatgaagagtttcaacacagaagaacgcaaccactccacggcggaatccggcgatgcctacactgtgtcggacccgacaaagaacgtcgatgaagatggtcgagagaagcgtaccgggacgtggcttacggcgagtgcgcatattatcacggcggtgataggctccggagtgttgtctttagcatgggctatagctcagcttggttggatcgcagggacatcgattttgctcattttctcgttcattacttacttcacctccaccatgctcgccgattgctaccgtgcgccggatcccgtcaccggaaaacggaattacacttacatggacgttgttcgatcttacctcggtggtaggaaagtgcagctctgtggagtggcacaatatgggaatctgattggggtcactgttggttacaccatcactgcttctattagtttggtagcggtagggaaatcgaactgcttccacgataaagggcacactgcggattgtactatatcgaattatccgtatatggcggtttttggtatcattcaagttattcttagccagatcccaaatttccacaagctctcttttctttccattatggccgcagtcatgtcctttacttatgcaactattggaatcggtctagccatcgcaaccgtcgcaggtgggaaagtgggtaagacgagtatgacgggcacagcggttggagtagatgtaaccgcagctcaaaagatatggagatcgtttcaagcggttggggacatagcgttcgcctatgcttatgccacggttctcatcgagattcaggatacactaagatctagcccagctgagaacaaagccatgaaaagagcaagtcttgtgggagtatcaaccaccacttttttctacatcttatgtggatgcatcggctatgctgcatttggaaacaatgcccctggagatttcctcacagatttcgggtttttcgagcccttttggctcattgactttgcaaacgcttgcatcgctgtccaccttattggtgcctatcaggtgttcgcgcagccgatattccagtttgttgagaaaaaatgcaacagaaactatccagacaacaagttcatcacttctgaatattcagtaaacgtacctttccttggaaaattcaacattagcctcttcagattggtgtggaggacagcttatgtggttataaccactgttgtagctatgatattccctttcttcaacgcgatcttaggtcttatcggagcagcttccttctggcctttaacggtttatttccctgtggagatgcacattgcacaaaccaagattaagaagtactctgctagatggattgcgctgaaaacgatgtgctatgtttgcttgatcgtctcgctcttagctgcagccagatccatcgcaggacttataagtagtgtcaaaacctacaagcccttccggactatgcatgagtgagtttgagatcctcaagagagtcaaaaatatatgtagtagtttggtctttctgttaaactatctggtgtctaaatccaatgagaatgctttattgctaaaacttcatgaatctctctgtatctacatctttcaatctaatacatatgagctgttcc

SEQ ID NO: 2136 - protein, 485 aa, Arabidopsis thaliana
  misc_feature (37)..(472): Pfam Name: Aa_trans; Pfam Description: Transmembrane amino acid transporter protein
  misc_feature (37)..(472): Pfam Name: Aa_trans; Pfam Description: Transmembrane amino acid transporter protein
  misc_feature: Utility: Useful for making plants sterile and for genetic confinement
  misc_feature: Utility: Useful for making smaller plants
MKSFNTEERNHSTAESGDAYTVSDPTKNVDEDGREKRTGTWLTASAHIITAVIGSGVLSLAWAIAQLGWIAGTSILLIFSFITYFTSTMLADCYRAPDPVTGKRNYTYMDVVRSYLGGRKVQLCGVAQYGNLIGVTVGYTITASISLVAVGKSNCFHDKGHTADCTISNYPYMAVFGIIQVILSQIPNFHKLSFLSIMAAVMSFTYATIGIGLAIATVAGGKVGKTSMTGTAVGVDVTAAQKIWRSFQAVGDIAFAYAYATVLIEIQDTLRSSPAENKAMKRASLVGVSTTTFFYILCGCIGYAAFGNNAPGDFLTDFGFFEPFWLIDFANACIAVHLIGAYQVFAQPIFQFVEKKCNRNYPDNKFITSEYSVNVPFLGKFNISLFRLVWRTAYVVITTVVAMIFPFFNAILGLIGAASFWPLTVYFPVEMHIAQTKIKKYSARWIALKTMCYVCLIVSLLAAARSIAGLISSVKTYKPFRTMHE

SEQ ID NO: 2137 - protein, 464 aa, Brassica napus
  misc_feature (1)..(464): Ceres CLONE ID no. 1078352
  misc_feature: Utility: Useful for making plants sterile and for genetic confinement
  misc_feature: Utility: Useful for making smaller plants
MSDPTKNVDDDGREKRTGTWLTASAHIITAVIGSGVLSLAWAIAQLGWIAGTLILIIFSFITYFTSTMLADCYRAPDPLTGKRNYTYMDVVRSYLGGRKVQLCGVAQYGNLIGITVGYTITASISLVAIGKANCYHNKGHHADCTISNYPYMAAFGIIQILLSQIPNFHKLSFLSLMAAVMSFAYASIGIGLAIATVAGGKVGKTNMTGTVVGVDVTAAQKIWRSFQAVGDIAFAYAYATVLIEIQDTLRSSPAENKAMKRASFVGVSTTTFFYILCGCLGYAAFGNKAPGDFLTNFGFYEPFWLIDFANACIAFHLIGAYQVFAQPIFQFVEKKCNRNWPDNKFITSEYSVNIPFLGKFSINLFRLVWRTAYVVITTLVAMIFPFFNAILGLIGAASFWPLTVYFPVEMHIAQTKVKKYSSRWIGLKMLCWVCLIVSLLAAAGSIAGLISSVKTYKPFRTIHE

SEQ ID NO: 2138 - protein, 467 aa, Glycine max
  misc_feature (1)..(467): Ceres CLONE ID no. 479285
  misc_feature: Utility: Useful for making plants sterile and for genetic confinement
  misc_feature: Utility: Useful for making smaller plants
  misc_feature (53)..(53): Xaa is any aa, unknown, or other
  misc_feature (62)..(62): Xaa is any aa, unknown, or other
MHIETPETFADGSKNFDDDGRAKRTGTWITASAHIITAVIGSGVLSLAWAIAXMGWVAGPAXLFVFSLITYFTSTLLADCYRSPDPVHGKRNYTYSEVVKANLGGRKFQLCGLAQYINLVGVTIGYTITASLSMGAVKKSNCLHKHGHQDECKVKDNAFMIAFACIQILLSQIPNFHKLSWLSIVAAVMSFAYSSIGLGLSIAKIIGGGHVRTTLTGVEVSGTEKVWKMFQAIGDIAFAYAFSNVLIEIQDTLKSSPPENKVMKRASLIGIMTTTLFYVLCGCLGYAAFGNDAPSNFLTGFGFYEPFWLIDFANVCIAVHLVGAYQVFVQPIFGFVEKWSKENWTESQFINGEHTLNIPLCGSYNVNFFRVVWRTAYVIITAVVAMLLPFFNDFLALIGALSFWPLTVYFPIEMYIKKSNMQRFSFTWTWLKILSWVCLIISIISLVGSIQGLSVSIKKYKPFQAEQ

SEQ ID NO: 2139 - protein, 471 aa, Zea mays
  misc_feature (1)..(471): Ceres CLONE ID no. 264196
  misc_feature: Utility: Useful for making plants sterile and for genetic confinement
  misc_feature: Utility: Useful for making smaller plants
MVGAMRGGAMELEDRLATLPRFRGDHDDDGKERRTGTVWTATAHIITAVIGSGVLSLAWAMAQLGWVAGPLTLVLFAAITFYTCGLLADCYRVGDPVTGKRNYTYTEAVKSNLGGWYVWFCGFCQYVNMFGTGIGYTITASISAAAINKSNCFHWHGHDADCSQNTSAYIIGFGVVQVIFSQLHNFHKLWWLSIIAAIMSFSYSAIAVGLSLAQIVMGPTGKTTMTGTLVGVDVDAAQKVWMTFQALGNVAFAYSYAIILIEIQDTLRSPPAENKTMRRATMMGISTTTGFYMLCGCLGYAAFGNAASGNILTGFGFYEPFWLVDFANACIVVHLVGGFQVFCQPLFAAVEGAVAARYPGSTREYGAAGLNVFRLVWRTAFVAVITLLAILMPFFNSILGILGSIAFWPLTVFFPVEMYIRQRQVRRFSTKWIALQSLSFVCFLVTAASCAASVQGVVDSLKTYVPFKTRS

SEQ ID NO: 2140 - protein, 513 aa, Glycine max
  misc_feature (1)..(513): Ceres CLONE ID no. 512972
  misc_feature: Utility: Useful for making plants sterile and for genetic confinement
  misc_feature: Utility: Useful for making smaller plants
MLPRSRTLPSRIHQGIIEERHNVRHYLQVEVRPNNTQTETEAMNIQSNYSKCFDDDGRLKRTGTFWMATAHIITAVIGSGVLSLAWAVAQLGWVAGPIVMFLFAVVNLYTSNLLTQCYRTGDSVTGHRNYTYMEAVNSILGGKKVKLCGLIQYINLFGVAIGYTIAASVSMMAIKRSNCYHSSHGKDPCHMSSNGYMITFGIAEVIFSQIPDFDQVWWLSIVAAIMSFTYSSVGLSLGVAKVAENKSFKGSLMGISIGTVTQAGTVTSTQKIWRSLQALGAMAFAYSFSIILIEIQDTIKSPPAEHKTMRKATTLSIAVTTVFYLLCGCMGYAAFGDNAPGNLLTGFGFYNPYWLLDIANLAIVIHLVGAYQVFSQPLFAFVEKWSARKWPKSNFVTAEYDIPIPCFGVYQLNFFRLVWRTIFVLLTTLIAMLMPFFNDVVGILGAFGFWPLTVYFPIDMYISQKKIGRWTSRWLGLQLLSASCLIISLLAAVGSMAGVVLDLKTYKPFKTSY

SEQ ID NO: 2141 - DNA, 1263 bp, Arabidopsis thaliana
  misc_feature (1)..(1263): Ceres CLONE ID no. 38843
  misc_feature (1)..(1263): Also known as  Ceres CDNA ID no. 23382940
atgaaataaaaagaagcatcttctagagagagacatattgagaaagagagagaaagctttagggtttcaaaaaaaaaaactgagaccctttagaaatctcctaacaggaaattttttctcaaacgctatagaaaatgggagtcataatcaatcaccatttcctcgcttttatcttcggcatcttaggaaacgtgatatccttccttgtattcctcgctccagtgccaactttttatagaatatacaagagaaaatcgacggaaagtttccagtcgctaccgtaccaagtgtcgctatttagctgcatgctatggctctactacgcattgattaagaaagacgcttttctcctaattaccatcaactcctttggctgcgtcgtggagactctctacatagccatgttcttcgcttacgccaccagggagaaaaggatatcggctatgaagttgttcatagcaatgaacgttgccttcttctcgttgattctaatggtaacacatttcgtggttaaaactcctcccctccaagtctctgtactcggctggatttgtgttgccatttctgtttctgttttcgctgcccctctaatgatcgtggctcgtgtgataaagacaaagagtgtggagtacatgcccttcacgctttctttcttcctcactataagcgccgttatgtggttcgcttatggtttattcctcaatgacatatgcatagcgattccaaacgtggtgggattcgtactagggctgttgcaaatggttttgtacttggtttacaggaactcaaatgagaaaccagagaagattaattcgtcagaagaacaacttaagagtattgtcgtgatgagtccgttaggtgtgtcggaagtgcacccagttgtgacggaatcggtggacccactctctgaagccgttcatcatgaggatctgtccaaagttactaaagtggaggagccgtcaattgaaaacggcaagtgctacgtggaggctactcgtcctgaaaccgtttgaagtatgtgaagctcaaaatattgctctctctctctctctctctttcactctctttctctcggctcgtcgggccggccaaaggaagaaattgtattatcggcggggtggtttgttaaatttccatttttgtttcgtatcttattgatgatgtactacttgcataaagttttgtgtttatttgaatatattatctttgtgtaagttgtaactagtgctctttggaaaatttgatataataaacctcaatagc

SEQ ID NO: 2142 - protein, 292 aa, Arabidopsis thaliana
  misc_feature (134)..(220): Pfam Name: MtN3_slv; Pfam Description: MtN3/saliva family
  misc_feature: Utility: Useful for making plants sterile and for genetic confinement
  misc_feature: Utility: Useful for making plants with increased biomass
  misc_feature: Utility: Useful for making plants with increased biomass and foliage
  misc_feature: Utility: Useful for making smaller plants
MGVIINHHFLAFIFGILGNVISFLVFLAPVPTFYRIYKRKSTESFQSLPYQVSLFSCMLWLYYALIKKDAFLLITINSFGCVVETLYIAMFFAYATREKRISAMKLFIAMNVAFFSLILMVTHFVVKTPPLQVSVLGWICVAISVSVFAAPLMIVARVIKTKSVEYMPFTLSFFLTISAVMWFAYGLFLNDICIAIPNVVGFVLGLLQMVLYLVYRNSNEKPEKINSSEEQLKSIVVMSPLGVSEVHPVVTESVDPLSEAVHHEDLSKVTKVEEPSIENGKCYVEATRPETV

SEQ ID NO: 2143 - protein, 281 aa, Zea mays
  misc_feature (1)..(281): Ceres CLONE ID no. 263281
  misc_feature: Utility: Useful for making plants sterile and for genetic confinement
  misc_feature: Utility: Useful for making plants with increased biomass
  misc_feature: Utility: Useful for making plants with increased biomass and foliage
  misc_feature: Utility: Useful for making smaller plants
MEHPWASVFGILGNIISFLVFLAPVPTFLRVYRKKSTEWFSSVPYVVALFSCTLWILYALVKTNSSPLLTINAFGCVVEAAYILLYLVYAPRGARLRALASFLLLDVAAFSLVAVVTVVLVAEPHRVRVLGSVCLAFSMAVFVAPLSVIFVVIRTKSAEFMPFTLSFFLTLSAVAWFLYGLFTKDPYVTLPNVGGFFFGCIQMVLYCCYRKRKPASVVLPTTTAAAAVAQQLEAEMELPLAAHQHQLAVAVLPTCAAPVLAELQKLEEAMGSPRKGGVKAI

SEQ ID NO: 2144 - protein, 280 aa, Triticum aestivum
  misc_feature (1)..(280): Ceres CLONE ID no. 918913
  misc_feature: Utility: Useful for making plants sterile and for genetic confinement
  misc_feature: Utility: Useful for making plants with increased biomass
  misc_feature: Utility: Useful for making plants with increased biomass and foliage
  misc_feature: Utility: Useful for making smaller plants
MAHPWASAFGILGNIISFLVFLAPTPTFLRVYRKKSTEGFSAVPYVVALFSCMLWIFYALVKTNSSPLLTINAFGCVVEGFYILLYVVYAPRHARHRALAFFLLLDVAAFALIVAVTVFLVPQPSRVKVLGSVCLAFSMAVFVAPLSVIFVVIKTKSAEYMPFSLSFFLTLSAVAWFFYGLFTKDIYVTLPNVGGFFFGVAQMTLYFCYRKPDTSALVLPTGIHDVSTEPAAQQEVELPEGTHPAVAMLTVSTLPMLAELQKMEQEISSPTPRKGYIKAF

SEQ ID NO: 2145 - protein, 299 aa, Zea mays
  misc_feature (1)..(299): Ceres CLONE ID no. 239640
  misc_feature: Utility: Useful for making plants sterile and for genetic confinement
  misc_feature: Utility: Useful for making plants with increased biomass
  misc_feature: Utility: Useful for making plants with increased biomass and foliage
  misc_feature: Utility: Useful for making smaller plants
MSLQHPWAFAFGLLGNVISFMTFLAPIPTFYRIYKSKSTEGFQSVPYVVALFSAMLWIFYALIKSNETFLITINAAGCVIETIYVVMYFVYAPKKAKLFTAKIMVLLNGGVFGVILLLTLLLFKGSKRVVLLGWICVGFSVSVFVAPLSIMRRVIQTKSVEYMPFSLSLSLTLSAVVWFLYGLLIKDKYVALPNILGFTFGVVQMVLYVLYMNKTPVAATAEGKDAGKLSSAADEHVLVNIAKLSPALPERSSGVHPVTQMAGVPVRSCAAEATAPAMLPNRDVVDVFVSRHSPAVHVA

SEQ ID NO: 2146 - protein, 271 aa, Triticum aestivum
  misc_feature (1)..(271): Ceres CLONE ID no. 798115
  misc_feature: Utility: Useful for making plants sterile and for genetic confinement
  misc_feature: Utility: Useful for making plants with increased biomass
  misc_feature: Utility: Useful for making plants with increased biomass and foliage
  misc_feature: Utility: Useful for making smaller plants
MTYLAPLPTFYRIYRSKSTQGFQSVPYVVALFSAMLWIYYALLKSDECLLITINSAGCVIETIYIIIYLTYAPKQAKLFTAKILLLLNVGVFGLILLLTLLLSEGEKRVVMLGWVCVGFSVSVFIAPLSVIRLVVRTRSVEFMPFSLSLSLTVSAVVWFLYGLLIKDKYVALPNILGFAFGVIQMGLYALYRNAMPSPAPKQVDDADAIKVPEHVIHIAKLGPAAAIELNTHNPMERGMPPPMEDNGLACASDMTKGGIDMVEKATRVEQV

SEQ ID NO: 2147 - protein, 293 aa, Zea mays
  misc_feature (1)..(293): Ceres CLONE ID no. 219950
  misc_feature: Utility: Useful for making plants sterile and for genetic confinement
  misc_feature: Utility: Useful for making plants with increased biomass
  misc_feature: Utility: Useful for making plants with increased biomass and foliage
  misc_feature: Utility: Useful for making smaller plants
MAGLSLLHPMAFAFGLLGNIISFMTYLAPLPTFYRIYKNKSTEGFQSVPYVVALFSAMLWIYYALLKSNELLLITINSAGCVIETLYIAMYLLYAPKKAKLFTAKILLLLNVGVFGLILLLTLLLSAGQRRVVVLGWVCVAFSVSVFVAPLSIIRQVVRTRSVEFMPFSLSLSLTVSAVVWFLYGLLIKDKYVALPNVIGFSFGVVQMGLYALYRNATPRVPAKDVADDASKDKAPGEHVVVTIAKLTAATTAPAAAVAEDLVKVHDGHPEEAAKGAAKPAENGAGRSDAEQV

SEQ ID NO: 2148 - DNA, 660 bp, Arabidopsis thaliana
  misc_feature (1)..(660): Ceres CLONE ID no. 39127
  misc_feature (1)..(660): Also known as  Ceres CDNA ID no. 23356669
gcatctctgatctttcttggtgagagtaatagacatgggagctcttgattctctttccgagtatatctccgactacttccgcgtcaccagaaaaaggaggaagcggaaagtcatgcagacggtgaatataaaggtgaaaatggactgcgatggttgtgaacgcagagtcaagaacgcggtttcctccatgaaaggtgtgaaatcggtggaggtgaatagaaagatacataaagtgacggtgagtggatacgtggaaccaaagaaggtattaaagagaatcgaaaggacagggaaaaaagcggagatatggccgtacgttccttacaacatggtcgcatatccatacgcggtcggaacttacgacaaaaaagctccggccggttatgtcaggaaatctgagcagtcgcagttgcagctgttgccgggagctcccgagaaccactacatttctctttttagcgacgagaatcccaacgcttgcaccgttatgtaataaataatttactctagtagtattatccacagcatgtaacgtttttatcaagcaattggctctctctctctctctctttttgttatgttaatgcagagaggaagaaccaactatagctagttgtgtaaaattttcaatatttcaaaataagttagtggaatgtgtac

SEQ ID NO: 2149 - protein, 152 aa, Arabidopsis thaliana
  misc_feature (31)..(91): Pfam Name: HMA; Pfam Description: Heavy-metal-associated domain
  misc_feature (31)..(91): Pfam Name: HMA; Pfam Description: Heavy-metal-associated domain
  misc_feature: Utility: Useful for making plants sterile and for genetic confinement
MGALDSLSEYISDYFRVTRKRRKRKVMQTVNIKVKMDCDGCERRVKNAVSSMKGVKSVEVNRKIHKVTVSGYVEPKKVLKRIERTGKKAEIWPYVPYNMVAYPYAVGTYDKKAPAGYVRKSEQSQLQLLPGAPENHYISLFSDENPNACTVM

SEQ ID NO: 2150 - protein, 124 aa, Glycine max
  misc_feature (1)..(124): Ceres CLONE ID no. 656297
  misc_feature: Utility: Useful for making plants sterile and for genetic confinement
MQTVEIKVKMDCDGCERRVRNSVSNMSGVKQVEVNRKQSRVTVTGYVDRNKVLKKVQSTGKRAEFWPYIQYNLVAYPYVAQAYDKKAPSGYVKNTEQALPNPNAPDEKLTSLFSDDNPNACSIM

SEQ ID NO: 2151 - protein, 162 aa, Triticum aestivum
  misc_feature (1)..(162): Ceres CLONE ID no. 769994
  misc_feature: Utility: Useful for making plants sterile and for genetic confinement
  misc_feature (76)..(76): Xaa is any aa, unknown, or other
MGVGGTLEYLSGLLGGGGGHGHGHGYGNRRRRKQMQTVELKVSMDCEGCERKVKNALSSMKGVRSVNINRKQQKVXVAGYVEPSKVLRKAQSTGKKAEIWPYVPYSQVSQPYVAGTYDKRAPAGYVRSQEPGYGNVSGQVSRQDDQLTDMFNDDNANSCAVM

SEQ ID NO: 2152 - protein, 115 aa, Zea mays
  misc_feature (1)..(115): Ceres CLONE ID no. 493668
  misc_feature: Utility: Useful for making plants sterile and for genetic confinement
MDCEGCERRVKSAVKSMRVVTSVAVNAKQSKCTVTGNVEPAKVLERVKATGKNAEMWPYVPYALTTYPYVGGAYDKKAPAGFVRSAPQAMADPGAPELKYMNMFNDDNVDACTVM

SEQ ID NO: 2153 - protein, 124 aa, Parthenium argentatum
  misc_feature (1)..(124): Ceres CLONE ID no. 1608079
  misc_feature: Utility: Useful for making plants sterile and for genetic confinement
METVEIKVKMDCDGCERRVKNAASSLKGVKSVDVNRKQNRVTVKGYVEPKKVLKKVQNTGKKAEMWPYVPVSITSYPYAPQAYDKKAPAGYVKNVPQAFHAPNSPTERYDDLFSDENPNACSVM

SEQ ID NO: 2154 - DNA, 565 bp, Arabidopsis thaliana
  misc_feature (1)..(565): Ceres CLONE ID no. 95855
  misc_feature (1)..(565): Also known as  Ceres CDNA ID no. 23364939
acaaacaagcattttagagagacaaaacttaagtaaaaaaaaaaaactaattgagaaaatatggagaccgtgacatcacttgtcttcattgttaacttacttatcatttttacatcagttgtgaatcaggctagaggagatacatgtatagatggattaggctattgcaacaattgtgacgagagatgcaaggccaagcacggaccatcgagcgaaagcagctgtgatcgtagtgttggggtgccgctgtgcaaatgctactacgaatgtgaatctccgccatcaccacccgcgcagccgaagaaatgcgacggtggggctggtatatgtagtcaaagatgtcaaggacaatgttgtgatatgaactgtgcacaaaagtatattggtggacatggattttgtaatactcttggtacgtttagtttctgccaatgcgaatatccttgttaaagtcggttgacaaaactgtacaccaattattttttattattattttaatttcagcaatgcaataataaattaagaacaattactattaataataatatgkggacgacgtacttac

SEQ ID NO: 2155 - protein, 129 aa, Arabidopsis thaliana
  misc_feature: Utility: Useful for making plants sterile and for genetic confinement
  misc_feature: Utility: Useful for making smaller plants
  misc_feature: Utility: Useful for making stronger plants
METVTSLVFIVNLLIIFTSVVNQARGDTCIDGLGYCNNCDERCKAKHGPSSESSCDRSVGVPLCKCYYECESPPSPPAQPKKCDGGAGICSQRCQGQCCDMNCAQKYIGGHGFCNTLGTFSFCQCEYPC

SEQ ID NO: 2156 - protein, 127 aa, Arabidopsis thaliana
  misc_feature (1)..(127): Public GI no. 46396244
  misc_feature: Utility: Useful for making plants sterile and for genetic confinement
  misc_feature: Utility: Useful for making smaller plants
  misc_feature: Utility: Useful for making stronger plants
MERITSLVFFASFLIIFVSGVNQTRADSCDESLGLCETCDERCQAKHGPSCISKCDGEVGMLSCTCTYECGPPLPPKGNVCSGGTGMCSGKCPYKCCDTSCAQKYNGGRGFCNSFGNYNFCQCEYPC

SEQ ID NO: 2157 - protein, 104 aa, Glycine max
  misc_feature (1)..(104): Ceres CLONE ID no. 1041952
  misc_feature: Utility: Useful for making plants sterile and for genetic confinement
  misc_feature: Utility: Useful for making smaller plants
  misc_feature: Utility: Useful for making stronger plants
MGLCDERITSSECDLRCKSHYNDGEGHCDNMNICNCIHHCVSPQPNKDTEPIRKCTSGLGLCSIDHCYDDCCNSKCAKQFKEGIGHCEIVGSMGTILCTCDYVC

SEQ ID NO: 2158 - DNA, 599 bp, Arabidopsis thaliana
  misc_feature (1)..(599): Ceres CLONE ID no. 99763
  misc_feature (1)..(599): Also known as  Ceres CDNA ID no. 23389588
agagaagaagaagatgtcgatgattccgatcagcaatcgccggagactatctccccggcgatagaatctgggaaccatttgaactcatgaacacctttcttgatttcccatcaccagctctctttctttctcaccactttccctcactttctcgagaaatattcccacaaacttcatcatccaccgtcaatacgcagctcaattggaccgagactccgacggctcacgttttcaaagcgtatcttccgggagtggatcaagacgaagtgattgcgttcgtagatgaagaaggatatcttcagatctgtactggcgacaacaagttcatgagcagatttaagcttcctaacaacgccttgacggatcaggtcacggcgtggatggaggacgagtttcttgtcgtgttcgttgagaaagatgcttcttcgtcgccgccacagctgccggagattgaggagaatcgtaacgtgagagttgtggaaatcaccggcgatgatgattaattaagtgttacatgttgtcgagatatatgtgaattaaagggaaacttaaaagtttagtgtactaaatgaacaagttaatcgcttgtttaggttgtg

SEQ ID NO: 2159 - protein, 162 aa, Arabidopsis thaliana
  misc_feature: Utility: Useful for making plants sterile and for genetic confinement
MSMIPISNRRRLSPGDRIWEPFELMNTFLDFPSPALFLSHHFPSLSREIFPQTSSSTVNTQLNWTETPTAHVFKAYLPGVDQDEVIAFVDEEGYLQICTGDNKFMSRFKLPNNALTDQVTAWMEDEFLVVFVEKDASSSPPQLPEIEENRNVRVVEITGDDD

SEQ ID NO: 2160 - protein, 134 aa, Brassica napus
  misc_feature (1)..(134): Ceres CLONE ID no. 975383
  misc_feature: Utility: Useful for making plants sterile and for genetic confinement
MNTFFDFPSPSLLLSRHFPSLSPFSSPSTVETQLNWTETPTAHVFKAYLPGTTQDEAIVFVDDEGYLQICAGDNKFMSRFKLPDNALKDQVTAWMEEDGFLVVFVAKDGAFSQTPPEIEDNRNVRVVEITGDDD

SEQ ID NO: 2161 - protein, 160 aa, Brassica napus
  misc_feature (1)..(160): Public GI no. 6969974
  misc_feature: Utility: Useful for making plants sterile and for genetic confinement
MSLIPNSRRGSSSVFDPFSLNLWDPFKDFPFPSSSSLSAFPEFSRENSAFVNTRVDWKETPEAHVFKADVPGLKKEEVKVEVEDDRVLKISGERNVEEEDKNDKWYRVERSSGKFLRRFQLPENAKVDQIKAAMENGVLSVTVPKAELKNVDVRAIEISG

SEQ ID NO: 2162 - protein, 148 aa, Glycine max
  misc_feature (1)..(148): Ceres CLONE ID no. 556334
  misc_feature: Utility: Useful for making plants sterile and for genetic confinement
MSIVPINQGDANGSNPFASWGQFVDFPLPPSISGFFPGLEFGFGFGSSVNTRVDWRETPRAHVWKLVLPGFSNEDVLVELQDERVLQVSVESGNFVTRFKVPDNGNLEQLKANMRHGVLVVTVPKFHQPTTTAPANRNVREVEIEGTD

SEQ ID NO: 2163 - protein, 158 aa, Glycine max
  misc_feature (1)..(158): Public GI no. 25809052
  misc_feature: Utility: Useful for making plants sterile and for genetic confinement
MSLIPSFFGNRRSNVYDPFSLDVWDPLKDFPFPSSALSASFPRENSAFVSTRVDWKETPEAHVFKADLPGLKKEEVKVEVEDDRVLQISGERSVEKEDKNDEWHRVERSSGKFLRRFRLPENAKMGQVKASMENGVLTVTVPKEEIKKPDVKSIEISG

SEQ ID NO: 2164 - protein, 158 aa, Zea mays
  misc_feature (1)..(158): Ceres CLONE ID no. 247046
  misc_feature: Utility: Useful for making plants sterile and for genetic confinement
MSLIRRSNVFDPFSLDLWDPFEGFPFGSGNSSSLFPSFPRTSSETAAFAGARIDWKETPEAHVFKADVPGLKKEEVKVEVEDGNVLQISGERNKEQEEKTDTWHRVERSSGRFLRRFRLPENAKTEQITAAMENGVLTVTVPKEDAKKPEVKSIQISG

SEQ ID NO: 2165 - protein, 156 aa, Zea mays
  misc_feature (1)..(156): Public GI no. 25044839
  misc_feature: Utility: Useful for making plants sterile and for genetic confinement
MSLVRRSNIFDPFSLDLWEPFEGFPFGGALSFPRPSASFPAETASFAGARIDWKETPEAHVFKADLPGVKKEEVKVEVEEGNVLQISGERTREKEEKNDTWHRVERSSGKFLRRFRLPDNAKVDQVKAAMENGVLTVTVPKEDVKKPQVKSVQISG

SEQ ID NO: 2166 - protein, 153 aa, Parthenium argentatum
  misc_feature (1)..(153): Ceres CLONE ID no. 1608166
  misc_feature: Utility: Useful for making plants sterile and for genetic confinement
MSIIPSFFGRRRSNVFDPFSLDVWDPFEGFPFNNNFGSLSDQVRSSETSSFVNANIDWKETADAHVFKADVPGLKKEEVKVEVEDDRVLQISGESNKESEEKGDTWHRVERSSGRFMRRFRLPENAKVDQVKAAMENGVLTVTVPKVDFKSLM

SEQ ID NO: 2167 - protein, 155 aa, Parthenium argentatum; identical to SEQ ID NO: 945
  misc_feature (1)..(155): Public GI no. 56606538
  misc_feature: Utility: Useful for making plants sterile and for genetic confinement

SEQ ID NO: 2168 - DNA, 635 bp, Arabidopsis thaliana
  misc_feature (1)..(635): Ceres CLONE ID no. 106135
  misc_feature (1)..(635): Also known as  Ceres CDNA ID no. 23385352
aggttagttttttttcagcaatctctctctcgttgaatttcttcaaattgcagaagatttatccaatcttatttcgagtatattcaaaccttaatttcaacgctagtgaaaagtataagaggaagaagacagaagacatgcttactcgctgcgacgcggtagtagaggcggtttccggcgccgggaatgtaaccagtgcggtgatcgggagattctggtttatttttgtttgttgttgctgaattgggtgtaccgtaccggtttaattctgaaccggtggaaattccggtttagtccaaggaaaattttggataaactatggtttgttgggaatttagtcatccgatctatagttctctttcgctccttctggattgatcagagtttagttgatttgcttgaagaagatgaagttatgattgaagatgagctccgaccgtcgcagaggtgaaatgctgctgcccaaactaattactattgggccatttttaggcccatcaaaataagactgtcaatatgtaattttcacaaagtaaaaaacaatccttttatgtcttttggaagtgagatttaaattgggtatgtaatttttcagcgtaacaaaaacgacaaaaaaaaaataatcatgttatttt

SEQ ID NO: 2169 - protein, 34 aa, Arabidopsis thaliana
  misc_feature: Utility: Useful for making plants sterile and for genetic confinement
  misc_feature: Utility: Useful for making smaller plants
MLTRCDAVVEAVSGAGNVTSAVIGRFWFIFVCCC

SEQ ID NO: 2170 - DNA, 992 bp, Arabidopsis thaliana
  misc_feature (1)..(992): Ceres CLONE ID no. 267657
  misc_feature (1)..(992): Also known as  Ceres CDNA ID no. 23383683
atcaagatcgatccctctctaaaaatggctcaacaacactcttttctcctcttatgcttcttcctctcaatctcttatttactatcttccgcccaaaccgaagccacctcaatcgagagattagtgccaagagacctctacaacaaaattttcatccacaaggacaataccgcttgtcccgcaaatggtttctatacttacgaatcatttgtccaagcgacgaggcggtttccgagattcgggagcgtaggaagccccgtgacacaacgactcgaagtggctgcatttttggctcagatttcacacgagacgaccggaggatgggcaacggcaccagacggaccgtacgcttggggattatgctttaaagaagaagtgagtccacaaagcacttattgtgattcttctaatacacagtggccttgtttccctaacaagacttatcaaggaagaggtccaattcaactatcgtggaactacaactacggaccggccggtcgagccttaggattcgacggtctaaggaatccagaaacggtgtcaaataattcagtgatagcttttcaaacagcactttggttttggatgacgccacagagtcccaaaccttcgtgccatgacgtcatgatcggaaaataccgacctacggcggcggatttggcagctaaccggaccggcgggtttggtttaaccacaaatataataaatggcggtttagagtgtgggattcctggagacggacgggtcaatgaccgaatcgggttttttcagagatatactgggctgtttaaagtagcaactgggccgaatttggactgtgaaaatcaaaggccttatgcttaaacaattaatttggttgacccgaaatatgtatgtttataaacaaaaagtcaacatgtatgtttatggcattgcccacacatgggagccataaaaggggtttatattcaataatgtaattcaatttaatgtgatttgatggttttaattcc

SEQ ID NO: 2171 - protein, 272 aa, Arabidopsis thaliana
  misc_feature (33)..(265): Pfam Name: Glyco_hydro_19; Pfam Description: Chitinase class I
  misc_feature: Utility: Useful for making plants sterile and for genetic confinement
  misc_feature: Utility: Useful for making plants with increased biomass and foliage
  misc_feature: Utility: Useful for making smaller plants
  misc_feature: Utility: Useful for making stronger plants
MAQQHSFLLLCFFLSISYLLSSAQTEATSIERLVPRDLYNKIFIHKDNTACPANGFYTYESFVQATRRFPRFGSVGSPVTQRLEVAAFLAQISHETTGGWATAPDGPYAWGLCFKEEVSPQSTYCDSSNTQWPCFPNKTYQGRGPIQLSWNYNYGPAGRALGFDGLRNPETVSNNSVIAFQTALWFWMTPQSPKPSCHDVMIGKYRPTAADLAANRTGGFGLTTNIINGGLECGIPGDGRVNDRIGFFQRYTGLFKVATGPNLDCENQRPYA

SEQ ID NO: 2172 - protein, 277 aa, Glycine max
  misc_feature (1)..(277): Ceres CLONE ID no. 719679
  misc_feature: Utility: Useful for making plants sterile and for genetic confinement
  misc_feature: Utility: Useful for making plants with increased biomass and foliage
  misc_feature: Utility: Useful for making smaller plants
  misc_feature: Utility: Useful for making stronger plants
MTSSVPLVSTLLLCSIALLYSASFGAEAWTSPYIPVSSLISKSLYDTFFLHKDDTACPAKDFYPYDAFIRASKSFPAFGTTGCLATRKREIAAFLAQISHETTGGWATAPDGPFAWGLCFKEEISPQSNYCDSTNTQWPCFPGKSYKGRGPIQLSWNYNYGPAGKALGFDGLRNPEIVANNSVIAFKTAMWFWMTEQKPKPSCHNVMVGIYVPTEDDIAANRTAGYGLVTNIINGGLECGIPGDARVNDRIGFFERYTKLFNVDTGPNLDCAYQKPF

SEQ ID NO: 2173 - DNA, 837 bp, Glycine max
  misc_feature (1)..(837): Ceres CLONE ID no. 545208
  misc_feature (1)..(837): Also known as  Ceres CDNA ID no. 23694565
gaaagaaaagaactaagaagctgaaaaacaagagagagaaaaagaatagcacactcaaccatagttatctagaaccaaatcatgtctcacatagccgtcgagaggaacaggagaagacagatgaatgaacatctcaaagttttaagatctttgaccccatgtttctatatcaaaaggggagatcaagcatctataatagggggtgttatagaattcatcaaggagctacaccaagttcttcaagctttggagtcccagaaaagaagaaagagtttgagccctagccctggcccgagcccacgaacacttcagccaatgtttcatcaacttgatagcccctccatgattgggaccaattctttcaaggaactaggagcaagctgcaactctcctgttgcggatgttgaagtgaaaatctcgggttcatatgtgatcttgaaagtcatttgccacagaattccaggtcaagttgcaaagatcataactgttttggagagtctttcgtttgaagttcttcatctgaatatcagcagcatggaggagactgtcctttaccaatttgttgtcaagatagagctgggatgccaactaagtctggaggaactagcaatggaagtgcaacaaagcttctgcttagatgctataattgcgctgtgaagatgtagtatttctaaagagacccaatttcgaatcgtttgttaataaaagaatggcatgtgatagacatgcataaaaactatttcttcagtaattacttgctacaaactaggcttattatatcattactgttgtcataaacttgatgacaaggaaaatatgctgttgcttaatatttgg

SEQ ID NO: 2174 - protein, 191 aa, Glycine max
  misc_feature (1)..(50): Pfam Name: HLH; Pfam Description: Helix-loop-helix DNA-binding domain
  misc_feature: Utility: Useful for making plants sterile and for genetic confinement
MSHIAVERNRRRQMNEHLKVLRSLTPCFYIKRGDQASIIGGVIEFIKELHQVLQALESQKRRKSLSPSPGPSPRTLQPMFHQLDSPSMIGTNSFKELGASCNSPVADVEVKISGSYVILKVICHRIPGQVAKIITVLESLSFEVLHLNISSMEETVLYQFVVKIELGCQLSLEELAMEVQQSFCLDAIIAL

SEQ ID NO: 2175 - protein, 202 aa, Glycine max
  misc_feature (1)..(202): Public GI no. 6862916
  misc_feature: Utility: Useful for making plants sterile and for genetic confinement
MSHIAVERNRRRQMNEHLKSLRSLTPCFYIKRGDQASIIGGVIEFIKELQQLVQVLESKKRRKTLNRPSFPYDHQTIEPSSLGAATTRVPFSRIENVMTTSTFKEVGACCNSPHANVEAKISGSNVVLRVVSRRIVGQLVKIISVLEKLSFQVLHLNISSMEETVLYFFVVKIGLECHLSLEELTLEVQKSFVSDEVIVSTN

SEQ ID NO: 2176 - protein, 206 aa, Zea mays
  misc_feature (1)..(206): Ceres CLONE ID no. 336092
  misc_feature: Utility: Useful for making plants sterile and for genetic confinement
MNEHLKVLRSLTPGLYIKRGDQASIIGGAIEFIKELQQVLESLEARKKRRSSGGGHSFLTGSPSPTPSPRSHLLSSVSTPSPPVMIKELAACCNSAVADVEAKISGSNVLLRTLSRRSSIPGGQAVRLIAVLEGLHLEVLHLNISTMEDTVLHSLVLKIGLECQLSVEDLAYEVQQIFGQDTAEQKPQAEENHHHLIYSSAMAAAI

SEQ ID NO: 2177 - protein, 227 aa, Zea mays
  misc_feature (1)..(227): Public GI no. 57900676
  misc_feature: Utility: Useful for making plants sterile and for genetic confinement
MSHIAVERNRRRQMNDHLKVLRSLTPAFYIKRGDQASIIGGAIDFIKELQTLLQSLEAQKKRRQQPQAHLISPASISASGGGSPSPTPSPRSLITSCSPTAAAGSSAGSSSSISPKDENKQQLQLVAELAACCNSPMADVEARISGANVLLRTLSRRAPPVRIIALLESLHLEVLHLNITTMDDTVLYSFVLKIGLDCHLSVDDLAMEVHQSFMPPPAAHPDNHLHS

SEQ ID NO: 2178 - DNA, 1336 bp, Glycine max
  misc_feature (1)..(1336): Ceres CLONE ID no. 546490
  misc_feature (1)..(1336): Also known as  Ceres CDNA ID no. 23694311
atattaggatttgctttaaaatttttcaataaatcctatttatgatttcttctcaaaaccttgcaaacatcttggaggtgcttagttacttgatctttgggctagtattagtgagcattcttcatccactatcacaaatcagattcaaaatctattatcacaataatgaaaagaataaaaagagaataatgcaatgtcctcacataaaaaaaggaatatttttgccaacgatatatttattgagtggaactcttcaagcgatttttgggaaattttcaaagttacatgatgcaaatattcatttcaaagaagaacatttagaacttccttgtggtggaattgttggaatgtattgggcttcacagttggtggagacagagtctgctaaagcaaaggcgaaaaaagttgtagtaattatggtacctggattgacagcctctttcaaagaaccttatattcgaaatatatcgagtgaagctttagagaatggttataaggtggtgatttatcataatcgaggcaatcaagtagcattaactcttccaaaagaagggtatttggattattcaatagatctcaaatatgctgttgattatgttgtcaagacatatcctgatcatcaaatatttgctgttggacattcccttggtgcaaataatctcgtaaattatttggccaaatataaggatgattgtccgataaaagttgctgcttcggtttcaaatccttttgattttcacaaagcaggagaaggtgtcaaggatactatgtttgatggatttcttgctcaaatgatgcaaaattgggctcgaagaaatcaagatgtattactgaatgctccaaaatatcttgatatcaaatatgaattggcaatgcaagcaaagacattgagaggttttgatgaacagattactcgtagattatatggatatcctcattataatgattattatactggaatttcaagtgtttttaatattaaggatattaatataccattgctttgtttgaattctaaagatgatcctgttctaaatcatggaagtatctgtattgaagaatgtcaaaagaatgagaatattattttgattgyyyacacacaatggtggtcatgttggatggttccatgggattttacaaccgaaaaggtggtatcctaagcctgtcattgaatatttgaacacttgttttgaagaactacaggaagagggattacataagaaatagattttgattttttaaatgaaaaaagatttacattacatttattacaatatatacgaagggattttcttaccttgctatgatttttatttttatttgaaaaatggtttat

SEQ ID NO: 2179 - protein, 394 aa, Glycine max
  misc_feature (151)..(330): Pfam Name: Abhydrolase_1; Pfam Description: alpha/beta hydrolase fold
  misc_feature: Utility: Useful for making plants sterile and for genetic confinement
MISSQNLANILEVLSYLIFGLVLVSILHPLSQIRFKIYYHNNEKNKKRIMQCPHIKKGIFLPTIYLLSGTLQAIFGKFSKLHDANIHFKEEHLELPCGGIVGMYWASQLVETESAKAKAKKVVVIMVPGLTASFKEPYIRNISSEALENGYKVVIYHNRGNQVALTLPKEGYLDYSIDLKYAVDYVVKTYPDHQIFAVGHSLGANNLVNYLAKYKDDCPIKVAASVSNPFDFHKAGEGVKDTMFDGFLAQMMQNWARRNQDVLLNAPKYLDIKYELAMQAKTLRGFDEQITRRLYGYPHYNDYYTGISSVFNIKDINIPLLCLNSKDDPVLNHGSICIEECQKNENIILIVTHNGGHVGWFHGILQPKRWYPKPVIEYLNTCFEELQEEGLHKK

SEQ ID NO: 2180 - protein, 582 aa, Glycine max
  misc_feature (1)..(582): Public GI no. 56784222
  misc_feature: Utility: Useful for making plants sterile and for genetic confinement
MEAVAGGGGGGGGESVGELLLRAAAMVPAEHYALAALAVVSVLAYGFLELHFLGDLLRGFRGGRVELTFHPASEIYHRVASKCRSLHGRYLATPWLASPHLQTLFLGISGRPPSFTYKRQLYTVHDGGTIALDWLLATDSKGSDGILSEDASAPLVVIVPGLTSDSAAAYVKHMAYSMATKGCNTVVSNHRGLGGVSITSDCLYNAGWTEDLREVINYLHHKYPKAPMLCVGTSIGANIVVKYLGEEGENTPVAGAASICSPWDLVVGDRFISRKLVQRFYDKALAFGLKGYAKLHEPVLVRLANWEGIKKSRSIREFDHHATCMVAKYETVDTYYRRCSSASYVGNVSVPLLCVNALDDPLCTREAIPWDECRANKNIVLATTPNGGHLAFFQGLTAGRLWWVGAVSEFLFALLDSKYMHQQKAQDHILRSSLESSIDKSPYVNVMEDGMIAPVTDDGPCDDITPSHQVNDIKQDNGDFTQQNEHTREVDDKNITEVNAMPSQSPEQSAGQQVEEHYVGKFHEAIAPVKRSINQLTRYQGKSVWLLAYIAFVTSWPLLGSLAFIAFRKKFRNNLLAKWLRR

SEQ ID NO: 2181 - DNA, 1133 bp, Glycine max
  misc_feature (1)..(1133): Ceres CLONE ID no. 566317
  misc_feature (1)..(1133): Also known as  Ceres CDNA ID no. 23693659
aaagaaacaattaaaataataaacctaaaagccctaacatatctatccccaacagtaaaagaaagcagattcatactctctccctctctctttagtctttaccaccacctggcctgcttttaaaacttgttcttcctctctcacatgaagacactagtcatggacacaacctcatcaacccctcaagactcatcatcctccaagaggcacttccactggacgaacaaggttggaaatgaagacccccaactcgccacctcagaaacgatgtcaaaaatcatagaagaagaagacacaaacacaaaggaaaaagaacaagaagaagatgacaaggctgttccacttccaggccctgccacaaagagaaagattcaggcagtggcaatctcaaggctccgatctgttctgactgtgttcagcaaaaaccaccgttccaacctccccttcggcctcggctccagagtcgttggcaccctcttcggctaccgccgcggccacgtgcatttcgccttccagagggaccccacttcgcaacccgccttcctcatcgagctcgcgaccccaatcagcggacttgtccgcgaaatggcgtctgggctggtgagaattgctttggagtgtsacmaggacaaagactcagaggagaagaagacgacgaakaagaacaagaccctgaggctgcttcaggagtccgtgtggaggacctmcygcawcggtaaaaagwgcggstttgccacsagaagagaatgtggagccaaagactgggacatactgaaggcagkggagccaatttctatgggtgcaggtgttttgcctaacagtgatgggtctgatggtgaagkcatgtacatgagggctaggtttgagagaattgytggttccagagactctgaagctttctacatgatgaatcctgacagcaatggagcacctgagctcagtatttacttgcttagagtctagtactgctgctgccactaccagcccccccccagtcatctgtttagttatttatactttaactttctttcccttttttagtttcttctttgtggatgatgttaaacactaggctattcctatactacttgtttagctccttaatcatgaacaatggtgacctagttttcttc

SEQ ID NO: 2182 - protein, 272 aa, Glycine max
  misc_feature (106)..(272): Pfam Name: DUF617; Pfam Description: Protein of unknown function, DUF617
  misc_feature: Utility: Useful for making plants sterile and for genetic confinement
  misc_feature: Utility: Useful for making smaller plants
  misc_feature: Utility: Useful for making stronger plants
MKTLVMDTTSSTPQDSSSSKRHFHWTNKVGNEDPQLATSETMSKIIEEEDTNTKEKEQEEDDKAVPLPGPATKRKIQAVAISRLRSVLTVFSKNHRSNLPFGLGSRVVGTLFGYRRGHVHFAFQRDPTSQPAFLIELATPISGLVREMASGLVRIALECDKDKDSEEKKTTKKNKTLRLLQESVWRTYCNGKKCGFATRRECGAKDWDILKAVEPISMGAGVLPNSDGSDGEVMYMRARFERIVGSRDSEAFYMMNPDSNGAPELSIYLLRV

SEQ ID NO: 2183 - protein, 277 aa, Glycine max
  misc_feature (1)..(277): Public GI no. 62320932
  misc_feature: Utility: Useful for making plants sterile and for genetic confinement
  misc_feature: Utility: Useful for making smaller plants
  misc_feature: Utility: Useful for making stronger plants
MAKDFASKRHNSFHWTRKVGSDENDDVSSHKPLPHHNNTKPSSSSSSSSSNVITHKKKLQSFAVSRLRSVIATLSRARPGNQNSGLGSRVVGTLFGSRRGHVHFSIQKDPNSPPAFLIELATPISGLVKEMASGLVRIALECDKGKEEEEGEEKNGTLRHGGGDKTKTTTTAAVSRRLVEEPMWRTYCNGKKCGFATRRECGEKEKKVLKALEMVSMGAGVLPETEEIGGGGGGGGDIMYMRAKFERIVGSRDSEAFYMMNPDSNGAPELSIYLLRI

SEQ ID NO: 2184 - protein, 247 aa, Brassica napus
  misc_feature (1)..(247): Ceres CLONE ID no. 961315
  misc_feature: Utility: Useful for making plants sterile and for genetic confinement
  misc_feature: Utility: Useful for making smaller plants
  misc_feature: Utility: Useful for making stronger plants
  misc_feature (146)..(146): Xaa is any aa, unknown, or other
  misc_feature (147)..(147): Xaa is any aa, unknown, or other
  misc_feature (154)..(154): Xaa is any aa, unknown, or other
  misc_feature (156)..(156): Xaa is any aa, unknown, or other
  misc_feature (161)..(161): Xaa is any aa, unknown, or other
  misc_feature (173)..(173): Xaa is any aa, unknown, or other
  misc_feature (183)..(183): Xaa is any aa, unknown, or other
  misc_feature (186)..(186): Xaa is any aa, unknown, or other
  misc_feature (192)..(192): Xaa is any aa, unknown, or other
  misc_feature (205)..(205): Xaa is any aa, unknown, or other
  misc_feature (207)..(207): Xaa is any aa, unknown, or other
  misc_feature (219)..(219): Xaa is any aa, unknown, or other
MVDLGKHHHHMQLITTPTTVDCARELRHRRTLRSLIECILPYCCTYQQPSPSCQNDTVSVSSSSSSSSSSDHSSSSSSSSSSSRSNSIISGTFFGHRRGRVSFCLQDTAVGSPPLLLLELAVPTAKLAKEMDQAGVLRIALECDRXXSSNSGPXSXFDVPXWSMYCNGRKMGXAVRRKVTENXAVXLRMMQXVSVGAGVVPVDKXEXTLYLRARFERVXGSSDSESFHMMNPGGSYGQELSIFLLRS

SEQ ID NO: 2185 - protein, 239 aa, Triticum aestivum
  misc_feature (1)..(239): Ceres CLONE ID no. 786659
  misc_feature: Utility: Useful for making plants sterile and for genetic confinement
  misc_feature: Utility: Useful for making smaller plants
  misc_feature: Utility: Useful for making stronger plants
MAFSSACPSFHSEDFVSPPKKPVTGTAAPAQEKQQQRRKVRTAVARLRSALSAAVSGRRRQVGLGARLTGTLYGHRRGHVHLAFQTDPRACPALLLELAAPTGALVREMASGLVRIALECERAKAATGGGDGGGRKLVEETVWRAYVNGKSCGYAVRRECGAADWRVLRALEPVSMGAGVIPAASCGGGEGDVMYMRARFERVVGSRDSEAFYMMNPDSSSSGSGINGGPELSVYLLRV

SEQ ID NO: 2186 - protein, 263 aa, Zea mays
  misc_feature (1)..(263): Ceres CLONE ID no. 276062
  misc_feature: Utility: Useful for making plants sterile and for genetic confinement
  misc_feature: Utility: Useful for making smaller plants
  misc_feature: Utility: Useful for making stronger plants
MKSSEAEDDDETTMAFSSACTSFHSDGFVSPPLKPAPSDHIQQVAAAAAGQRRRMKVRTAVSRLRSALANAVAGRHRQVGMGARLTGTLYGHRRGHVHLAFQVDPRACPALLLELAAPTAALVREMASGLVRIALECDRARARGSPAAALPSPSPGAGKRLVEETVWRAYCNGKSCGYAVRRECGAADWRVLRALEPVSMGAGVIPAASCGGGEGDVMYMRARFERVVGSRDSEAFYMMNPDGSGGGAHGHGGPELSVYLLRV

SEQ ID NO: 2187 - protein, 223 aa, Zea mays
  misc_feature (1)..(223): Ceres CLONE ID no. 284925
  misc_feature: Utility: Useful for making plants sterile and for genetic confinement
  misc_feature: Utility: Useful for making smaller plants
  misc_feature: Utility: Useful for making stronger plants
  misc_feature (165)..(165): Xaa is any aa, unknown, or other
MQAGACPDRGAVVAARRRRRRAVVGLIELAADAAHRVVLLRRGRVVAPPPHRHALRLPRRPRVAVAAAERAVPAHAGGRAGAPDARAAPRARRPRGRAHRAGGREARRAGHRRRQRGHRHHRPRRVGAGGAHVDHVLQRQEGGYAVRRDPTEEDIAVLETLWAVXMGGGVLPGRSDMDGPDGEMAYMRGSFEHTVGSRDSESLYMVGPPGGDCPELAIFFVRL

SEQ ID NO: 2188 - DNA, 889 bp, Arabidopsis thaliana
  misc_feature (1)..(889): Ceres CLONE ID no. 28003
  misc_feature (1)..(889): Also known as  Ceres CDNA ID no. 23387939
cttttcaacacactactgatcttgagaatcctctcttcaaagccatggcgttagaactatggcaaactctcaaagaagcaatccatgcttacacaggtctttctcctgttgtcttcttcactgctctagctctcgccttcgccatttaccaagtcatctcaggctggtttgcctcgccgttcgatgatgttaaccgacatcagagagctagatccttggctcaagaggaggagccaccgattcctcagcctgttcaagtcggtgagatcacggaggaggagcttaaacagtacgatggctctgatcctcaaaagccccttcttatggctatcaaacatcagatctatgatgttacacaaagcaggatgttctacggaccaggaggaccatatgctttgtttgcagggaaagacgctagccgagctcttgcaaagatgtcatttgaggagaaagacttgacttgggatatctctggtcttggtccctttgagctagatgctcttcaagattgggagtacaagttcatgagcaagtatgctaaggttggtactgtcaaagtggctggttcagaacctgaaaccgcatctgtctctgaacccacagagaatgttgagcaagatgctcatgtaaccacaacgcctgagaagaccgttgttgataagagtgatgatgctcctgctgagactgtgttgaagaaggaggagtagagcccatttccaagatttgctctgatttgtcatagagaccagttttatgaaaaggattgtagaatctctaatgttgaagtgtcaatgataatcttgttttactttcccaaaaaataaagattgctgattaatgataagaaaaaaatgttttataaactgcatatcagaaggcgttgcattgc

SEQ ID NO: 2189 - protein, 220 aa, Arabidopsis thaliana
  misc_feature (74)..(171): Pfam Name: Cyt-b5; Pfam Description: Cytochrome b5-like Heme/Steroid binding domain
  misc_feature (74)..(171): Pfam Name: Cyt-b5; Pfam Description: Cytochrome b5-like Heme/Steroid binding domain
  misc_feature: Utility: Useful for making plants sterile and for genetic confinement
  misc_feature: Utility: Useful for making smaller plants
MALELWQTLKEAIHAYTGLSPVVFFTALALAFAIYQVISGWFASPFDDVNRHQRARSLAQEEEPPIPQPVQVGEITEEELKQYDGSDPQKPLLMAIKHQIYDVTQSRMFYGPGGPYALFAGKDASRALAKMSFEEKDLTWDISGLGPFELDALQDWEYKFMSKYAKVGTVKVAGSEPETASVSEPTENVEQDAHVTTTPEKTVVDKSDDAPAETVLKKEE

SEQ ID NO: 2190 - protein, 218 aa, Brassica napus
  misc_feature (1)..(218): Ceres CLONE ID no. 980499
  misc_feature: Utility: Useful for making plants sterile and for genetic confinement
  misc_feature: Utility: Useful for making smaller plants
MALLLWQTLKEAIHAYTGLSPVVFFTALALAFSIYQVVSGWFASPFDDVRRHQRARSSAAEEAPPIPQPVQVGEITEEELKQYDGSDPQKPLLMAIKHQIYDVTQSRMFYGPGGPYALFAGKDASRALAKMSFEEKDLTWDISGLGPFELEALQDWEYKFKSKYATVGTVKVTVSEAETASVSEPAETDDGDAHVIKQEPTVVDKNLETPAESDVKNE

SEQ ID NO: 2191 - protein, 219 aa, Zea mays
  misc_feature (1)..(219): Ceres CLONE ID no. 1381318
  misc_feature: Utility: Useful for making plants sterile and for genetic confinement
  misc_feature: Utility: Useful for making smaller plants
  misc_feature (78)..(78): Xaa is any aa, unknown, or other
  misc_feature (81)..(81): Xaa is any aa, unknown, or other
  misc_feature (85)..(85): Xaa is any aa, unknown, or other
  misc_feature (93)..(93): Xaa is any aa, unknown, or other
MALLLWQTLKEAIHAYTGLSPVVFFTALALAFSIYQVVSGWFASPFDDVRRHQRARSSAAEEAPPIPQPVQVGEITEXELXQYDXLPILKSPXSMAIKHQIYDVTQSRMFYGPGGPYALFAGKDASRALAKMSFEEKDLTWDISGLGPFELEALQDWEYKFKSKYATVGTVKVTVSEAETASVSEPAETDDGDAHVIKQEPTVVDKNLETPAESDVKNE

SEQ ID NO: 2192 - DNA, 639 bp, Zea mays
  misc_feature (1)..(639): Ceres CLONE ID no. 225200
  misc_feature (1)..(639): Also known as  Ceres CDNA ID no. 23746143
aagacaaagccagcaccacacaagcaggcaggaagggaagccctcgctctcgctcacccctgtctggcgtctgcttatccctggagcagaccggagtaaggccagccaaccaaattgtctatctactgaaggaaggagaaaaaaaaagagattcaacaagttgttgcagctgcagctttaccgattcccatgggttccaagccgggtgaggcgccaacctgggcggaccagtgggcctctggcgagggcgacgggagcatcgcgaacggcaaggcggccggtaagaggacggtggccggcaacgtgaaggcggcggcgtcggagggactcgtcaaggccaaggcggcggcgctggtcggagcgcacaagctcaagaccgggacgagctcgggcatcaagtgggtcagggagcagtaccagaagaagaggacgtcgtccaagtgagctgcaatgtgtcaattgtgatggaggagcactgctactctctgttctgatctttcttagtgaagcccattagaggaacaggtttttctcttgggtggagactcttcttggacgctttggttcctttggatggtgagcttgtaagccgctggccttttttttcattattatgccagactagtatgatttttgcgt

SEQ ID NO: 2193 - protein, 84 aa, Zea mays
  misc_feature: Utility: Useful for making plants that grow better in shade
  misc_feature: Utility: Useful for making plants with altered leaf shape eg curled leaves
  misc_feature: Utility: Useful for making plants with increased biomass and foliage
  misc_feature: Utility: Useful for making smaller plants
MGSKPGEAPTWADQWASGEGDGSIANGKAAGKRTVAGNVKAAASEGLVKAKAAALVGAHKLKTGTSSGIKWVREQYQKKRTSSK

SEQ ID NO: 2194 - protein, 88 aa, Zea mays
  misc_feature (1)..(88): Public GI no. 38093751
  misc_feature: Utility: Useful for making plants that grow better in shade
  misc_feature: Utility: Useful for making plants with altered leaf shape eg curled leaves
  misc_feature: Utility: Useful for making plants with increased biomass and foliage
  misc_feature: Utility: Useful for making smaller plants
MGSKKDAQTWADQWGSSGGDGSFKKGGGGGGSSGNSEKKTVAGNVKAAASEGLVKAKAAALVGAHKVKSGTSSGIKWVKGQYQKRAGK

SEQ ID NO: 2195 - protein, 85 aa, Glycine max
  misc_feature (1)..(85): Ceres CLONE ID no. 646162
  misc_feature: Utility: Useful for making plants that grow better in shade
  misc_feature: Utility: Useful for making plants with altered leaf shape eg curled leaves
  misc_feature: Utility: Useful for making plants with increased biomass and foliage
  misc_feature: Utility: Useful for making smaller plants
MGSKGPSWSDQWGSGGFGSDHYEEEEKMKMKKSGSSKKMADAKAVASAGMDKAKTAAVVGAQKVKSGTSAGLKWVKNQYQKRTSK

SEQ ID NO: 2196 - DNA, 1218 bp, Arabidopsis thaliana
  misc_feature (1)..(1218): Ceres CLONE ID no. 19080
  misc_feature (1)..(1218): Also known as  Ceres CDNA ID no. 23376262
atgctcaccacttcacctctctctctctttcttctccactgtaacctcccaattcaaaaacaattataaaccaaacttgattaatatatatttctttatcatcatctcttcgaaatgcaagatattcatgatttctccatgaacggagttggtggtgggggaggaggaggagggaggtttttcggtggaggaatcggcggcggaggaggtggtgatcgaaggatgagagctcatcagaacaatatacttaaccatcatcaatctctcaagtgtcctcgttgtaattctcttaacacaaagttctgttactacaacaattacaatctttctcagcctcgtcacttttgcaagaactgtcgtcgttactggactaaaggtggtgttctccgtaacgttcccgtcggaggtggttgccggaaagctaaacgttcgaaaacaaaacaggttccgtcgtcgtcatcagccgacaaaccaacgacgacgcaagatgatcatcacgtggaggagaaatcgagtacaggatctcactctagcagcgagagctcttctctcaccgcttctaactctaccaccgtcgccgccgtctccgtcaccgcggcggcggaagttgcttcgtcggttattccaggttttgatatgcctaatatgaaaatttacggtaacgggatcgagtggtcgacgttacttggacaaggctcatcggccggtggtgttttctcggagatcggtggttttccggcggtttcagctattgaaactacaccgtttggattcgggggtaaattcgtaaatcaagatgatcatctgaagttagaaggtgaaactgtacagcagcaacagtttggagatcgaacggctcaggttgagtttcaaggaagatcttcggatccgaatatgggatttgaaccgttggattggggaagtggcggtggagatcaaacactgtttgatttaaccagtaccgttgatcatgcatactggagtcaaagtcaatggacgtcgtctgaccaagatcagagtggtctctaccttccttgattctgatcatagcttcttcttcttaacccaaaaatatatattttatacacataaggtaaagttcgatgaagtggtttttttaatttttatttgatgggtctaaaacgggatttattatataattatatgactgcttgtaaatttttttcccaaatatcaaatttacctctcttttttttt

SEQ ID NO: 2197 - protein, 307 aa, Arabidopsis thaliana
  misc_feature (46)..(108): Pfam Name: zf-Dof; Pfam Description: Dof domain, zinc finger
  misc_feature: Utility: Useful for making plants with altered leaf shape eg curled leaves
  misc_feature: Utility: Useful for making plants with increased biomass and foliage
MQDIHDFSMNGVGGGGGGGGRFFGGGIGGGGGGDRRMRAHQNNILNHHQSLKCPRCNSLNTKFCYYNNYNLSQPRHFCKNCRRYWTKGGVLRNVPVGGGCRKAKRSKTKQVPSSSSADKPTTTQDDHHVEEKSSTGSHSSSESSSLTASNSTTVAAVSVTAAAEVASSVIPGFDMPNMKIYGNGIEWSTLLGQGSSAGGVFSEIGGFPAVSAIETTPFGFGGKFVNQDDHLKLEGETVQQQQFGDRTAQVEFQGRSSDPNMGFEPLDWGSGGGDQTLFDLTSTVDHAYWSQSQWTSSDQDQSGLYLP

SEQ ID NO: 2198 - DNA, 972 bp, Arabidopsis thaliana
  misc_feature (1)..(972): Ceres CLONE ID no. 125409
  misc_feature (1)..(972): Also known as  Ceres CDNA ID no. 23649551
acaccgatccaatgtcggaagaagaacaaaaccctgatccgatgtcggaagaaagagaacaaaacccgaatccgatgatctacctatgtcccgatctagtggaagaaatcgtccttggattgccgttgaaattcaatcctcagattcaaaacggtctcaaaacaatggagatcaatccttggattgtgagatttttgatgtcaatattggtgaatggcggagatcgaggagcccccctccttattgggtggatcccagaaggaagtctgcgtgtgttcagggctccatctactggttaaatgtcaaacctttccaggtactagctttggatcttcacacacaagagttccataatgttcgctcaagacctactcacgcaacttatgccgaccaacttgtcaaccttgatgaccgtctagccatagcctaatcgtttttgcatcctccttggatactatggatatggaccatggatgttctaaaagatgatggatggaccaaggcttactccatagatttatcctcctgtagagatcttaccgtggaaagtgcatttcaggccggtggcggtttctaagcatgggaatgtttacttgcatgacaatgaaaagaggttgttgaaatactatccaaagaccaacctccttcgttgcatctctaaagacacttgggtcatatcccctatggttgagaatgtgcttccacttcggcctctaggctctattcccaagacattcggctacggatccatatctcaggagcttaaccacatgccgggatcgaggatgtccaaatttcttagcagaatcccaactatactgtttacaaccactctagtgtctcaagttgtttaccgctatttgtcttgatgttgactttatactcgctgaatgttgttatgtctgtcagtatattaagtatgaacttgtttgatctttgaaacatttatcttcactcttgcttgtgacttct

SEQ ID NO: 2199 - protein, 114 aa, Arabidopsis thaliana
  misc_feature: Utility: Useful for making plants with altered leaf shape eg curled leaves
  misc_feature: Utility: Useful for making smaller plants
MSRSSGRNRPWIAVEIQSSDSKRSQNNGDQSLDCEIFDVNIGEWRRSRSPPPYWVDPRRKSACVQGSIYWLNVKPFQVLALDLHTQEFHNVRSRPTHATYADQLVNLDDRLAIA

SEQ ID NO: 2200 - DNA, 705 bp, Zea mays
  misc_feature (1)..(705): Ceres CLONE ID no. 301326
  misc_feature (1)..(705): Also known as  Ceres CDNA ID no. 23744280
aataaaccaagatagtgagatgtgtctccatcataccacaccatgtgatgcgaggagcctcttctgcctctcatccccctacttccaagatgcaatcatgctgccccagactcctcgggccctcggccaccatgattgcctcaccgcctctcaggagtcgcctccacctacttccaagaggaagaggccggagaagctatagtccatgaggaaattaagcggaggggcggcggccggtgaacgaggggccggaggaggaggagagagaaggggaggtggcagaaaaagctagagagagagagagacagagatgcatggtgcatggcatgatgatggcgtggttgatctattcgatccagtacttctgtgatcattcgagtcaagaagccatcatcagatcggtgcagttctccctcctccttccagctcctcctcagcttctttgtaacactgcgcccgccatggctttggggaatcaagcgtcttggtccgaaatccttctttcctagctaggaactacgtacttgtacgtgcaagagtatgtatgttatccctgcatgttcttattctgtctctatatatggtttatgcagacagagcaagattcgttcgtcttgattgatttgtttccatcactctttgattcagagtttgattcatgtaatattttgttagttatgtggatttcttctttgagctttttct

SEQ ID NO: 2201 - protein, 60 aa, Zea mays
  misc_feature: Utility: Useful for making plants with altered leaf shape eg curled leaves
MCLHHTTPCDARSLFCLSSPYFQDAIMLPQTPRALGHHDCLTASQESPPPTSKRKRPEKL

SEQ ID NO: 2202 - protein, 58 aa, Triticum aestivum
  misc_feature (1)..(58): Ceres CLONE ID no. 908026
  misc_feature: Utility: Useful for making plants with altered leaf shape eg curled leaves
LHHSTPCDARSASLSSSSPNFQEAIMLPGAPWALRHHHHHLLLFPPAPTSKKERSGEL

SEQ ID NO: 2203 - DNA, 686 bp, Glycine max
  misc_feature (1)..(686): Ceres CLONE ID no. 681088
  misc_feature (1)..(686): Also known as  Ceres CDNA ID no. 23400925
tgccactctatacactgtgaatggaccatcaacctccaccgtgccccgccgccgcctccgcaacggacaaccctcgtggcggaacgcgccaccccatgtaccgcggcgtccgcaagcgccggtggggcaaatgggtctccgaaatccgggagccacggaagaagaaccgcatatggttggggtcgtttccggtgccggagatggcggcacgagcatacgacgtcgcagcctactgcctcaaaggccggaaggcgcagctcaactttcccgacgacgtcgactccctgccgcttccgtcgtcccgcacggcaagagacattcagaccgccgcggcccaggcggcgcgtatgatgaaagcttccggcaatgatgagaaaagcggcattgcctccgacgacggcgatagcggttgcgatgatttttggggcgagattgagttgccagagctgatggacggcgagtgctactggggttgtccggccggcgcttcctcctggacttcctccggcgatctcgccgagtggccggaggaggagctttcgccgcagcaaccgtcgtttatggcatgtctataatctactgtatctctgtattaatgctgcatgttcagttgttgttggtatgtttcttgtattatatatcctattcctaatgttatatcctatgtgccaactgttcctgttgtc

SEQ ID NO: 2204 - protein, 184 aa, Glycine max
  misc_feature (25)..(88): Pfam Name: AP2; Pfam Description: AP2 domain
  misc_feature: Utility: Useful for making plants with altered leaf shape eg curled leaves
  misc_feature: Utility: Useful for making plants with increased biomass and foliage
  misc_feature: Utility: Useful for making smaller plants
MDHQPPPCPAAASATDNPRGGTRHPMYRGVRKRRWGKWVSEIREPRKKNRIWLGSFPVPEMAARAYDVAAYCLKGRKAQLNFPDDVDSLPLPSSRTARDIQTAAAQAARMMKASGNDEKSGIASDDGDSGCDDFWGEIELPELMDGECYWGCPAGASSWTSSGDLAEWPEEELSPQQPSFMACL

SEQ ID NO: 2205 - protein, 192 aa, Glycine max
  misc_feature (1)..(192): Public GI no. 18378818
  misc_feature: Utility: Useful for making plants with altered leaf shape eg curled leaves
  misc_feature: Utility: Useful for making plants with increased biomass and foliage
  misc_feature: Utility: Useful for making smaller plants
MSPQRMKLSSPPVTNNEPTATASAVKSCGGGGKETSSSTTRHPVYHGVRKRRWGKWVSEIREPRKKSRIWLGSFPVPEMAAKAYDVAAFCLKGRKAQLNFPEEIEDLPRPSTCTPRDIQVAAAKAANAVKIIKMGDDDVAGIDDGDDFWEGIELPELMMSGGGWSPEPFVAGDDATWLVDGDLYQYQFMACL

SEQ ID NO: 2206 - protein, 187 aa, Glycine max
  misc_feature (1)..(187): Public GI no. 25406719
  misc_feature: Utility: Useful for making plants with altered leaf shape eg curled leaves
  misc_feature: Utility: Useful for making plants with increased biomass and foliage
  misc_feature: Utility: Useful for making smaller plants
MKLSSPPVTNNEPTATASAVKSCGGGGKETSSSTTRHPVYHGVRKRRWGKWVSEIREPRKKSRIWLGSFPVPEMAAKAYDVAAFCLKGRKAQLNFPEEIEDLPRPSTCTPRDIQVAAAKAANAVKIIKMGDDDVAGIDDGDDFWEGIELPELMMSGGGWSPEPFVAGDDATWLVDGDLYQYQFMACL

SEQ ID NO: 2207 - protein, 192 aa, Arabidopsis thaliana
  misc_feature (1)..(192): Ceres CLONE ID no. 25524
  misc_feature: Utility: Useful for making plants with altered leaf shape eg curled leaves
  misc_feature: Utility: Useful for making plants with increased biomass and foliage
  misc_feature: Utility: Useful for making smaller plants
MSPQRMKLSPPPVTNNEPTATASAVKSCGGGGKETSSSTTRHPVYHGVRKRRWGKWVSEIREPRKKSRIWLGSFPVPEMAAKAYDVAAFCLKGRKAQLNFPEEIEDLPRPSTCTPRDIQVAAAKAANAVKIIKMGDDDVAGIDDGDDFWEGIELPELMMTGGGWSPEPFVAGDDATWLVDGDLYQYQFMACL

SEQ ID NO: 2208 - protein, 187 aa, Arabidopsis thaliana
  misc_feature (1)..(187): Public GI no. 21554403
  misc_feature: Utility: Useful for making plants with altered leaf shape eg curled leaves
  misc_feature: Utility: Useful for making plants with increased biomass and foliage
  misc_feature: Utility: Useful for making smaller plants
MKLSPPPVTNNEPTATASAVKSCGGGGKETSSSTTRHPVYHGVRKRRWGKWVSEIREPRKKSRIWLGSFPVPEMAAKAYDVAAFCLKGRKAQLNFPEEIEDLPRPSTCTPRDIQVAAAKAANAVKIIKMGDDDVAGIDDGDDFWEGIELPELMMTGGGWSPEPFVAGDDATWLVDGDLYQYQFMACL

SEQ ID NO: 2209 - protein, 185 aa, Brassica napus; identical to SEQ ID NO: 874
  misc_feature (1)..(185): Ceres CLONE ID no. 973892
  misc_feature: Utility: Useful for making plants with altered leaf shape eg curled leaves
  misc_feature: Utility: Useful for making plants with increased biomass and foliage
  misc_feature: Utility: Useful for making smaller plants

SEQ ID NO: 2210 - DNA, 974 bp, Glycine max
  misc_feature (1)..(974): Ceres CLONE ID no. 681222
  misc_feature (1)..(974): Also known as  Ceres CDNA ID no. 25087671
agatttctcattcgtcatggaacagattcactctctctctctttagagatttgattgacaaacacaactaattccaaagctaacaactttatagagagagagagagagagagagagagatggagggtgaaggaagaagaagagaaggaggagagagagaaacagcaacagcagcagcaacgaggaaggtggtggagggtgctgatcagagaagatacaaaggaataaggatgaggaagtggggcaagtgggtcgctgaaattagagaacccaataagcgttcaaggatttggctcggttcctattctacccctgtcgcagccgcacgtgcctacgacaccgccgtcttttaccttcgaggaccctccgcgcgtcttaacttcccggagcttctcatcggagaaggcgccgccgccctcaccggcggctgtgacatgtcagcagcttctattaggaagaaggcctccgaggtcggtgctagagtcgatgctcttcaggcaacccttcaccaccatcaccaccatgttgtgccaccacggcagcttctctctgccagctgtggcggtgggtccggtgattttgcagtgcgggttgttgacctgaataagatgcccgaacccgagagctccgactgtgagtggaacgtgaattgaaggaaaaagaaaaaaggtgcatgttttcatattcaggtgatggtggttgttaacgtgcgccggctgaggcaaaatgatgttgttgatgaggcctgtggtggtggtggtggtggtgcggagtactgtactgtatcttttttccttcaaccttctctcttgggtagtttttttttaaaatttttagatattacaaaagaatttttggcttgtaaaaatatgttaaatgtaaattaactagtccggtagcagtttctttttaaaaaaaaaaaaaaaaaaaaaaaaaaaaaaaaaaaaaaaaaaaaaaaaaaaaaaaaaaaaaaaa

SEQ ID NO: 2211 - protein, 177 aa, Glycine max
  misc_feature (31)..(94): Pfam Name: AP2; Pfam Description: AP2 domain
  misc_feature: Utility: Useful for making plants with altered leaf shape eg curled leaves
  misc_feature: Utility: Useful for making plants with increased biomass and foliage
MEGEGRRREGGERETATAAATRKVVEGADQRRYKGIRMRKWGKWVAEIREPNKRSRIWLGSYSTPVAAARAYDTAVFYLRGPSARLNFPELLIGEGAAALTGGCDMSAASIRKKASEVGARVDALQATLHHHHHHVVPPRQLLSASCGGGSGDFAVRVVDLNKMPEPESSDCEWNVN

SEQ ID NO: 2212 - protein, 168 aa, Glycine max
  misc_feature (1)..(168): Ceres CLONE ID no. 594823
  misc_feature: Utility: Useful for making plants with altered leaf shape eg curled leaves
  misc_feature: Utility: Useful for making plants with increased biomass and foliage
MESEGRREGGERETTAATRKVEGAERRYKGIRMRKWGKWVAEIREPNKRSRIWLGSYSTPVAAARAYDTAVFYLRGPSARLNFPELLVREGPAALVAGCDMSAASIRKKATEVGARVDALQATLHHHYVPPRQLLSGGGGGSGDFPVRVVDLNKMPEPESSDCEWDVN

SEQ ID NO: 2213 - protein, 196 aa, Glycine max
  misc_feature (1)..(196): Public GI no. 56381907
  misc_feature: Utility: Useful for making plants with altered leaf shape eg curled leaves
  misc_feature: Utility: Useful for making plants with increased biomass and foliage
METATEVATVVSTPAVTVAAVATRKRDKPYKGIRMRKWGKWVAEIREPNKRSRIWLGSYSTPEAAARAYDTAVFYLRGPSARLNFPELLAGVTVTGGGGGGVNGGGDMSAAYIRRKAAEVGAQVDALEAAGAGGNRHHHHHQHQRGNHDYVDNHSDYRINDDLMECSSKEGFKRCNGSLERVDLNKLPDPETSDDD

SEQ ID NO: 2214 - protein, 196 aa, Glycine max
  misc_feature (1)..(196): Public GI no. 16323159
  misc_feature: Utility: Useful for making plants with altered leaf shape eg curled leaves
  misc_feature: Utility: Useful for making plants with increased biomass and foliage
METATEVATVVSTPAVTVAAVATRKRDKPYKGIRMRKWGKWVAEIREPNKRSRIWLGSYSTPEAAARAYDTAVFYLRSPSARLNFPELLAGVTVTGGGGGGVNGGGDMSAAYIRRKAAEVGAQVDALEAAGAGGNRHHHHHQHQRGNHDYVDNHSDYRINDDLMECSSKEGFKRCNGSLERVDLNKLPDPETSDDD

SEQ ID NO: 2215 - protein, 249 aa, Zea mays
  misc_feature (1)..(249): Ceres CLONE ID no. 298090
  misc_feature: Utility: Useful for making plants with altered leaf shape eg curled leaves
  misc_feature: Utility: Useful for making plants with increased biomass and foliage
MQGEYRSSSEESAAAAAAAAMAPLAAAAAAAVKMEAEQAAMASAAAPQLGSAHQHQHQQMQPRRQYRGVRMRKWGKWVAEIREPHKRTRIWLGSYATAVAAARAYDTAVFYLRGRSARLNFPDEIPSLAPSEGEGEGDGGEPARDPADGGGTLSAASIRKKAIEVGSRVDALQTGMMVPPPHHRERQRHHHHHHHHLPQLRMHAAAAEAAAVAEHRQEVKQSPQRPAWSGRVKNPDLNRAPSPESSDAE

SEQ ID NO: 2216 - protein, 243 aa, Triticum aestivum
  misc_feature (1)..(243): Ceres CLONE ID no. 883658
  misc_feature: Utility: Useful for making plants with altered leaf shape eg curled leaves
  misc_feature: Utility: Useful for making plants with increased biomass and foliage
MQQGEYRSSSSSEGSAGSAAAAAAAAAMAPLAAAAAAVAAKEEHNVTVAVAPPMPMAMAMPLQQQQPRKQYRGVRMRKWGKWVAEIREPHKRTRIWLGSYATPVAAARAYDTAVFYLRGRSARLNFPDEISALALSSPEAAEAGGGEEPGDGGGALSAASIRKKAIEVGSRVDALQTGMTTMVAAPAHHRERQRLHHHHHHAEPHGEELHRHVKQQRTAWNGRAKNPDLNQAPSPDTSDAEAE

SEQ ID NO: 2217 - protein, 161 aa, Parthenium argentatum
  misc_feature (1)..(161): Ceres CLONE ID no. 1605060
  misc_feature: Utility: Useful for making plants with altered leaf shape eg curled leaves
  misc_feature: Utility: Useful for making plants with increased biomass and foliage
NSSTTTIIIIIMGAQHHHNTDCSSSRKNQIHNNKPYRGIRMRKWGKWVAEIREPNKRSRIWLGSYSSPVAAARAYDTAVFYLRGPSARLNFPDLVLDDRADLCDLSAAYIRKKATEVGAKVDALQNQTGGTRHHSPESYSGRVCLNTDLNEYPIPESSDGN

SEQ ID NO: 2218 - protein, 233 aa, Parthenium argentatum
  misc_feature (1)..(233): Public GI no. 50929183
  misc_feature: Utility: Useful for making plants with altered leaf shape eg curled leaves
  misc_feature: Utility: Useful for making plants with increased biomass and foliage
MQGEYHRSSSEDSAASAAAAAAAAAAAMAPLAAAAAAVAAKEEQAAAAAVLPLQQQQPRRQYRGVRMRKWGKWVAEIREPHKRTRIWLGSYATPVAAARAYDTAVFYLRGRSARLNFPEEISSLASLSEGGGASEPREPDGGTLSAASIRKKAIEVGSRVDALQTGMMVAPTTHHRERQKHHHHHHHHHPHLQPHGEEQHHHHEQKHQRTAWSGRAKNPDLNQAPSPENSDAE

SEQ ID NO: 2219 - DNA, 798 bp, Arabidopsis thaliana
  misc_feature (1)..(798): Ceres CLONE ID no. 11975
  misc_feature (1)..(798): Also known as  Ceres CDNA ID no. 23371180
aaatgggagagaaacaggaagtgaaactattaggagtatggtacagtccatacgccataagaactaagatcgctcttcgtctcaaatcagtcgattatgattatgttgaagaagatctgtttggatccaagagtgagcttcttctcaaatcaaacccggttcacaagaaagtccctgttctcctccactacaacaaaccgattgtcgagtctcttaacatcgttgaatacattgatgagacgtggaactcatctgcgccgtccattcttccttcacatccttatgatcgtgctcttgctcgcttttggtctgacttcgttgataacaagtggtttccggcgttgagagtggcggcgatcgctaaatcggaagacgcaaaagcgaaagccatggaagaagtggaagaagggttgttgcaactcgaggatgcgtttgtttctataagtaaagggaaacccttttttggcggtgaagtaatcgggtttatggatatttgctttggaagctttgtggttctcttgaaagctagagaaaagtttaaagcagaaaagcttttagacgaatcaaaaactccttctctttgtaaatgggccgaccggttcttgtccgatgaaacggtgaagaatgtggcaccggatatcgaaaaagtagctgagtttctacaagaacttgaggttagagctcaatccgcagcttcaagatcttgagatcatcttagaaatgtattgcaatgcaattgtgttttgtgtacatgtaaaacgaaaataagttgaagttttaaagtgttgtgttcagttc

SEQ ID NO: 2220 - protein, 234 aa, Arabidopsis thaliana
  misc_feature (7)..(79): Pfam Name: GST_N; Pfam Description: Glutathione S-transferase, N-terminal domain
  misc_feature (89)..(204): Pfam Name: GST_C; Pfam Description: Glutathione S-transferase, C-terminal domain
  misc_feature: Utility: Useful for making plants with altered leaf shape eg curled leaves
  misc_feature: Utility: Useful for making smaller plants
MGEKQEVKLLGVWYSPYAIRTKIALRLKSVDYDYVEEDLFGSKSELLLKSNPVHKKVPVLLHYNKPIVESLNIVEYIDETWNSSAPSILPSHPYDRALARFWSDFVDNKWFPALRVAAIAKSEDAKAKAMEEVEEGLLQLEDAFVSISKGKPFFGGEVIGFMDICFGSFVVLLKAREKFKAEKLLDESKTPSLCKWADRFLSDETVKNVAPDIEKVAEFLQELEVRAQSAASRS

SEQ ID NO: 2221 - protein, 227 aa, Arabidopsis thaliana
  misc_feature (1)..(227): Public GI no. 11096016
  misc_feature: Utility: Useful for making plants with altered leaf shape eg curled leaves
  misc_feature: Utility: Useful for making smaller plants
MASSDVKLIGAWASPFVMRPRIALNLKSVPYEFLQETFGSKSELLLKSNPVHKKIPVLLHADKPVSESNIIVEYIDDTWSSSGPSILPSDPYDRAMARFWAAYIDEKWFVALRGFLKAGGEEEKKAVIAQLEEGNAFLEKAFIDCSKGKPFFNGDNIGYLDIALGCFLAWLRVTELAVSYKILDEAKTPSLSKWAENFCNDPAVKPVMPETAKLAEFAKKIFPKPQA

SEQ ID NO: 2222 - protein, 225 aa, Zea mays
  misc_feature (1)..(225): Ceres CLONE ID no. 1592057
  misc_feature: Utility: Useful for making plants with altered leaf shape eg curled leaves
  misc_feature: Utility: Useful for making smaller plants
MSEAAVRVIGLWPSPFVIRVLIALKLKHVEYEFVEEVVGSKSELLLASNPVHKKIPVLLHHGKPLSESLIIVQYIDEVWSSGAPAAILPADPYARAVQRFWAQYVDDKMHPAIRVLKGTYDGDKEQAAGQLSAALQLLEEAFAQLGQGKRYFGGDSVGYLDIALVSHVGWVKAVEKIAGVTLLDEAKVPNLVAWADRLCAHPAVVDAIPDADKFVEFSVTYGSFS

SEQ ID NO: 2223 - protein, 235 aa, Zea mays
  misc_feature (1)..(235): Ceres CLONE ID no. 285432
  misc_feature: Utility: Useful for making plants with altered leaf shape eg curled leaves
  misc_feature: Utility: Useful for making smaller plants
MAAGGELQLLSSWYSPYVIRAKVALGLKGLSYEFIEEDLFSKSDLLLELNPVHKKVPVLVHGGRPVCESLVIVQYVDETWAAGTGTPLLPADAHDRATARFWAAYVDDKFCKEWIKLYRSTTAEKAAEALGGVVPVVETLEQAFRECSRGKPFFGGDAVGLVDIALGSFVVWIRVVDEAAGVKLLDEAKFPALTAWAERFLAVDAVREVMPDAGRLLEHYKGFLAKRAPPSPAGY

SEQ ID NO: 2224 - protein, 234 aa, Glycine max
  misc_feature (1)..(234): Ceres CLONE ID no. 1103933
  misc_feature: Utility: Useful for making plants with altered leaf shape eg curled leaves
  misc_feature: Utility: Useful for making smaller plants
MSKSEDLKLLGGWFSPFALRVQIALNLKGLEYEVVEETLNPKSDLLLKSNPVHKKIPVFFHGDKVICESAIIVEYIDEAWTNVPSILPQNAYDRANARFWFAYIDEKWFTSLRSVLVAEDDEAKKPHFEQAEEGLERLEEVFNKYSEGKAYFGGDSIGFIDIGFGSFLSWMRVIEEMSGRKLLDEKKHPGLTQWAETFAADPAVKGILPETDKLVEFAKILQLKWTAAAAAAAK

SEQ ID NO: 2225 - protein, 235 aa, Triticum aestivum
  misc_feature (1)..(235): Ceres CLONE ID no. 1017106
  misc_feature: Utility: Useful for making plants with altered leaf shape eg curled leaves
  misc_feature: Utility: Useful for making smaller plants
  misc_feature (15)..(15): Xaa is any aa, unknown, or other
  misc_feature (46)..(46): Xaa is any aa, unknown, or other
MAGDGELKLLGVWTXPFVIRVRVVLNLKSLPYEYVEENLGSKSALXLGSNPVHQSVPVLLHGGRPVNESQVIVQYIDEVWAGAGPSVLPADPYERATARFWAAYVDDKVGSAWTGMLFSCKTEEERAEAVSRAVAALETLEGAFAECSKGKAFFGGDAIGFVDVVLGGYLGWFGAIDKIIGRRLIDPARTPLLARWEEQFRAADAAKGVVPDDADKMLEFFPPCSLGSPPKRSEL

SEQ ID NO: 2226 - protein, 232 aa, Zea mays
  misc_feature (1)..(232): Ceres CLONE ID no. 1558718
  misc_feature: Utility: Useful for making plants with altered leaf shape eg curled leaves
  misc_feature: Utility: Useful for making smaller plants
MSEAAVRVIGLWPSPFVIRVLIALKLKGVEFEFVEEVVGRKSELLLRSNPVHKKIPVLLHHGKPISESLIVVQYIDEVWSSGAPAFLPVDAHARAVQRFWAQYVDDKLPWAIRILKGTDDGGMEQAAGQLSAALQLLEEAFAQLSQGKRYFGGDSVGYLDIALVSHVGWVKAVEKIAGVTLLDKAKVPNLVAWADRLCAHPAVVDAIPDADKFVEFSVTYGSFSKPINAPAK

SEQ ID NO: 2227 - protein, 231 aa, Zea mays
  misc_feature (1)..(231): Ceres CLONE ID no. 986507
  misc_feature: Utility: Useful for making plants with altered leaf shape eg curled leaves
  misc_feature: Utility: Useful for making smaller plants
MAGGNDLKVLGVWTSPFVIRVRIVLNLKGLAYEYVEEDLGNKSALLLGSNPVHKSVPVLLHAGRAINESQVILQYIDEVWAGTGPAVLPADPYERAVARFWGAYIDDKVESAWLGMLFRCANEEERAAAVARAREALDALEGAFRDCSRGRPFFGGDDIGFVDAVLGGYLGWFGAVGRIIGSRLIDPARTPLLAAWEDRFRAADVAKGVVPDDLDKMLAFLQTLRAMNYAK

SEQ ID NO: 2228 - protein, 236 aa, Zea mays
  misc_feature (1)..(236): Ceres CLONE ID no. 1276499
  misc_feature: Utility: Useful for making plants with altered leaf shape eg curled leaves
  misc_feature: Utility: Useful for making smaller plants
MAGGGDDELKLLGAWASPFVLRVKLALSFKGLSYEDVEEDLSGGKSELLLESNPVHKKVPVLLHNGKPVCESQIIVQYIDEAFAGTGPSLLPADPHQRAVARFWGAYIDDKLLAFWLQSARAKTQEEKAEALKQALAAAENLEAAFTEISEGKPFFGGDSVGYLDVTLGALVAWVHAAEKLYGMRLFDATRTPRLSAFVERFGALGAAKAVLPDVDGLVEYAKQRQADAAAAASDS

SEQ ID NO: 2229 - protein, 235 aa, Triticum aestivum
  misc_feature (1)..(235): Ceres CLONE ID no. 772062
  misc_feature: Utility: Useful for making plants with altered leaf shape eg curled leaves
  misc_feature: Utility: Useful for making smaller plants
  misc_feature (62)..(62): Xaa is any aa, unknown, or other
  misc_feature (64)..(64): Xaa is any aa, unknown, or other
  misc_feature (114)..(114): Xaa is any aa, unknown, or other
  misc_feature (124)..(124): Xaa is any aa, unknown, or other
  misc_feature (127)..(127): Xaa is any aa, unknown, or other
  misc_feature (129)..(129): Xaa is any aa, unknown, or other
  misc_feature (150)..(150): Xaa is any aa, unknown, or other
  misc_feature (159)..(159): Xaa is any aa, unknown, or other
  misc_feature (183)..(183): Xaa is any aa, unknown, or other
  misc_feature (198)..(198): Xaa is any aa, unknown, or other
MEMPCEQPAVKLIGWLSPYVHRAEVALRLKGVPYDLLHDDMASKSDLLLAHNPVHKKVPVLXHXHRSIAESLVIVEYVDEAFPAGPPLLPSDPLARANARFWARFLDDKCWKAXWVALWAEPGXAQXAXAREAKEGLALLEAQLPEGKRXFGGDAIGLXDIAASGLARWLGVFEEMAGVRLLXEEEHPALCRWARAYXADQTAQQCLPDRDLVLAVLTPRRDMFVSTAKAMAAHK

SEQ ID NO: 2230 - protein, 239 aa, Zea mays
  misc_feature (1)..(239): Ceres CLONE ID no. 1061444
  misc_feature: Utility: Useful for making plants with altered leaf shape eg curled leaves
  misc_feature: Utility: Useful for making smaller plants
MEEELTLVGYWSSPFALRARFALNLKGLPYAYVEEVGLFDGKSPLLLASNPVHKRVPVLIHNGKPVPESQLIVQYVEEAFPASSPRFLPPDPHERAVARFWASYVDGELLSAWLPVYGGRTGEERAEAAGRVGAALETLERAFGECSKGKGFFGGDTVGLVDVVLGGFVGWLQTSEAMCGVRLLDAAATPLLAAWAERFRALDGVKEVMPDAQRLLEYNLMRRARLGLPLTQPPPPQHQ

SEQ ID NO: 2231 - protein, 237 aa, Zea mays
  misc_feature (1)..(237): Ceres CLONE ID no. 381987
  misc_feature: Utility: Useful for making plants with altered leaf shape eg curled leaves
  misc_feature: Utility: Useful for making smaller plants
MATAGGGAGHLKLLGAWPSPFVNRVRMALHLKGLEYENVEEDLTNKSDLLLASNPVHKLVPVLLHGDKPISESLVIVEYLDDAFPGAGQAVLPADPYERAVARFWAKYVDGKLHGMMVKALMGATEEERATATADALAAMDTLEGAFAECSGGKEFFAGDAPGYLDVALGGFIGWLRAWDKVGGVKLLDAGRAPRLATWAERFAALDVAKEVIPDPDHIAEFAKVLQARSAAAATSN

SEQ ID NO: 2232 - protein, 241 aa, Zea mays
  misc_feature (1)..(241): Ceres CLONE ID no. 373922
  misc_feature: Utility: Useful for making plants with altered leaf shape eg curled leaves
  misc_feature: Utility: Useful for making smaller plants
MGRDGGDGELKLLGLWASPFVARAKLALQIKGLSYEYVEEDLGNKSELLLSSNPVHKTVPVLIHNGTPVCESTVIVQYIDDAFAGTGPSLLPADPYQRALARFWAAYLEDKIVTPWRRFFMVKADEEKAEAMRQTVAAMDALEGGLKECSSGGGGQSPFFGGDSVGYVDVLLGGMVSWVKASEPLSGAKIIDAARTPLLAAWMERFCELDAAKAVLQDVHEVVEYARTVQARVAAATASNQ

SEQ ID NO: 2233 - DNA, 1192 bp, Arabidopsis thaliana
  misc_feature (1)..(1192): Ceres CLONE ID no. 14105
  misc_feature (1)..(1192): Also known as  Ceres CDNA ID no. 23377314
caacataactcttttgcttaagcctcaaaaaattgtcattaacccaatttcccagaaacttcaaaaacagttgggggaagaagaagaagatgaaacgacgaagaacccttttataaagtctcaatctcttaatccaagatctgccctttttcagattctatctcaaagctttcctcgatcttgtgatgtattgaagccggagactgagagagatgttgtgcttcaaaggctcggttaagcggaagaagcaatccggttctgttccggtttatctgaatgtctacgatctaactcctatgaatgcttatggttattggcttggacttggtgtttttcattctggtgttgaagttcatggagttgaatatgcatttggagcacatgaatcatcaagcacaggtatttttgaagtggaaccaaagaagtgtcctggtttcacgtttaggaaatcgattcttgtggggaaaaccgacttggttgcgaaagaagttcgtgtttttatggagaaattagctgaagagtatcaaggaaacaagtaccatctcatcacaaggaactgcaaccatttttgcaatgaagtttgtcttaaacttgctcagaaatcaatccctagatgggtgaatcgacttgctcgcttaggggttctctgcaactgtgtgttaccacctcgtttgaacgaggcaaaagtgagacgagtaggaaaaggagagctttcggaaagtgagaagaagaaactaagaaaccgatcacgatcagatcctttactgtcttcttctccgtcttcatcgacacctgataatcatcgttcacacattcgagcaaaatcaagtggtaatcatccttcttcttcttcttcttcgtcttcgggttctaagaaaaatcgaagacctaaagctcaagaccagaagtcgccaagcgtaagcatcaagacttgattgttatcatcattatttgaacatttaattattgtttatgaaaaggacaaaaagtaaaaagacaagaacagaggaacatgccaagcaaagtatcaatcatacatggggcatgctcgtgctttgttctaaggttattgaaaacctttttgggtgtgtagatcatttttctttgtacaattgcttataggagagagagagaggtcatgagtatgtacaaaaagaatatgattcatatatttttctatgttttatctctc

SEQ ID NO: 2234 - protein, 240 aa, Arabidopsis thaliana
  misc_feature (17)..(140): Pfam Name: DUF862; Pfam Description: Eukaryotic protein of unknown function (DUF862)
  misc_feature: Utility: Useful for making plants with altered leaf shape eg curled leaves
MLCFKGSVKRKKQSGSVPVYLNVYDLTPMNAYGYWLGLGVFHSGVEVHGVEYAFGAHESSSTGIFEVEPKKCPGFTFRKSILVGKTDLVAKEVRVFMEKLAEEYQGNKYHLITRNCNHFCNEVCLKLAQKSIPRWVNRLARLGVLCNCVLPPRLNEAKVRRVGKGELSESEKKKLRNRSRSDPLLSSSPSSSTPDNHRSHIRAKSSGNHPSSSSSSSSGSKKNRRPKAQDQKSPSVSIKT

SEQ ID NO: 2235 - protein, 249 aa, Arabidopsis thaliana
  misc_feature (1)..(249): Public GI no. 20259079
  misc_feature: Utility: Useful for making plants with altered leaf shape eg curled leaves
MFCRNVSVRRKKNSGTVPVYLNVYDLTPMNVYGYWLGIGIYHSGLEVHGVEYGYGAHEKSSSGIFEVEPKKCPGFTFRKSILVGETEMKAKEVRSFMEKLSEEYQGNKYHLITRNCNHFCNHVSLKLTHKSIPSWVNRLARLGFLCNCVLPACLNETKVKRVGKDGKLLLEGENTKKKKRKKKIRRSRSGPLSSSSSNARLDNTPTHNRSISTGNPPLSASPSCPLRPRLPSVASGAEDQNPPSVSVKT

SEQ ID NO: 2236 - protein, 212 aa, Brassica napus
  misc_feature (1)..(212): Ceres CLONE ID no. 963952
  misc_feature: Utility: Useful for making plants with altered leaf shape eg curled leaves
MVVVNGRKKKPGLVPVYLNVYDLTPINGYAYWLGLGVYHSGVEVHGVEYGFGAHEHSTTGIFEVGPKQCPGFTFRKSILIGRTELDPQQVCAFLEKLAEGYCGNTYHLITKNCNHFCNDVCVRLTRRSIPSWVNRLARFGLFCNCVLPAELNETKVRQVRSKEEKIPEVKKLRSRSSRFPPSSSLSSSGSLNRNRRGERRRQRLPPTPPVSA

SEQ ID NO: 2237 - protein, 218 aa, Brassica napus
  misc_feature (1)..(218): Public GI no. 62319459
  misc_feature: Utility: Useful for making plants with altered leaf shape eg curled leaves
MLCRMVVVTGRKKKPGSVPVYLNVYDLTPINGYAYWLGLGIYHSGVEVHGVEYGFGAHDHSTTGIFEVEPKQCPGFTFRKSILIGRTDLDPENVRVFMEKLAEEYSGNSYHLITKNCNHFCNDVCVQLTRRSIPSWVNRLARFGLFCNCVLPAELNETKVRQVRSKEEKIPEVEKKKLRSRSSRFPPGPSLSSSGSLNRSRRGERRRQCLPPSPTVSV

SEQ ID NO: 2238 - protein, 219 aa, Glycine max
  misc_feature (1)..(219): Ceres CLONE ID no. 654289
  misc_feature: Utility: Useful for making plants with altered leaf shape eg curled leaves
MLCRKSSKNDVGSGSVPVHLNVYDLTPINGYAYWFGLGVYHSGVQVHGVEFAFGAHEYSLTGIFEGEPKRCEGFAFRKTILIGKTDMRPGEVKAVMEELAAKYRGNAYNLITKNCNHFCNDACLRLTGNPIPSWVNRLARIGFMCNCVLPVTLNSTKVRHHKMEEKQCEGEKQALATKAKKLSASNSSSSSPEGLRRGRSRNRRALPPSSPLIIGSSSS

SEQ ID NO: 2239 - protein, 217 aa, Glycine max
  misc_feature (1)..(217): Ceres CLONE ID no. 626552
  misc_feature: Utility: Useful for making plants with altered leaf shape eg curled leaves
MLCRRSSKNGVGSGSVPVHLNVYDLTPINGYAYWFGLGVYHSGVQVHDVEFAFGAHEYPSTGIFEGEPKRCEGFAFRKTILIGKTDMGPCEVRAVMEELAAEYRGNAYNLITKNCNHFCNDACLRLTGNPIPSWVNRLARIGFMCNCVLPVTLNSTKVRHHKIEDKQCEEEKQALASEPKKLNSSNSSSPKGLRRGRSRTRRALPPSSPLIIGSSSS

SEQ ID NO: 2240 - DNA, 1281 bp, Arabidopsis thaliana
  misc_feature (1)..(1281): Ceres CLONE ID no. 156807
  misc_feature (1)..(1281): Also known as  Ceres CDNA ID no. 23556939
actctctctctatctctatatatcgacacaccataaaagttgttctttctctccgtttccttagcctctgcatctgggcgattttctctttctatctccctacaccttagggagtactgatcctaaactcatcatctttctatgccttcctcttttctttcacttattttcttttctatttttctttctttcttactttgcgtaaaactagcgagtcaaaaataaagacacttgcatgatcctaatataatattatatattgtaattagagaaagagagagaagagaagaaagaaagtggcaatagattcttatggattttggtataaagaaacatgaaaaaatgggtttgaccgaagaaacgttgaggacgctttttgtatgcaaccccaaatagcagcttaaagaaagcagagaggatcttcttttatttcccctctgagcaacagaagccattattcaaagaaaggcttctttaatttactcgcagggagagggaaaagagaaaaaattgaaaaactccattttcaagtcattaaaatggcatcttcttcaacaaactcaccatgcgccgcttgcaaattcctccggcgaaaatgtcaaccggaatgtgtattcgcgccctatttcccaccggaccagccacaaaaattcgcaaacgttcacaaagtgtttggagcaagtaacgtgacaaagctcctcaacgagcttcacccttcacaacgtgaagacgcagtgaactctttggcctatgaagccgacatgcgcctccgtgaccctgtctacggctgcgttggcgtcatctctctcctccaacatcagcttcgtcagcttcagatagatctcagctgtgctaaatctgagctctctaagtaccaaagcctcggtatcctcgccgccactcatcagagtcttggcatcaacttactcgccggagcagcagatggaacagccaccgccgtgagagaccactatcaccaccaccagttttttcctagagaacaaatgtttggtggcttggatgttccggccggtaacaactacgacggtgggattcttgccattggacagatcactcagtttcagcagccgagagccgccgctggagatgatggtcgccgtactgttgatcctcttgagattttagggttttggtggtgttcatcttcgtcgatcgcttggtgatgagaaaactataattttaagaaaatatttgatgtggaaaaccaaaatattttaaacgtatggtacgtctctcttaatgacattaatttcggttttt

SEQ ID NO: 2241 - protein, 214 aa, Arabidopsis thaliana
  misc_feature (9)..(109): Pfam Name: DUF260; Pfam Description: Protein of unknown function DUF260
  misc_feature: Utility: Useful for making plants with altered leaf shape eg curled leaves
MASSSTNSPCAACKFLRRKCQPECVFAPYFPPDQPQKFANVHKVFGASNVTKLLNELHPSQREDAVNSLAYEADMRLRDPVYGCVGVISLLQHQLRQLQIDLSCAKSELSKYQSLGILAATHQSLGINLLAGAADGTATAVRDHYHHHQFFPREQMFGGLDVPAGNNYDGGILAIGQITQFQQPRAAAGDDGRRTVDPLEILGFWWCSSSSIAW

SEQ ID NO: 2242 - protein, 260 aa, Zea mays
  misc_feature (1)..(260): Ceres CLONE ID no. 281759
  misc_feature: Utility: Useful for making plants with altered leaf shape eg curled leaves
MASSVPAPSGSVITVASSSSSAAAAAVCGTGSPCAACKFLRRKCQPDCVFAPYFPPDNPQKFVHVHRVFGASNVTKLLNELHPFQREDAVNSLAYEADMRLRDPVYGCVGVISILQHNLRQLQQDLARAKYELSKYQAAAAASASTAPTGPQAMAEFIGNAMPNGAHNFINIGHSAALGSLGGSASVFGQEQFGNAQMLSRSYDGGEPIARLGINGGGYEFGYSTAMGGSGAVSGLGTLGISPFLKSGTAGGDEKPNGGQ

SEQ ID NO: 2243 - protein, 178 aa, Parthenium argentatum
  misc_feature (1)..(178): Ceres CLONE ID no. 1603612
  misc_feature: Utility: Useful for making plants with altered leaf shape eg curled leaves
  misc_feature (134)..(134): Xaa is any aa, unknown, or other
  misc_feature (135)..(135): Xaa is any aa, unknown, or other
  misc_feature (141)..(141): Xaa is any aa, unknown, or other
MPPGHSPCASCKLLRRRCAKDCIFAPYFPSNDPHKFAIVHKVFGASNVSKMLQELEVHQRGDAVSSLVYEANARMRDPVYGCVGAISYLQKEVSQLQKQLAMAQAEILCIQMQQEPLGPAPTLAASVINSLVPXXPTRTSXVTDDVIFRGSSDDVSYPCLHNTTNHHHHNDQHFNFNF

SEQ ID NO: 2244 - protein, 182 aa, Glycine max
  misc_feature (1)..(182): Ceres CLONE ID no. 592749
  misc_feature: Utility: Useful for making plants with altered leaf shape eg curled leaves
MKGYEPRSSSSCAACKFLKRRCIPNCIFAPYFRSDECKKFAKVHKVFGASNVSKILVEVPEEQREDTVNSLAYEAEARLRDPVYGCIGAIALLQRKMVELQHDLAIAKDRLARYTAAATTATATTTTSDALINGHVSLPPFPDFFTCADNFNNDNFCHTSSSQSSFTRHETVDDFIQIPYIF

SEQ ID NO: 2245 - DNA, 1218 bp, Zea mays
  misc_feature (1)..(1218): Ceres CLONE ID no. 228787
  misc_feature (1)..(1218): Also known as  Ceres CDNA ID no. 23777556
acatcctctttcagttccctctctggatctcttcctgaagagaggcactgccacaccaccacgccacccatgctcaacatgatgaccgatctgagctgcgggccgtcgtccaaggcgaaaggagggcagccggcagcgacgacgggctccggcggcgacaggcaggggaggggcaagatcgagatcaagcgcatcgagaacacgacgaaccggcaggtcaccttctgcaagcgccgcaacggcctgctcaagaaggcgtacgagctctcggtgctctgcgacgccgaggtcgcgctcgtcgtcttctccagccgcggccgcctctacgagtacgccaacaacagtgtgaagtccaccattgagaggtacaagaaggccaacagtgacacctccaactctggcacagttgcagaagtcaatgctcagcactaccagcaggagtcctccaagctgcgccaggcgatcgatagcttgcaaaacgcaaacaggaccatagtgggagattcaatccacaccatgggcctcagggagcttaagcagatggagggcaagctggagaaggccataaacaagattagagctagaaagaatgagctcttgtatgctgaagttgaatatatgcaaaaaagggagatggatctgcagactgacaacatgtacctgaggagcaagatcgccgagaataatgaaacggggcagccagcgatgaacatgattggagtgccgtcgacgagcgagtacgatcacatggccccttttgttgactcgagaaactttcttcaggtgaacatgcagcagcagcctcagcactactcccatcagctgcaaccaacgaccctccaactcggatgatgaaattaagaatcttcggccaacaatccatgcatccacgcaaggacgcagtaaatcatgtgtccaactcagataaaaatctactctagcgtttgtataattattaataatcgtgactagtaaactgttatatatatagccatatgtgtgtggcgcctacatatatgtcatgtggctgtacggcgagttttttttcacaagcgtttgcagcagcatttggtgttgctcatccatcaattaatcgcaagaaattaaacctgtcaccaccgtgtgtgcatttgtacgtgttaatgcagttgctgtatccgttaattgtaccctccatcagataaacgcgggtgcgcgtatgcatacttatttatgtgt

SEQ ID NO: 2246 - protein, 260 aa, Zea mays
  misc_feature (40)..(90): Pfam Name: SRF-TF; Pfam Description: SRF-type transcription factor (DNA- binding and dimerisation domain)
  misc_feature (105)..(204): Pfam Name: K-box; Pfam Description: K-box region
  misc_feature: Utility: Useful for making plants with altered leaf shape eg curled leaves
MLNMMTDLSCGPSSKAKGGQPAATTGSGGDRQGRGKIEIKRIENTTNRQVTFCKRRNGLLKKAYELSVLCDAEVALVVFSSRGRLYEYANNSVKSTIERYKKANSDTSNSGTVAEVNAQHYQQESSKLRQAIDSLQNANRTIVGDSIHTMGLRELKQMEGKLEKAINKIRARKNELLYAEVEYMQKREMDLQTDNMYLRSKIAENNETGQPAMNMIGVPSTSEYDHMAPFVDSRNFLQVNMQQQPQHYSHQLQPTTLQLG

SEQ ID NO: 2247 - protein, 259 aa, Zea mays
  misc_feature (1)..(259): Ceres CLONE ID no. 219824
  misc_feature: Utility: Useful for making plants with altered leaf shape eg curled leaves
MLNMMTDLSCGPSSKVKEQVAAAPTGSGDRQGQGRGKIEIKRIENTTNRQVTFCKRRNGLLKKAYELSVLCDAEVALVVFSSRGRLYEYANNSVKSTIERYKKANSDSSNSGTVAEVNAQYYQQESSKLRQMIHSLQNANTRNIVGDSIHTMGLRDLKQMEGKLEKAISKIRARKNELLYAEVDYMQKREMDLQTDNMYLTSKIAESNETGQPAMHMMGVPPPTSEYDHMAPFDSRNFLQVSMPQHYSHQLQPTTLQLG

SEQ ID NO: 2248 - protein, 259 aa, Zea mays
  misc_feature (1)..(259): Ceres CLONE ID no. 266080
  misc_feature: Utility: Useful for making plants with altered leaf shape eg curled leaves
MLNMMTDLSCGPSSKVKEQVAAAPTGSGDRQGQGRGKIEIKRIENTTNRQVTFCKRRNGLLKKAYELSVLCDAEVALVVFSSRGRLYEYANNSVKSTIERYKKANSDSSNSGTVAEVNAQYYQQESSKLRQMIHSLQNANTRNIVGDSIHTMGLRDLKQMEGKLEKAIIKIRARKNELLYAEVDYMQKREMDLQTDNMYLRSKIAESNETGQPAMHMTMGAPPTSEYDHMAPFDSRNFLQVSMPQHYSHQLQPTTLQLG

SEQ ID NO: 2249 - protein, 273 aa, Zea mays
  misc_feature (1)..(273): Public GI no. 29372746
  misc_feature: Utility: Useful for making plants with altered leaf shape eg curled leaves
FPADREALPHHHHPMLNMMTDLSCGPSSKVKEQVAAAPTGSGDRQGQGRGKIEIKRIENTTNRQVTFCKRRNGLLKKAYELSVLCDAEVALVVFSSRGRLYEYANNSVKSTIERYKKANSDSSNSGTVAEVNAQYYQQESSKLRQMIHSLQNANTRNIVGDSIHTMGLRDLKQMEGKLEKAISKIRARKNELLYAEVDYMQKREMDLQTDNMYLTSKIAESNETGQPAMHMMGVPPPTSEYDHMAPFDSRNFLQVSMPQHYSHQLQPTTLQLG

SEQ ID NO: 2250 - protein, 259 aa, Zea mays; identical to SEQ ID NO: 2248
  misc_feature (1)..(259): Public GI no. 2529340
  misc_feature: Utility: Useful for making plants with altered leaf shape eg curled leaves

SEQ ID NO: 2251 - protein, 236 aa, Zea mays
  misc_feature (1)..(236): Public GI no. 2130078
  misc_feature: Utility: Useful for making plants with altered leaf shape eg curled leaves
MGRGKIEIKRIENTTNRQVTFCKRRNGLLKKAYELSVLCDAEVALIVFSSRGRLYEYANNSVKSTVERYKKANSDTSNSGTVAEVNAQHYQQESSKLRQQISSLQNANSRTIVGDSINTMSLRDLKQVENRLEKGIAKIRARKNELLYAEVEYMQKREVELQNDNMYLRSKVVENERGQQPLNMMGAASTSEYDHMVNNPYDSRNFLQVNIMQQPQHYAHQLQPTTLQLGQQPAFN

SEQ ID NO: 2252 - protein, 247 aa, Zea mays
  misc_feature (1)..(247): Public GI no. 34903684
  misc_feature: Utility: Useful for making plants with altered leaf shape eg curled leaves
MGRGKIEIKRIENTTNRQVTFCKRRNGLLKKAYELSVLCDAEVALIVFSSRGRLYEYANNSVKSTVERYKKANSDTSNSGTVAEVNAQHYQQESSKLRQQISSLQNANSRTIVGDSINTMSLRDLKQVENRLEKGIAKIRARKNELLYAEVEYMQKREVELQNDNMYLRSKVVENERGQQPLNMMGAASTSEYDHMVNNPYDSRNFLQVNIMQQPQHYAHQLQPTTLQLGSRPSISFGVDTVRTHVR

SEQ ID NO: 2253 - protein, 236 aa, Glycine max
  misc_feature (1)..(236): Ceres CLONE ID no. 513630
  misc_feature: Utility: Useful for making plants with altered leaf shape eg curled leaves
MSVSPQRKMGRGKIEIKRIENTTNRQVTFCKRRNGLLKKAYELSVLCDAEVALIVFSSRGRLYEYANNSVKATIERYKKASSDSSGAGSASEANAQFYQQEADKLRQQISNLQNNNRQMMGDSLGSLTAKDLKNLETKLEKGISRIRSKKNELLFAEIEYMQKREIDLHNNNQLLRAKIAESERNHHNMAVLPGGSNYDSMQSSQQQFDSRGYFQVTGLQPNNQYARQDQMSLQLV

SEQ ID NO: 2254 - protein, 230 aa, Arabidopsis thaliana; identical to SEQ ID NO: 6
  misc_feature (1)..(230): Ceres CLONE ID no. 32791
  misc_feature: Utility: Useful for making plants with altered leaf shape eg curled leaves

SEQ ID NO: 2255 - protein, 230 aa, Arabidopsis thaliana; identical to SEQ ID NO: 6
  misc_feature (1)..(230): Ceres CLONE ID no. 1010174
  misc_feature: Utility: Useful for making plants with altered leaf shape eg curled leaves

SEQ ID NO: 2256 - protein, 228 aa, Glycine max
  misc_feature (1)..(228): Ceres CLONE ID no. 1046745
  misc_feature: Utility: Useful for making plants with altered leaf shape eg curled leaves
  misc_feature (67)..(67): Xaa is any aa, unknown, or other
  misc_feature (96)..(96): Xaa is any aa, unknown, or other
MGRGKIEIKRIENTTNRQVTFCKRRNGLLKKAYELSVLCDAEVALVVFSTRGRLYEYANNSVRATIXRYKKANAAASNAESVSEANTQFYQQESSXLRRQIRDIQNLNRHILGEALGSLSLKELKNLEGRLEKGLSRVRSRKHETLFADIEFMQKREIELQNHNNFLRAKIAENERAQQRQQDMIPGTECESTIPNSQSYDRNFFPVNLIDSNNNQYSRQDQTALQLV

SEQ ID NO: 2257 - protein, 265 aa, Brassica napus
  misc_feature (1)..(265): Ceres CLONE ID no. 1251169
  misc_feature: Utility: Useful for making plants with altered leaf shape eg curled leaves
MDRGKIEIKRIENANSRQVTFSKRRAGLLKKAHELSVLCDSEVAVIVFSKSGKLFEFSSTGMKRTVLRYENYQRSSDAPLIKYKPENQEEDCTEVDFLKNEISKLQEKHLQMQGKGLNALCLKELQHLEQQLNVSLISVRERKELLLTKQIEESRIREQRAELENETLRRQVQELRNFLPSINQNYVPSYITCFAIDPKNSPVNNSGLDDTNYSLQKTNSDTTLQLGLPGEAQARRRSEANRESPSSDSVTTSTTKATPQRINLV

SEQ ID NO: 2258 - DNA, 1334 bp, Glycine max
  misc_feature (1)..(1334): Ceres CLONE ID no. 537272
  misc_feature (1)..(1334): Also known as  Ceres CDNA ID no. 23699533
atagtgagtgagagagagaaacaaaaagaaaagagagagctctttcattttcattcctttcaagggtttaacacaaacttcttattacttttgaaactatgatagggtttggagggaacagttgcagtgagctttctgagatggacatgacgaacatggaaactaataggaagtttctttctctgcctctcagtaacaacaacaactctggtgataatagaagggtacctgtcactagcaatagcatcgctcaggaacatcactacagccaccaccacaaccccaccgacacttgcagtgtgagggataaaatcatggcacatcctctttttcctcgtctcttatcctcttacctcaattgcctcaaggttggagcacctcctgaagtggtggctagcttagaggagtcatatgcaaaatatgagtccttcaatgcatcatcaggaaggataggaggtggttcaataggtgaagatccagctctggaccagttcatggaggcttactgtgagatgctcattaagtatgagcaagagcttacaaaacccttcaaagaagccatgcttttcttctcaagaattgagtgccagctcaaagccctagcagtttcatcagattttggtcaaagtgaaacatcttcaaagaatgaggttgatgttcatgaaaacaacctagattctcaagctgaagaccgggaactcaaagtccagcttttgcgcaagtatagtggatatctagggagcctcaagaaggaatttttgaagaagaaaaagaatggaaagttgccaaaggaagctcggcaacagctacttgattggtggaacaggcattataaatggccatacccttcggaatctcaaaagcaggcacttgcagaatccacaggcctagatatgaaacagatcaacaactggttcatcaatcagagaaaacgccattggaagccttctgaggatatgcaatttgccgtgatggatgcaactaactactacatggaaaatgttatgtgcaagccatttcccatggatagcatgcctatgcttctttaactcaatcctctaccactagaatatccaaaagctgagccgaaaaccctatctttttttaagttgcctaggtacccaagttgctataatgtcattgatgcatgttttactttaaaattgtagaaagcaggatgaaaattctaccttattatccctgaactgcaatctgtaactctaagtgagcgggaatctaactagctatatactctattatctacactgtttgtgcagatcactagagatgtcgtgtatgtgtagtttcctaatttaatgaatataatttgtttt

SEQ ID NO: 2259 - protein, 316 aa, Glycine max
  misc_feature (66)..(110): Pfam Name: KNOX1; Pfam Description: KNOX1 domain
  misc_feature (119)..(170): Pfam Name: KNOX2; Pfam Description: KNOX2 domain
  misc_feature (200)..(221): Pfam Name: ELK; Pfam Description: ELK domain
  misc_feature (231)..(282): Pfam Name: Homeobox; Pfam Description: Homeobox domain
  misc_feature: Utility: Useful for making plants with altered leaf shape eg curled leaves
  misc_feature: Utility: Useful for making plants with increased biomass and foliage
  misc_feature: Utility: Useful for making smaller plants
MIGFGGNSCSELSEMDMTNMETNRKFLSLPLSNNNNSGDNRRVPVTSNSIAQEHHYSHHHNPTDTCSVRDKIMAHPLFPRLLSSYLNCLKVGAPPEVVASLEESYAKYESFNASSGRIGGGSIGEDPALDQFMEAYCEMLIKYEQELTKPFKEAMLFFSRIECQLKALAVSSDFGQSETSSKNEVDVHENNLDSQAEDRELKVQLLRKYSGYLGSLKKEFLKKKKNGKLPKEARQQLLDWWNRHYKWPYPSESQKQALAESTGLDMKQINNWFINQRKRHWKPSEDMQFAVMDATNYYMENVMCKPFPMDSMPMLL

SEQ ID NO: 2260 - protein, 178 aa, Glycine max
  misc_feature (1)..(178): Ceres CLONE ID no. 625922
  misc_feature: Utility: Useful for making plants with altered leaf shape eg curled leaves
  misc_feature: Utility: Useful for making plants with increased biomass and foliage
  misc_feature: Utility: Useful for making smaller plants
MLIKYEQELTKPFKEAMLFFSRIECQLKALAVSSDFGQSETSSQNEVDVHENNLDSQAEDRELKVQLLRKYSGYLGSLKKEFLKKKKNGKLPKEARQQLLDWWNRHYKWPYPSESQKQALAESTGLDLKQINNWFINQRKRHWKPSEDMQFAVMDATNYYMENVMCKPFPMDGMPMLL

SEQ ID NO: 2261 - protein, 362 aa, Glycine max
  misc_feature (1)..(362): Public GI no. 20977642
  misc_feature: Utility: Useful for making plants with altered leaf shape eg curled leaves
  misc_feature: Utility: Useful for making plants with increased biomass and foliage
  misc_feature: Utility: Useful for making smaller plants
MESDGDGGGTSSCLMSFGDTTNNINNNSSNNNNSNNNIGSLCLPPNPPGAYNTTTNNNNLIFSDHHPSAMMLEDNNININDGVGLAFMNPSSSVKAKIMSHPHYPRLLSAYLNCQKIGAPPEVVERLEEACRASVVAAMSSCSGGAGTSDGSGGGMNMIIGQDPALDQFMEAYCEMLIKYEQELSKPFKEAMLFLSRIESQFKAISISTSDSAGGEGGMDKNGSSEEEVDVNNNLIDPQAEDRELKGQLLRKYSGYLGSLKQEFMKKRKKGKLPKEARQQLLDWWTRHYKWPYPSEAQKLALAESTGLDQKQINNWFINQRKRHWKPSEDMQFVVMDAAHPHYFMENMNILGNPYPMDVSLL

SEQ ID NO: 2262 - protein, 286 aa, Arabidopsis thaliana; identical to SEQ ID NO: 115
  misc_feature (1)..(286): Ceres CLONE ID no. 3000
  misc_feature: Utility: Useful for making plants with altered leaf shape eg curled leaves
  misc_feature: Utility: Useful for making plants with increased biomass and foliage
  misc_feature: Utility: Useful for making smaller plants

SEQ ID NO: 2263 - protein, 373 aa, Arabidopsis thaliana
  misc_feature (1)..(373): Public GI no. 55276120
  misc_feature: Utility: Useful for making plants with altered leaf shape eg curled leaves
  misc_feature: Utility: Useful for making plants with increased biomass and foliage
  misc_feature: Utility: Useful for making smaller plants
MEGGGGDGGSSTTSCMMAFGDNSNGLCPMMMMTPLMSSSSSAHHQHPHHHHRANEGDSSISNTLFLPLPPTNNQGHNRIHSNASGSSSMIIDDHNRNHNNNTVTATGCYFMDNNDGSSSSVKAKIMAHPHYHRLLAAYANCQKVGAPPEVVARLEEACASAASIAPANTGCIGEDPALDQFMEAYCEMLTKYEQELSKPLKEAMLFLQRVECQFKALTLSSPISGCGDGNDRNVSSEEEVDVNNNFIDPQAEDQELKGQLLRRYSGYLGSLKQEFMKKRKKGKLPKEARQQLLDWWSRHYKWPYPSESQKLALAESTGLDQKQINNWFINQRKRHWKPSEDMQFVVMDAGHPHYYMDNVLGNPFPMDISPTLL

SEQ ID NO: 2264 - protein, 342 aa, Arabidopsis thaliana
  misc_feature (1)..(342): Public GI no. 7446291
  misc_feature: Utility: Useful for making plants with altered leaf shape eg curled leaves
  misc_feature: Utility: Useful for making plants with increased biomass and foliage
  misc_feature: Utility: Useful for making smaller plants
MGGGGSSGNTSSCLMGYGDDNNNNNSGNAALCPPPMMMPPPPINNNNGESSNNIGGNNNNNILFLPFMANNNNNPHEDANCSSSSSIKSKIMAHPHYPRLLSAYVNCQKIGAPPEVVARLEEVCATSATIGRNSGGIIGEDPALDQFMEAYCEMLTKYEQELSKPFKEAMVFLSRIECQFKALTLTSSSESVAALGEAIDRNGSSEEEVDVNNGFIDPQAEDQELKGQLLRKYSGYLGSLKQEFMKKRKKGKLPKEARQQLLDWWTRHYKWPYPSESQKLALAESTGLDQKQINNWFINQRKRHWKPSEDMQFVVMDAAHPHYYMDNVLGNPFPMDITPTLL

SEQ ID NO: 2265 - protein, 343 aa, Arabidopsis thaliana
  misc_feature (1)..(343): Public GI no. 27413549
  misc_feature: Utility: Useful for making plants with altered leaf shape eg curled leaves
  misc_feature: Utility: Useful for making plants with increased biomass and foliage
  misc_feature: Utility: Useful for making smaller plants
MEGGGSSGNTSCLMGYNGDDNNNNSGNAALCPPPMMMMMMPPPINNNNAESSNNIGGNNNNNILFLPFMDNNNNNPHEDANCSSTSIKSKIMAHPHYPRLLSAYVNCQKIGAPPEVVARLEEVCATSATIGRNSGGIIGEDPALDQFMEAYCEMLTKYEQELSKPFKEAMVFLSRIECQFKALTLTSSSESVAALGEAIDRNGNGSSEEVDVNNGFIDLQAEDQELKGQLLRKYSGYLGSLKQEFMKKRKKGKLPKEARQQLLDWWTRHYKWPYPSESQKLALAESTGLDQKQINNWFINQRKRHWKPSEDMQFVVMDAAHPHYYMDNVLGNPFPMDITPTLL

SEQ ID NO: 2266 - protein, 361 aa, Arabidopsis thaliana
  misc_feature (1)..(361): Public GI no. 54042995
  misc_feature: Utility: Useful for making plants with altered leaf shape eg curled leaves
  misc_feature: Utility: Useful for making plants with increased biomass and foliage
  misc_feature: Utility: Useful for making smaller plants
MEGGDGGSSTTSCMMAFGDNSNGLCPMMMTPLMSSSSAHHHHRANEGDSSVSNTLFLPLPPTNNQGHNRIHSNASGSSSMIIDDHNHNNTVTATGCYFMDNNDGSSSSVKAKIMAHPHYHRLLAAYANCQKVGAPPEVVARLEEACASAASMAPANTGCIGEDPALDQFMEAYCEMLTKYEQELSKPLKEAMLFLQRVECQFKALTVSSPISGCGDGNDRNVSSEEEVDVNNNFIDPQAEDQELKGQLLRRYSGYLGSLKQEFMKKRKKGKLPKEARQQLLDWWSRHYKWPYPSESQKLALAESTGLDQKQINNWFINQRKRHWKPSEDMQFVVMDAGHPHYYMDNVLGNPFPMDISPTLL

SEQ ID NO: 2267 - protein, 347 aa, Arabidopsis thaliana
  misc_feature (1)..(347): Public GI no. 22074785
  misc_feature: Utility: Useful for making plants with altered leaf shape eg curled leaves
  misc_feature: Utility: Useful for making plants with increased biomass and foliage
  misc_feature: Utility: Useful for making smaller plants
MEGGGNSSGNNTSSLMAYGDHENNNNAICPPMMMMMMPPPPLSITNTSNNGESSSNNNNNILFLPFMENNSNTIHEDGNSCSSNIKAKIMAHPHYPRLLAAYINCQKIGAPPEVVARLEEVCATSAHMGRNGGGGGGGGNNVIGEDPALDQFMEAYCEMLTKYEQELSKPFKEAMVFLSRIECQFKALTLASTSESVAAFGEAMDRNGSSEEEVDVNNSLVDPQAEDRELKGQLLRKYSGYLGSLKQEFMKKRKKGKLPKEARQQLLDWWTRHYKWPYPSESQKLALAESTGLDQKQINNWFINQRKRHWKPSEDMQFVVMDAAHPHYYIDNVLGNPFPMDMTPTLL

SEQ ID NO: 2268 - protein, 355 aa, Arabidopsis thaliana
  misc_feature (1)..(355): Public GI no. 6016221
  misc_feature: Utility: Useful for making plants with altered leaf shape eg curled leaves
  misc_feature: Utility: Useful for making plants with increased biomass and foliage
  misc_feature: Utility: Useful for making smaller plants
MEGGSSGNTSTSCLMMMGYGDHENNNNNNGNGNGNGNGNVTICAPPMMMMMPPPPPSLTNNNNAETSNNNILFLPFMDNNNNNNPQEDNNSSSSSIKSKIMAHPHYHRLLTAYLNCQKIGAPPEVVARLEEICATSATMGRSSSSSGGGIIGEDPALDQFMEAYCEMLTKYEQELSKPFKEAMVFLSRIECQFKALTLAPNSSHESALGEAMDRNGSSDEEVDVNNSFIDPQAEDRELKGQLLRKYSGYLGSLKQEFMKKRKKGKLPKEARQQLVDWWLRHIKWPYPSESQKLALAESTGLDQKQINNWFINQRKRHWKPSEDMQFVVMDAAHPHYYMDNVLANHFPMDMTPSLL

SEQ ID NO: 2269 - protein, 194 aa, Triticum aestivum; identical to SEQ ID NO: 119
  misc_feature (1)..(194): Ceres CLONE ID no. 1250120
  misc_feature: Utility: Useful for making plants with altered leaf shape eg curled leaves
  misc_feature: Utility: Useful for making plants with increased biomass and foliage
  misc_feature: Utility: Useful for making smaller plants

SEQ ID NO: 2270 - protein, 351 aa, Triticum aestivum
  misc_feature (1)..(351): Public GI no. 18389212
  misc_feature: Utility: Useful for making plants with altered leaf shape eg curled leaves
  misc_feature: Utility: Useful for making plants with increased biomass and foliage
  misc_feature: Utility: Useful for making smaller plants
MEGGGGSSSNSCMIGFGENTSSNNGFCPMTMMMMPPPSMASSHPNGNTLFFPLPSTNNSHQGLNHRTSASTMLEDQHNNNTITSTGYYFMDGNDNDSVKAKIMAHPYYHKLLAAYINCQKIGAPPEVAVKLEEACASAATMGRNSVSRIGEDPALDQFMEAYCEMLSKYEQELSKPFREAMLFLSRIECQFKALTLSSSDSACGEAMDRHGSSEEEIDVDNSLIDPQAEDRELKGQLLRKYSGYLGSLKQEFMKKRKKGKLPKEARQQLLDWWSRHYKWPYPSESQKLALAEQTGLDQKQINNWFINQRKRHWKPSEDMQFVVMDAAHPGHYYMDNVLGNPFAMDILPTLL

SEQ ID NO: 2271 - protein, 193 aa, Zea mays
  misc_feature (1)..(193): Ceres CLONE ID no. 239250
  misc_feature: Utility: Useful for making plants with altered leaf shape eg curled leaves
  misc_feature: Utility: Useful for making plants with increased biomass and foliage
  misc_feature: Utility: Useful for making smaller plants
MEAYHEMLVKFREELTRPLQEAMEFMRRVESQLNSLSISGRSLRNILSSGSSEEDQEGSGGETELPEVDAHGVDQELKHHLLKKYSGYLSSLKQELSKKKKKGKLPKEARQQLLSWWDQHYKWPYPSETQKVALAESTGLDLKQINNWFINQRKRHWKPSEEMHHLMMDGYHTTNAFYMDGHFINDGGLYRLG

SEQ ID NO: 2272 - protein, 354 aa, Zea mays
  misc_feature (1)..(354): Public GI no. 4098240
  misc_feature: Utility: Useful for making plants with altered leaf shape eg curled leaves
  misc_feature: Utility: Useful for making plants with increased biomass and foliage
  misc_feature: Utility: Useful for making smaller plants
MEGGSSGNTSTSCLMMMGYGDHENNNNNNGNGNGNGNGNVTICAPPMMMMMPPPPPSLTNNNNAETSSNNILFLPFMDNNNNNPQEDNNSSSSSIKSKIMLNPHYHRLLTAYLNCQKIGAPPEVVARLEEICATSATMGRSSSSSGGGIIGEDPALDQFMEAYCEMLTKYEQELSKPFKEAMVFLSRIECQFKALTLAPNSSHESALGEAMDRNGSSDEEVDVNNSFIDPQAEDRELKGQLLRKYSGYLGSLKQEFMKKRKKGKLPKEARQQLVDWWLRHIKWPYPSESQKLALAESTGLDQKQINNWFINQRKRHWKPSEDMQFVVMDAAHPHYYMDNVLANHFPMDMTPSLL

SEQ ID NO: 2273 - protein, 358 aa, Zea mays
  misc_feature (1)..(358): Public GI no. 57116572
  misc_feature: Utility: Useful for making plants with altered leaf shape eg curled leaves
  misc_feature: Utility: Useful for making plants with increased biomass and foliage
  misc_feature: Utility: Useful for making smaller plants
MEGSAGNMNMTSSFKGANSYLGFGDNVNGFCPMMMMMPANNPNGDCSQPIFQPLPAANQQGINRNSSSAAACGGSMMPEHQSNTSTGYYFMEGDGDAGGGSVKSKIMAHPHYPRLLAAYVNCQKIGAPPEVVAKLEEACASTITIGGRNERSCVGEDPALDQFMEAYCEMLTKYEQELSKPFKEAMLFLSRIECQFKALTLSHSSDSGACGEAVLERNGSSEEEFDVNNSFIDPQAEDRELKGQLLRRYSGYLGNLKQEFMKKRKKGKLPKEARQQLLDWWSRHYKWPYPSESQKLALAESTGLDQKQINNWFINQRKRHWKPSEDMQFVVMDATHPHYYMDNFMGTPFPMDISPSFL

SEQ ID NO: 2274 - protein, 356 aa, Zea mays
  misc_feature (1)..(356): Public GI no. 57116570
  misc_feature: Utility: Useful for making plants with altered leaf shape eg curled leaves
  misc_feature: Utility: Useful for making plants with increased biomass and foliage
  misc_feature: Utility: Useful for making smaller plants
GSAGNVNMTSSFKGANSYMGFGDNVNGLCPMMMMMPANDPNGDCSQPLFLPLPAANQQGINRNSSSAAACGGSMMPEHQSNTSTGYYFMEGDGVAGGGSVKSKIMAHPHYPRLLAAYVNCQKIGAPPEVVAKLEEACASTITIGGRNERSCVGEDPALDQFMEAYCEMLTKYEQELSKPFKEAMLFLSRIECQFKALTLSHSSDSGACGEAVMERNGSSEEEFDVNNSFIDPQAEDRELKGQLLRRYSGYLGNLKQEFMKKRKKGKLPKEARQQLLDWWSRHYKWPYPSESQKLALAESTGLDQKQINNWFINQRKRHWKPSEDMQFVVMDATHPHYYMDNFIGTPFPMDISPSFL

SEQ ID NO: 2275 - DNA, 1121 bp, Glycine max
  misc_feature (1)..(1121): Ceres CLONE ID no. 608818
  misc_feature (1)..(1121): Also known as  Ceres CDNA ID no. 23705833
cttaacatttccctaaacataactcacacacccctcttctctagggtttcaatttcaccatgtttccctttctcaaattagggttccggcgagcatggccgacggtccggcgagtccaggcggcggtagccacgagagcggcgagcacagccctcgctctaacgtgcgcgagcaggacaggtacctccccatcgctaacataagccgcatcatgaagaaggcactacctgcgaacggtaaaatcgccaaggacgccaaagagaccgttcaggaatgcgtatccgagttcatcagtttcatcaccagcgaggcctctgataagtgtcagagggaaaagagaaagactattaacggtgatgatttgctctgggccatggccactcttggttttgaggattatatcgatcctcttaaaatttacctcactagatacagagagatggagggtgatacgaagggttcagccaagggcggagactcatcttctaagaaagatgttcagccaagtcctaatgctcagcttgctcatcaaggttctttctcacaaggtgttagttacacaatttctcagggtcaacatatgatggttccaatgcaaggcccggagtaggtatcaagtttattaaccctcctgttgtaacgtatgttttccacgccagttaccaagtgctcacggcatattgaatgtctttttatgttatgtgaatactgacataggagatggttcttgtgtcctttttttttaaaaaaaaaagtaaggtttgtatattatctttggagtcgaattattatttgaaagttattatattgtaaatcctaragccctgttgtctgaatccatcaggcggcttggcaaagaccgagattttaggactgattgtaagcataaacccgaatattcttttcctaatttctttgtgcaataatgtatgaaaaaggctcgagcttcttttcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaarttttttttyccccccccccc

SEQ ID NO: 2276 - protein, 171 aa, Glycine max
  misc_feature (29)..(94): Pfam Name: CBFD_NFYB_HMF; Pfam Description: Histone-like transcription factor (CBF/NF-Y) and archaeal histone
  misc_feature: Utility: Useful for making plants with altered leaf shape eg curled leaves
  misc_feature: Utility: Useful for making smaller plants
MADGPASPGGGSHESGEHSPRSNVREQDRYLPIANISRIMKKALPANGKIAKDAKETVQECVSEFISFITSEASDKCQREKRKTINGDDLLWAMATLGFEDYIDPLKIYLTRYREMEGDTKGSAKGGDSSSKKDVQPSPNAQLAHQGSFSQGVSYTISQGQHMMVPMQGPE

SEQ ID NO: 2277 - protein, 178 aa, Glycine max
  misc_feature (1)..(178): Public GI no. 4371295
  misc_feature: Utility: Useful for making plants with altered leaf shape eg curled leaves
  misc_feature: Utility: Useful for making smaller plants
MAESQAKSPGGCGSHESGGDQSPRSLHVREQDRFLPIANISRIMKRGLPANGKIAKDAKEIVQECVSEFISFVTSEASDKCQREKRKTINGDDLLWAMATLGFEDYMEPLKVYLMRYREGDTKGSAKGGDPNAKKDGQSSQNGQFSQLAHQGPYGNSQVTFPLFSSHSSNTHHSLLIC

SEQ ID NO: 2278 - protein, 180 aa, Zea mays
  misc_feature (1)..(180): Ceres CLONE ID no. 1561235
  misc_feature: Utility: Useful for making plants with altered leaf shape eg curled leaves
  misc_feature: Utility: Useful for making smaller plants
MADAPASPGGGGGSHESGSPRGGGGGGGGSVREQDRFLPIANISRIMKKAIPANGKIAKDAKETVQECVSEFISFITSEASDKCQREKRKTINGDDLLWAMATLGFEDYIEPLKVYLQKYREMEGDSKLTAKSSDGSIKKDALGHVGASSSAAQGMGQQGAYNQGMGYMQPQYHNGDIKK

SEQ ID NO: 2279 - protein, 173 aa, Zea mays
  misc_feature (1)..(173): Public GI no. 20147111
  misc_feature: Utility: Useful for making plants with altered leaf shape eg curled leaves
  misc_feature: Utility: Useful for making smaller plants
MAESQAKSPGGCGSHESGGDQSPRSLHVREQDRFLPIANISRIMKRGLPANGKIAKDAKEIVQECVSEFISFVTSEASDKCQREKRKTINGDDLLWAMATLGFEDYMEPLKVYLMRYREMEGDTKGSAKGGDPNAKKDGQSSQNGQFSQLAHQGPYGNSQAQQHMMVPMPGTD

SEQ ID NO: 2280 - protein, 167 aa, Zea mays
  misc_feature (1)..(167): Public GI no. 30409461
  misc_feature: Utility: Useful for making plants with altered leaf shape eg curled leaves
  misc_feature: Utility: Useful for making smaller plants
GRWSATRPGGGGGGGGGVREQDRFLPIANISRIMKKAIPANGKIAKDAKETVQECVSEFISFITSEASDKCQREKRKTINGDDLLWAMATLGFEDYIEPLKVYLQKYREMEGDSKLTAKAGDGSVKKDVLGSHGGSSSSAQGMGQQAAYNQGMGYMQPQYHNGDVSN

SEQ ID NO: 2281 - protein, 174 aa, Zea mays
  misc_feature (1)..(174): Ceres CLONE ID no. 1559765
  misc_feature: Utility: Useful for making plants with altered leaf shape eg curled leaves
  misc_feature: Utility: Useful for making smaller plants
MAEAPASPGGGGGSHESGSPRGGGGGGSVREQDRFLPIANISRIMKKAIPANGKIAKDAKETVQECVSEFISFITSEASDKCQREKRKTINGDDLLWAMATLGFEDYIEPLKVYLQKYREMEGDSKLTAKSSDGSIKKDALGHVGASSSAAQGGAYNQGMGYMQPQYHNGDISN

SEQ ID NO: 2282 - protein, 164 aa, Zea mays
  misc_feature (1)..(164): Ceres CLONE ID no. 455104
  misc_feature: Utility: Useful for making plants with altered leaf shape eg curled leaves
  misc_feature: Utility: Useful for making smaller plants
  misc_feature (13)..(13): Xaa is any aa, unknown, or other
MADDGGSHEGSGXGGGVREQDRFLPIANISRIMKKAVPANGKIAKDAKETLQECVSEFISFVTSEASDKCQKEKRKTINGDDLLWAMATLGFEEYVEPLKIYLQKYKEMEGDSKLSTKAGEGSVKKDAISPHGGTSSSSNQLVQHGVYNQGMGYMQPQYHNGET

SEQ ID NO: 2283 - DNA, 930 bp, Arabidopsis thaliana
  misc_feature (1)..(930): Ceres CLONE ID no. 5055
  misc_feature (1)..(930): Also known as  Ceres CDNA ID no. 23358890
atcttttgggagaggagaaagaaaaagaaaatgggaagagggagagtagaattgaagaggatagagaacaagatcaataggcaagtgacgtttgcaaagagaaggaatggtcttttgaagaaagcatacgagctttcagttctatgtgatgcagaagttgctctcatcatcttctcaaatagaggaaagctgtacgagttttgcagtagttcgagcatgcttcggacactggagaggtaccaaaagtgtaactatggagcaccagaacccaatgtgccttcaagagaggccttagcagaacttagtagccagcaggagtatctcaagcttaaggagcgttatgacgccttacagagaacccaaaggaatctgttgggagaagatcttggacctctaagtacaaaggagcttgagtcacttgagagacagcttgattcttccttgaagcagatcagagctctcaggacacagtttatgcttgaccagctcaacgatcttcagagtaaggaacgcatgctgactgagacaaataaaactctaagactaaggttagctgatgggtatcagatgccactccagctgaaccctaaccaagaagaggttgatcactacggtcgtcatcatcatcaacaacaacaacactctcaagctttcttccagcctttggaatgtgaacccattcttcagatcgggtatcaggggcaacaagatggaatgggagcaggaccaagtgtgaataattacatgttgggttggttaccttatgacaccaactctatttgaatctttctcacttaatcaatccctctctttttttttttgacatttttaagatgatgtttctattttattacctctctcatgttttctgtcttgtgtgcatgtgtgtgtgtaatgtttatgcccttctattattcaataattttttcg

SEQ ID NO: 2284 - protein, 250 aa, Arabidopsis thaliana
  misc_feature (9)..(59): Pfam Name: SRF-TF; Pfam Description: SRF-type transcription factor (DNA- binding and dimerisation domain)
  misc_feature (75)..(176): Pfam Name: K-box; Pfam Description: K-box region
  misc_feature: Utility: Useful for making plants with altered leaf shape eg curled leaves
  misc_feature: Utility: Useful for making smaller plants
  misc_feature: Utility: Useful for making stronger plants
MGRGRVELKRIENKINRQVTFAKRRNGLLKKAYELSVLCDAEVALIIFSNRGKLYEFCSSSSMLRTLERYQKCNYGAPEPNVPSREALAELSSQQEYLKLKERYDALQRTQRNLLGEDLGPLSTKELESLERQLDSSLKQIRALRTQFMLDQLNDLQSKERMLTETNKTLRLRLADGYQMPLQLNPNQEEVDHYGRHHHQQQQHSQAFFQPLECEPILQIGYQGQQDGMGAGPSVNNYMLGWLPYDTNSI

SEQ ID NO: 2285 - protein, 254 aa, Arabidopsis thaliana
  misc_feature (1)..(254): Public GI no. 1617211
  misc_feature: Utility: Useful for making plants with altered leaf shape eg curled leaves
  misc_feature: Utility: Useful for making smaller plants
  misc_feature: Utility: Useful for making stronger plants
MGRGRVELKRIENKINRQVTFAKRRNGLLKKAYELSVLCDAEVALIIFSNRGKLYEFCSSSSMIRTLERYQKCNYGPPEPNVPSREALAVELSSQQEYLKLKERYDALQRTQRNLLGEDLGPLSTKELELLERQLDSSLKQIRALRTQFMLDQLNDLQSKERMLNETNKTLRLRLADGYQMPLQLNPNQEDHHVDYGRHDQQQQQNSHHAFFQPLECEPILQMGYQGQQDHGMEAGPSENNYMLGWLPYDTNSI

SEQ ID NO: 2286 - protein, 242 aa, Arabidopsis thaliana
  misc_feature (1)..(242): Public GI no. 20385588
  misc_feature: Utility: Useful for making plants with altered leaf shape eg curled leaves
  misc_feature: Utility: Useful for making smaller plants
  misc_feature: Utility: Useful for making stronger plants
MGRGRVELKRIENKINRQVTFAKRRNGLLKKAYELSVLCDAEVALIIFSNRGKLYEFCSSSSMLKTLERYQKCNYGAPETNVSTREALELSSQQEYLKLKARYEALQLSQRNLLGEDLGPLSTKELESLERQLDVSLKQIRSTRTQYMLDQLTDLQRKEHMLNEANKTLKQRLLEGTQVNQLQWNPNAQDVGYGRQQAQPQGDGFFHPLECEPTLQIGYQPDPITVAAAGPSVNNYMPGWLP

SEQ ID NO: 2287 - protein, 242 aa, Glycine max
  misc_feature (1)..(242): Ceres CLONE ID no. 511680
  misc_feature: Utility: Useful for making plants with altered leaf shape eg curled leaves
  misc_feature: Utility: Useful for making smaller plants
  misc_feature: Utility: Useful for making stronger plants
MGRGRVELKRIENKINRQVTFAKRRNGLLKKAYELSVLCDAEVALIIFSNRGKLYEFCSSSSMLKTLERYQKCNYGAPEANVSTREALELISQQEYLKLKARYEALQRSQRNLMGEDLGPLSSKELESLERQLDSSLKQIRSTRTQFMLDQLSDLQRKEHLLSEANRSLRQRQLEGYQINPLQLNPGVEEMGYGRHPAQTHGEALFQQMECEPTLQIGYQPDPVSVVTAGPSMSNYMAGWLP

SEQ ID NO: 2288 - protein, 253 aa, Glycine max
  misc_feature (1)..(253): Ceres CLONE ID no. 467502
  misc_feature: Utility: Useful for making plants with altered leaf shape eg curled leaves
  misc_feature: Utility: Useful for making smaller plants
  misc_feature: Utility: Useful for making stronger plants
MGRGRVELKRIENKINRQVTFAKRRNGLLKKAYELSVLCDAEVALIIFSNRGKLYEFCSSSSMLKTLERYQKCSYGAVEVSKPAKELEQSSYREYLKLKARFESLQRTQRNLLGEDLGPLNIKELEHLERQLDSSLKQVRSTKTQFMLDQLSDLQTKMLVEANRSLTVKLEEINSRNHYRQSWEAGDQSMPYGGGGPENSHSHSHSQGFFQPLECNPTLHIGPDYRYNAVASDQITATTQPQQVSGFIPGWML

SEQ ID NO: 2289 - protein, 243 aa, Zea mays
  misc_feature (1)..(243): Ceres CLONE ID no. 226181
  misc_feature: Utility: Useful for making plants with altered leaf shape eg curled leaves
  misc_feature: Utility: Useful for making smaller plants
  misc_feature: Utility: Useful for making stronger plants
MGRGRVELKRIENKINRQVTFAKRRNGLLKKAYELSVLCDAEVALIIFSNRGKLYEFCSGQSITKTLERYEKNSYGGPDTAVQNKENELVQSSRNEYLKLKARVDNLQRTQRNLLGEDLGSLGVKELEQLEKQLDSSLRHIRSTRTQHMLDQLTDLQRREQMLCEANKCLRRKLEETSNQVHGQVWEHGANLLGYERHSPQQQAPSHVGNGLFFHPLEAAAEPTLQIGFAPEHMNNFMPTWLP

SEQ ID NO: 2290 - protein, 240 aa, Zea mays
  misc_feature (1)..(240): Ceres CLONE ID no. 227805
  misc_feature: Utility: Useful for making plants with altered leaf shape eg curled leaves
  misc_feature: Utility: Useful for making smaller plants
  misc_feature: Utility: Useful for making stronger plants
  misc_feature (193)..(193): Xaa is any aa, unknown, or other
MGRGRVELKRIENKINRQVTFAKRRNGLLKKAYELSVLCDAEVALIIFSNRGKLYEFSSTQSMPKTLEKYQKCSFAGPETALQNRENEQLKSSRNEYLKLKARVDNLQRTQRNLLGEDLESLGIKELEHLEKQLDSSLKHIRSTRTQHMVDQLTELQKKEQMFCEANKCLRRRLEESNQVIWQHAWEQSERHXEVQPQQLNGNNFFHPLDGAGEPTLQIGYPSEALTSSCMTTFLPPWLP

SEQ ID NO: 2291 - protein, 251 aa, Zea mays; identical to SEQ ID NO: 1678
  misc_feature (1)..(251): Ceres CLONE ID no. 246416
  misc_feature: Utility: Useful for making plants with altered leaf shape eg curled leaves
  misc_feature: Utility: Useful for making smaller plants
  misc_feature: Utility: Useful for making stronger plants

SEQ ID NO: 2292 - protein, 244 aa, Triticum aestivum; identical to SEQ ID NO: 1690
  misc_feature (1)..(244): Ceres CLONE ID no. 1314092
  misc_feature: Utility: Useful for making plants with altered leaf shape eg curled leaves
  misc_feature: Utility: Useful for making smaller plants
  misc_feature: Utility: Useful for making stronger plants

SEQ ID NO: 2293 - DNA, 921 bp, Zea mays
  misc_feature (1)..(921): Ceres CLONE ID no. 331626
  misc_feature (1)..(921): Also known as  Ceres CDNA ID no. 23765288
gagcaacaagagagagaggacatagccgcacaaagggaaggagaccctcgccaacctcgaagctagtccaaactagtgggaggttgagtgcagggatcgatcgaggaagacgagacaagcttcttcttctgctgccgccgccgccagctctagctcaccacgagttactagccaatctgacaccgaccgtccatggcgcggggcaaggtgcaacttcggcgcgtcgagaacccggtgcaccggcaggtgacattctgcaagcgccgcgcggggctgctcaagaaggcccgggagctctccgtcctctgcgacgccagcgtcggcatcatcgtcttctccgcgcacggcaagctctacgacctcgccaccaccgggaccatggaggagctgatcgagaggtacaaggctgccagcgccggagaagcgacgaccgacggctgcggcaggcacaacaggatggaccccaaacatgaaaccacggtgctgcaacaggaaatcaacctgcttcagaagggactgaggtacatctacgggaacagggcgaacgagcacatgaatgttgacgaactgaacgccctagagaggtacttggagatatggatgtacaacacccgctctgcaaagatgcagataatggctcaagagatccaagcactgaaaagcaaggaaggcatgttgaaagctgccaacgagattctccaggaaaagatagtagagcagagtagtttgcttgacgtaggcatggtggtagcggaccagcagaatgggcgttttagcacagtcccactggtagaagaggtgatcagtagtaacccactgactatactgagtggctattctagctgtaggggttcagagatgggctactccttctgttgattactactagtgtgtaatacatacagtcaataatgtctgtgt

SEQ ID NO: 2294 - protein, 228 aa, Zea mays
  misc_feature (81)..(175): Pfam Name: K-box; Pfam Description: K-box region
  misc_feature (9)..(59): Pfam Name: SRF-TF; Pfam Description: SRF-type transcription factor (DNA- binding and dimerisation domain)
  misc_feature: Utility: Useful for making plants with altered leaf shape eg curled leaves
MARGKVQLRRVENPVHRQVTFCKRRAGLLKKARELSVLCDASVGIIVFSAHGKLYDLATTGTMEELIERYKAASAGEATTDGCGRHNRMDPKHETTVLQQEINLLQKGLRYIYGNRANEHMNVDELNALERYLEIWMYNTRSAKMQIMAQEIQALKSKEGMLKAANEILQEKIVEQSSLLDVGMVVADQQNGRFSTVPLVEEVISSNPLTILSGYSSCRGSEMGYSFC

SEQ ID NO: 2295 - protein, 222 aa, Zea mays
  misc_feature (1)..(222): Public GI no. 50940449
  misc_feature: Utility: Useful for making plants with altered leaf shape eg curled leaves
MARGKVQLRRIENPVHRQVTFCKRRAGLLKKARELSILCEADIGIIIFSAHGKLYDLATTGTMEELIERYKSASGEQANACGDQRMDPKQEAMVLKQEINLLQKGLRYIYGNRANEHMTVEELNALERYLEIWMYNIRSAKMQIMIQEIQALKSKEGMLKAANEILQEKIVEQNGLIDVGMMVADQQNGHFSTVPLLEEITNPLTILSGYSTCRGSEMGYSF

SEQ ID NO: 2296 - protein, 224 aa, Zea mays
  misc_feature (1)..(224): Public GI no. 21586457
  misc_feature: Utility: Useful for making plants with altered leaf shape eg curled leaves
MARGKVQLRRIENPVHRQVTFCKRRAGLLKKARELSILCEADIGIIIFSAHGKLYDLATTGTMEELIERYKSASGEQANACGDQRMDPKQEAMVLKQEINLLQKGLRYIYGNRANEHMTVEELNALERYLEIWMYNIRSAKMQIMIQEIQALKSKEGMLKAANEILQEKIVEQNGLIDVGMMVADQQNGHFSTVPLLEEITNPLTILSGYSTCRGSENGLFLLT

SEQ ID NO: 2297 - protein, 213 aa, Zea mays
  misc_feature (1)..(213): Public GI no. 5230654
  misc_feature: Utility: Useful for making plants with altered leaf shape eg curled leaves
ENSTNRQVTFCKRRAGLLKKARELSILCEADIGIIIFSAHGKLYDLATTGTMEELIERYKSASGEQANACGDQRMDPKQEAMVLKQEINLLQKGLRYIYGNRANEHMTVEELNALERYLEIWMYNIRSAKMQIMIQEIQALKSKEGMLKAANEILQEKIVEQNGLIDVGMMVADQQNGHFSTVPLLEEITNPLTILSGYSTCRGSENGLFLLT

SEQ ID NO: 2298 - protein, 201 aa, Zea mays
  misc_feature (1)..(201): Public GI no. 24967140
  misc_feature: Utility: Useful for making plants with altered leaf shape eg curled leaves
MARGKVQMKRIENPVHRQVTFCKRRAGLLKKAKELSVLCDAEVGLFIFSAHGKLYELATKGSMQGLIERYIKSTKGVEVAEEAKDTQPLDPKEEINMLKNEIDVLQKGLSYMYGGGAGTMTLDELHSLEKYLEIWMYHIRSAKMDIMFQEIQLLKNKGGILEAANKYLQDKIDEQYTVTNMTQNLTDFQCPLTVQNEIFQF

SEQ ID NO: 2299 - protein, 204 aa, Zea mays
  misc_feature (1)..(204): Public GI no. 16549066
  misc_feature: Utility: Useful for making plants with altered leaf shape eg curled leaves
  misc_feature (34)..(34): Xaa is any aa, unknown, or other
  misc_feature (35)..(35): Xaa is any aa, unknown, or other
  misc_feature (85)..(85): Xaa is any aa, unknown, or other
  misc_feature (86)..(86): Xaa is any aa, unknown, or other
MARGKIQMKRIENSVHRQVTFCKRRAGLLKKARXXSVLCDVDIGLMIFSTHGKLYELATKGTMEGLIERYLGTSRGAQIEGGPAXXPPESDQEVFMLKQEIELLQKGLRNSIGGGMGNMTMDELHALERHLELWIYHIRSTKMRIMIQEIQSLKDNEGILKSANEFLQGKIEEQNVIFDMPPMIGGIPYPLTIPNEIFLEELNY

SEQ ID NO: 2300 - protein, 244 aa, Triticum aestivum; identical to SEQ ID NO: 1690
  misc_feature (1)..(244): Ceres CLONE ID no. 1314092
  misc_feature: Utility: Useful for making plants with altered leaf shape eg curled leaves

SEQ ID NO: 2301 - protein, 245 aa, Triticum aestivum
  misc_feature (1)..(245): Public GI no. 4204232
  misc_feature: Utility: Useful for making plants with altered leaf shape eg curled leaves
MGRGKVQLKRIENKINRQVTFSKRRSGLLKKAHEISVLCDAEVGLIIFSTKGKLYEFATDSCMDKILERYERYSYAEKVLISTESEIQGNWCHEYRKLKAKVETIQRCQKHLMGEDLESLNLKELQQLEQQLESSLKHIRSRKSQLMHESISELQKKERSLQEENKILQKELIEKQKAHTQQAQLEQTQPQTSSSSSSFMMGEATPATNRSNPPAAASDRAEDATGQPPARTVLPPWMVSHLNNG

SEQ ID NO: 2302 - protein, 244 aa, Triticum aestivum
  misc_feature (1)..(244): Public GI no. 39843112
  misc_feature: Utility: Useful for making plants with altered leaf shape eg curled leaves
MGRGKVQLKRIENKINRQVTFSKRRSGLLKKAHEISVLCDAEVGLIIFSTKGKLYEYATDSCMDKILERYERYSYAEKVLISAESETQGNWCHEYRKLKAKVETIQKCQKHLMGEDPESLNLKELQQLEQQLESSVKHIRSRKSQLMLESISELQKKEKSLQEENKVLQKELVEKQQVHKRLVQWDQTQPQTSSSSSSFMMREALPTTNISIYAAAAGERAEDAAGQPQIHIGLPPWMVSHING

SEQ ID NO: 2303 - protein, 244 aa, Triticum aestivum; identical to SEQ ID NO: 1691
  misc_feature (1)..(244): Public GI no. 39843110
  misc_feature: Utility: Useful for making plants with altered leaf shape eg curled leaves

SEQ ID NO: 2304 - protein, 250 aa, Triticum aestivum; identical to SEQ ID NO: 1683
  misc_feature (1)..(250): Public GI no. 33309864
  misc_feature: Utility: Useful for making plants with altered leaf shape eg curled leaves

SEQ ID NO: 2305 - protein, 246 aa, Triticum aestivum
  misc_feature (1)..(246): Public GI no. 7592642
  misc_feature: Utility: Useful for making plants with altered leaf shape eg curled leaves
MGRGKVQLKRIENKINRQVTFSKRRSGLLKKANEISVLCDAEVALIIFSTKGKLYEYATDSCMDKILERYERYSYAEKVLISAESDTQGNWCHEYRKLKAKVETIQKCQKHLMGEDLESLNLKELQQLEQQLENSLKHIRSRKSQLMLESINELQRKEKSLQEENKVLQKELVEKQKVQKQQLQWDQTQPQTISSSSSFMMREALPTTNISNYPAAAGERIEDVPAGQPQHVRIGLPPWMLSHING

SEQ ID NO: 2306 - protein, 246 aa, Triticum aestivum
  misc_feature (1)..(246): Public GI no. 6606070
  misc_feature: Utility: Useful for making plants with altered leaf shape eg curled leaves
MGRGKVQLKRIENKINRQVTFSKRRSKLLKKANEISVLCDAEVALIIFSTKGKLYEYATDSCMDKILERYERYSYAEKVLISAESDTQGNWCHEYRKLKAKVETIQKCQKHLMGEDLESLNLKELQQLEQQLENSLKHIRSRKSQLMLESINELQRKEKSLQEENKVLQKELVEKQKVQKQQVQWDQTQPQTSSSSSSFMMREALPTTNISNYPAAAGERIEDVAAGQPQHERIGLPPWMLSHING

SEQ ID NO: 2307 - DNA, 1755 bp, Arabidopsis thaliana
  misc_feature (1)..(1755): Ceres CLONE ID no. 35742
  misc_feature (1)..(1755): Also known as  Ceres CDNA ID no. 23449074
cgaagaaaagcgacgccgttttaaaggagatggataaacaaccggcgaccagttggagtatccatacccggccggagataatcgccaagtacgagatcttcgagcgagtcggatccggagcttacgccgacgtttacagagctcgccgtctctccgacggtctaatcgtcgcgctcaaggagattttcgattaccaatctgcgttccgggagattgacgcgctcaccatcctcaatggatctcctaatgtagttgttatgcacgaatacttctggcgtgaggaagagaacgctgtgcttgtgcttgagtttcttaggtcggatctcgctgcggtgatccgagatggtaagaggaagaagaaggtagaaggaggggatggattctcggttggggagattaagagatggatgattcagattttaaccggtgttgatgcttgtcatcggaatttgattgtacatagagatttgaagcctgggaatatgttgatttctgatgatggagttcttaagcttgctgattttggtcaggctaggatactcatggagcatgatattgtagcttcagatgaaaaccaacaagcttacaaactggaagacaaagatggagaaaccagcgaaccaccagaagttattcctgattatgagaactcacctaggcaagggtctgatggtcaggaacgggaagcgatgagtaaagacgagtacttccgacaggtggaagagctcaaggctaaacaggttgttagagatgatactgataaggactcgaatgtgcatgatggagacatatcttgccttgcaacgtgcactgttagtgaaatggatgatgatctcggtaggaactcgttttcttacgatgctgacgaagcagtggatgatacacagggtttgatgacatcttgtgtgggaacccgatggtttaggccaccagaactgctctatggatctacgatgtatgggttagaggtcgatctatggtcgcttggttgtgtgtttgcagaactcttgtctcttgagcctttgttcccaggaatttcagatattgatcagatcagcagagtgaccaatgtgctgggaaatttaaatgaagaggtctggcctggttgtgttgatcttccagactacaagtcaatctcatttgctaaagtagaatctcctcttggtattgaaggatgccttcccaaccattcaggggatgtgatatcgctgctcaagaagcttatctgttatgatccagctagtagagctactactatggagatgctgaatgacaaatatttaagtgaagagcctcttccagttccagtttcagagctctatgtgcctccgacaatgagtggaccagatgaggattctccgagaaagtggaatgattacagagaaatggattcagattcagattttgatggctttggacccatgaatgtaaagcctaccagtagtggatttacaatagaattcccctgaccttggcatttaaggtacgcagtcaaaagctctggctcgcttaaacacataaatcagtctcttctctctctctctttcttcttcaaagagaatgggtatataccaaaacctgacatgtgtttctttaggtcttgattgatgcaacactctttgttgtttgaagatcttgttacagaataccgcttagaaaattgttaacttttcgttaggacattgtttaggtatcaatggcggcaaaaacttttgaaattcgtttgctcattgatctcacaacttttttttgcgc

SEQ ID NO: 2308 - protein, 479 aa, Arabidopsis thaliana
  misc_feature (21)..(418): Pfam Name: Pkinase; Pfam Description: Protein kinase domain
  misc_feature (21)..(413): Pfam Name: Pkinase_Tyr; Pfam Description: Protein tyrosine kinase
  misc_feature: Utility: Useful for making plants with enhanced abiotic stress tolerance
  misc_feature: Utility: Useful for making smaller plants
MDKQPATSWSIHTRPEIIAKYEIFERVGSGAYADVYRARRLSDGLIVALKEIFDYQSAFREIDALTILNGSPNVVVMHEYFWREEENAVLVLEFLRSDLAAVIRDGKRKKKVEGGDGFSVGEIKRWMIQILTGVDACHRNLIVHRDLKPGNMLISDDGVLKLADFGQARILMEHDIVASDENQQAYKLEDKDGETSEPPEVIPDYENSPRQGSDGQEREAMSKDEYFRQVEELKAKQVVRDDTDKDSNVHDGDISCLATCTVSEMDDDLGRNSFSYDADEAVDDTQGLMTSCVGTRWFRPPELLYGSTMYGLEVDLWSLGCVFAELLSLEPLFPGISDIDQISRVTNVLGNLNEEVWPGCVDLPDYKSISFAKVESPLGIEGCLPNHSGDVISLLKKLICYDPASRATTMEMLNDKYLSEEPLPVPVSELYVPPTMSGPDEDSPRKWNDYREMDSDSDFDGFGPMNVKPTSSGFTIEFP

SEQ ID NO: 2309 - protein, 480 aa, Arabidopsis thaliana
  misc_feature (1)..(480): Public GI no. 6984233
  misc_feature: Utility: Useful for making plants with enhanced abiotic stress tolerance
  misc_feature: Utility: Useful for making smaller plants
MEQLPPSPPPHAKSWSIHTRPEIIAKYEIQERVGSGAYSDVYKARRLSDNLIVALKEIHDYQSAFREIEALHIVQNCPNIVVLHEYFWREDEDAVLVLEFLRTDLASLIKEGKKNGGIGVNAGEIKRWMMQILSGLDACHRNMVVHRDLKPSNLLISDDGVLKLADFGQARILMEPGFVATATDETMHPDEQNLAVNEQKVVTSPENIPQVNPVPIEVQSNQEQVIVKGYESFRETGESKPYDYLDETSIRDGDTSCLATGTASDMGDDFMRSTYNYETDEVDNERYGSLTSCVGTRWFRAPELLYGSTDYGLEIDLWSLGCIFAELLTLEPLFPGTSDIDQLSRIINVLGNLTEQVWPGCLKLPDYGTISFNKVENPTGIESYLTNHSPEEIALVKKLVCYDPAARATAMELLRDEYFSKEPFPVPKFELGGPLLNSGQDEDFPGRYDDYFERDFDSDFDNFAPVKIRSTRTGFSKQFS

SEQ ID NO: 2310 - protein, 481 aa, Zea mays
  misc_feature (1)..(481): Ceres CLONE ID no. 298125
  misc_feature: Utility: Useful for making plants with enhanced abiotic stress tolerance
  misc_feature: Utility: Useful for making smaller plants
MAIVGGGGSWSIHGRADVTSRYEVLGRAGSGSYADVYRGRRRSDGAAVALKEVHDAVSARSEVEALLAIPPSPNVVALIDHFPGGDCDDDVLVLEWLPLDLAAVVRDARRRAGGGEGGEGIPASQLKRWMLQVLEGVAACHRAGVVHRDLKPENLLISEDGVLKVADFGQARILQQSAPTFQEMYPHEQSSGMETWVPQQQPAVLQGTEEEPTSYESDATAGQEPETLTAADYLRELDQLREKSSDVDKMSFQDEHASCLATCSTGDIEDDPYPASYSDDMEGIGEDSGAFTSCVGTRWFRAPELLYGSTNYGLEIDLWSLGCILAELMKLEALFPGISDIDQISRIINVLGDITEETFPGCSNLPDYNKISFNKVEKPTGLEACLPNRSPTEVSIIKQLICYDTAKRTSAVDLLNDRYFTEEPLPAPIEGLHVPASKDEDDDSSTEEWGNYRDGVSRVDFDEFGSMDATKTEKGFSIQFS

SEQ ID NO: 2311 - protein, 479 aa, Zea mays
  misc_feature (1)..(479): Public GI no. 54291188
  misc_feature: Utility: Useful for making plants with enhanced abiotic stress tolerance
  misc_feature: Utility: Useful for making smaller plants
MAIGGGGGGGSWSIHGRPDVTSRYEVLGRAGSGAYADVYRGRRRSDGAPVALKEVHDAVSARREADALLAAAPSRHVVALLDHFPGGDHDDDVLVLEWLPLDLSAVVRAAAAARPSALPAAQRKRWMLQVLEGVAACHSAGVVHRDLKPANLLISEDGVLKVADLGQARILQETGTYQGMHPYEQSSGVEPWVSQQRAVLHGVKENHPSHDSETQTGQEPERLTAADYLHEMDQLRAKSTHGDVDKMSLQDGNASCLATCSTADIDDDPFRASYSYDAEEGMLEEESGAFTSCVGTRWFRAPELLYGSTNYGQEVDLWSLGCILAELFNLEPIFPGTSDIDQIGRIISVLGNITEETFPGCSNLPDYNKIFFNKVEKPIGLEACLPDRSASEVSIIKRLLCYDPTKRASAADLLNDPYFAEEPLPVPIEGLQVPESKDEDDDSTEEWANFRGGDSDSDFDEFGSMDVTKTDKGFSIRFS

SEQ ID NO: 2312 - DNA, 661 bp, Arabidopsis thaliana
  misc_feature (1)..(661): Ceres CLONE ID no. 22382
  misc_feature (1)..(661): Also known as  Ceres CDNA ID no. 23373746
aaaaattctctttctcactctctcactctctttctctcttccttcatatatgctttaagtttgagcgacgtttcttctcaaagatgggtttctccgacgctggaatttacctctccgacccaaacaatctctgccaaaccgaactaggtttctttcatgaaccatctctagggttttcagaccagagcgatccacaaaacgagttccacatcactcctcctatatatcaagaattacaagatcaggatcttgaacctaaatcccaagagacgaataattgctcacgcaaagaaggagcaaccgtcaagaaagaagaagaagaagaagacgattattgtaaaactccgactcgttcagaccagattctctcggcgatgccaagaatttgtccaccggcgcctaggaaacctaaaagagtcccgtcgagaagccttaaggttagaaattcatatagaagcaagagaatgatcattctaaatgtttctagagagattgattgtttgtttaatccaacatcactatgtaacaaaattaagaaagccagatacatctaatgttttgtacgtactgtatttgtataacgtagcaacctaataaccaaattgtaatacactacgactttacataatgtmstgagaaactatctatttcacttttattt

SEQ ID NO: 2313 - protein, 156 aa, Arabidopsis thaliana
  misc_feature: Utility: Useful for making plants with increased biomass and foliage
MGFSDAGIYLSDPNNLCQTELGFFHEPSLGFSDQSDPQNEFHITPPIYQELQDQDLEPKSQETNNCSRKEGATVKKEEEEEDDYCKTPTRSDQILSAMPRICPPAPRKPKRVPSRSLKVRNSYRSKRMIILNVSREIDCLFNPTSLCNKIKKARYI

SEQ ID NO: 2314 - protein, 133 aa, Brassica napus
  misc_feature (1)..(133): Ceres CLONE ID no. 1094248
  misc_feature: Utility: Useful for making plants with increased biomass and foliage
MGFSDAGICHSDQNNLGQTEIGLLRVPSIGFSDRSVQVFRPDQDLETKVRELTNCSPEGVKNEEEEELCKTPTRLDQILPNIPNICPPAPRKPKGIQSRSLKVRDSYKSRRMIILNVSREIDCMFHSASLGNK

SEQ ID NO: 2315 - DNA, 674 bp, Arabidopsis thaliana
  misc_feature (1)..(674): Ceres CLONE ID no. 119790
  misc_feature (1)..(674): Also known as  Ceres CDNA ID no. 23447644
  misc_feature (499)..(499): n is a, c, t, g, unknown, or other
  misc_feature (560)..(560): n is a, c, t, g, unknown, or other
  misc_feature (573)..(573): n is a, c, t, g, unknown, or other
  misc_feature (614)..(614): n is a, c, t, g, unknown, or other
  misc_feature (629)..(629): n is a, c, t, g, unknown, or other
  misc_feature (633)..(633): n is a, c, t, g, unknown, or other
aacataaattaagtttttttttgtccttttctgcctttacctttccttctactcccgaaaaagcactgactttgctctgtttccttcgttcacacagagaaagagagaaatcttctgagcgaaattctgacaaaagagatgatggaatgggataatcagctacaacccaataaccatcactcttctaatcttcaagggatcgacgttaatggcggctccggcgccggaggaggaatgtacgtgaaggtgatgaccgatgagcagtatgaaactctcaggaaacagattgctatttacggcaccatttgtgagcgtcttgttgagatgcataaaactctcactgctcaacaagatcttgcaggagggagaatgggaggactatatgcagaccccaatgatgtcatctttaggtcataagatgacagctagacagaggtggactcctacgccagtccagcttcagattctggaacgtatattcgatcaaggcacgggaacncccgagcaagcagaagatcaaagacataacagaagagcttgagcccacacgggcagattgnttgaacaaaatgnctataactgggttccagaacccgacgtgctcgatccaaganggaagcagcatgggngganggtctttcttggaaaaaaaataaatggggaagtctgaggta

SEQ ID NO: 2316 - protein, 133 aa, Arabidopsis thaliana
  misc_feature: Utility: Useful for making plants with increased biomass and foliage
  misc_feature (120)..(120): Xaa is any aa, unknown, or other
MMEWDNQLQPNNHHSSNLQGIDVNGGSGAGGGMYVKVMTDEQYETLRKQIAIYGTICERLVEMHKTLTAQQDLAGGRMGGLYADPMMSSLGHKMTARQRWTPTPVQLQILERIFDQGTGXPEQAEDQRHNRRA

SEQ ID NO: 2317 - protein, 268 aa, Arabidopsis thaliana
  misc_feature (1)..(268): Ceres CLONE ID no. 1350005
  misc_feature: Utility: Useful for making plants with increased biomass and foliage
MMEWDNQLQPNNHHSSNLQGIDVNGGSGAGGGMYVKVMTDEQYETLRKQIAIYGTICERLVEMHKTLTAQQDLAGGRMGGLYADPMMSSLGHKMTARQRWTPTPVQLQILERIFDQGTGTPSKQKIKDITEELSQHGQIAEQNVYNWFQNRRARSKRKQHGGGSSGNNNGESEVETEVEALNEKRVVRPESLLGLPDGNSNNNGLGTTTATTTAPRPEDLCFQSPEISSDLHLLDVLSNPRDEHLVGKMGLAESYNLYDHVEDYGMSG

SEQ ID NO: 2318 - protein, 268 aa, Arabidopsis thaliana; identical to SEQ ID NO: 2317
  misc_feature (1)..(268): Public GI no. 23308275
  misc_feature: Utility: Useful for making plants with increased biomass and foliage

SEQ ID NO: 2319 - protein, 292 aa, Zea mays
  misc_feature (1)..(292): Ceres CLONE ID no. 1379507
  misc_feature: Utility: Useful for making plants with increased biomass and foliage
FPSRALRPSSVSFIHTERETQKTKTLRKEMMEWDNQQQPSNNPSSNLQGIDVNGGSGSGGMYVKVMTDEQLETLRKQIAIYATICERLVEMHKTLTSQQDLAGRVGGLYADPTFGHKMTGGRQRWTPTPVQLQILERIFDQGIGTPSKQKIKDITEELSQHGQIAEQNVYNWFQNRRARSKRKQHGGGGGGVGSSSNNNNGESEVEAETETVNEKRKMPESLLVFPDGNKNAIGTTSATSPRPEDLYFQSPEMSSDLDLLGVLSNPRDEHFVGKMGLSESYNMYDHVEDYGM

SEQ ID NO: 2320 - protein, 261 aa, Zea mays
  misc_feature (1)..(261): Public GI no. 3955021
  misc_feature: Utility: Useful for making plants with increased biomass and foliage
KLVFYDCQSIAGRMDWDNNQENHQDSHQNQRECRNGINGTNVNVNGNGGTNMLYVKVMTDEQLETLRKQIAVYAAICEQLVEMHKTLSAQQDLAGGRLGNLYCDPLMASGGHKITARQRWTPTPVQLQILERIFDQGNGTPSKQKIKEITSELSQHGQISETNVYNWFQNRRARSKRKQLVASSNNAESEVETEVDSLNEKKKPEIFHAQQNPPRAEDLCFQSPEISSELHFLGDDHLTGKVGVPGNYNLYDQAEDYGMAG

SEQ ID NO: 2321 - protein, 257 aa, Zea mays
  misc_feature (1)..(257): Public GI no. 40233087
  misc_feature: Utility: Useful for making plants with increased biomass and foliage
CQSIAGRMDWDNNQENHQDSHQNQRECRNGINGTNVNVNVNGNGGNNTLYVKVMTDEQLETLRKQIAVYAAICEQLVEMHKTLSAQQDLAGGRLGNLYCDPLMASGGHKITARQRWTPTPVQLQILERIFDQGNGTPSKQKIKEITSELSQHGQISETNVYNWFQNRRARSKRKQLVASSNNAESEVETEVDSLNEKKKPEIFHAQQNPPRAEDLCFQGPEISSELHFLGDDHLTGKMGVPGNYNLYDQAEDYGMAG

SEQ ID NO: 2322 - protein, 262 aa, Glycine max
  misc_feature (1)..(262): Ceres CLONE ID no. 609489
  misc_feature: Utility: Useful for making plants with increased biomass and foliage
MEWQKQRWQPNGNAEMMYVKVMTDEQLETLRKQIAVYATICEQLIEMHKNISSHQDLAGIRLGNMYCDPLLGSGGHKIASRQRWTPSAMQLQILERIFDQGAGTPTKEKIKEITNELSQHGQISETNVYNWFQNRRARSKRKQQNVAPSANAESEVETEVDSKDKKTKPDEFQSPPSVSAVPADDNLGFQNHGSLQYLNPESNKPDSVFPSDASLRSTRNFNHVPVFDGLLSNSTSDYLTGKMEAPENYDLYQPAGDFNMAG

SEQ ID NO: 2323 - protein, 262 aa, Glycine max
  misc_feature (1)..(262): Ceres CLONE ID no. 561279
  misc_feature: Utility: Useful for making plants with increased biomass and foliage
MVNAMEWQKQRCWQPNRNAEMMCVKVMTDEQLEILRKQIAVYATICEQLIEMHKNISAHQDLAGIRLGNMYCDPLLGSGGLKIASRQRWTPTAMQLQILERIFDQGIGTPTKEKIKEITNELSQHGQISETNVYNWFQNRRARSKRKQQNVAPSANAESEVETEVDSKDKKTKPDEFQAPPSVSAGPADNLGFQNHDSLQYLNPESNKPDSVFPSDGTRNFHHVPAFDGLLSNSRSNYLTGKLETPENYELYQPAGDYNIAG

SEQ ID NO: 2324 - protein, 250 aa, Glycine max
  misc_feature (1)..(250): Public GI no. 34909272
  misc_feature: Utility: Useful for making plants with increased biomass and foliage
MEWDKAKASSGEAVDDRGGGEGGLGYVKVMTDEQMEVLRKQISIYATICEQLVEMHRALTAQQDSIAGMRLGNLYCDPLMVPGGHKITARQRWTPTPMQLQILENIFDQGNGTPSKQKIKDITAELSQHGQISETNVYNWFQNRRARSKRKQAALPNNNAESEAEADEESPTDKKPKSDRPLHQNIAMRDHNSERISEMHHFDTEHEQIRRMMYASNDSSSRSSGSLGQMSFYDNVMSNPSTSYKHPCFI

SEQ ID NO: 2325 - protein, 267 aa, Glycine max
  misc_feature (1)..(267): Public GI no. 56201899
  misc_feature: Utility: Useful for making plants with increased biomass and foliage
MEWDKAKASSGEAVDDRGGGEGGLGYVKVMTDEQMEVLRKQISIYATICEQLVEMHRALTAQQDSIAGMRLGNLYCDPLMVPGGHKITARQRWTPTPMQLQILENIFDQGNGTPSKQKIKDITAELSQHGQISETNVYNWFQNRRARSKRKQAALPNNNAESEAEADEESPTDKKPKSDRPLHQNIAMRDHNSERISEMHHFDTEHEQIRRMMYASNDSSSRSSGSLGQMSFYDNVMSNPRIDHFLGKVESPGSFPHMRSGESFDMY

SEQ ID NO: 2326 - DNA, 994 bp, Arabidopsis thaliana
  misc_feature (1)..(994): Ceres CLONE ID no. 34976
  misc_feature (1)..(994): Also known as  Ceres CDNA ID no. 23374632
atcgaaaatcagattttctctgcaaactctcagattcacctttcaagaaaaaaacagagagagagagagaacaaagaaggatgacgaaaattgactctctccgtcgatttcttcttccatgtatctcaactccgacgaatccaaccaccgtatcaacaacatccaccggagcttccaagaaacgtctcagtacttccctaagagacgatatcgacgttcaagattcagcttcttcctccgcctcttcctccgaggctacttccgccgtcgactacagcatatccgccgtcacggtgccgcagagaccgtcgaagacgatggtgattggtacgatattcggtagaagaaagggacacgtgtggttctgtgttcaacacgaccgtctctctgttaaaccaatccttctcctcgagctttcaatagctacgagccagttagttcacgagatgggttcgggtcttgttcgtgtcgctttagaatgcccgacccgacccgaattgaagtcttgcttgctgagatccgtacccgtttggacgatgttttgtaacggaaggaagctagggtttgctgtacggagaagtgctaatgaagagacgaggatgatgttgaagagattggagtctatgactgttggagcgggtgtgttgccatctggatccgggttgggtgggtctgatgaatcggatactgatgaggttatgtatatgagagcgaattatgagcatgttgttggtagctctgactcggagtcgtttcatctcattaaccctgatgctaactctgctcaagaactcagtatcttcttgctcaggacctctagttgaattggccttttggggtaacttatgaatcattttcatcatgttcagagattgtgaagtcacatgagaaagattgagattttgagagttcttgatgagatatttctttgtgggtcgttagttctagatctttgtaaaacattattttgttagaaagattgatgatttttttc

SEQ ID NO: 2327 - protein, 247 aa, Arabidopsis thaliana
  misc_feature (80)..(245): Pfam Name: DUF617; Pfam Description: Protein of unknown function, DUF617
  misc_feature (80)..(245): Pfam Name: DUF617; Pfam Description: Protein of unknown function, DUF617
  misc_feature: Utility: Useful for making plants with increased biomass and foliage
  misc_feature: Utility: Useful for making smaller plants
MTKIDSLRRFLLPCISTPTNPTTVSTTSTGASKKRLSTSLRDDIDVQDSASSSASSSEATSAVDYSISAVTVPQRPSKTMVIGTIFGRRKGHVWFCVQHDRLSVKPILLLELSIATSQLVHEMGSGLVRVALECPTRPELKSCLLRSVPVWTMFCNGRKLGFAVRRSANEETRMMLKRLESMTVGAGVLPSGSGLGGSDESDTDEVMYMRANYEHVVGSSDSESFHLINPDANSAQELSIFLLRTSS

SEQ ID NO: 2328 - DNA, 1649 bp, Arabidopsis thaliana
  misc_feature (1)..(1649): Ceres CLONE ID no. 36334
  misc_feature (1)..(1649): Also known as  Ceres CDNA ID no. 23374338
tccattaatactctctctccctcatcctctcttcttctctcatcatcatcttcttcttcaatggccttcaccgcttttctcctcctcctctcttccatcgccgccggcttcctcctcctactccgccgtacacgttaccgtcggatgggtcttcctccgggaagccttggtctccctctgataggagagacttttcagctgatcggagcttacaaaacagagaaccctgagcctttcatcgacgagagagtagcccggtacggttcggttttcatgacgcatctttttggtgaaccgacgattttctcagctgacccggaaacgaaccggtttgttcttcagaacgaagggaagctttttgagtgttcttatcctgcttccatttgtaaccttttggggaaacactctctgcttcttatgaaaggttctttgcataaacgtatgcactctctcaccatgagctttgctaattcttcaatcattaaagaccatctcatgcttgatattgaccggttagtccggtttaatcttgattcttggtcctctcgtgttctcctcatggaagaagccaaaaagataacgtttgagctaacggtgaagcagttgatgagctttgatccaggggaatggagtgagagtttaaggaaagagtatcttcttgtcatcgaaggcttcttctctcttcctctccctctcttctccaccacttaccgcaaagccatccaagcgcggaggaaggtggcggaggcgttgacggtggtggtgatgaaaaggagggaggaggaggaagaaggagcggagagaaagaaagatatgcttgcggcgttgcttgcggcggatgatggattttccgatgaagagattgttgacttcttggtggctttacttgtcgccggttatgaaacaacctccacgatcatgactctcgccgtcaaatttctcaccgagactcctttagctcttgctcaactcaaggaagagcatgaaaagattagggcaatgaagagtgattcgtatagtcttgaatggagtgattacaagtcaatgccattcacacaatgtgtggttaatgagacgctacgagtggctaacatcatcggcggtgttttcagacgtgcaatgacggatgttgagatcaaaggttataaaattccaaaagggtggaaagtattctcatcgtttagagcggttcatttagacccaaaccacttcaaagatgctcgcactttcaacccttggagatggcagagcaactcggtaacgacaggcccttctaatgtgttcacaccgtttggtggagggccaaggctatgtcccggttacgagctggctagggttgcactctctgttttccttcaccgcctagtgacaggcttcagttgggttcctgcagagcaagacaagctggttttctttccaactacaagaacgcagaaacggtacccgatcttcgtgaagcgccgtgattttgctacttgaagaagaagagacccatctgattttatttatagaacaacagtatttttcaggattaatttcttcttctttttttgcctccttgtgggtctagtgtttgacaataaaagttatcattactctataaagccttagcttctgtgtacataaaaaaaaaaaaacttttgtttacc

SEQ ID NO: 2329 - protein, 472 aa, Arabidopsis thaliana
  misc_feature (205)..(467): Pfam Name: p450; Pfam Description: Cytochrome P450
  misc_feature: Utility: Useful for making plants with increased biomass and foliage
  misc_feature: Utility: Useful for making smaller plants
MAFTAFLLLLSSIAAGFLLLLRRTRYRRMGLPPGSLGLPLIGETFQLIGAYKTENPEPFIDERVARYGSVFMTHLFGEPTIFSADPETNRFVLQNEGKLFECSYPASICNLLGKHSLLLMKGSLHKRMHSLTMSFANSSIIKDHLMLDIDRLVRFNLDSWSSRVLLMEEAKKITFELTVKQLMSFDPGEWSESLRKEYLLVIEGFFSLPLPLFSTTYRKAIQARRKVAEALTVVVMKRREEEEEGAERKKDMLAALLAADDGFSDEEIVDFLVALLVAGYETTSTIMTLAVKFLTETPLALAQLKEEHEKIRAMKSDSYSLEWSDYKSMPFTQCVVNETLRVANIIGGVFRRAMTDVEIKGYKIPKGWKVFSSFRAVHLDPNHFKDARTFNPWRWQSNSVTTGPSNVFTPFGGGPRLCPGYELARVALSVFLHRLVTGFSWVPAEQDKLVFFPTTRTQKRYPIFVKRRDFAT

SEQ ID NO: 2330 - protein, 479 aa, Glycine max
  misc_feature (1)..(479): Ceres CLONE ID no. 690176
  misc_feature: Utility: Useful for making plants with increased biomass and foliage
  misc_feature: Utility: Useful for making smaller plants
MASFIFTPVLFLLIISAVLLFLHRRSRCRRFRLPPGTLGLPFVGETLQLISAYKSDNPEPFMDQRVKRYGPIFTTHVFGEPTVFSTDPETNRFILLNEGKLFECSYPGSISNLLGKHSLLLMKGSLHKRMHSLTMSFANSSIIKDHLLVDIDRLIRLNLDSWSDRVLLMEEAKKITFELTVKQLMSFDPGEWTETLRKEYVLVIEGFFSVPLPLFSSTYRRAIKARTKVAEALTLVVRDRRKESVTEEKKNDMLGALLASGYHFSDEEIVDFMLALLVAGYETTSTIMTLAIKFLTETPLALAQLKEEHDQIRAKKSCPEAPLEWTDYKSMAFTQCVVNETLRVANIIGAIFRRAMTDINIKGYTIPKGWRVVASFRAVHLNPDHFKDARTFNPWRWQSNSEASSPGNVYTPFGGGPRLCPGYELARVVLSVFLHRIVTRYSWFPAEEDKLVFFPTTRTQKRYPIIVKRREESKLSKSP

SEQ ID NO: 2331 - protein, 472 aa, Glycine max
  misc_feature (1)..(472): Ceres CLONE ID no. 574698
  misc_feature: Utility: Useful for making plants with increased biomass and foliage
  misc_feature: Utility: Useful for making smaller plants
MASLPALPTLLLSFAAIFFTVLLLFLRRRQLRLPPGSYGLPLIGETLQLISAYKSDNPEPFIDERVERYGSIFTTHVFGEATVFSADPEVNRFILQNEGRLLDCSYPGSISNLLGKHSLLLMKGGLHKRMHSLTMSLANSSIIKDHLLHHIDRLVCLNLDAWSNRVFLMDQAKKITFELTVKQLMSFDPDEWTENLRKEYVLVIEGFFTLPFPLFSTTYRRAIKARTKVAEALTLVVRQRRKEYDEDKEKKNDMLGALLASGDHFSDEEIVDFLLALLVAGYETTSTIMTLAIKFLTETPLALAQLKEEHDQIRARSDPGTPLEWTDYKSMAFTQCVVNETLRVANIIGGIFRRARTDIDIKGYTIPKGWKVFASFRAVHLNPEHYKDARSFNPWRWQSNSSEATNPGNVYTPFGGGPRLCPGYKLARVVLSVFLHRIVTRFSWVPAEEDKLVFFPTTRTQKRYPIIVQRRD

(The sequence listing continues in the following parts.)

What is claimed is:

1. A method of introducing an isolated nucleic acid into a plant, plant cell, plant material or seed of a plant comprising:

a) providing an isolated nucleic acid molecule which codes for the amino acid sequence set forth in SEQ ID NO: 747;

b) contacting said isolated nucleic acid with said plant, plant cell, plant material or seed of a plant under conditions that permit insertion of said nucleic acid into said host cell and c) obtaining a plant with increased biomass when compared to a non-transformed plant of the same species cultivated under the same conditions when said nucleic acid molecule is overexpressed.

2. A method of transforming a plant, plant cell, plant material or seed of a plant which comprises contacting said plant, plant cell, plant material or seed of a plant with a vector construct comprising (a) a first nucleic acid molecule having a regulatory sequence that causes transcription in a plant; and (b) a second nucleic acid molecule which is operably linked to said first nucleic acid molecule, wherein said second nucleic acid has a sequence that encodes the amino acid sequence set forth in SEQ ID NO: 747 and wherein said first and second nucleic acid molecules are heterologous to any element in said vector construct, to obtain a transformed plant, plant cell, plant material or seed of a plant wherein overexpression of said second nucleic acid molecule in said transformed plant, plant cell, plant material or seed of a plant causes said transformed plant or plant resuitina from said transformed plant cell, plant material or seed of a plant to possess increased biomass as compared to a non-transformed plant of the same species cultivated under the same conditions.

3. A method for increasing plant biomass comprising transforming a plant, plant cell, plant material or seed of a plant with the nucleic acid molecule that encodes the amino acid sequence set forth in SEQ ID NO: 747, wherein the overexpression of said nucleic acid molecule confers increased biomass on said transformed plant or plant resulting from said transformed plant cell, plant material or seed of a plant when compared to a non-transformed plant of the same species cultivated under the same conditions.

4. A plant obtained from the method of claim 3, wherein said plant has increased biomass as compared to a non-transformed plant of the same species cultivated under the same conditions.

* * * * *